United States Patent 10,407,724 (METHODS AND COMPOSITIONS FOR SCREENING AND TREATING DEVELOPMENTAL DISORDERS) - sequence listing, part 92

SEQ ID NO: 2657 - DNA, 176028 bp, Homo sapiens
gagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcaggtgagtcggatgcagcgccgcgtcctcgctcccgcggcggcccggaccaggcctgggccgtgatgactagttctggggtctgctcctggccttcccctccccagctctcctctttctcaggctcctgtgccccgcgggcccctcctggctcccttggctgtcttctgcttgcttagactacttgcagagttttaaggtacgaaatacactgctcgctcaatcctgggaatctaagctcagcttagggtgtaggagaaaactgccttaagtctctggggcttgtgccctttaagccattccgtgttcatggagccagtcagtcgccctgctgcctcctcagtcacacgctgtcctccttggttcgccccttgtaagtgtttttaaaataaagtttttcgctcggtttgaatattggccctgtgctaaggatgcagagcattctgttaacatgtttgggcagaggatggaaaggggtgtagggacacaatttcagaaggctttttgcactgcggaatcgtacctccccagttacgattaagatagtaatcgtatctggatttggcctatttcatacaattacaaagcccctttaaaaggaattctcgctaaactgttctggagtcctaacgagtagcaagaactattgcttctgtaaaatgataactcatcatgttaaaatcagatttttttttttttttcacaaggacgtttgtaggaaaaagtatacccgtaaagagtgaaccaaacacatggaacttgtagtcggaggatttttaaaatggaggacgaaggtcaggttgaggaaatagggaaaattatctgcagggaagttttgctccccccccccttttttttttctttttcaacctattttgtttccttctttgctttatttttcgtctcttggccttttttccctttaaaccgagtgattacttatgatatgcttgtggtcctaccctgagatgattatttattttgatgttttataatcgaatgtgcacttcctaagcattttattgaattttggggtggttaggcattgcctgcagactgggctcaggtaagatacactaataatgttactccatgttctttgtttatttagaaacatttaaacaacctagtaggaaagacatatgttaaccttttgggtttatgttaacattaagagaaaacatcttagcagtggatatgtatgtgaaatctttggacgatgtggagcaacattataattctgtttcacagtcacctgtttctctgaaaaaggaagtgaaatgttcagctgggtgtgatggctcacgcctgtaatcccagcattttgggaggccgaggcgagtggatcacaaggtcaggagtttgagaccagcctgaccaacacggtgaaaccccgtctgtactaaaaatacaaaaattagctgggcgtggtggcgcgcccctgtagtcccagaggctgaggcaagagaatcgcttgaacccaggaggcggagtttgcagtgagccgagatcatgccactgcactccatccagcctgggtgacagagcgagactcatctcaaaaaaaaaaaaaaaaaaaaaacagaaagtgaagtattcaacttggttataattaagattatgatttcccaattgacttgcccacattcttcattgttagttttggaaaacctgtttgaagacttttgactacaaaagactacaagatttttatacaagataaaaattagggaattgtatcaagataaaatttgtaattggtaagcaaagactaatgttaataacttgttgttttcttttcttttctttttttttttgagacagggtctcactttgtcacccaggctggagggcagtggtgtggtggtgtgatcatagccaactgcagcctcgaactcttgggttcaagtgatcctcccatgtgagcctcctgagtagctgggactacaggtgtgcatcaccacaccagctcattttttttgttttttgtagagacaaggcctcactctgtttcagaggctggtctggaagacctgagatcaagcaatcctcctgcttcagcctcccaaagtgctgggattacatgtgtgagccaccatgcctggatgtgtttttttttgtttttttttttttttctctttaaaattgaccatattggttgattattcaaatgataagtccaagtcatctacatatgagtgtacagtaaaaggcaagtgatgtaacaccataagtaacatttgtgttgaaaagatttggccccagaggaaggataattgataaattaagggaagtatttgtgtaagatttagatatgaaatttgaactggaacactggaacagcagaggatcatagtatcataattgaagtgaaatgctgacaggttcaatttaccctgggttttggattttttttttttaaatgcttaagcagaagaagtgatcttaaaagaaaatactccctttatcttcaaattctgggactcttcaaaaacaaaattaagagcagctcatcttaaacaggttcttcacatgagttggaggggtgaactgaaataatttgaaaaacaaactagcagagatgacacttgaataattagagttgtgattaaaaatattgttccaccaaagttatgattttagaattgttgtatgtaaatagtactagtaagttttttccctacgaaattactatcttaatctcaagagtctctgttcttatgcagcctttgaatctactttctagtactaatatttaatattttcctctttaaaaccaattatatattttaagtattttattagtatatgttgaattgatactatatttttattcttgttattcttagtctcttcatgtgagtatcttcatgtgagtatgtttaatctgtctgcctcagattttaggatctgaggggcagaaagcgtggattctcactttttgtcttttctcacaaattggctcttctaaatttaagaacaaaaactttgaaaaacttgaaatacaggtatgcttcacaatcagtaaaatattctagataacagtttccttagtgttgttaggctttcaagactgtccattacttggctggcccacactctaatttatctccatctcctggtcaagagctgggccatctctttctcctagttctcaccagtaacattcccactcaggtgaatcccctgtgttccctatacccctagaaggtgggtttagccaatttagtaagtaagacttctttgtcattgttacccgaatacttcctgtatttcttaggagaacaaaaggagatcctgtgaatgtggagtttcaggtgtttgaaggtcagtgtagcaagtaatcaaaaaaagattgataacaaaggtggtcagtttgtattaaataaaggaaagaacagtcactgctatagagcaataaaaaatgtgatctgtagaatgtggtttgaccataaatacattttgcaagtatttgagtagtttccattgctggagttcatctaaaatgattgctattgaaataaagtggagatgatagatgcaaaggcaaggtaagtagacttccaatgtcaagatattttataactttaaacataagacagcactctgagcacttatttttagtttttaatgaagaggatattgttacacgcagtgaagaataaatgatccactaatcagttagtgagttagattttttaaaacaactttagtgggatataattaatataccatacaatttgcccatttaaagtgtacaattcaaggtttttacttatgttcacagggttgtgcaaccatcatcaaatctaatttcagaacattttcatcttccttaaaagaaatgctgtacccattaggcccttcactccctgacccccacccgctccagccctagtcaactaccaatctactttctgtctacgtaggtttgcctgttctggatatttcatataaatggaatcatacaataggtgttcttttttgttagtggctctttgatttttgcataatgttttcaagtttcatctatgaaatctgtacttcattttgtttgtattgctgaataatattctgttttgtggagtgaggtcagatttcacaaaaaaagtcttcaaccctttgttctaccctctggatgtttacattagcaaatctctaagatgtagcttctggttgctgatggaactcgtttggctttgcagtattccaaggttctcctaattcagtagatagtgaggacttaaaaatggcatggaatggtgtggttctcctctggaaaaaccattcatgaaaacatgcatcaaaggattctcaaaatcacaggtataatcacaatttctgttttcacattggttaactgcacagggttaacctcaaatgactgaagaatacttgtgtaactagagcttattaatagtaggtgtctttctttaacaagagtttgtgatatcacatgatttgaagaattatatatgaaatgttagttatttaaattgacaacccagaagaaatattaataactatcatttattgaatgggtgcttgaaatgtgccaggaacttgagattatttttaacctctttgagctgtgctccgttgtccccagtggacagaggaagaatcagagggtttagtaaattgctttcattatctatggtttcatagctattaaattgcagagtcaggatttgaaaccaagtcatccgttctgcaacattcgtacactgtatgttggtgatgggcctacagactggatgagtactcgggagtagatttctttatacctacaaactttattaaaagctttttgattgaagacacactttcactttttaaaatttaaatttttgttttatttttaagaacaatctcagaccaaaaaaaggcacagtttcaaatttgcacattcatgatttttctggaaggattgcagaatagttggcacattttgggatcaagtagcttgggattttcttcagatttgcaaccataaatcttgtcgtatgagaaaatactggaaagttactaaggtgcttaacaaagcaaagggtttgacagtcatcagaatggtgggatttgacttcgaatgctattttctgtttatcgctctggcattcttgaatggatttagtgactccctggaggtccagcttggtaaatgtcatatgcttgctgttgacattctagtattggggtatagatacctgttcttactggcgagccaatgttgatcgcagtagtcattacatgggttatgtttttcgcagaggcagggaaggtgagggaaggcagagaaacaaacttagtcataaatgtttttgaatatttgtttattctgccctttggctcccgaaagggagtacgtgtgcctaaatggaaaaagttctgcagattaaagttggcagggcaactttcaagtactagtgctggagtctacataagaggaaacagatgcaactgaagattggacctaaaagcatacctttatttgatttggaggaaaaaccaaagagggaggtttcctgggattacagatcctgagtttacattccctgaatatctttttccctcactcccctcccgactagcccccattgctcccaccctgtttttttttttttttttcctgttctttctttctgtgcaacactaactttcctatttagaggtcaaacttgaacttggagacccaaacctagacttgaattctagcttccctacagatttcataggcttattgtgaagggtaaatgagaatacttattctctgtaaaacagatagtacataagtgcttgataacttgttattattatagtattattagccttagtagcactgtgctctgattacctgagctaattgccagggtagggtttagaagaaagagttgatatctgggtgactacattgtcagataactgagattaccattgctacttgcaactgagagtgttgagctttaaaactaattttttgttgttgttggttttggttggttgaattgaggataatttatttctttcagtttcagaaaaatttgtcagatttacataacaaaatttataagtttagaatgcatgggtaaacggatttgaatagatcagtttcagtgccattaaaagctatttgtagataaggataagttaaatgtatattttaaaaacagtgcatcctttatttcatttcccttcttgtcactcttagcaaaacaacatgtagcaattcatatgcatgtcatctgggatggattgagattaaggttagggaggcagggtgagcaaagccctcactgggcttggtggagagtatgacataacactattcatttgcccatttatccaccacaaatactgttgagtgctaactatagaccttataatagtccaatgggatgacaaacagtaacaaaatgaataaactgtgctatggtaagtggtgagaacaggaagtatttggtcctatgagaatttgtgagggaaagttctagagctgtgctggggaagcagtgcctcagctgagatctggcggttgagtgtaagtgagcaagctggagtgacaggaagggcagagggaagaatgttcttggcagaaggaaaagcagttgctaaattcctagggcaggaaagggcagggccctcatgaaacgagggctgagtgacgagccaggaaagctcagatatgagtgccatggaactggagaggcaagaagggcaatgagcagggccttcagcctttatcctggagcagtggaaagcagttgaggtgattttaagcagaagggtaacactgttgtgtttgcaactgtaagccgaatttcttgtttctatgacttccctagagttattgccggccctctttgggaaaacattgttacacagagatagatcagtctaggtattcagataaactcagttaaaattgccttttttaaaatgtcaattggctgggcgcagtggctcatgcctgtaattccaacactttgggaggctgaagtgggcggatcacttgaggccaggagtttcagaccagcctggccaacatggcaaaaccacatctctactaaaaatacaaaaattagccaagtgtggtggtatgcacctgtagtccccgctactcgggaggctgaggcaccagaatagcttgaacccaggaggcggaggttgcagtgagccgagattgcaccactgcgctccagagtgggcaactgagcaacactctgtctcaaaaaaaaaaaaaatttaatgaatacaataaaatgggaatttatgctttttgtaagggatgctacttttgtgcacttcttagttatcatctctcagagaccatttctgtctgggggaaaagtctgatcactgtggtatgggaagttcttctcttacagggactgagtgatggggttattgaaacactgaaactaggttattgcgttgtcatggtaactccataataccatggtgtggtagttgagaagcttgccacaaatctgtatcagaaagaacgctttgttttatttgtcgatttttgtctacaaaacaatgcgtttgccctatctctaactggcaattccaggaaaactatccagtttctggaaagttatctttgccaccatttagtgaagttatttccatttaaataacctagtcattgtggaagagaggaagggctagacagtttaagaacttgaacaattggtgcctctcaagagtattacattgggaaacagtatagctaacaaacagattggctttggagtcagtgggcaagctgtgctgttactaagctggttgaccttaggcaaaaatagttaacctctgagcataacttctttcattttttagggggatgatacttttcgggattattatgacaattaaatgagatgtaaatgaggttctagtatagtccttactgtatttttatgaatattaagtaacatatatttaagagcatcatttgtttgtatagattactcttattggatgaaaagggattgttgaaactaagaaataattgtagttcactcagcaggtatacacttgaaaatctaaaattatgaacagaccaattaggagatgactagtgctactgcagaagaattccttgcttgggtaaaagatttactaagcagttcctttatatatagatccccttagtgagtaaatctaagataggaaggacttcaaaaaatttggttatttataatttttcaattacatttgtaaaaaccttagagttatctttaagtcttcaccacatgcagccttttaggaaatcccgttgactctgaacttcaaaatatccagaatctagtgagttctaagccaccacagactcttgtctctctaataacaagtttcttatctctctgcttccaccttggctctcctgcagttgattctcacacagcagccacagtgatccttgacaagctttggtcagattatgtgatgctctgcctagatctctctagtggtttctcacccactcagattaaaactcagtatttgtctcgtggctttgaataaggctttattttattttattctattttatatttatgtttatttttattttttgaagctgggtcctgctctgtcacccaggctggagggctgtggtgtgatctcagctcactgcagcctctgcctctcaggttcaagtgattctcctgcctcagccccccaagtagctgggactacaggcgagtgccaccacaccctgataatttttttgtatttttattagagacggggtttcaccatactgaccaggctggttttgaactcctgacctcaggtgatccacctgcctcagcctcccaaagtgctgggattacaggtgtgagccaccgcacccggcctgaacaaggctttaaaccacctgcttcctgcttccattgacctctgacctcatctccactactcttactccgttccacccacatacacctcttgctgttccttgaacaaccttggcattgttgctttggggcctttgctttttcctcttcacggaatgctcttcccccagatatccatgtgactgacccttcttactctccttcaagtctttgcagaaatatcaccttttcaatggaaccgcccctcctacctataaactcacagtcgtttctccctcactcccactcctatccattaccctgccccacttttcctttttgtcatagcacttgtcaccatctcccctactgtatactttgctcatttatgatgtttctgttagaatgtgagcactgtaaggcaaggatctttgtcttttaatctcaagcacctagaacaatgtctgtacacagtaagtgccaatgtacctttgttgaattaatggaaatatctgttaagtaaggtattcatacatatatatatatatatatatatatatatatatatatatatatatttttttttttttttttctgagacagggtctcactatattgcccaggctggcctcaaactcctgggctcaagcaatcctcctgccttagcctcctgagttgctgggactataggcatgtgtcccagctgtgtctggcttccagtctttttaatattaagggataatgatttttgtgaattatcttctctttttacattctcttatcagctacaaatctaacaaatattagcggtttcccaacctctaagaatgaaattatttaatctaaaaatatagagtaacctcaggacgaagttctcctaatacagactctggaactagattacctacttttgaatcccagctcagctagttacagtgttatcaccttaacttctgtgtgcctcagtttcctcatctgtaaaattgggataattatagattggaaatactgattaaatggggctaactgatttaatgtgtgtggaatacttagactactgagaacactacctgacatttcaatgttaaatactatagaaatgatagcagatattatctgatgggatgattctgattttatccacatgcatcttttcccgactttccctcaaatttctaaagacactgcatattcccttctagatgattatcaaagtcgtcaattttagtatgtctaaaatttagcttttctactctccccagcgtgttctggacttccttatttttgctaattatgtcatcgtcttgctagtcatgaagctccaaatcagagatggcaaattctgatgcctcaggcaggtcaagtaaaatgagtgaagtggaccaggtgtaatgcatgtcaagacactgtccaggtaaccaggcatggtctctagtagcagccttcagcaacactggcacagtcctctcagattttcaccagcagcccaaatctagattttcatatagaaagtttcttaattgtttagagttgatgcaaatttctcaggtttactctgtggaccaaataaattatgtcagtggctagatgcatcaagtagccagtttgctccctcatctctaagtcttagaatcatgctttcctttgcacatctagacaggaaattgccaaatcttgctgaatctaccactacagtctctctcgcatccataccttcctctatgttctcctaatatattgcctccctaccaaatcttacactcactctggcgcaagtttaatctaccagtgaagcctccaatcaagttaccccttccttataccttacacatacaggtcagaagtttcataatgtctatgcaaacatcaggctccttggcccttttgatcttggccttgtgtctgtttctgatgtcacctcctttgcacccttccttggatgcatcctggatgacgtcctgtgtcccagacatgcctgtgctttcctgcttcttgcagcctccagggccttgcttgtgcagaggcatttagtaggttttggtggttgttgcatgttggcctcactctgcctgaggtgctctttctcatattccacactcttcctcactcttcctgtttgtgaaattctactcatgttccagagtgtcaattgtgactttttgcattgagagctttctagatgatagtgactgtgcacttttggaactctaatagtatttcttgtattcattctggtgggctttttcacagtttaccttattagtcgtgtgtatgtatatgtgtgcatgtatcacttcatttgctcaaaagtgtatttgcactataatatttcatgagtgaatacttttttccttgaggttctggtgtatttcaattggggggtcagatgttttgctttagttttctattttttgttctactttgcaaaataatttgtgaactgttttttctccttcttctgaaacctcaagtgctatacatctaaaaatgctagattgaaaataaaccaaggctggttagacaaagctggttacagagttatgatagcagggctgtcatactagttttgaaaatgtatagtgcactgagatcaaaaagatgtccttgaatagtattggtaacaggctaacctttcttcatctgtggtatcaggaaattacagggagttacagggaactgaacactctgccatatttaataaacattaaatataaatttggtagtatatttattattctttcccaaatctttacaaaattgttgtgagtagattttcctttagtaagaaagatttctccaattaaagttttagtaacaccttgctaattggtaaggcttattggtaagactaattcgtgaaaaattaaattctagagtgtgttgaccaaaatgtagtttttaattttgaaattgtgataaaataagtccataccttctggaactaccattctttttgaattgttgaagactctggaccaaattccctggaaaatctctttgatagtaaatacattgaatagtaagcatatagaaccagaaactgctataaagttaaccatagagcattgagtatatagtttatttgcttcatggaaataaatgaatactacagttggttgacaatttttacacaagtttagtcagccattttgtgaaaaaacttgagaaaatgaaaaaaatcaggaggcagaagagaatcatgatagaatagcagaactggaagggatgttagcaacctcttcacttcaattattagggaaatacatgctggaaaaggtaatgacttgcccaagattatgcatccagttagagaatggccaggccagacagttcagtggcaaagggcagaagtggtggatgcatctgtggtagattgattaaaagcaacgataggagcgatgagcagcaggctctgacagcaaagtggaagagatttgtctgggttgaattagaggaaagtggtgaggaggaaaagcagaggtgatttagtgatagtgatgaggatgctggcagaactggacatcatcacacattcctgaaactggtatgaggcaagaaacagtcctctctatacaagagcctaaactcttaaagaaatgatatgtacctttttagcccttaaggatgccattatgccatgctcttggtacaccctacatagatgttaagaccaggaggcacttgttcattgtatatagtggtgcaagctaagttagttgatccaatatctcctacccagagtctcagctgtgcttatatcccaaactactgattatgttgatgacacttaattcccaaggaaatactgcatttagtatatgttcctcaaggtggccaaaaaagaatatagtattttttagaaatttaaataccagtgtaaaaaaatcctttaatattcctagtctggagaaaacttcttcagattgattttactgtaatgactggcattaactgctcataaccaagctaacttccagtaggaatattgtcagctttgctttactgatagctgagactctagtcctgtagaagcagtactcatacagtagacaggttcccctgatcttgcacatccaatcttataattttgccgtggaacaggaagctactgcttatctgtgtgttccaatgcctatcactgtctgtcatgtgtaaggaggcgatgatctccttacagataacgtgaaaacaaaagccacattgggctagacaacaacattcacacattctgaattagagcaggctgatttaataaaatgttactgtaatggtgacattttaatttacagagcccttttcaagtattcttgaattatttccataacaaccctatgaggcaggttagggttggttttgttatttccatgtaatataccaagaccagatggagatgcagtgactggtataagggttacacagatagtaagtagcagaagaaattgaatctaggttttctgactctaggctccatgttctttctaatttactgccaaagctgctaaataagggtgattttaaggccatttggaatacttgcacatgagcttacaagttggagaatttctcaaatgttgcttcaaagtgaaaggttggccaggtgtggtggctcatgcctgtaatcccagtactttgggaagctgaggtgggaggattgcttgagcccaggagttccagatcagccagggcaaaaaaaaagaaaaaagaaaaaaaatgagccaggcatggtggtacatgcctgtagtcccagttactcagatggctgaggtgggaggattgtttgagccccggagattgagggtgcagtgagccatgattgcaccactgcacttcagcctgggtaacagagcatgaccctgtctcaaaaaagaaacataaaagttaaaggtctgtttatatcatggcagtattcaaattcatctggatcatatgaatcagtccagtgtgctcattaacgttacattctagggctttactacagacctacagaaaaaaaatctgtaagaaaagagcatgggaccatgtatttttaacaaataagatgattcttaaggtcatgcattttgggggccaggcacggtggctgacacctgtaaccctagcactttgggtggctgaggtgggcagatcacttgaggtcaagaagctctagaccagcctggcctggtctagtagagatggtgaaaccccatctctactgaaaatacaaaaattagccccaagtggtggcatatgtctgtaatcccagccatttgggaggccgaggcaggagaattgcttgagcctgggagacagagtgagactctgtctcaaaagatcatgcattttgggaaacactggactagccctagaaaaaacagtggattatccatgcaggctttttaaccaaatatcttctgaataccagggcttggtttataatagtgagccaccgtgtccggcccagatgggtttttaaaaattatctttattggccgggcgtggtggctcgtacatgtaatcccagcattttcggaggccgaggcaggtggatcacttgaggtcaggagtttgagaccagcctgaccaacacggtgaaaaccggtctctactaaaaatacaaaattagctgggcgtggtggtgcacgcctgtaatcccagctacttgggaggctgaggcaggagaatcacttgaacctgggaggcagaggttgcaatgaattgagattgcaccattgcactctcgcctgggcaacaagagcaaaacttcgtctcaaaaaaaaatctttattatgaaattaatataaatgatatcttttaatgatgattcttaaagaggcaatagactgaagaggatgttctaattagtcttcttcttcttcttcttctttttaagccttttaaatgatgaggaaggaggaaaatgggcttaggttctaccagaagaaatttagattttagttggccatctggatgacctttgtagtaattaaacagtcagattgggtcattccttcagcagataaataaataaatacatatatttctaacttttattttaagttcaggggtgcaagtgaacgtttgttacataggtaaatttgtgtcatggaattttgttttacatattatttcatcaccgaggtattaagcctagtacccattatttttcctgatcctctccctcctcccaccttccaccctccgaaaggcccatgtgtatgttgtttccctctatgtgtccatgttctcatcatctattatagttcccacttataagtgagaacatgtggtatttggttttctgttcctgtattagtttgttaaagataatggcctctagttccatccatgttcctgcaaaggacatgatcttgttcttttttatggagcagataaatattcattgtgtggtgattatatgctaggccctgtgctgggtatgagaatatagtgatgagcaagaaagccatggtctcaaagttctgatatccggaatctacaagcaagttaaacaaatttataagaaaaaaaatcatcaaaaagtgggcaaaggatatgaacagacacttctcaaaaagacatttatgtggccaagaaacatatgaaaaaagcgcaacatcactgatctttagagaaatgcaaatcaaaaccacagtggaatatcatctcatgccagccagaatggcgattattaaaaagtcaagaaacgatagatgctggtgaggctgtggagaaataggaacacttttacactgttagtgggactctaaattagttcaaccattgtggaagacagtgtggcagttcctcaaggatctagaaccagaaataccatgtgagcaatcccattactaggtatatacccaaaggaatataaatcattctactataaagacacatggacacatatgttgaatgcagcactatttacaatagcgaagacatggaaccaactcaaatgcccatcagtgacagactggataaagaaaatgtggtacatacacaccatggaatactatgcaaccaaaaaaggaatgagatcatgtcctttacagggacatggatgaaactggaagtcatcatcctcagcaaactaacataggaacagaggaccaaacaccacatgttctcacccataagtgagagttgaacaatgagaacacgtggacacagagaggggaacaacacacaccaggacttgttgcggggggtgggaggcaagggggaggggaagcattaggacaaatagctaatgcatatgtggcttaaaacctagatgatgtgttgataggtacagcaaactaccatggcacatgtatacttatgtaagaaactttcacattctgcacacatatcccagaacttgaaataaaacaaacaaacaaaaagaaagccatggtctctatctctgctggtctggcagaagacacagacattatataagcagatccaaaaagtgttacaggagccggctatgggggcactaacctggttcaggggcttaaggaaggttttctggaagaagcaacatttaatccaagatgtggaagaaaagtagaagatgatgatgttcataatggtaataagatgtaatgtttattaaaaagcttaccatgtaccaggtacttttctaaatatcttaattgactcatttaatctgcacataatgtaataaggtagatcctattaatatctctgttttagtaaaagagagctaaaatatagagaggtcaagcagtttacccaaagtcacatagtaagtggaggagcacctgggctttgaactgaagtctgtctcctcaatttcctctcttagccactatgctaaacggcattgataaattagagatgggcaggtgaggggtgttggaggacaggggactatttcaagcagtgagaacaccttgggtgaagaccttgaggaaactgagaccatttcaggaagtttttctaaaagaaggttgagagagctggggctgagaatcctgagaggagagaggcaatagataagactagagaaatgtaggcagggggccagatcccacaggcccttgagtctacagtaagagtttgtttatcctaaggacagtgggaagtcgttgaaagattttaagcagtagagtgtcatgatcaagtttgtacttaggacagtttactctggcattttggagaatggatgtggaggtagcaactcaggaggttgggagaccagcaggagactggtgatggtaaaccaggcattgggtggtggtggcttggattaaggaaactgagacagggactgggagagggagtcagacaagaaagagataggaggtaaagttatgggcccttgtcataaacttatgattgtggggctgagggagacagcagagtccaaaaggactgtgaggggtctgagctctgggcactgacataaaacactaagagagatcaggctttgggaagaaaataatgaggttgatttctgacaggttctatgtggatatcaggcagtcttactgtagattcgcaccaagctgagcctaagtcctttggtctagccatcatttaagttgttctaaattagatgctatattttatagtctacagaaaagtgtggtgcctcagcaatgtaatagtttaggaaaaggaaaatgttattttttaataagttgagtgtattccatgtagcacattgtgctatagttgggtcaatccgtttgctattttctctttgggcagaaagtatagtggaaagaacgggtacaggattatcacaggacctgagttcatatctcatcttcccacctttggcacttattagtgtggaatctttgatcagctattctgtttttttccatctatcaaatgtgttcaaaaatccccactttgtctaagatattaagagtctttggaagcgtggtagaaagtacaaagcattatgcacatacaaggcactgggccttttcccctcttcacctttcaattagaaacctagaaatagaattgccgtatgagttgatcagcttgtgtgaggttcacattgcttcaagatttattttggggtctgttgcaactttgttgtgatcaacacctgagtctcttgatgtgattatctaatatatatcaattttagaacatacctaaaacagattttttaaagcaatttttgttaatgtaagcttgtttctaaattaaaagttaaactaatgtaaccactaattgtattttaaagagatgccttaagcttcaactttatttttaacatatacaaaaggtatgtatggttagttactacagtggattaaagatatagttaaattattgctagtgaagtatcatttcaactatggtataattggaagactttcatagcttgacataactgtttaaagtctcattattttattataagcattattataagagattattataagttcctgtcatttctcactcaataccccactgttcccatctcatgctaaaagatatttagagttctttttctttagcttaaggctttttattattctcttttttcattttttcctctggggaagtgagaaaggaatgttctcatttttatttaagctagattctgatgaattatgatgttaatgagataatagtaccttttagatatctgtagcaaaagtatcatctttgaaatgaggaaatattttccagaatatactttgaatcaatttttaaaaaatactaaggagtatatatccaaatcttctagtaattttagctccaaaatatgtatatttgaaaattgtgaattactttttgtttttttcaaattgtttgttaatgttactgcaaatggagacatttatttttctcttctcttgtgttcctattttagtttgggttctcccaaaatcagatgttgagacacattcaagttcagtttatttgaaaggtgatcccaagaaacaccagtagggaggagatagagaagggaattcagccaatttggccagaaatctaataatccgatcaaaaaatgggcagaagatttgaatagacatttctcaggacatacaaatgacaaacaggcatatgaaaaaggtgctcaacatcactgatcatcagagaaatgcaagtcaaaaccacagtgagatatcatcttacccagttatggcttatatctacaggacattatcaagcactgtggcccactggagctttagcccacacaataactctggagctagagcagaactcaagtttcagggttatcttatctgaggggctgggaagtttgggtatttatacaccagtggccttagtcactggatgaaggctgttgatggggaggagcctgagttccctaggacttctagtctaccgtgtacttggcattgctggcttcagccaccagaaaaagtcctaatttatttatttatatatatttttttaatttgtaatttttgtgggtacacagtaggtatatatatttttggggtacatgagatattttgatacaggcatgcaatgagaaataatcacatcatgaagaatgaggtgttcatcccctcaaccttttatcttttgaattacaaacaaaaatgtacaattaagttattattgactacagtcgccacattgtgctgctatcaaatggtaggtcttaatcattctattttttttttaacccattaaccatccgcacctccctcccagccccccactacccttcctagcttctagtaaccatccttctactgtctgtccatgagttcaattgttttgagttttagagcccataagtaagagaacacacaatgtttgtcttctatgcctgacttatttcacttgatacatgatctccagttccatccatgttgttgtaaatgactggaactcattcttttttatggctgaatagaactccattgtgtatatgtaccacattttctttatccattcatctgtcgacggacacttaggttgcttccaaatcttagctattgtaaacagtgctgcagcaaacataagagtgcagatatctcttagatatattgatttcctttattttgagtatatacccagcagtgggattgctggatcaaatggtagctcaatttttagttttctgagaaagctccaaactgttctccatagtggttgtactaatttacattcccaccaacggtgtacaggggttcctttttctccacatctttgccagcatttgttattgcctgtcttttgggatatatgccattttaactgggatgagataatatctcattgtagttttgatttgcatttctctgatgatcagtgatgttgagcaccttttcatatgcctgtttgacatttgtatgtcttcttttgagaaatgtctatacacatattctgcccattttttgatcagattattagattttttcctgtagagttgtttaggctccttatatattctggttattaatcccttatcagatgggtagtttgcagatattttcttccattctgtgggttgtctcttcactttgattgtatcctttgctgtgcagaagctttttaagttgatgtgatcccatttgtccatttttgctttagttgcctgtgcttgtagggtattgctcaagaactttttgcccagactaatgtccttgagattttctctaatgttttcttgtggtagtttcatagtttgaggtcttagacttaagtctttaatacattttgatttgatttttgtatatggcaagagatagggggtctagtttcatttttctacatataactatccagttttcctagcaccatttattcaagagactgtcttcagtatattcttggcacctttgttgaaaatgagttcactgtaggtgtgcagatttgtttctggattctctattgtgttgcattggtcagtgtgtctgcttttatgcccataccatgctgttttagttattatacctctgtagtataatttgatgtcaggtaatgtgattcttccagttttgtcctttttgcttaggatagctttgacttttctgggtcttttgtggttctgtataaattttaggattgttttttctatttctgtgtagaacattattggtattttgatagggattacattgaatttgtagattgctttgggtagtatggacattttaacaatatcaattcttccaatccatgaacatggaatatcttccaattttttggtgtcctctttaatttctttcatcagtgttttatagtttttattatagagatcttttacttctttggttaattcctaggcatttaatttcatgggtagctattataaaggggattactttttaatttctttttcacattgttcactgttggcatatagaaatgctacttattttcgtattttgattttgtgtctgcaactttactgaatttgtctatcagttctaatattaatagttttctcatggagtcctttgctttttccaaatataagattacatcatctccaaacaaggataatttgacttcttcctttccaatttggatgcccattatatctttctctaatccaactgctgtagctaggacttccagtactatgttgaataacagtggtgaaagtcagcatctttgtcatgttccagatcttagaggaaaggttttcagtttttccccgttctgtatgatgctggctgaggggctgttgaggtatgttcctgctatacccagttttttgaaggtttttgtcatgaagggatatttaattttatcaaatgctttttcagcattaattcatttaattcattaaatgaatatgtggtttttatcctttattctgttgatatgatgtatcgcattcattgatttgtgtatgttgaaccatccttgcatcctagggataaatcccacttggtcacggtggatgatctttctaatgcaagcttgtccaatctgcggccaatgggccacatgtggcccaggatggctttgaattgtggcccaacacaaatttctgaactttctaaaacatgagattttttttgcaattttttttcttttttttaagctcatcagctattgttaatgttagtgtattttatgtgtggcccaaggtaattctctttccagtttggcccagggaagccaaaagactggacacctctgttctaatgtatcattgaattctgtctgctagtgttttgtagagaatttttgcatcagtattcatcagagatattggcctgtagttttcctttttttgttgttgttgttttttttgtttgatgtacctctgtctagttttggtatcaaagtaatactggcctcatagaaagtgtttggaagtattccctcctcctctagttttcagaatagtttgagaaggattggtactaggtcatttttaaatatttctaatagtagaatgagaattaaacttctttttttttgagacggagtctcgctctgtcacccaggctggagtgcagtggcgggatcttggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcccgacctcgtgatccgcccgcctcggcctcccaaagtgctgggattacaggtgtgagccaccgcgcccggccaaacttctttaaatattctaatagtagaattcagtagtgaacccatccaatcctgggcttttctttagtgggagactttttattacagcttctgtgtcatttcttgttattggtctgtttaggttttggatttttttctggttctatcttggtaggttgtatgtgtctaggaatttgtccatttcttctagatcttccaatttattggcatatagttactcatagtagccacttatgattcttagaatttctgcagtatcatttgtaatgtttcctttatcattttttatttgtatctttcttttttttcttaattagtctggctaaaggtttattagttttaactttaaaaaaagaacaactttttgtttcattgatcttttgtattttttttccatttccatttcatttatttctgctctgatccttattttttattttcttctgctaattttgggtttggtttgctcttgcttttctagttctttaagatgcattgttagatagtttatttgaagtttttcctcatttttgatgttggcacaaagtccttgggcaaagagatgcatttggaacgtgctccccagtggtatggtcagaggagatatgggcaaggcaccactagcttagctgtaattcccatcacaatatttgcattagatttcattttctttaagcaaagcaacaaagtaagcctgacgaaaaggtagaaaaggacttaattccaggagataattttaaaaatatagtagattagaggcataagttgatgtagttgatgtatactttctttgtgagtaaagtttctgcaacctctcagggtagttgatggattagcctgttttaggtattttcagtaaataaaaatgactgctgactaaatactgaacgaaccttgtaggtttgtgtttgtgataaagtatgaattaatctcttgtttatagtttaattctcatctactgaatgggagatgatttccacatggtctcctcagtacagggtgactgcaacacttggggaagatgtggcagatacagttggttgcttgttgacagaatcccacatttgtataggtactgtgtaatcatatgcttcaggaaaagttgaccaatcttgattagcttaagcttattttgatttctttcctcttgctagtggttggtttaggagcatgcatatcgcagttctggacaatgagatatgagaggagatttgctggagggagagattctgagaaggctttccgagccttaagaagaggtagaagaaagggtgttattatgtgaggatgggatggatacctgtggccaccttgaagaccagacagaataaactggggaaagaaccaacacactgaggatcacagagaagaaagatggaaagcttctgggatcttgatgctatccctgacccactcagtttgcccactctggaagtacctgaatgtttcctgttactttgagataaaaattccattttttaaggatatttctgtcagtttcagctgaaagcgtcctaagctacagattcagtagaaaaggagggaaattttcttgtttcaaatgaaattttataattgatttaaataaagtccaatgggttttgggtgaacttaatttattgctattcatttgaatacagacatggatgaaaggaaaagacttttgtatgggatatggttgcaagtcttactgaataaataaagtctcattcctgattatgctggttattgagttcttgtccatatcaggtagttaaattattttagtgcccaggtttatactttataaaaccaaagagtagaggtatgtgggaattgtcttattaccattattctttgagaactattaacaaatgattcaggaatattggattttcaattaacttgaagtaagtttcttgggatgatctgcttttagttactctaaatatttttagcaagtacctggtaatctgggagactgtggcccaaagtagttcaactgaatttgaaaaggatcaggactggctatgaagtgaggctgagtgggtacatctatatgtggatacgttactgtcctttgtgcatatttctttctaattacgttccaaatccaataagaagtcaattgtattcatcatcctgggggtatcatcttaactctgccatttttccatattaatgtattaagtataaaggttgtgaaatccatttcagatgctcctggtttgggaagtataaggttacagattcaatggcatttaaatttctttttttcctctctcctctttttttttttttttttttttttttgagatagggtcttgctctgtcacccaggctggaatgcagtgacatgctcactgcagtcttcacctccccggctcaaataatccttcccacctcagcctctctagtagctggaactgcaggtgtatgccatctttcccggttaatttttgtattttttgtagagacagggtttcactatattgcctaggctggtagatttctttatttttaaaatagaaatggtggggaaatgtaccatccgggtcactgaaaagctggagcaaagatgtatggaactcagggacatggactctactttgcatccctggtggggtgggggtgtgtccttactgatgtagactttaagaaccatgagagcctgatgtgtgtgtataaatatggctttaaaaaagaagacagagattgtttatctttaatagcagtaatataaggccgaagtctaaaaggactctaggataataagaaatgaatcctcaggctggcatgatggctcatgcctctaatctcagcactttgggaggccgaggtgggcagatcacttgaggtcaggagttcgagaccagcctggccaagatagtgaaaccccgtctctattaaaaatacaaaaattagccgtcatgaggatgcatgcttttaatcccagctactttggaggctgaggtagaagcattgcttgaacctggaaggtggaggctgcagtgagccaagatcacatcactgcactctagcctgggcaacagagtgagactctgtatcaaaacagaaaaaagacctcagtctgtgaagactttggtcatacactattgcttggggtttaagggaagctgcctttttggttgggggtatcctttctgataaaagagattcagtaacttagtcaagctttgctctgtgaatgaaggggtgtgtgtgtgtgtgtgtgtgtgtgtgtgtgttgtggggggtgggtgtgcattcttttcctgccttctggttttataggagaaatactcattgggtcttggaaagacgacacttcctgtgtttaaggtacagtattatgctgactagtaaaataatcttaattctttgataatgggccaaaggcaagtacaagatgaataggaaagctattattacaggttttaattttgaaaattttatgcctctttttctattttttgttatatttttatattactgtcatttctgccccttatttggtactgatgcctcatatcagggatatgacatataccatagatatatcatcaagagtaagatataacatcagagaagttatatcgtctattcttaggttctctccacaccccatagttattcttttatttaactgattcaataaattaattgatcaccactggtatgtcagacgctttgcaatgcctaggggtgtagcagtgaacaaaatgggcaaagtctttgctctcatggagcctgcattttaatgaggaaagatggacaataagcagacatttggtaagtttggtggtgaaacgtactaagaagaaaaataaagtagatgatagaataatagaggaggatagagaggaagtttgtatccctgcttctttgcataggatgatggttagggaagattttctcgatacgttgacatttagactgagacctgaatggaatttctttactccactccaaccatactggcctctttgccattccttgtgtatttacagcacaaactttgtactaatttatccctttgcctagaatactcttctgagagatagtcacaatttaaataagtagggaaaaggattgggagttatcagttgtgttaccaggcaaatggaattccctcttctattagaagtgcagaggatgggtctggcagccattgaattgtgtagaattatggtttctttagtgaatcacttctaaaataacatgcataatttgtttaaatatacatgatgtttaggataatttttttgaagacttaattaatctcacctgttatttttcccgcacttgttactttacaaaaattaaagtggactatctaacaaaaaactaagttgtcttggtcagtttgggctgctgtgacagaatactatagactagatggctgaaacaaaacaaatttattgctaaaaattctggaggctgggaagtccaagatcaaagcttctgatgtcaggtgagggatttttcctggtttgcagatggctgtctttcattgtatcttcacatgcttgtgtctttttttgtaagggcattaatcccattaataattacctcccaaaggccccacccgcagataccatcacattggagatttaagcttcaacgtatgaatttggggggatgcaaacattcagtcccagagcataagttataatattttgtcagttgacctaataaaacatgatatcctgggtaacagcatagaggtaatcacattacttttaacacaaataaaagcttggaaagctttttggtaagctgaagaggaataacagttttattctaatgcaatttttaaaacaacaataggctattgttttacacatctctctgaaaactatacatttattgactttatctagaagggcagtaactatgtatctctttattaatctttctcctaaacatactgaaaatattttgcagtacacccttaggacttattaggtttataaagaaaaggcagctgtgaatgaaatgctgaattgcatcccccattggatcaactctaaaataattatgcaaaaaataagaataaccccatttttgctgaacatataaattttatcattgcaaaagaactgaatagttcaacaccacattctcatggagatgtcttactgggaccgcagtagttgggtgtactattgttgaaaaagataatttctatttgtatgtaggttactctgtgcctaaaatggatcatttctaccatcgtattttatcttccttgttttccacctcatcttttatttatacttcatagatcatgatatttggagcatatttggctattagccaattagtgcttatcttttataatggttttcaaggataacagagataaattaaattccaaaatattactgaaacatcattcccaatagcaactataaccttcttctcgcccgtgctttttctggaactatagaacagaccaaatgagatttcaccttttttttgtttttaagctaactgtgccctccagtggagaaaacacagggcagtgaaatagctcaggtaagaagcagcagagaggagaggatgtaacacagccaggtaaagttcaagctgcgtagctgttttctacataaaagaaagaaattgttttcacccctcataagcaagacttttttttttcttttttttgagacagagccttgccctgtcgcccaggctggagtgcagtggcatgatcttggctcactgcaacctctgcctcccaggttcaagtgattctcctgcctcagcctcccgagtagcggggattacaggcgcgcaccaccacacctggctaagttttgtaattttagtagagacagggttttgccatgttggccaggctggttgcaaactcctgacctcaggtgatccgcctgccttggcctcccaaagtgttgggattacaggcgtgagccactgcacctggcccataagcaagactattatgcataagtcctcctcttgatgaatttgttgatgaatcaaagaaggatatattatcatttctctgacttaatgtctttgatgcaatgcttttcagccttttgtcctctctggtaggatgtattcagtttttgacacattaggcaagtgtaacaggaggtgagtaattggatttttttctcccctagaatgaactcaaatgataacttttaattttttaaattttttgaacagatgaaagaaaaccttaaattaagtagatataaacaagaaacattttgctgctacttgtatattcaaatcattcagaaaactatgaattgactatgactcccccttttttgaatagaaaagggagagagttgacctgacctctgtggcttggcctgaacttgatctcttggtgaacactgggcttcatcagtgtgaatggtgactatgtgtgactgagcacctgtgagggttacagaggcacgtgttcagaacatgggctggtatgtgtgcaactctgggctggggaatggagccaggtttaggggatgctagactgcctgtgtttctgcccttccagggagggagaactaggtaactaagttgaagctgaaatgttaaaggaggcttgatggttttgtgttggtggaaattgggagatacgtttccctaaaagaatatagtgggtgatagttgagaaacagtaaacagaggctttctttttcttaactcttataaaaccctgagccaactatccttacaatgagttgtcatttgaagttttctacatactcaagaaatatgtttccttatcttattttaatggagcgtatcttctgcaaacctttttacagttagagtgattcttaaaatttaggcacatacaggacaattagacataaaaagacttgacttacagattttaaagcagggatccttgcatggtagactttcaaaatgatagtatcttttacttgaaccatcttttgcaaagtaacataaatatctcagagacactgccagagcgaactcacttttagaaaaagcaggatatgtaaacttttagtgataaattttgaaattcttgaggggaaatgatatgtgatttaagttccttcaaaataatttatctttattttatttttattttaaataatgaattatgttttaagatctgattcattctgaactataactgactctagagggtgcttaatgagcactgaagacttcctaaagatttatattgaagatgatttttattaaaatgaagtttatttggggttttaatccagtatttgaaaataaaccatattttgccctcccaagagagcctagagcaaaaatacttagttgtcagtattttttcgtttttttgagatggagtcttgctctgttgcccagactggagtacagtggcacgatctcagctcactgcaacctccacctcctgggttcaagtgattctcctgcctcagccttccgaacaggtgggacaacaggtgcatgcgccaccacgcctggctaatttttgtatttttagtagagatagggtttcactatgttggccaggctggtctcgaactcctgacctcaagtgatccacccaccttagcttcccaaagtgctgggattacaggcatgagccaccgtacctggcctagctgtcattctttttaaagtaggtaaataatttaccattgttcttagaaactctttgaaaattccattgaatttgtgggatttctataaactacctttgaatcatgcttttgaaagcttgtttaatatttcaaaagaaaagaacctacttcatgcatataaaatataaatcttagtactggattagtgtatcattttataaatttagttgtttgcacagatatttattttatctttagaaagaagctattcaaaaagcacattctaaagttagattttacagaacatttaggttttagagtaatgtatgcttcttatatttttagcaggtagagtacttttaaaactatggtgtgtttttttgtttgcttggttggttggttttttttttttttttttgagacagggtcttgctctgttgccgaggctagagtgcagtggtacaatcacggcttactgtagcatcagcctcccgggcttaagtgatcctcccacctcagcctcccaagtagctgcagctacacatgtgtactaccacacctgactaatttttatattttgagtagagacgggtttttgccttgttgcccaggttggtctcaaactcctgggcccaattgatttgtacaccttggcctcccaaagtgctaggattacaggcatgagccaccacacccggcctacagtgtgatgtattaatttgaagaaaattttcagacttttcagatgggaaagcttttagaaaattgctgtcttaacccaaacttcaaagatggtgatgataaagatatacattgtaaagcaaaaataaaatttgaagggccccccagccccctgcagccatctgaatggactccctcatcagcaagggcactgtaaaatttaacctgaaagactgactcaggccatgaagtaggggttggacatgcctcattatacccctccagcattaacatcaacacagaccttaagtctgataagaaacatttacaatctattttctctgaagcctgctacttggaggctttgtctgtataataaaaccttggtctcagcctggcgcagtggctcatgcctctaatcccaggactttgggaggcggaggcgggcagatcacgaggtcaggagatcaagaccatcctggccaacatggtgaaaccccgtctctactaaaaatacaaaaattagctgggcatggtggcatgtgcctgtagtcccagctactcaggaggctgaggcaggagaattgcttgaaccagggaggcggaggttgtagtgagctgagatgttgccactgcactccagcctggcgacagagtgagactctgtctcaaaaaatgaagaaacaaccaaaaagcttggtctccacaaccccttatcttaacccagagatttttttttctactgataataactctttcaaccaattgccaatcagaatatgtttaaatctacctatgacctagaagcccctcccctgcactgagttttcctgcccttccagatctaaccaatgtaaatcttacgtgtattgattggtgtatatatcttccctaagatgtataaaagcaagctgtaccccaactatcttggggtacagcttctgaggctgtgtcatgggtgcgtccttaacgttggcaaaattaactttctaaactgactgagacctctctcagattttgagttcacaacgtttacaaaaggtctgtgttatagtgagaaaactttgctaaacaaaatgagttatccttcattggagtattagtcattgcagagaatgaatgttaatgtaaacttttacatgatgtcagcctatgaaaaagtgatgtgtttccatactacccgtttgtttaacatttcttcagaaatatcacactgttttcattactgcaggcagagaatcatattagaaaaattcagtaatttgatgtgaaacctatgttttactcattgaaggcactgttatccaacagaactttttatgataatggaaatattctgtatctacactgtacaatttggtagtcaccagcttttttaaatttttttgttatactttaagttctagggtacatgtgcacaacgtgcaggtttgttgcatatgtatacatgtgccacgttggtgtgctacacccatgaactcgttatttacattaggtatatctcctaatgctatccctccccctccccccaccctacaacaggccccagtgtgtgatgttccccttcctgtgtccaagtgttctcattgttcaattcccacctatgagtgagaacatgtggtgtttggttttttgtctttgcgatagtttgctgagaatgatggtttccagcttcatccatgtccctacaaaggacatgaactcatccttttttatggctgcatagtattccatggtgtatatgtgccacattttcttaatccagtctatcattgttggacatttggcttggttccaagtctttgctattgtgaatagtgctgcagtaaacatacgtgtgcatgtgtctttatagcagcatgatttgtaatcctttgggtatatccagttatgggatagctgggtcaaatggtatttctagttctagatccctgaggaatcgccacactgtcttccacaatggttgaactagtttaccgtcccaccaacagtgtaaaagtgttcctatttctccacatcctctccagcacctgttgtttcctgactttttaatgattgccattctaactggtatgagatggtatctcattgtggttttgatttgcatttctctgatggcttgtgatgatgagcattttttcatgtgcctgttggctgcataaatgtcttcttttgagaagtgtctgttcatatccttcacccacttgttgatggggttgcttttttcttttatatttgttagagttctttgtagattctggacattagccctttgtcagatgagcagattgcaaaagttttctcccattctgtaggttgcctgttcactctgatggtagtttcttttgctgtgcagaagctctttggtttaattagatcccatttgtcaattttggcttttgttgccattgctttttgtgttttagacatgaagtccttgcccatgcctatgtcctgaatggtattgcctaggttttcttctagggtttttatagttttaggtctaacatttaagtctttaatccatcttgaattaatttttgtataagatgtaaggaagggatccagtttcagctttctccatatggctagccagttttcccagcaccatttattaaataggaaatcctttccccatttcttgattttgtcaggtttgtcaaagatcagatagttgtagatgtgtggtattatttctgagggttctgttctgttccattggtctgtatctctgttttggtaccagtatcatgctgttttggttactgtagccttgtagtatagtttgaagtcaggtagcatgatgcctccagctttgttcttttggcttaggattgacttggtgatgcgggctcttttttggttccatatgaactttaaagtagttgtttccaattctgtgaagaaagtcattggtagcttgatggggatggcattgaatctatacattaccttgggcagaatggccattttcatgatattgattcttcctatctatgagcatggaacgttcttccatttgtttgtatcctcttttatttcgttgagcagtggtttgtagttctccttgaagaggtccttcacatcccttgtaagttggattcctaggtattttattctctttgaagcaattgtgaaggggagttcactcatggtttggctctctatttgtctgttattggtgtataagaatgcttgtgatttttgcacattgattttgtatcctgagactttgctgaatttgcttatcagcttaaggagattttgggctgagacgatggggttttctagatacacaatcatgtcatctgcagacagggacaatttgacttcctcttttcctaattgaatactctttatttctttctcctgcttgattgccctcgccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagggctgttgaattttgtcaaatgccttttctgcatctattgagataatcatgtggtttttgtctttggttctgtttatatgctggattacgtttattgatttgggtatgtcgaaccagccttgcatcccagggatgaagcccacttgatcatggtagataagctttttgatgtgctgctggatttggtttgccagtattttattgaggatttttgcatcaatgttcatctgagatattggtctaaaattctctttttttgttgtgtctctgccaggctttggtatcaggatgatgctggcctcataaaatgagttagggaggatttcctctttttctattgattggaatagtttcagaaggaatggtaccagcttctccttgtacctctcgtagaatttggctgtgaatctgtctagtcaccagctattgagagcttggaatgtggccagtgtgactgacgaactgaatttttaattttgtttcattttaattaaaaattaaattaatagcaatgtgtatctagtggctaccctgttggactgcactgattttaagtcctcctgctaggtgataggtgtatctgggattgaattatgactctgatggtgcatatgtgtatctgtttagtcctttgaacttttataatcctgcctgaggtactataacatgcaagcaccttgttttcaaatagccacatttatgtgaaaagaagaggaattgtgttctgaaaactaagttaagtttaggttaaacctgaaacttaacttaatttaaaaaatcctctgactttttaacaaacccgtagattaaattgcatttgccctttggatgtgtctcaaaccctgaaggttttcttctgtgcttttgagttaaaatgcaggtagcatataacaggtgactgcaaaatggagggactgatgaaaacaaaacaaaagcaaccacaaaccagaacttatatctactctgtaggaattttgtttgaaagttggtatgcttttctgaatgtccttaagtataacaagtcttcctactctgagggtaaacttgggtattataaagaggcaatttgtgcttacgtctggtaaataatgataaaatacttgagtaatactttataatttgccaggcagttgcgatttcatcttctccttggaatattaaccccattctaccgacaagagaaccatgatttaatcaaggttctcattcatttcgcaaacccttattgatcacttactattgatcaccttgctattcatgtagatttctatgttaggaatgaaagaatagttcctctcctggaggaattaacaatctagttgggacaattaaacaaagaaacaataaattatactgtactcaacaggatgagattatatattgtattatatattatatatattatacatatatatatatataaaatatatatgtgcataggatgcagtggaagaagaaggagaaacatctggcatggtggtgagacctgagggagtcaggagtttcccaggtgaaggaggcaggggaaaggtgccccagaagaggatatgtcaggagtaaaggtgtgaaggtgctagtgttctaaatcagaataaatttagtaaatagaaggtacctgaatattcacatgcacaaaatttactagcagtcttatatcattttgaccttgctttttttctagctcagtctgaagaaaagctgggctaaaaatagctcctggtacagtgataaagcatccaagtaacgatttcaaggagaaagttaagactagatttagttatttggcaaacactaacttacaatattgatgtgctaataagaaatcatcttacttattaaagcagatccttagaggcctgtttttgttcctcttactggaatatcaattccatgaggactttaattcactgttttctcagggcctagaacagtacctgacatatattagaagctcagtaaatatttggtatataaaggaatgaatcctaggctattatgctaaaagtcactgtgaatgcttaaaccatattagaaatgtgttttttaaaaattcaagaattcattcatttccattattcagactagccttttctccagtgtctgagatacctattgctatataacaaactatcctaaaacttagtgattaaaaaaaattattgcttatgattttgtggatccggagtttgggcagggcttattggagacaacttttttctattccacatggtattggctgggggtagagggttcacgatggcctcacctccatgtctggggccttgatactagttgttaccaaggaagcctcagttttcttccatgtggtctctcattatttactagactaggttgagcttccttacatggtactgagattgttccaaggtgaaaacagaagttgtaagatatcttaaggccttgatctgaaagttatacactgtcagttatgccacattcttcttcttcttttttttttttttttttgagacagagtctggctctgtcgcccaggctggagtgcagtggcaccatcttggctcattgcaacctccacatcctgggtttaagcaattctcatacctcagcctcccaagaagctgggattacaggcatgtgccaccatacccagctcatttttatatttttagtagagatggaatttcgccatgttgctcaggctggtctcaaactcctggcctcaagcaatccacccgccttggcctcccgaagtgttgggattacaggcatgagccactgcacctggccagttctaccaaattatgttggtcaaagcaagccacaggaccagctcagatttaagtggaagggaaaagattctactttttgattggagaatgtcaagttcctatagcgaagtggcatgagatggaaggtattgttgcagctgtctttggaaatagtgtgctacagtctgccctctgaacatatcaattcacatttcttccacgtgcagaatatacttactcctctcttagaagtcttatcccattatggcatcaacctggagtccagtatcttttcatccaactaaagtccagatgcatatgagatttcttaggcacagctgctccagtacagcttctttagatctagaaatctgtgaatgaaaatataagttacctgcctctgtctcccatcccccatccaacatacagtggtgagacaggggcaagaaaactgtagtagatgctctcatttaaaaagaggaagaattggaagcactgttccatagcaattttgaaattcatctgggcacatgttactaagtctcttaccccatgtatcaaaaatataccttgaatagccttttcacaagatggcgctgaaagcaaagaaggaagctcctgcccctcctaaagctgaagccaaagcaaaggctttaaaggccaagaaggcagtgttgaaaggtgttcacagccacaaaaaaaagaagacccgcacgtcacccgccttctggtggcccaagacaccacgactccggaagcagcccaaatatcctcggaaaagcaccctcaggagaaacaagcttgaccactatgctgtcatcaagtttccattgaccactgagtctgccatgaagaagatagaagacaacaacacacttgtgttcattgtggatgttaaagccaacaagcaccagatcaaaaaggctgtgaagaagctctatgacattgatgtggccaaggtcaacaccctgattcagcctgatggagagaagaaagcatatgttcaactggctcctgattacaatgctttggatgttgccaacaaaattgggatcatctaaacttagtccagatggctaattctaaatatatgtatatcttttcaccatatacatgcctctgtcaatttctggttgggctgggaggccatatacaggcattgacattgtaacagggcttggtcaagactcttgttttacttatgcttttggaatactcaccctgccactccaccatgtttgatcactccagagatctatgtgactagagttagcatcataggaaaaccagaactcagaacttgcctccatggttgagggtaacaagaagctttagaagaaccccttttatccctggaagaggctgtgtgtgaaaccaatgcccagagtttgaagggtattagcatccatttcaggcgagtatgggttggctggctttcaggtagcattttgtcctcatacacccatctactatggtccaactggtctgtctgtttccctcactccttgtgcaataaaggacaaggacttcaaaaaaaaaaaaatatatatatatatataccttgaatagtgcccagttctgctctttgagagttgttccctagtacattgttttgtaagactattagctctaccctttgggctcttggctttctccttcttttttctttttcataagaaataggtcatatttgtagctgagtagcttttcaacctgcttcttacctatgtgaagttgggaacccacagatattttatttctcccattttgaactgtttctttctcttttagtccaaactggtggtacttttagtacgatagttttctttaaaactttgagagttttctatgaatgttattagggattgattctatgtcccaaaagccacatttataatccctttccaggacagaactgtctttactttgggtctgcctattgaagaaaaggtcattaagattcttcgaagtccctttgtatagatgagaagggtctatattttcaaggtctcaacaaaagatcttatggacaaacctctgatttgatatctccccagagaccatttttaaatttcagatctttcgccagttgtagagactgttttgggccctctttacttcctctaaattctgcttaaaaattaaacaggtccttctttagtttatttctctcttctccatactttatcatatgcagctgaaagaagccagttggtactactttcagtgttctacctggaaatatctttagccagtcaataagttaattaggtaaatattctatcttatgtaattgttaaattaggtaaatattattgcagacaacagtcttgccaaacattccaccactgtgtaacatgaggcactctctctcctgcatctaatagcaattttctcatggttcttctggcctttgctaacaactgactttccactttttcagcctctgcctgccatcaggtcccaaaaccaatgctgcatattttaggctgtttggcacttcccttaagcaagtcaatcaaagcaagtcgcatatccaaggaagggaaaatagattccatctcttgatgggaggaatggcaaattcacattgcaaaagagcatgtggaatgggatgacttatagtcatctatagaataatctattgcacctagtaagtttaaacttggaagatttactataggtgagaagttaacaagtggtagcctgtgtatgtatctggctcacagatatggtatatttggcttggatagagttttaatgaaaaaaaaccaacataatttatcatcaaacaattgggagattttatctagaaggttatatatcaggtctctcttgaaaaatagtaagctgtttttgtgttgggccttcatttccatattagctggaaattgcctgatttactccctttcatgacctcttggctcctataggtatttgattttgcagtttttgctgctgcagattactaatttatatgttagttttttttaagggaatatggtgatgagcaagacagtcatagagcttacattcaagtatgggaagatggacaataatactagataaataatgtaattgcacatggaagtggaataaagcaagaatctgggatagaaagtaactagtaaataggtagttggggtggggatattttagatagggtggtcaggaagccctctctgaagacatgacgttgagtggccttagtgtgagaaggagccaaacatggggtaagagtgttccaggcaggctgagcctcgtggctgatgcctgtaatctcagcacgtttggaggctgaggtgggcagatcaccaggtcaggagatcgagaccatcctggctaacatggtgaaaccccatctctactaaaaatacaaaaacattggctgggcatggtggcacgtgcctgtagtcccagctactcgggaggctaagccaggagaatcgcttgaacctgggaggcagaggttgcagtgagctaagatcgcaccactgcactccagcctgggtgacagagcgagactccatctcaaaaaagaaaaagaatgttccaggcagaggaaaaagcaagtgaaatgacccatgggtgggcctgggcttggggtgtttgaggaaaggcaaagccgagagtataagaggagaaaatggtagtagaagaggggcatgaacgaggtcatgaaatatcctgtaggacataaaaaaacttgagctcttattctgagtaatgggaagtcattgaaggaattgaacagggctaaggttgtgatgtcatttactttttgcaaagatgtctgtagctgctgtgtggtaaatagactagtggcaaagggtggaagtaggatgttgtaaaggaggcttgcagtcatctaggggaggtataaatgatggggccttgaaccagggcatggtacttttaggagtgagaagtggtcatacgtggtatgtattagacaggtcttatggattattgaatatgggatatgggaatgggaggaattaaagccaactttgaggcttttggcttgagcaactgaataaatgggtggtcccatggggagttctgacagaggagcaagctcgaagtgggaattgagagttttctcttgactattattaactttgtgaccctactgcaaaaataagtttgaaaatgaaaactcctaaagtgaaattgtttttatcttacagctctttatatgtgtttttttcttcttttcctcttcattagaagactttgccattacttggatggcataccagctgcaatggaggaagtatacagatgtatattggaggatgtatttatattttaatgtgtagctatctgctgtcaagaattaggcaaggagactagtcactcacacctgtaatcccagcacattgggaggctgaagcggaaggattgctttaggccagggattcgagaccagcctggccaacatagtgagctcttgtctctacaaaaaatttaagaattggccaggtgtggtggctcacacctgtaatcccagcactttgggaggccgagatgggtggatcacttgaggccaggagttagagaccagcctggccaacatggtgaaaccccatctctactaaaaatacaaaagtactagctgggaatggtgtcaggtgcctgtaatcccagctacttgggaggctgaggcaggagaattgcttgaacccgggaggcagaggttgcagtgagccgagaccacaccattgcactccagcctgggcaacaagaaaaaaaaaattaagaattcgcctgccatggtggtgtgctattttgagtaatgggaagtcactgaaggaattgaacaggggtagtgatgtgatgtcatttactttttgcaaagatgcccctggttgctgtgccgtgaatagactagtggccacaggtggaagcagaatggtcatttaaaattttctatttattccaattcagtgtggtcataaaggatcaagtgtaatttattattcacattttattggtatggagaattaattcatttttactattaaaaaaaggtggcatgttagtaatcagaatgttctaggagaaccttccagaggtttgcaactcttagaattgaaatcactatttagctaagaccagaatcgtaacataaggcaagattgaataaggtgaatggatttgatgaattaaagtgctacttgtaaaggatagtaaattcacttttgcattttagatagtagcttttattgtaaatttggatgcaaaatgagataatagcgttttcaccccttttcaagagccatttggagatagcattttgactagatctgtcattcaattcagcttagaaataatttataattttatttttaaattcctattttaggatattatcatattatcatgagataatgataataccactctaattttattataattgggttgggaggaaatagtcttttgtaaaaggttagttagtggcatattgccattagcatttattttaccttttttagaaaatgaaaatcattacacttaaattcaatgtatattatatagagaacataactgatttataaccatgtaaaatatcttgtcttactaacaaaacgttcagtttttccttctttgtgaaaccttgagtcaaaatgtactagtgaggatgtttatattccagtggtgtagctgaaccagacaggtctgcagcgcagtggtttatttttagacctgcgttgccatttttatcctgcaaaaatattcatcagtgtcttgctgacaggccatcagtttcataaatgtgtcacatagaccagattttgttctttgtctcattttccctccaactcttcttttccttttgatttgttcatacaactgtttggaggaggagaatttttttttttaatttcaattcatgtattagatgcttcaattctaagatctaacagattttcagatcacccagttcattcatctatctgcatctgcttacacatctctacttattgtctgatatgagaagctgttatagatcactaagctgaaggcaaggaaaagagaattgcatgcattggggattctcttcatgggtccagtcagtttttgactgccttctccatatatgtttttatatatttatgtgtatgctctgtgtgtgtgtgtgtgtgtgtgtgtgtgtgtgtgtgtgtgttttcgtttatttacttgtcttacccaacaagggactggcataaaatattttgcataaaaaaaatagctgcctaagggcctaggggttaccatatgtggcagaaagccatgtattgaaaataaatccatcattatctttaaatacatagagcaccaattatttaatttgttaggagactgttttaacctgtttgggctgctaaaacaaaataccataaaccaagtggcttacgaacaacagaaatttatttctcacagttttgaagactgtgaagtccaagatcaaggtcctggaagatttggtatatggtgagggactgtttcctggttcacagatggtactttctcactgtgtcctctcatggcagagggggcaaatgagctctctcagacctccaaaagaggactgatcccattcatgagggctctgtcctcgtgatccaaccatccacaaatgccccctgctagtaccatcaccttgtgggttagggtttcgactatgaattttgggggaacacaaacattcagaccgtaacagagatgatgttttgattccagatgcctgagtgacaaatatcaccaaaacagaaggaaaaattcctgcaatcaagagaaactaggggcacatacttgagaatatagtaattttttaacagtgtatattcatgtctcatttttataaaaactcagattcccagagcaggattggtattcacttatctctgtaacaaatatttactgagtagctacttgagggcccaatatattaattgctttagtggctaccatggcttggagaacaggatttctgacttgtggagcttatagttattttaagaggaaaatacttctatgtatatttcacagacatggcagtacagcatactaggtaagagtataggcactggagccagaaatttgcatttatagtttgtgccagtcatttcctagttttgttaccttgagcaaactgttcagcttttctgagcctcagtttcttcatctctaaaattggtatgtacttcagaaattattgcaaaggttaaaaaagatgatgcttgtttagcaatgtgctaaaaatactgaacatcatgcctagcacatagtaagcacataataaatgctggttaattcataataacagtaataacaatgatggggataacaacaaatattctatgcatattctgtaatgctttaacatcaggaatgtcttcagctgtaagtaacagaatacacaactatggtggcttaaacagataaggatttattaatctaacaagtctgacataggccagattgaatattaattattcaacaatttttatcaataatctatatgccagctactattctaggcacaaggattcatccattaacaaaatgcagttattcctgtcctcatgaagcttacattctaattggggagagagacaaaaataaacaaaacaatgtaatataaaaatggtaagttattactatgttagaaggtgggcttcatagaaagctttgtgaaggagggcccatttatgttaggccataagggaacaacagagtttgaataaatgaggctaggtgagagaaagacacaacagaggaacagatatgagaaaaatggaggagccattttgagccatctcaaaatggaagttttggcaacagtgctttgttaatcatcaagtaatcaggagccatgaacgcaagatttttctcagatttctaaagtaaaagatttcatgttgttattttcactttatgtaacagttaacaatcaaataataatagtgatagtaatatgtagtgcttacaaatcaaacgttctacttaatactaatgataataaaagcatatggctgacacttacgtaatgctaattaggtatcacactagtctaaggatttggtattcatatcctaatctctgtgttaagtactaatagtattcccattttacagataagtaaagttaggtagtttggtaacttggcccaggtttatttgcccttagtgtctctaagggcgataagaaaagagataactggagagatagcctctcattccataatccaggggatagagtgggtgaggaaatgttcagggaatataagtaggtttaacccctaaagcccgagcaaaggaagaaaggagaaattgagggcgttagtagggcttgagatggctcatctaaacagttacccacaatttccacaactctggcagaaatttaccattagatgagattaggtccagagctttatcatatttcagagacaggctttccaatgctaagcatcacacatataccttacccagcagggaccattagaatccttttctcatagggagagtgtcttttgttgtttgtttcttcacttggttatctcttaaatgaaagaagaattttccaatttcaacatgagctttcaaatggaccaaattctcaagcatatttaggttgtgtctaaatagttcttatagaacaaatattatgatatgtgctgcctgttaaaatttctgtctgtattcatgtacacattctatgtctaattagaagctgccagccttgtcaaaatacaagtatggtccactgttaaaacctgatgtaagaaaatataaatgtataaaaatagttaaagttgggaggtggggggccatggagagtacttgcattctaaaaaaatttttaaggcttccattaattgggaaagtttgctttacataataattcaaagaatagattttatttatgtagtataaatgtgagaccacagttattacataaagggtgaacttacttaaatatactttatattaaggattcagtcatggtacaatgccatgctcattttcagtgaacaagacaactgtatactcagatagcatatggtagaaagaactgaggcatcacaggccaagaggccccctgaagctgaatgtggtcttgctggtgctgttagactgagtagcccttgtcggaagaaatggtagattccatcagaaaatgttcaatgtaaaatattacagcagtccttgtgattttcagtaggtgtttcccaagctactcttacgttattgggatcagctaactaaccgaaggtggctgtgttctatttaaataaaatcttgagtttagaaggtttcaggggagtcccagtttagagggaactttgtgtgaactttgattctgtttgaatcttgatcatgctagagaaataactcatgaatataaggcttttttttttttcgatagggagtcttgctatattgcccaggctggtcttgaattcctggtctcaactgattttcctgcctcagcctcctgagtagctgggattacaggcacacaccaccctacctggcttataaggcattttgttgatataaattcccatcatagtacaaaccaccatctcttaatgctgagttttacaactccttctccaagtatttggtgttatggtaaaacagtaggaaaaaaacacaacaattcaccctctttctaccctttaatccatttttgtttttaatcacaccttttttcctccactttgccagtgtgcttcttgatctcaggttgggagagatgaactatggcagtaatgtatagtgggcagtggactcccctttctccagagatggtagagtaggtttggtgcttttttgtttgtttcatttctggaaaacttgagtttatgtgtttttctgtctgaggctttaaatacaaactgaattaagcagacatctcaattgtggcagtaaccacatgggggcttgcatagtgtgattctgttttttttttgtttgttttttgtttttttgttttttgagaccgaatcttgctctgtcactcaggctggagtgcagtggcacaatctccactcactgcaacctccgcttcctgggttcaagtgattctcctgcctcaccctcccaagtagctgggattacaggtgcctgcaaccacgcccagctaatttttgtatttttagtagagatggggtttcaccatgttggccgggctggtcatgaactcctgacctcaggtgatctgcccaccttggcctcccaaagtgctgggattataggcataagccattgcacctggcccaattctgtttaactaatatacagaatataattttatttgaattttaaactataaaaacattacacaagaaatatatttacttatagaaaaattagaaaatccagctaagtaaaaaaaaaagaaaagaaaaattatttatattcctctacctagaggtaactaccatcaactttttggtctgtggctcttttagattctttagatttttttcccaaaacaaaaaatggctactgtacttgttactcctcccactgtatctgggaatcggattatttatgagctagattattggtaaacttcttttgactcatcattaggtgatgatccttagaaatttcaattaaagatcttctggagaaataaacattgttaaaacaaaaatagttaatttttgttaattaaaaaataatccattttttcttcacttggctgtgtatcatagacaggttttcactgccagtcaccattctttggtgccataatttttgataactgtattgtgttctattgtactgatatgctataatgtgtaatatagatatgctacatataatatagatataaataagggtataaaagattagtatgcaccataattatatactatatctatatgctattatgtgtgctatacatgctctataattacatattataatgtatttagtggccccttatggtttcaatgttggtattgtaaacagtgctgccacataccagcatcttaaaggtcttgttcattctgaaaaactaaaagggaaaggcaatagagtagcaacttagtaagggccagcaaatggcatagaaagttatgacatttaaagaattgtttcagatgtccttgcatcttagggatcaatgacaatttaagtaaaatgaggactattgtacatctaatagaatttaataaaataccaagtttatatgtttagtagtgtcctaatcttgtgaagggattgaaggtgttttcaaaatgttaaatagcagatagtattaatttttaaattaattaattgcaaagtaggtgagtaggtctgtaacagcacaactataacttcaggcatcagagaagttgttttttctctctttgagctctagtccagacagtaaacttcgttaagtaatttacatttgaaacttttgctggagaccaggaaatttctatggtatgtttgtagaataaaaagccatgtaagtaaataaatgaaatcactgaaaagtgcataagaggacgcttaaatcagacttgtattaaaagttctatttgtgagaggtagcttcttgaagggaggaaagtatgctttctttgattccatgaagctcacagtcatgctgtacctgctgcctatccgctgcatctgaaagggtagcttatctaagaagttgaatgaaacaaacttcaaatgataaacagaaagttatttcatcagtctttaacacttccacctaaaggttcacagaagaaataaaagtcatagagactagcctcaagttttcctcttttcttgttaaaggtctgtgggagagaaggtaaaaataatcaaaacatttttcttttaattcagttattcatgttctttctattttaaattgttgaagatgagctagctgtaggtttattgttttaaatcacagctctgacttgacatactgtttttaaaacttgtggatgtgtgtgtgttttttttttaataaagataagagaagtcattactttgattttatattcatcatagtcatggactcatagggtcttgggtgttcatttagtttgcaactacattgtaaagatgctgaaactaaggctcagaaatattaaccactggtccaggttgatttagctagcagaaccaggaccagaaaataggttttctgactattggtcaatccaccactattgtatgtagagtataatctctgtaactgagaaatattgtgctggattatatgaagcccctttaaaaagatttatctggaagtgaatttcactgagtgttcattttgaaaagtctgttagttgttaagttgtttaacataattttattggcagtctgggggtttaccaaaaagtagaaagaggatccagcaggatgttgtataacaagaaggaattgtgttgagcttccatggttttgacttctcagggatgagaaaaaaaaattagttgagaataaatgagcattcttcctttcttttctcacatttgttgttgatactaccattatttatttcagtcttcaagatatataaactgtttattaaactatcttttggtgaggctgttttgaagttcttgactaggcctgagtgagtcaggcatgacaagtagatttacttgatttctcctaggtgtaaagtacctaggggtgtgctgggcctcagcatcagtatgcttaaacacatgcctttaagatatatttaatccttaaagaaaaggtagttattcaccaggagactctggcccaaacataggactttattgtagtgttagtgtgataagcatggtggcttaaaaggagaatagctttctaaatctcatttctaaatctcttagtgaggtgagacagagtgaataaaatccagggtctctgtttttggagaatttgcccacttcttatatgaagaatattattaaatttttttttttcgagacagagtttcactctgtcacccaggctggagtacagtggcacgatcttggttcactgcaacctctgcctcccgggttcaagcgattctcctgcctcagcctcccaagtagctgagattacaggtgcacaccaccccgcccagctgatatttgtatttttagttgagacggggtttcaccatgttgaccaggctggtcttgaactcctgacctcaggtgatctgcccgcctcggcctcccaaagtgctgggattacaggcgtgagccactgcgcccagcctaaaatcttaaactggatgaattaggttgaaataagtcaaataatctacattagaccttcccttatgtttatctgggtggatataaatgtggaccactgaagataagttagctagtggaattataccaggtagatctcattacacctctttcacttttattagacctgagttatatacagtatttcaagggcacttgtgtagtagacaacgattgtcctactggtgtgtttgcatactgtttataactaaggagatgtttaatgtaatcatgttgactgaagaacaaaaagggtcataaatttcgaaaggagagctttatttctcataaagggttgcagcctgcaggttggtcatcctgacaagctgggaagcaaagcctcccaccagaatttggaaacagatacttccagggaggggcaaagggaacaggaatttatgctgggcagggtggccaaatatatatgttcagtaagctctaggaggcatcatgaatattcatggaaggagaaaatgtacacatgtgcaattgagcttcagacctttccatggcatggaacccgtgtccaaaaaatggcagcattagcatgatctcggggtggagttttcgatcttctgacatcaaaagatgaagcagagcacacaaaaacctttactgtgcttcctctgtagactggccagaaccactctatatggtttggctgtgtcccccctgacctaagtctcatcttgaattgtagttcccataatctccttaatgtggtaggagggacctggtgggaggtaattgaatcttggggtggttacctccatgctgttctcctgatagtgagttctcatgagatctgatggttttataaggggctctcctctgcccttagtctgtacttctccttgctgccaccatgtgaagaaggatgtgtttgcgtccctttctgccatgattgtaaatttcctgaggcctccccagccatgctgaactatgagtcaatgaaatctctttcctttataaattacccagtcttgggtatgtctttatcagcagcgtgagagtggactatacacactccatggttggtctcttatcaggaagaaatgctgctggttagttgttttgttgaaactgcaaaaggaaggggcagcagttaggctattggttgcagtcagcggtggatctttttttttttttagagacagggcctctgtcatccaggatgaagtgttgtggcccagtcataactcactgctgcctcttaactcttaggcccaaggaatcctccttcctcagcctctcgagtagctgggactacaggcaggtgccagcatgcttggctaaccttttttattttttgtagagacagggtcttgctgttgcccaggctggtctcgaactcctggtctcaagtgatccttctgcgttggcttctcaaagtgcttggaattatagatgtgagccactgtgcccagttgaagttcacgttattaattaactaattaattaattgacagtctctgttgcccaggctgaagtgcaatgacatgatcatggttcactgcaacctcagcctcctggctcaggcaatcgtcttgccttggcttctcaaagtgctggaattacagatgtgagccacaatgcctagcctcaggttgtttaaaaagtggctgatgggaatgaggaataaagaaaaatgtcattctcagtggtgaagagtgacttgggcacaatatgaaactgattccctggcatgttgtatttgggaaataccaggtggactgtttgaagttaaaacgttggttaaaggtaatgaaaaataaagttggattcagcattatcagattaatgaggaatccactctttggagtatttgtgtgtgcacagtgcattattgctgaatgcgtctgttataggtagttcctagtttataaagcaatattgtattgtatcgttgggtttatgttgtggcgatcagattatgatgtgatgagtgacaagtcatttaacctctctgagattgtcacttcttctgttaaattagatgctttaatcaggtcttattatctaccaccctcctagggttgtttggggaactactgattgtaccttatagagtgttgggatctgttaaaacagacattgtctgtaaagtatctgctactgtgtttggcacatgttaggcacttgatacatttagatttaaattttaaaaggctgttccacccataggagcagtccgaacttaggattctctgtattctgtagtgtaaattgagtgatacattgaatagttttacttcccaaattcaaggaatgatacaccaagaaaaatagcaatttctgtccctttcctgatctagcccttggtaaaaagctaatctttagtaacttttaaaaaaaggggtttagggggaattcatgtggaggtcagagtggaagaaggtgtgagagggcccagcagaagaaaacttggctgccaaagtgtttgagtccattggcaagtttggcctggtcttagccgttgcaggaggtgtggtaaactctgccttatataatgtggatgctgggcacagagctgcgatctttgaccaattccatggagtacaggacattgtagtaggggaagggactcactttctcatcccatgggtacagaaaccaattatctttgctgttctcgaccacgtaatgctccagtcatcactggtagcaaagatttatagattgtcaatatcacacggcggatcctcttccggcctatcgctagccaacttcctcatatcttcaccagcatcggagaggactatgatgagcgtgtgctgccgtccatcactaccaaatcaagtcagtggtggcacgctttgatgctggagaactaatcacccagagagagctggtctccaggcaggtgagcgacgaccttacggagcgagcagccacctttgggttcatcctggactacgtgtccttgacacatctgactttcaggaaggagttcacagaagccgtggaagccaaaaaggtggctcagcaggaagcagagagggccagatctgtggtggaaaaggctgagcagaggaaaaaggcggccatcatctctgctgagggtgactctaaggcagccgagctgatcaccaactcactggccaccgcaggggacagcctgatcgagctgtgtaagctggaagtcgtggaggacattgcataccagctctcgctctcggaatatcacctacctgccagcagggcagtccgtgcccctccagctgccccagtgagggcccaccctgcctgcatcttcacgggccaactggccacagccccgatgattcttaacaccgccttccttctgcccccaccccagaaatcactgtgaaatttcatgattggcttaaaaagtgaaggaaataaaggtaaaatcacttcagaaaccccatccccccaaaaaatgggggggcagggttaaaagaaattcaagtaaaattctcattacataaaattaaccattaacgaattcacagtgtacgattcagggggctttagtacattcacactgctgtgcaactttcacctctatctagtttcaaggtatttctaccaccccaaaaggaaacaccatacccactaagcagtccctctctatcctcccatccacagtccctggcaaccactaatctgctttcttcctctatggacttacctatttattctggatgtttcgtgtaaatagaatacattttgtgtctggcttctttcattaagcatgatgttcatatataaggttcatccacattgtagcatgtatcagtacttaatccctttttgtggctgaataatattccattgtatgtatatactacactttgtttattcagccatcatttgttggacatttgagttgtttctaccttttggctattggcagtggtgctgttaggaacattcatatacaagtttctgtttgaatacaggttttcagttttgggggctatatacctaggagtggaattgccaggtcatatggtatttctgttgatctttttgaggaactcccaacctgtttccttcagtggctgcaccattttatagttctactagcaatgtacaagggctttaatttccccacatcctcaccaacacttaatttacattttaaaaaattacggtcaacctagtgtgtcactgtagttttgattttcatttctctaataatgttgagcttttttcttatgcctgttggccatttgtatatcctctttggataaatgtctattcaagtcctttgcccaattttaaaattggatcatcattttgttactgagttgtacaaattctttatatattctagataataaacctttattatatagatgatttgcaaatgttttctctcattctatgtgtgggttgttgtattagtatgttttcacactgctgtaaagaactacctgagactctgtcatttataaagaaaagaggtttaattgactcacagttctgcatggctggggaggcctcaggaaacttacaatcatggtggaagatgaaggggaagcaaggcatgtcttacctggtggcaggagagagagatcgagggggaactgccacacgcttttaaaccatcagacctcctgataacccactcactgtcacgagaacagcatgagaattcctattttcatgaggccccttccgtgttactcccacattttgggtattcccaaaggaagccacaaagtagtttgaatcagatcacactgaggcataaagattgatagccttttaattcttatacatgggtttgcatttttaaagaggatgtggcattaaccaaaatgaatcattatttggaagggtttttagttaaccaaataaagtgaaaaaatcaggcagaaggcatttttgggttatggtgccaccagaaggaatcgcagggccttgcctggaagtcggcccaggggagtaactgcctttaagcaaatctgcttttcacagttttttttttgttttcgtttttctgttctggacctatagatgctttgaatttttgttattgttgttgtttgggtttgccagttttttaagtgacaagtagaacagtctgcagtgtctggttgggtcaaaagaaggggagtaaagagtcgaagagagggctgctcagtggggaacctgaaaggactgagtgggaaaaaggggactctgtattgggacaggacatttgtaaactgggcattttctttctataataatctactgttcttgaagaaagatgtgtgcttcctcataccatgggattgtggaaaatgcccacaatatctgggtgtatgcataaactaatatttttctgtaaaattatttttataatatgattaggagaacaagttagagtggtcttatattgcatcactttcactgtttgtctttaataaaaatggaggaagttgctgctgttttattaacttgcaccctgcatgcttctcttctttgttctttgttaaatatgagctggcgtgtgttaagactacgttagcatttgctctcagggacttctgtggtttctaaattcagcactgctaagcccctacactgtttgcctgaatcagttgagactgctatttttagcaacaaaagggaattgaaatagcaattttctttccatgtaatagattcccaagaggaatactgatgcaagctctctatcattttctattcctaccaccctcctcccaaagccctcagaggaaaggcagctgtcatggtttgcggcagtattaatctttaatcaatcgagtgttttctgcattcaggtgttcggggggaaaaaagagtcacaagaaggaacctgtttggaataactaagctcttaggcatggactttacagtcagaattttgtgggtagtggcagggaatagacagaagagctaaaaatagtgagtttgcttccagtgttgctctagtctatttttgatgtttgattttgataaggttgattgggttcttactaaaaatatctgttcctagcaagttgaggacaaaaagagtagaatatttttaacctacacaaactaaagtatttttgttgactgtataaaatctggaagtggagccctggtcagttgccagtattttatataatctgtagcaagctagacacttctggatgccaagttgggctattctttatagttgtcagtttccatcttctcaaaggcttgtaaatttgggttctagtgttatatttgtgtatgaagacataagcctttttaaaaaatcttcctttttccactttccttcttttcttcctctaccttatagtgccacccatgaccatcatctgtactgtcccaacccacagggttctgggtgataccatatagcttttttctgtgtattgttaaaagctaccctaacttatccacgtatttcatagcaaagtggaatctgaggacaccagtgttaaatgaagaagcaaatcttagagacaagaatagtgaactgtccggccaggcgcagtggctcacgcctgtaatcccagcactttgggaggccgaggcaggtggatcacgaggtcaggagatcgagaccatcctggctaacacggtgaaacctcatctctactaaaaatacaaaaaattagccaggcatggtggcgggcgcctgtagtcccagctactcgggaggctgaggcaggagaatgatgtgaacccggcaggcggagcttgcagtgagcggagattgcctgggcgacagagccagactctgtcccaaaaaaaaaaaaaaaaaaaatagtgaactctcactactttggtaatttagcatgtttggtaaagcatgttttggtaaaacatgttttagcatgtttcactggcacattatgagtgaagtagttctctctagcactgaaaatcatcacttgtctcttttttttctttgacttttaagttcaggggtccatgtgcaggatgtgcaggtttgttacagaggtaaacatgtgctatggtggtttgctgcacaggtcatctcatcacctaggtattaagcccagagtccattagctattcttcctgatactttccctcccccaacccccaccccctccaacaggtcccagtgtgtgttgttccccggaaatcatcacctttcaaggacagcctcagaattctttgaaagtgcaaatctacaggtttatcataaagttaaacttctctctgttaaagttcttgaaaatctcacttttagatgattcttgacgttgagaggaggctgaagagtgtaggggttgtgtaattatttctaaataaggtgtggaaaaagcagtgggtagggtcataaaaggttagttttccttttataatctccattcattcactcatccattcatacagtaaaacctcattaatcacctgctttttgccaggttctgtgctagcagttagactgtgatgatccagacagaccctgctcttacagaatcctgtgtgatgaatgtcatgatgatattgtccaaaggacgaccagcatggctagatagtaggaaagagagttttattggcaatatcagtttgcaaaacagagagtctccagcatgaaccgaaagcactctccaaaacaaaaagaaaaaaactagaggttttataaaaagaagaaatgttacctattgctctttgagaaagttcactggctttgggtaagggtttggggaactggcaagtcctgattggtgagcaactgctgtggacaaaattagttccagagttgcagcaaacatagataaaactggtgtcaggttacaacgagcagtttcagcagtcaagcttgcagagaattacattcttggagcaatgttttgtaccctaagggcttttccccctggcttcttgtctctgtttcagtcgggtgtgacaagagtgacccaactggcatgatcagctttcacaaagggggagttcggagtactatggggcagagaattctgtatgaggttctaagttagtctacaggtcaaggaaggcttaatgggagatgagacggtttaactgaaaaacctcaaggatgggagggaaacacagctagaagtgtgtcttagttcatttgtgctgctataataaaatacataaagaacagaaatgtattttctcacagttttgcatgccaggaagtccaagatcaaggtgctggtaagttcagttgtctggaaagggatactgtgtgtttccaggatggcaccctgttgctgcatccttcgaatgctgtgtcctcacagagcagaaggcagaaagttggctgaaggaacacttcatgaagattcttttataagggccttaattccactcatgagggaggagacttcatggcctaatcacctcttaatgtctccacttcttactactgtcacattggccattaagtttaacacctgactcttggaagggacacattaaaaccatagcagagtgtacgttggaggtgtagagaacattttcgaagagaaagcatgttaccttggaggaactgtaaaaatttcagcacaactggggcatgcttgagtggaaggaggaaagtggtaggagtaaggtcagctcatggaagaccttgtaaagaatgaggggagtgagaagccagtgacaggttttaggcagggaagtgaagttcagatttgcactttggagtgattgttttggctacaatgtagagattgaattggagaggagtaagaacgggaccaggcgaatgcgttagaaggctgttaacagtagttcttgtgggagatgaatgatggtagctctaggtggtagcaatgggaagaagtgaatgaatttgtgtttcagtttttatatagttggcaaaagggaaatgtaacttcttggcagagaaaaaatggtgtttgagaaagataatttttaactgtgtatagcatgaattgagtgaggagggatgaaagattcctcgtacaagtccttgtgtttgggatgatagcgtagattggggtagtagttgtgagaattacctggatgatatcagtgacataccttgagcaaatattcttataatgatgtgaatattattttgttttcataatttattttattgaccgtttacgcttacttttccgggcctatcatagttgctttaataagacaagtttatttttcacccactttaaagactagaacttttgtatatgtttgattccttatgataaacagtaaaagaagaaatgattgggattttaaaatggcgtggtaattcagtggtgttatcagggaccttgattcctatgatactgttccattatcttagcccatggcttcaaccctaagattacttcatggttcaagagactactgcagctacagccatcactttagaattgactagatgaagggcaaaaggggcctgtctctgccaagtcagcttccattaagcagcctttttcaaagtccttcacaaccttgcttcatgttgttccctgaaattaatcatatggccactgctagctggtagggaggttggaatataagtccttattccaggccacaatatgctgggttaaaaatcagtattctcctgcaaaggaagaagggaagaatgggtattaaggaaggcaaccagcaggctctggcccagatgtgcatttaacacatgaaggatggcctccccagggtagtttttgcacattgtatcttatcatttcagtgttgctgtgaatgcttcgtttttttcattttaagaaaccacaaaaaacaagcagtacttctgatttggatgacttggaagctggtctttgttttatttggttttcattgaaaattggtattataagggtgggagtgtttagatcagtgttttccaaagatcaaccaagagattatcttaggtaccacattgattaatatttttaaattttgacattcatatgttttttacactaatagtctatgttaattgaaactgatggtcctttataagaagcaattaaacagtaatcaagtaatcaagttttctattaaattttagttaagaaaaaatttcagttttaagaaaacttaagtgaccttgagaaacactgatttaaacaagactaccctgattttggaaaattggagtagatgagtttgctggctcagtttacaccatttttctattcatagtagcaaaggactttaaaaaaaaatgcagtacatgcacatggttaaaaaatgcaaagagttaaaataatgataaaaagtaatctctttcccatctttccctaatcccccagaagcaactatcaatagacttttgatttgagatgttatactttggtttacctttctaaaatttatgatgaagaattgactccccagacaatatagtttaattttaaaatagtgaaaatcacactattattttataaaaataaaaaattattgaacttaactgagggattttctttttctttttctttttttttttttttttgagacggggtctcgctttgtcgcccaggctggaatgcagtggcgcgacctcggctcactgcaacctccccctcttgggttcactccatcctcctgcctcagcctcccaagcagctgggactacaggcgcctgccaccacgcctggctaatttttttgtgtttttagtagagacagggtttcaccacgttagccaggatggtcttgatctcctgacctcatgatctgcctgcctcggcctcccaaagtgctgggattacaggcgtgagccaccgcgcccggcaactgagggattttctatccaactacagctgctatctctgctactactgttggaagacatatagctttaaggcaaaggaaatatatatatatatatatatatatatatttttttttttaaattgagacaggatctcactctgtcacccaggttggagtacagtgccgcaatcataactcacttcatcctcaacttcctgagctcagaggatcctcctgcctcagcttcccgagtaggtgggactataggtgtgtgctaccacattggctaattttcttgagtttttttttgtaggattggggtctcgctatgttgcccaggctggtcttgaactcctgagctcaagcattcttcccacctcagcctcccaaagtattgggatgagccactgtgccccatgaaaatacctttaaaaccaaaagcaggacaacccttattcccactgtcttaaataaacaaatttgaattttttccatgtttgttgagtaggactttttctttcataattgacttaaacttgggtatgtttgtatgttattgcaaatataatacattacccatcatgtaacttgtagatctaaaggctttgtcatttcctttgctggggaaatgatacttggtctcccattgcctgaccactgtgtataacactaattattgtagaactacagtggtgctatagagatggctaagagaggcccaggatttccagtttttttgtgtgtgtgttttttttttgtgcccataaataatttttacacttctctgttttctcagaaaaaatatttacttgtgaggtaatatttgacttacatgtaactgggcagtgttggatttggttttgagaagtatgagaaaatggaaaaatgatatttttacctgaaatatcagaggttaaatttttaatatttgtacaatgtaaagtcatattgtttctgcttatatttaaagtcctaaccatgaaatgggtaatttatagaatatctaatatcgaatgtggaccattgtattctcgatagtcatacacataatagtttctgaagactgttagtttcacttaaatttgatagttgctagcaggagataggaaaaaatgttcttgctgggcataaatctttctaagtatgtttagtatcattctcaactaaagttagtgtactttggtataatatgcttaagaggaaccttgggtgcttctagttttaaaatgatgaagtagcaatacttttgacctttcatctcttggaaatgttctctaaaggctggaagaataagaaatggaaagctccattttgatgcaactagggaacttctgtcatccctcatccccagtcacagctattgaaggtggtggagtggtaactgacttccagagcagacacctgagtcctcatagtggggccaccattgggaaacaagcaagttttgtcccttggatcccagaacagcacaggaattggaagtatcaggtatctcaaaagacaggggtggggcagatgtgcttgagactcagggaaattaagcagcagaagccctaagatgagacacctgactgagaacagaggatgagtaaaacacctgcaaactaataactgcccagcagccagaagactggaaattagggaatgctttttaagagacactgaagggccccacagaagagacagatactgacttttgtggattccccaatgacaaagctgattggcccgttgattgcattgtattgagggtcacagtgtaatcacctcacctatgaactctaatcgatattttaatgcagccaagatgagagtgaccaaaacaatcaagaaggaacttagaggaacaaaatataaagagtagaagaaaatgtaaatgtgtaaacaaactataattaatatcctcagagattagataatggatctataataagaacaagatgctgttaaaagcgagaaggagagtgagagtgtgcaaaagggcagtcggaatatggaagattcttcaaagtagcaaaattgacaacctacatttaaaaagtacatagatggtttggaagataaagttgaagaaatttataggaaagtagagcaaaaagaaaagtaagattaatagagaaactgttaagtccaaattccaatttatagggattctaggaagagaaaaatgtgaggcagatattattaaacaattaacataagaaacttttcagaactgaagatcatgaattttaagacccaccaatgcctagcaccagtgagtggaaaaacacccactcatttgggtgcattttcatgatggagttctacagactaagtgataattgtaaaagccccaatgataaaaaaaaaagcaggttacatagaaatggtgggaagtaagaatggtgaaacattttaaaatgatacttgcgttagaagacaacggagagttgtctaaaatttttttgttaaaaatgatttcctacttagaattctatacccagttaagctattatatgtgtggttagaaaatagactttttacaaaaagatatacacaatttaaaaaatgttgtcttttaaactgtcatataaggagacatgatgactaaatgtggtatatcctggatatcctggatgggatcctagatcagaaaaaggacattcagtaacaagtaaggaaatctgaataagatatggactttcattaattgtatcaatattggttcatgtgtatgtgaggtgtattcaggaatgttctcaggaataacacctgtgaggaagcaaaagaagcagaattgagcagagggagaaattgaactatgatgcaggtatagcaaaggttgtagctgataccattggccctgaacataggatggctctagagagatgcctaaatgaggtaagggagcccaacctttgtccctgagtgtggcctcgccattagacatgtactgcccaggggagcaaggcagcccgcctttggctgagagcagttactgggagagactcagtcctgagctggcagcaggtaacactcctggcaagaaaggattgattgagtacctctttgccggaagggaggatctggctggtgcactaacagtatccattacaaactccaacaactggagaatcaggaaaaggaagacaatatacatgaggcagatttcagaatctctagacctggcatattctggcctttctaagactgtttttagttttatggtatgctggtttttagatcagcccaaagttggcaattttaaacatggatacgcacatgcaacagttatctgtattcttttgaaagagattccagtcaaatgtttagatgcacagtactgagtgactttatgtagtttcattcttcagcatattttcattaagagatttctgagcccttaatctgagaaatctagtgatactgccatcaattcattgctgtaatcatatatatagtcatatgtcatttaatggtggggatacattctgagaaatgtgttgctagacaacacatttgttgttgtacaaacatcaacagcctgtacttctacaaatctagatggtttaacctactgttcatacctaggttatatggtatggcctaaagctcctaggctacaaacctgtatataatagcatgttactatactgaatactataggcagttgtaacacagtggtatttgtgtatctaaatatatccaaacatagaaaaagtacagtaaaaatatggtacaaaagattaaaaagggccaaggatggtgtcttatgcctgtaatcccagcttttggaaggccgaggtgggagcattgcttgaggttatgagttcaacatagcaagacctggtctctacaggaaaaaaaaaggttggtcaggtatggtagcatgtgcctgtagctacacggggggctaagacaagaggatcacttgagcccaagagtgagaggctgtagtgagctatgatcacaccattgcactctagcctgggtgacagagcaagaccctgactcttaaaaataaacaaacaaaagattaaaaatggcacatctgtctaggacgcttactgtgaatggaacctgcaggactggagtttttctgggtaagtgagtgagtgagtggtgagtgaatgtgaaggcctaggatattactgtagactttataaacgtttaatacttgggctatactgaatttatttaaaaattttttctttaataactagcttactgtaacccttttactttataaatttatcttgcttatcttttggacttctgtaataacacttagcttaaaaaagaaacacattgtatactgtacaaaaatatcttctttatatccttattccatttttaatttttgaaattttattttttactttttaagcttttttttgttaaaaacagagatataaaacatacacactggcctgggcctacaccaggtcaggatcctcaatatcagtgtcttttacctccacattttgtcccattggaaggtcttcagactcaatcacacacatagagctgccatctcctatgataacagtgctttcttctggagtatctcctgaaggacctgcctgaggctgttttacagctaacttttttcctgtaaagcagaaggagtatactctaatgtgaaaaagtatagtattatagtaaatacataactcagtagcatagttgtttattatcattatcgagcactatatgttatatataattgtatgtgttctacttttctattactggcatagttgtaggtttgttacaccagcatgaccacaaacacgtgattaatgcattacgttatgacattatgacagctacagtgtcactagatgataggaattttccagctccattgtaatcttaggggaccagagctgtatatgtggtcctttgttgaccaaaacattgttatgcagctgctgactgtatgtggtttgcttgctccacagttgtaggcttaatgcagaataatctagttaccaacaggatttgtaaataggtcagtggctaataggtgttagtgtaggaaagtgtaagatactgtacttgtaaataaagacttttgagaaaccaggttgtcaggaaaactgtccaagtcttgcgtgttttgcaactttttagaccaactaaatgccgatcatcatttaaacacttaccaaatgtctactgaacacctaccttgtgcatgttgcctagcaaggagactagaatcttacagaagaattaagacatgtagatgtaaggaaatacaattcaaaatagagtggtaaagtgccatagacttaaagatgtgccaagtgttgtgggagtttagaaagaggaagttttctttcacgtaaagtgatctagaacagtgaagttggtggatcttcaataaggctttgatggaagagggtaggaggtgaggttctgtgttggaaacagggcttgtggggtgcctgcataaactgcccataaaaataggggacaataagttctggaaagccacaagaggcctctgaggaggaaagcctcctaattgccatcatgttcccatgctcagagtgagagctgctctcttatctgtaaacactgtgttcaaggagaaagacactcctttgaagcgttggaatgtggacagatatgcaggctcctagttaagcctactcccaccagctactcttcgataagttaaagatatgctgtttgaacacaaaggagattcacttaaaccgccactgctatagattatgtgcatgacggactgccttccattcaccattttgccctgaacgtctgcttcttagatctaagtgactgtactcaataaaaagtgtggagaccagagctctgagccttttgcagcctccattttgcaattggctctctggcccccactctttatgcattcttaacctgtctcattccttcattgccactggattttgagtaccctgcgggtggtgttgaggctggtccccaacagttctggggtcttggagaggggagaaaagtttatcacagagaaaaggaagaggagaaaagtggaaacaattagaatatgtgtatccatcacttatgaaatgttagtgaatcaataacaagaatacagtataaaatttggattcctgtgcctctaaaaacagtcgggagatgaaaagttacagaaaattatgttcattgctactctagtcacaataccaaagacatggaattagtccaggtgcccatcaatggtagattgggtaaagaaaatgtggtgcatatacaccatggaatactacacagccatgaaaaagaataaaatcatgtcctttgcagcaacatagatgaaattagaggccataatcttaagcaaattaacacaggaacagaagaccaaatactgcatgttcttacttataagtgggagctaaacactgagcacacgtggaaataaatatgcaaacagtagacactgtggtctactagagggtggagggaaagggggtgagttgaaaaactacctatcaggtactatcctcactacctgtgtggtgggatatatacccacaacctcagcatcaagcaatattcccatgtaacaaacctccacatgtaccctctatatctaaaataaaagttgaaattaaaaaaacaaaaacaaaagttatgaattgatcatgaggttggaggagattttataagatgctcagttttctgtaattaggttctcccacaaacatttaaatctgttagttactaatgtttcctataaacaggacaatagtgacaaaaacacatgggttacctttggaagatgccagagtaccagtttattttgaaaactgataaataaaggcaaaaaaaaattcaaacatttatcttgtgttcttatgcaatctatatatcatggtaactaactaatgaggaataatttgtctctggaaatattccagctaatagatgaagatgaatgattgaactctaatatgaccattttgcaacccctaatgaaataatggatctcagtggtgaccagcagtggctgctaatataacaaaacaaaagataaccagacatatgcttcctgatgtaaaaatgcattatcccttatgaagtactcctaccaaaaaaatcaaacctgaatttgatcaatatctatatccaaccaccatgggacagaggaacatgttaaatggtatcaaggacaggctgagaaagcacaaacctatgacctaatatcttaaaccaataaattgagagggtgaagggaagaaaggggagaggggttatagacatggttaattgacatattaacaaattttattatggaacattttgaatcctgattggaacaattgttaaaagtcttttgaaacatttggcagaatttatagtgattacatattggatgtcaaggaattgttatttataattttaggaatgagataatggtattgtggctatttttcatagcagaaacatactgtaatagttatgaatgaagtgaaataatgtttttacttcaaaataatccagtgtgagaggaagcaggagggaatattagatgaagcaaggttaacctcaagttgttgattggtgaagctgagctatgggtacctaggggtttgttatactgttctctggatatttcaactttttttttcttttttttttttaattctggaaagatatcagctaagcaagaacatgatgaaagtctacaagattatgagagatatggctagggagactatgaatgtgtttaccatatttctgaatagtaaaattagggaccatcttgtataattggaaagaagtgaatacaagaaaatcctactttacaccataacttgtttttcaaagtctgtaaatgttttggaaaaactcgtatttagagaatttggggaggcatccctttttgaagcagacatctgtgctttgaacttgtaacatgattctagtattccagagataagatatcatggtatagcctgccctatataaatttcaatgtttctgctacataaagtttttgaggttgtaaggcaaatatggtttctcatagaataattaagaccattttctatttacttttactaccctttgttttaaaaagtagcttatgaagatatatacagtaagtatgtacttaagtgtacagctcagtgaatctacacacacacagtagtaactgccaccctgaaaagatacagaatatttcctgtatcctggaagattcccgtattgcccttccctgttatctactccactatccagagataaccagtattctgacttctgtcaccatagattagttttaccttttcttaaacttacatttttatgtcagactttttgtaatgtcttagagattcattcatgttttgcatatatcagtagttctttttttattttcttttttattgctgtttagttttgcttcttttgttttctcttttattgctgtttagtattccattgtttgtctatatctcaatttacttattcttctgtcgattaatatttagttgtatttacctactatgcatcaactaagctactgtgaacattctttggggtagacattaatgcatttctgtctcttgagaattggtgggttaaggtaggcatatttttagttctgaacatattggcaaatagtattttccaaaataattgtaccaatttacagtgccaccagcaatgtgtgagagtctagttgctccacattctttttaacacttggttttgaagtctttttaaaattttagctattgcggtgtgtattcaaccttagatttgaaccgctggtattgttctgtcttttacatcaaagtgtcacactggtccttttgtatgtaattggtgggtcctaactatgaccaattcctcaatgtaattcttagactaaactattgcttttttccctttcccagttgtcacaggtagtactgatggaattggaaaatcatatgcagaagaggtaggtgattttcaagatctttccttttaatataaaaaataagaataaatatgggatgatttcttatagtagttttgatttttgaagtaaaaaacacaaatataatgttgcatggtacaatagatgctttttgtttctaccttgttggaaataccatatttgcctaaacagacacaattttttgaaacaaatttcatgtaaaataagtataaaactttctggttgtactgggtagttggaactgggaacaatttagtgtaattttattttatgtcatgtaagtgtgtacagtcttcagatttgaaagtcaattattttgaactattttccaaaaaatgaaaatattataggtggttacatttctaggctagtccatgacatcattttcacaagaaggactgtgattaacagaaaggtattgatagacacaggcaaagggttcagattctctgcaatgaaattaaagaacaggagagcatcatagtttgaagaccactggacaaagcaggagccggggcagtattctttaggcaagtttccctgccttctggtccctgtgaaggcacctacagcctatgatgaagtgatctggaacagtggggtgattctaataaagatcccagcagattcactggatcttctatttatcattctcaaaaggtctttttgttaattttaatttttccagctttttatttggaagaatatcaaaactacagaaaagttgcaagaatataacaaacacctgtatactcttcacctggattcactaattgttaatatttggcacatttaatttactttactattattattaattatttcgctggaccatttgtaagttagttatagacataacagttcacccctaaatatttcaggatgaatcttctaagagctaaaacattcacccttacaaccccaatacattggtcacaataggaagtttaacgtgacacaatactgttgcataacatacagcccttatgcaggtttccggttgccccaatacatccttttaagctcttttttaatcgttgtttttccaagatccaggtaaggattatgcattgcatttggtgtcatgtctcttagtctccattaatctaaaagagtaagttagccttatttttcttttataagaatgccatttttgaaaaatccagtttagttgttttgcagacaaacttggatttgtcccattgttttctcattagattcaggaaaagcattttttcatcaggaaggctacacaggtttatccttctgagttcatcttattaggaggcaaaagaagtctcatttttcccattattgattataaacgtaattaataaggaatatgtggaatgacactttgaggctgtataaatatattatttcccaaaaatcttttatccagtggtgttaggattcattgatagtttttgcctagattggttattaccatggtggttaaaaaatggtgatttttggccaggtgcagtggctcacacctttaatcccagcactttgggaggctgaggtgggtggatcacctgaggtcaggagttcaagaccagcctggccaacatggtgaaaccctatctctactaaaaatacaaaaattagctggacatggtggtgggtgcttgtaatcccagctactcaggaggctgaggcaggagaatcgcttgaacccaggaggtggaggttgcagtgagccgagatcacaccgtggcactccagcctgggtgacagagcaagactctgtctcaaaaaaaaaaataagtgatttgtttctaatgctatatctcctacatttattaagatggtgtttttctataaaagcttttccttatccctcttgccctattaattttttaaaagaaagtatcagtatgggctaatggtttttttagtggtgttataacagattaatttcgcaaatcatcaccaacctttttatttttataaaaaatgttcttccatagcttcatttgcaatatcactcactacttaataaaccctgactttaggatttaagactggaatattagtttgctaaatcacttttagttgatagcacctaatttattgctcatttatattctgtctagaatatttcactaaatagttttgtgcagattagtgctttttttcctctactactatatttatgtgtcctgggatagtaaccacatttgtgtaaatctttttcattatgtacaacacttacatatgctgggtatgtacacagaaggtgttcctcaggaaattctttatttattcaattaacttctttagtttgccatggtccataaagtataatgctcaacttaaaattttaaaaataattatgtttttaggaatttttaaaattttagtagtagtttcctttgccagtcctctgatgtttgttttatatatccattctgcagcaaaaacttttttttttttttttttgagatggagtcttgctctgttgcccaggctggagtgtagtggtgggtgcaatcacggctcactgcagtctaaacttcctgggctcaggtgatcctcccacctcagcctcctgagtagctggaactacaggcatgtgccaccacacccagataattaaaaaaaaaaaaaaaatttttttttttttaattttttgtagagatgggattttactatgttgcccaggatggttttggactcctgggcttaagcaattctcccacttcggcctcctgaattgctgggattacaggcgtgaaccactgtgcttggcataaaacttttttaaagctaatttttaaattatagaagtggtagacacttaaaggtttaaaaaacccaaatagtatagatgatataaaatgaaaaagtaaaagtctccctccttctaaaaccctttcacatttaaatactagcttggcttagaaagataactttttggggcatttttttggtaaaatctctattttggattatgtcttcattacacttgggtttatattttgaactatcatctggacaggttttcttaaaatgggggttatagctcattaatgtttttcagtgacatgcacaggtgtgattcaaatctcctttactgtttcagttagcaaagcatggaatgaaggttgtccttatcagcagatcaaaggataaacttgaccaggtttccagtgaaataagtaagttctcacatcaaacaaaaggaatacatagctaattaatgttttcaagcagttatccgatactgacatagttatttctagttcaggaaacttctttttcaaggagagatatcattaaagagcatgaaaaagcacaggatgctttaaaaatggatcatcaattttaggctgggtgcggtggctcacgcctgtaatcccagcactttgggaggctgaggcgggtggattacctgagatcaggagtttgagactggcctgaccaacatggtgaaaccccgtctctactaaaaattaaaaaaaaattagccgggtatggtggcgggcacctgtaatcccagctactcaggaggctgaggcaggagaatctcttgaacctgggtggtggaagttgcagtgagccaagatagtcccactgcactccagcctgggtgacagagtgagactccatctcagaaaacaaacaaacaaaaaaagttttttaaaaattgttttagggtgattgtaatttgcttaaaatgtcttttactaatttatttttgtcttgtcagtagtcaaattatctgattattttatcgtattctgctgaaatgtctaaacttgtttgctgtgacttcatttcagtattcctgaatgttttttactctttttatctcagtgtttctaaatgtataacacatatgtgttaggaaaaatagaaaagatagcaatacccatgtgacagggaaaatcttttgaactttcttcttaggcaattatacttgagacctgaattacaatatggcaaagactcttaactaacttctactcaatcaaccagatggataaaccaatgctgttcatttgtttggtaaaacatactaactgatgtccccagtttgctgaccatttgtggccaggaagcttctgtgtataatgcttatatacttttatcctcacaaatcaaattgtttacttattaagagtcaatttgtgtttgtttccaaacttatgttgggtatattttttattaaatattctgtaaaatgatgaactattagtgtaaaagctagagttagttctataaaaactaagttgaatgctctaaaaaaagtgagtaaaattacttctttgaaaaattggccgtcaaattagtgttgaacaaagacaaatgtaaaatattggaagaacttacaaaaaagaaatctgctctcctgattgtttcatatgtgttgaagtttgtgctgtactttactagaactgaaattgtaatcataaatgatagaatatgggtgtgatgcatgcaagaaagactggaattcaagtccgcagatccaatctcaaagacaaggtcttggccctacacagaggattggtgaatgaattacatttatacatggtttaagtgaaaataaaatgattaccatgtgtatttatctctatgagtccttgttttaactaacttctcagctaacagatcgtccaaattctttcaatgagaattgatgagagaggatttcttctatattttgttaccaacattaccacctactgctaacatttatatagtgccttattatttattcattctctcacatgtattgtctcctttgattcttccaacatacttatgaggtatattttgttactatttctttccagaccatagctggtcctattggacagatagcttcacttcatctttagataaaaaacagagtgtattcgtctgtttttcatgctgctgataaagacatacctgagactgggtaatttgtaaagaaaaagaagtttaatagatacacatggctgaggaggcctcacaatcatggcggaaggtgaaaggcacgtcttacatggtggcaggcaagagagaaaatgagaaccaagtgaaagaggtttcccctataaaaccatcagatctcatgagacttattcactaccatgagaacagtatggggggaaccgcccccatggttcaattgtctcttaccagatccctctcataacacatgggaattatgggagatgcaattaaagatgagatttggatggggacacagccaaaccattcacagcgccttattggagattcccaatattaaatatgttatatctttttttttttttaattattttaaccttgctgagagtacagatctttacaaagctgagcatgtggtatatagatatacaatatatctttggcatttgaagcttttaacattcaagatttcagctatgtaaatgcaaccccaaagggccaagatatacagtattttacagttttgctgaggtctgaatctgaattaagccatgacactaatgagcctgaggtagttactgagatagtaggtgaatttaacatactgcctggatcttagcactgtttcattcttagcttcttgtagtcttgtatataataactcttaaagtgatttaaaaaatgttgtgtttgtgggtgtgtctagaaattgcctctcaatgaatgcatctactagttgctagaaataaaggtacataggcagaaagtagatgcttttgactaaatggaatgttgcattttgaaatgctatgatatgaatgaatctaccgtctactcgatacagaaacaagaaaagctacctcatgacactttcagcaagtactgcagcctgtacaaagattgctcagtgactcagaagatatgctttaatgatatttgagaatttggttaactcatgatatgaggtggcacgtgactgttggcagaaatgtgattctggagaaagagaggattctgttcaaacattttcatgaaggaacagatggtaaagacactgaattgacctttattaaaaggcatgggtttttatccttgttaaaatttttgaaaaatgtttttctgggcataatatgaatttaataggagaggtgatatcagcagactatgtcttctgttctaagctgaaaaaatacatagaggagatttataagttaagacagatttttaactgagatgtaaatcacctctttgggaggataatgtttgcatgaacatatttattccaggagaaagaaggaccagtatttaatattgtcaaagacagactaactctgcattcctttgattatacctttaacacatctttattgaatgcctgtgtaccaggtactgtgctaggcagtgaagataccatggtgaacaaggtggcatgcagtccctgttctcaaagaacttaagtgcaggagacagtaaaaacaaataggtaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacaaataggtaaaaaacaaacaaataaaccaaaccaaaaaaagcacacacaaaaaaaacagacaaataaataattgcagcctatattgaatgccacaaaggaaacaaagggctagagagataacaatagagaagttcttactttgttgcagcatggtgagttttgcgattcgcaaggtgataaaagggctagaataacggcctgttgcccatataacagcactccagtaacaaaactggagccttactgaaagacctatcctctgggcccatttgggggtataatggtggagggattgtgtgtgtgcaagttgcataggatacatgcactaacgtttctattttcttaagccttgttatgcaagggaatttatggccccccagtctcattaaactgtagcctattatggagtccaagttccaagtttcagtcagccaaccaagtcaaccaactatatgaactaaacattaaatcctaaatctctggtaagtgaatcataaaaatatttggcccaatctggtattatattgttttctgttgtgggtgtcagtgagggatatttgagttaagtcttgaggagaagaggaattcttttgctaggaaactgcccttactgttgtggtggggttattagaggatcttcaagccagagaacgccaatcttgggagacacaggcaggagaacagactagtactatttccactggaaagggaggttcagagtagcttgggagtccaagattctcagtttcagttgagtctgaccaaatatccccatcccaaatctcagggtcacactttttctcattcagtgctttcaaatgagactaggtgtctgtggaattcaacttaagttgtaattctgcaactggcacatttaaatctgatgttagcaaggtgaactccatggctataaaacataaaactttttactggggctaccacggaagttctctggttctctcatggtaaatgtgagctgacagtttagtgatctgaacttgccgtttttattctataagtgctccagtatattcagaagaagccacagcttagcacagtctttgtactcatcatttctgccaaactcaaatgtagccaccatttggtccctcaaggcacttctccagtgggtacttcattacaattaacagccagggttaatttgatgaactgtcataccacttattgcataatggattgctagtatcccatttcctattgggaaggggcttaacactatgtctaagcccaaggacacaatcaaaccagtgcaaaagtcctttgaagtttgtcttgtgatcctactcctgaaactaattcgtggatcaggcagcgcccagtcaggaaacagaagtcacacaatttagtttaaccaggataacttgtctcttctagtccaacatttaaactcactccaatgggttgaactcatcgttcttacttccctgtgtgactgaaagacaaaaagaggaaatgggggattgatgaggaaattacttgacaagtgaaaaaaatcaaggactttttttttggctgctctcaccttcgaaatctgtcatcatataaacttgggcactttatatcaagaagtaattccttatgaatgtggagggtagcctactcatcagtgtcaaaatttttaagaaaaattttgaatggattatatgtagttagtaggacactaaatgtttcaccaacaatggataagtgctttgtcaggattgactgctttgatgaaattacagttctttgtaaggatacctgtcacccttttaattaagacaagctgaaagccatcacacatgtaataagcttattttattatcattcttagccaggattattcatatattaaatatttttgccaattttgattcatcaaagaaaaaaactagaaatttttttaacactgagctgagtttttatttgcaataaagcataataaaaaggagactagctttcagaacaacctgttggttcacagattgtagagatggtgatatttataattcatattattttacagtcctttcttccttctcttttcgtttcatttcttttctttttttcttttttgagacagagtcttactttgtcacgcaggctggaatgcagtggcccaaatatggctcactgtgacctcaacctcccaggcccgagcagttctcccacttcagcctcccaggtagctgggactacaggcttgtaccaccacacttggctgattttttttttttttaaattgagacaaggtctcactctgtcattcagcctggagttcaatggcacgatcttggctcactgcaacctacgtctcccaggttcaagcaattcttgtgcctcagcctcctgggtaactgggaataagaggcacgtgccaccatgcctggctaatttttgtatttttagtagagatgggggtttcaccatattggctaggctggtcttgaactcctggcttcatgtgatccacccacctcggcctgccaaagtgctgggattacaggcctgagtcactgctcccagcctaatttttttgtttgttttttcttgtatttttcgcagaaacagggtttcgccatgttacccaggctggtctccagctcctgagctcaagcgatcctcccaccttggccccccaaagtgctgggcttatacatgtaagccactgcgcccagcccacggtcagtatttctgattggatgcagtttaataaactttgatttttaaaactgcatatttctttcttggatttaaaaaaatcaaaccatgagatttctcttttttgtaacttatctcagggtgtaaagcttttggatggtcctgtaactccatggctttatctcttgaaatgcaatgcttttttagaaatgtaaatcttactggtctatagtgaacagaagagtaggataaggtaagaaatgtccatttcactttttcaggccttacttggaattaaatttctatagttaagatatgaatttgaccaaataagtttgttccacaattttctgatgcagtaataataccattaatacgatgccttgttatatttagcttgttttgttttcataagtacaacaggaggcattagtaaacacctgtagaccttttcgttttatgtctaataaaactaaaaccacatgatgttaggattagagagttaatctcatatagccccatgagtcatatttttaaaactgcttctttaatgctagaaatatctttgttgctcgtagagtttatatgttacagggccaggaataaaacccatccattttgcctctactggttttgcccatagtacctgtaactgtagagatattctacaattttgtcaatgttcctggccttccagaaagtgacgttctgtactgcctgtaagacagactccacaaggcagtgagctagtcccaggatagtttcctgaaaggtctttgaagcattgtttccacataagagaatccttgttccttactagtgggcttgtcatgcttaattaaatgaaatttaccattaaatgaaacatttctgttatggtcatggttacaaaattgttttatctaattatatcctgatagggagaaggatagattcttactgagacaatgcaaataattacattgtcatgtaaaataaaagaactcaataaaggcatgttgtagaatatttggccattgctttgattagttttacagacaaggccaatcaatatgtgttgtattttctatataattaacatctttaaatttatctaatgatttaccagtttatatttcagctactgttgcagcgtaacaaaccaccccaaacttattgtggtaaaggaacaaccattttagatgctcacaagtttttctggtcaggaattttgtcaggacttagacaatccttttgctcctcatggcattactgaggtcactcagtgatattttgctgacggatggtctggtctggaagatctaagatggcttctcttaacaggtctagtgacttggcaggagatggccagaggctggacttagctgggactgttgactagaacacctacatgtagcctctctagcatagccatatcagggtaactggacttctcacatggtaactatattcccccagagtgaacattccaagagaaccaggcagaggcttatgtctttgttgcctggtctcagaattcacgtagcattattactaccatactctgttggtcaaagcagtcatgaatctgcccagatttaaggggagaggaatagactctaccatttgataagggagtggcatggtaactttggcaaagaacatatgggatagaagatattgttggaaaatacgatctggatttggaaaatacaatctgccagtttataagctatattaaagtttcccagggaatatttttcctgaattctgtgggatcagtaggaaaaacatagaattccaagagcgttcattgcaatttgcccaagtatggctaactaccatgagggttagtgaaaaattaagaagaaaaaaaagacgttttctcaaaatattaagttttttctggttctatttagtcttgcaaaattaatttttgttccattggtcagcagcatgcttttacaaaatgtttaattttggaatatagagtcctataaatactaactcaatttcctggtacaatttgtcagattgtctgcttttgtggcaatgttgggttacactgagcaggaagcctgacttacactgagaatgagttgattctctgcagcatcagtaatagccaagagtccagatacagcccttgctgaggctaattagtcttttgatgatcttcctaaagactctattttctgacattcagtttatggccggggcccttagacaagcttgaaggaaatgtagcaaccacctgttaataagactgatggttaatttattataataattaccactgtcagaatggaatcccctagtgggatataatatggaactaattaatatgatttagtcagtgattatcctgagggtatgagccttatcatggacattaaaggaattgatacctccagagactttcataatgtgtgtttttaaattgccaactattaagagtattttgtacttgttgataacgtaatcttagcaatcaatttgttcatagttgtgccagtctttgcatagaatcatgaatatgtttctattcatcctgaaaagtagtacatgttgagccatatttattattaattacaccttgcctacacataattgaccagggtgttgagcttctcttattgatttaatagttcttcccatatcatgggcttgataaacaaagcaggtctcataagagagctgaactaattaaagatgtggaatatgctatgtatctagttacacctaatgtcctccttgctcagtagtgctgcatagcggttaatcaagaagcactgaagatagtttgggtgtaaagtatatcttaacaattttatttttcttcatctgaggcccaaatttgtgaagagactaatcgttatactgacatataagcataagtcttaggtacccaagacaagaaatgattatagtcttaatttggtatgacagcaattaaagcatagctacaagaaataatggttattagcaaatctagcatatacagaaacaagaaacttttgttcgaaaatcattcaacaacatgacaaaagtcaacacaaaagctcaaaaagttaacaggctcttaggaagtgagagtattctaaggagataaggaacctttactagccaggctggatactgaggcgcatagtaattttgatagctttatcattaagagaagactatattctcaaagatcaattttcttctcaacaactggttccagacagtttaattcataagctttctttgttgatttcaatatattttatacccttatatatatatatataaggttatcttatatatatatatatcttatctacatataagatatatatatagagagagagagagatgacaagttaatactttcaactagcttaaaatacgttaactttacattctgtgattattcttcaagttgttgcacataccacattgagttctccatcctaactggagttttctgtatgaattttaatctttagaaattgtccagggcaaccaaagattctctttatttcacttgctgtgatatttgtatagtatttcaaggtcagttaagaattatagatattatatttaagttgacattgcagagcaacatgatcattgttgataccacgtttgtccaagaggtgatatttgaaagttttccacagatggcgtgaagagttacttagtttaaatgatttggggaatgtctgaagttcacaagtgtcaagccttggcattatatttcatactgtgataatatcagaagatatatagctatttttaaaattaaagttatcaaaccagttttaatttggttagggatttaccttaattaggagtgtaatgtgaaacttggattcttatataactctgaatttatttaccaatattagaaatgtttcaaaagtttatgttagtacattttaaaataatgactagttgttagccaaatatctgaattttaaaaactatcactgtttgagctggccatttctgtggggaatgatttgtctgagattgccagcacatttaaagcctcagaagttttgtccttgtctaataattttgagtttttttcttcttagatttaaataagcacttactaagtctctataagctatccagaacaggggcttttccaaatttgaaagagagaattgatgggcagtattgttcacgtcttctgtatccttattggtttcctttccactttctccatcaattattttgagaggggcaatgaaatcaccgactataattatggatttgtccttcacaatttttctatttatctgttattaggtgtattaacatttagagttgtatgtcctcttgatgaattcactctttatcattatggaatgaccctctttattcttggtaataatctttgctctgaaatctactttgatggaaatttactttgtctagctttcttttgattagtgttagcatggcatttctttttcctttaatctataagtgctttatattttaaatgggtttcttatggacagcatagagttgatctcgcttttttatctaaattgatggtttctgccttttaatcggggtccccagaccatctacattcagtgtcattattgattgagctaaaacctaccaattgctttttgtttgctatttattctgtctgttctttgttccctttttcattttttctgcctgcttttgaattgcatgctttttataattctaattttatttctatcctcggtttgctgactgtatatctttttttctttcttttaaaagtcttatatttacatacatattaacatttctgatgctcttcattcttttatgtaaatgatttcaatcaggaatcttttatttcccttttcccctgtctgaaggtcttcctttaacatttcttgtagtctggtctgctgatgattcattctttttgtatatctgaaaaaaaaaccctttacatttgaaaggtattttctctgggtataaaattatagatagatggtttctttttgttttctggtacttaaactactttgcttcactgtcttctggcttgcattgtttctgataagaagtcagctgttattcttaccattttatcaccatgcataatgtgaggtttttctcttttctggttacttctaagatttttctctttatcacttaagtttttttttttttaattattattttgcctcttcttgtagtttccctacttggagtttgttaagcttaaatttaagtgttcatagttttcggatagtttcttcatctcacactctttttctgggactttagttacgtatatattaagttgtcttaacccactgatgctgtctttagtttttatttgagtttcttttctctctgtgtttcatttttggacagtgtttatttatatgccttcacattcaccaacgtttttttctgcagtgtctaatctgctgttaattctgttagtgtattttaaatccagacattgtcctttttctctctgtattaaaatttctgccaattttatatcttctacaccttttctttttttgagacggagtctcactcttttgcccaggacggactgcagtggcactatctcggctcactgcaagctctgcctcccgggttcacgccattctcctgcctcagcctcccgccactacaggcgcccgccactgcgcccggctaattttttgtatttttagtagagacggggtttcaccatgttagccaagatggtctcgatctcctgaccttgtgatctgcctgcctcggcctcccaaaatgctgggattacaggcgtgagccaccgtgcccggcctcgccttttcttaacgtgctcactctctagtttcttgaacatatagaatatatctatcataattattttaatgtgtttagtgttttgtctacgagttcctcaattagtagactactaattagtagacagacttgactgctgggctctatctgaattcctcttctcctcataatggtctagaaaatctctccagactataagctagggtcatagggctcacctcatttgttttctttctcttagggacttctgtcatgcattctttattgtccaatgtctggaaaccattgcttcatatattttgtccatttttgttcaggctggtcaagtgatgtccagttttttagtttaaggccaaggaataaatctagtctctgttacaccgtcatggccagaagcagaagtccctctcccctcctttgttaaccatcatagatttcctggtaaatattaccatcattgcatgtgtccataaatgtttggtctacatcacacttttaaagagagacaaggacacaattcttttgtatttcgttgtaccaggcctagcatggtttaatgggtgtgggcacttagtaagtattgttttggtgactgaagaactactgtgaaacttcctcatgttcttactcttgcacagaaagatattttgaaatttagcttatggtccaattttggcacacatggttttttaagccaatatgagaccatgttgtaaaactgtctaactaaacgttttctctaagtgtagcttatttcaacttcattactgtttgttaccagtcgtttactctgatagagaaaaacatctgtaatatgggtggatattttgttaaaaatgtagcatacccaccaattagttggcccagctaaattagcatgtgttggtctgcatctccaattaaggcagctgcttgaatgttgctgttctacagctggcattagggatgtgggagtgtactccaccgtggccagacactagctgtacctctcaacatatttgcctatgtttgtatggtttctttaaaacagtaaagggtctttccaattggattattgatggttcagtgacttttgtgtaaaaaaaaaaaacactttttttggttgggaaatgtgggaccaaggtgttattaaatgagtaccatttaagtagagaatgtttcgcctcccacttttaaaatttggttgttgttctaagtggataattggaatttgaggtacaaccttcagctataaaagaatttgtagaatggcatattcttggaaacatttataaaatttagtagttttatgtggggattgcttcctttcttatcatgaaaagaaagtactttgaaacttttattgaaaaggttcactttaacttgatttttccatcaagtgaagttaaatattttcttgtcaattaccagttgttttgatcatcttattttgccattatttattaaatgcatatttttgttacatgctaatttttaaaataactacaaaccaattaggtaatttaaatgacctagcgttatgtctaatactagaatcaaagagaaaaggaattcattaacaccaataggaattttcacatatttgaattatttcatttctttgctattaaaagccaatagaattaatatttaacaacaccaggccactaagaatagaaaaaatgatatggaatcaacttttaatgtgctttcattctgtttaatgctgtagagatgtacaaaatctaagacgcaatcattctgcaatacctgatgaaagtattaagtcacagatgtaaatacatttaacttttatggaacacttaatcatattcaggcatgtttggaaaacatactcctcacatgatttaaaaggcatctctgtttaggaactgctgatggatcaatactctcattttataaatatgaaaacgaagtctggggagagaccaactcacatccagtgaatggcacaactaactgagttctaatctttgacttcttgtgctgtgttctccgtgactccatgcttttaagtgtactttaagtattgtaggtgggtaactgaataacttttggaaggtgcatccccaaaacgtaatgtcagaattacatcacatcaacagataaaacacaaactaaattaaatttgcagcatgactatgtttgaatgcaattgcctgttggagttattatattatttaattgatatatacaataatttttcctttttaagacatagccatgcccttgtattcatttatttagagacagagtctcactctgtaccccaggctagagcacagtagcacaatcttggttcactgcagcctctgcctcctggtgtgtccagagttggttccttctggtgggttcttggtctcactgacttcaagaatgaagaagccaaagaggttccccttgagtgttatatagcgcttaaagatggtgtgtccagagtttgttcctccagatgggtccagaatttattccttctggtgggttcatggtcttgctgacttcaagattgaagccacagacctcactgcgagtgttacagctcttaaaggtggtgtggacccaaagagtgagcagcagcaagatttactgtgaagagtcaaagaacaaacattccacagcacagaaggagaccagagcgggttgccgtggctggctctggtggccagtttttattctcttatttggccccgcccatgtcctgctgattggtccattttacagagtgctgattggtccattttaaagagtgctgattggtccatttttacagaatgctgattggtgcatttacaatcctctagctagacacagactgctgactgatacatttacaatcctctagctagacagaaaagttcacgaagtccccaccagactcagaagctcagctggcttcacctctcaccaggttcaagtgattctggtgcctcagcctcccaagaagctaggattacaggggcctgccaccactcctggctgatttttgtatttttaggagacacagggtttcaccatattggccaggctggccttgaactcctgacctcaagtgatccgcctgcctcagcctcccaaagtgctgagattataggcgtgagccactgcctcactgccttaaatatgctggcccctactgtgtatttaagcgtggctttaaatcagtacaattagtaactaaagaaagctaaacagtttttatattctaaaacaagctttgattaaaaacaaatagtcttacagtaatattttaaatgtttcctgaaaatataatgaaataagcatccatagttgattcttagagcaattatgaggacactgagacctggcaacgtcacccagtgcacagtaaagctgagcttcaattgcccatcacctaattgcaggtctagttctcattccacttctagattgtgatgttgatatttctaactgttcacccccttccagttttcctttatggtattaatctaaaatctcaaggcctcttgaatgtatgacattgtttttcaattatgaatcacttaaaatcagtgtttttgacttctatttctgaagtgaagaaatagaatggaggatgctgctgtcactacccatttctagaaagcctttattcagtctttgtgtgccttttactagtggtttatgtgcctggatgttagaccagcaatgtgggggccaccctcatgtgtgagtctctagctttcctcctgcttcagtttggctattttgctttgatcagttttgtaaattccattttgtattctttcgatagaagggcctattgcaataaagtgaaaatcattgctcagaaaattctccacattttctctaccaatccttattgcttccttccaacaaaggacttatattactcaaagtgtgtctctacgtgcctagccctctatcctcagagaaagaaatgccatcttctctaaaagctaacttttccctggtatcttgatccccagtgtcttcctggttccttaggacttgttcccatagcattcctctccatctgatatgtctcaaacagttacactatagacaaattttgttgagctgattgtttgttttaaaaatcagtacatttcacttactcaaatctgaatttatattttcttctgaaaatttacaggatctgttaaccctgggcccagcattcttgcagggcagcaatccactggagctgtgtcctttagatgggaatgctcctgtcaagttagcccagcccactcatatagtgcagcacctacttgcttttattaggacctcttcacttgcttaagtaatggacttggcactgatgacatttaactctctgccgggcacagtggttcacacttgtaattccagcgcttgagaaggccaaagtgggaggatggcttgagcccagaagttcaaaagaccaacctgggcaacatagggagaccgtgtctctacaaatataaaaagtacaaaaatcagccaggcttgatggtgtgcacctgtggtcccagccactggggaggctgaggtggaggattgcttaagcctgggaggttgaggctgcaatgagccactgtctcgtcactgcgctccagcctgggtaacagagtgagaccctgtctcaaaagaaaaagaaaaacaagtttgcagtctttattatcctttaaggcctcttagccttgcaggacatctaaagagaaattctatattgtttgcaagccatttcagaatatttgtaagacgcatagaacattttagtaataggatttgccttattttcagtgaaatttatttcttctattatggtatatttataaatattctccactaattttgcttttgtcacataacaaatatctatagatatgaatactaaaacaatgtaaacttcggacataggaaaatcacaaaaatacgcatgtacaggttagtgagtgattagagagggagagaatcacacgctccctactactttttgtttttctccccagagggagccactatcttaatttctaacattatcatttaattttgacttcttggactttatagaaattgtatgatacagtatagtttcttttgagttttggcttcttcagctcagcattaatgtttgtgacattcatccatatttttacatgtagctataattcactccttttaatcgctttatgaatgtattacaatttagttgtatatccaattgttgatggacttttgggttgcttccagtttctggctattatcaataacgtgactatgaacaatactgtacatgtcttttggagcacatatatacattatatacattcatttctgttggatatatatgtaggagtggactcatattcttttttttttttttttttttttgagacagagtatcgctctgtcacctaggctggagtgcagtggggcaatctcagctcactgcaacctccacctcccgggctcaagtgattctcctgcctcaacctccccagtaactgggattaaagacacacactactatgcccaggtaatttttgtatttttagtagagatagggcttcaccatgttgaccacactggcctaggactcctgacctcaagtgatcgacccacctcagcctcccaaagtgctgggattacaggtgtgagccactgcgcctggcctcacattcttgatagtctctttctcatgtataaagcattgctgtttctttcaagatctttggtactgagataccgagtacatttctcaagatcatattacaaatatggtagcagactcagaatttgcacctttgtttcttctataaactgtcaccttaaaaacaaaacaagacaaaaccaaaaacatttgatgagacctgtaaatctaactattttcatttattttggtagtttttataagttttacaagtaattgcatatatatatatatctctgtctctctcgaaagctgaacatctaacctttttatttaactgctttttaaagttttcaacctacaaaattttatctgttggttcatgtggaagtttaccttcatttagcatggttccaagtgttgagtcgttaatagtgaggagacataaagtacattttaaagatcctgttgatggagagtaaatatgttgcagcttactgcattaattggaaaataagccatcataaaatccccctactcctgttttctcttaaaagttcattcttgaaaatgtcatagaacaaataggtgtgctcgtttaagttggtgtgtactaactatctcagcaaatgatgagttaaaaattttggggttttttttggcattgccttctttccatcaccccttcatgcacagtgttaaaacattattaattgaattttctcttggcacaattacaagatgacttttgcaaggagggcttaatgttatttaaatcatcattttacatagcaacattgcctctgggacttttatacaatgcaactgctttggtagatgaaagaaatcaagtactgctgcacagacttttaggagtgttaatatatttaaaaagcaagtaaaatgccgatgtactagcttgtgatccagtatgaatggaaaataagtccatgggaatggttactttttcttgaatagaacagagtatcatgggaatgtgagctatttctaatctttttttgtgaatgagttttctttagattaacagattttcacctgatttggggggaaaagaaaaagctttcagccaggcatggtggctcacccctgtagtctcagcaccttgggaggccgaggtaggtagatcgcttgagcccaggcgtttgagaccagcctgggcaatatagtgagaccccatctctacaaaaatacaaaaaaatagctgggtgcggtggcacgtgcttatagtttcagctgcttgggaggctgaggcaggaggatcacttgaacgtgagaggtggaggttacagtgagcagagattgcgctactgcactccatcctgggcaacagtgagaccctgtctcaaaacaaaaaactccacaaactttcaagccattttgaaaatgttcagaaatttcttgaatattttattaagaacattttatcttactagatttgaaaaatattttgtggtttatttattcattttaaaaatagaattaaaaaaatttttttcagagataaggtcttgctttgtcacccaggctggagtgtagtggtgtgatcatagctcactgtaactttaaactcctgggcgcaagcaggtctgcctcagccacccaagtagttagcactacaggtgcacaccactatgctagctaatctttaaatttttcatagagttggaatcttgctctgttgcccaggctgctctcaaactcctgacctcagtgatcctcccaccttggcctcacaatatgctggaattacaggagtgagccactgtacctggcctaaaatcgactttgtttcttagagtagtttgagttcacagcaaattgaacagaaggtaaagagacttcccaaatactccgtgtccccatatgtatgcagcctcccctactataaaattcccacatcagagtgttagattagaacctatactgacacatcgttatcacctaaagttcatagtgcagtgtaaatttttcatggccttggaaggaatacatttaaatctcaagtttttgttgtatataccacctacaaaatgtttttcctagatgtctacattttgattccttagcttatttctcttttgactttttgaaaatggaatagaaagtatattttttgctttttgcccttttatgtttttaagtttaacattaaatgtctttggaaaatatattttactctatgcctctcttttctgtttctgttgtacatcgggtatagcctgaaagggatccaggtagatcctaggtcacatatgtgtatgcttatagaaaccaggctggtgataggaatgatctaagtgggctggggtgaggcaaaactgaacacatgccccatgtaaaggtgtcagctctagctgttactacgctgtagggcaagctcaggggtgccacattttccaatttttttaaagaatttttaaagaaaaccaagatgttttatgtaagactttgtaattttttttttttttgagatggagtctcgctctgtcacccagctggagtgcagtggcacaatctcggttcactgcaacctctgcctcccaggttcaagcggtactcctgcctcagcctcccaagtagctgggattacaggcacatgccatcacgcccagctaattttttgtgtttttagtagaggcagggttttaccatgttggccaggatggtctcgatctcctgacctcatgatctgccccccacggccttccaaagagctgggactacaggcatgagccaccacgcctggccaagactttgtaattttacatcagccctaattggaatgaaagaaaactgagggtccaacaacccatggaccactcttttcatttatttatctttatcaagtcattatttctataacaattaaatgtgctagagactcttcgaagaggtttatagaaatcaactcattgaatccttgaaaacccctttgagattggtacttatattattctcatttgagacatgatccaagtaagatacagaggggtaagaattccaaggtaggtggaattctaagatgttccccaagattctcaccttcaggtatatacaccccatatgattcccttcccttaagtttaggtgggacctgtgagcatcatggatgccattcttgtgattggttacattatatggcaaaggcaatgggagtttatagatattattaaggtccctaatcagttgactttgagttagccaagaaggagattatctctggtgggcctcacccaatcaggtgagcactctaaaagagggcccaagtggagacttgaagcaggagaaatcctcatattttgaccttgaagaagtaaactgccgtcctgtggggagggttatgtgacggggaatggcaggtggtctctaagagcagagggccccagtcttacaactgcaagaaactgagttgtgaacaaccagtgaacttgaaagtggcgcctgagccttagatgaaatcctagcctgatgagaccatgaacagcggagtcaattacattacagaaacagagagataatacatatatattgttctaaacagccaagttctgtggtaattgtgatgcagcagtggaaaagtaatacatactcctaggatcacattgctgatgagcgacagatgcaggttttggatccaggtgcccaactacagagcgtgctgtcggggatcatttggtggctcctgatccagagaactctttgaacaaataattttaagaattttttttttaagtttcaactcttttgtgaacacaaagtttatattccattctatgaagttctgctttctaaatccacttttatttgcaactcaaatttatttcttttttatttatttatttatttattttttattattatactttaagttttagggtacatgtgcacaatgtgcaagttagttacatatgtatacatgtgccatgctggtgtgctgcacccactaactcgtcatctagcattaggtatatctcccaatgctatccctcccccctcccccgatcccacaacagtccccagagtgtgatgttccccttcctgtgtccatgtgttctcattgttcaattcccacctatgagtgagaatatgcggtgtttggttttttgttcttgcaatagtttactgagaatgatgatttccaatttcatccatgtccctacgaaggacatgaactcatcattttttatggctgcatagtattccatggtgtatatgtaccacattttcttaatccagtctatcgttggacatttgggttggttccaagtctttgccattgtgaataatgacacaataaacatacgtgtgcatgcgtctttatagcagcatgatttatagtcctttgggtatatacacagtaatgggatggctgggtcaaatggtatttctagttctagatccctgaggaatcgccacactgacttccacaatggttgaactagtttacagtcccaccaacagtgtaaagtgttcctatttctccacatcctctccagcacctgttgtttcctgactttttaatgattgccattctaactggtgtgagatggtatctcattgtggttttgatttacatttctctgatggccagtgatggtgagcattttttcatgtgtgttttggctgcataaatgtcttcttttgagaagtgtctgttcatgtccttcgcccactttttgatggggttgtttgtttttttcttgtaaatttgtttgagttcattgtagattctggatattagccctttgtcagatgagtatgttgcgaaaattttctcccgttttgtaggttgcctgttcactctgatggtagtttcttttgctgtgcagaagctctttagtttaattagatcctatttgttgattttggcttttattgccattgcttttggtgttttagacatgaagtccttgcccatgcctatgtcctgaacggtaatgcctaggttttcttctagggtttttacggttttaggtctaacgtttaagtctttaatccatcttgaattgatttttgtataaggtgtaaggaagggatccagtttcagctttctacatatggctagccagttttcccagcaccatttattaaatagggaatcctttccccaatgcttgtttttctcaggtttgtcaaagatcagatagttgtagatatgcggcgttatttctgagggctctgttctgttccattgatctatatctctgttttggtaccagtaccatgctgttttgattactgtagcgttgtagtatagtttgaagtcaggtagtgtgatgcctccagctttgttcttttggcctaggattgacttggcaatgtgggctcttttttggttccatatgaattttaaagtagttttttccaattctgtgaagaaagtcattggtagcttgatggggatggcattgaatctgtaaattgccttgggcagtatggccattttcacgatattggttcttcccacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgactgttgttggtgtataaggatgcttgtgatttttgcacattgattttgtatcctgagactttgctgaagttgcttatcagcttaaggagattttgggctgagacaatggggttttctagatatacaatcatgttgtctgcaaacagggacaatttgacttcctgttctcctaattgaatgccctttatttccttctcctgcctaattgccctggccagaacttccaacactatgttgaataggagtggtaagagagggcatccctgtcttgtgccagttttcaaagggaatgcctccagtttttgcccattcagtatgatattggctgtgggtttgtcgtagatagctcttattattttgaaatacgtcccacaatgagaacaaagacacaacataccagaatctctgggacacattcaaagcactgtgtagagggaaatttatagcactaaatgcccacaagagaaagcaggaaagatccaaaattgacaccctgacatcacaattaaaagaactagaaaagcaagagcaaacacattcaaaagctagcagaaggcaagaaataattaaaatcagagcagaactgaaggaaatagagacacaaaaaaacccttcaaaaaattaatgaatccaggagctggttttttgaaaggatcaacaaaattgataaaccgctagcaagactaataaagaaaaaaagagagaagaatcaaatagacacaataaaaaatgataaaggggatatcaccaccgatcccacagaaatacaaactatcatcagagaatactacaaacacctctatgcaaataaactagacaatctagaagaaatggataaattcctcgacacatacactctcccaagactaaaccaggaagaagttgaatctctgaacagaccaataacaggatctgaaattgtggcaataatcaatagcttaccaaccaaaaggagtccaggaccagatggattcacagccgaattctaccagaggtataaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaactcaaatttatttcttcaagtttttctctttacaagtatacataccatgaaaaattagtttattaaaaagtaatatatcttctgtattgtgaactaattttaatatttataatctcttaggaataaaatgttaaacactgagcattttagaatatgtatttactgaaagctttttgtggtattgtagaaagtttattttctttgattcaaattttttaaagatgatataatattttagaatttggcagtttaattaatgaggttcatctcaaatattttgaccttcaaaatttatggcttgccttacatttcaaaatcatgagatagaatttatcttttatcactttgtcttcatctagtttcaaatatgtggatgtgaaatgagacctgcttaaattagtggagaggacatggtgtggagtataatctaccaagtgggcaataaaaattctaaggaaaacataataggcatttatcaattcttcttataggcattaatttgactgatcctagttactaattattaaggattactaagattctgaaattgcctgaaatccaggcttaaaaacagtgttctattttggaatgggaaataaacttacaacattggttttatgcaacatgctctttaaaataccaagagctgtttctggaccatgatactatgaccatggattagtcattaggagacccagattcatctgtcttcctctgtgaatctttgtggcccgagataccttgctgtctattgtactttgtgtaaaacaggtgtgactgaattcacatctgtgattgaagactctgtgttccacataagtgagaagattgttttaaggatcaaatgagaatgtattggagaacattttgaatgtaaggcgagtttaactttcagtctttgcctttgctggtataatatgttcattgctttaatgggccaaaatgagaaataaaactgccagctgccctgaacagtaggcaaaatattttccacatgatgcattaccgctttcacattgggtaggatgttcaaggagagttactgaatttcgttcatcttactactgtttatcatcctggtatctagtacctactgataaagaaaacttggtttcttttttcattttttatcctaattggctgcagaattattggtaatccagtgacatttgcaaaataattttgctgacctgtatatttgagatagtctctgagatttcatgggaagtattggtagcaggatgcagatgatctgctccctctcatcccccagtgccctctccactccctgttgctgcatatcatattgccttacacactccctgctgctcaggatatcatctcatgtgtatggtattcttttattttttgagacagaatttcactcttgtcgcccaggctagagtgcaatggcgtgttctcagcttactgcaacctccgcctcttgagttcaagcgattctcctgcctcagcctcccaagtagctgggattacaggcacccaccaccatgccaggctaatttttttatatttttagtacagacggggtttcaccatgttgaccaggctgatctcaaactcctgacctcaggtgatccacccacctcagcctcccaaagtgctgggattacaggtgtgagccactgcccctggcctatgtgtatcatattcttatcatacatatgttacatatgtaatgtatgtgcataccatacatatgttacataagcatacatcaattaggctgctcaggatatcatctcatatgtattgtttttagtctttctaaggaaaatgtttagaagctagataaagattattagaacgtgagttatcacctgtctttaccattgccactgggataaaataggtgaccagggttcacaaatactccagaatgctctggctcagcatggttctttaatgcattactcacattcttttctttatgacttcgtgcctttggctgttgcctgtggtacatcttttgtcaaattcttcctgcacctttccccaaggtgaccttaactagaatatatgtggccctgccttggattatgatttgttttacatactttattttttatatatattataacagatatgtatattttataataaaaatgccatatctttggcatgagaaggaatcccagaatctggggcatatgtgcatgcagactagtcgcacctataactccttctcctcaaactgtgtttttggctttggtggtaacaaatataagcattctgcagtttccctgttcttatcttgtcttccccccaacgcctcctcataaggtcttggtgacctataaaatttcctctgaattcaccagcttcacctattctgttgctcttaactttccatgatacaatctccttctccaatacaatgaattcttcctttgatctgtgcccttaacgctatgtttttgatgcctgattaaagaaattatggcatagctgttctatgtaatattatgcaaggatgctatgaaatcattaaaaatgtttgtctgtatatgctgacatggaaggtcatctttagtgaaaaaaaagcaagttgcagaatagcatttttagagaaagtctggtctgtcttttgttttaaaaaaagaatacaccacattcacacaaatgccaaactcatgaaccaattctgtttgtagataacatgtagatacacatcaaaaaagatctgcaagataacagcccagacctttcactgtggctatctctgggcagtaagaaaaccaaaaatgcttattatttgagtgtcatggaccttcttgtgaattcaaatggtaaaacgtttattcctacaaaaataaatatatatacatatatatacacacacacacagaatattttgccaacaattttagggagtttaggaagtttccttactgtccaaatcattcccctgaattttaaaaatgaaattttattgtatattaagtgtaattaactaatgctttttaaggccaaatttgtgttctgttagtcacatatttataagctgtatatgtactttatagttattggatccttcagacaatcagtatttggaaacataattttactattttaaattattccagagactaatggtattatatgtgtgtatgttacagttattaggtttaactctgattgatttaataacaaattccaattataaaattgtttctgtgggcacatatgatctacttttcaatatgcatttgatacactttctgggaatgctttaggcaaagcgtggagttgcttatatatcattagcatgaaacttagtaagtattaataactgagaactcgttttgcccctacaaagctcacatatttatttagaccctttatccaccaagtgaaggtcacaaataaagctatctcttctcaaatcaaggcttaaattagagcatttaatcagcctgtattatgcagcatagatgtcaaagatacttgaagggatttccactatccagcttgaagggatgctatctaaccaaacctggataaattgagcattaaaattaaaaggatggaaacaaattataatctgttaattaaaatagaaaaccatggccgggtacggtggctcactcctgtaatcccaacactttgagagcccaaggcaggaggattacctgaggtcaggagttcaagatgagcctggtcaacatagtgtaaccccgtttactaaaactacaaaagttagctgggtgtggcacgagcctgtagtcccagctacttgtgaggctgaggcaggagaattgcttgaaccgggaggcaaaggttgcagtgagccaagattgcgccactgcactccagcctgggtggcagagagagactctgtctcaaaaaaaaaaaaaaaataggaaagcatgagcccattgtaattatgataagtaaatgaatgaaatgaaatttttacaaggaatgggatttaatgtagtcttaaagtatcttcctacagaatacaaaaacttgcaaattaaaaaggaaataatagtaacttttatagtggaggaaactggcagacactaccttaataagagacaaaagttatcatcatcagtactgggacaaatcaaaatgatgtgccacctgatgggatgcagtgagaaacacagcatcacttctgtgatattctggccaaaagtgcatatcctgaatctaatcatgaggaagcatacaaacctaagttgagggacattctacaaagtaattggcctgtaataatcaatgtatcaaggatatgaaggtcaaggacagggcagaaagactgttccagattgaaggaggctaaccagaatggtagctaaatgcattgggtgattctgacttggatccttttgcagtaaaggatattgttgggacaactagtaaaaattgacaggctctgaggattagaagatagtaattattcatcaatagtaattattcctcaatgttaatttcttgatttcgatggttacatcatttaggagactgcagtaagtacatactaaggcagcattctcaaactttttagtctcagagccctttttactcttaaatattattgaggactccaaagagctttttttttttttttacttttttttttaaattatactttaagttctgggatacacgtgcagaacatgcaagtttgttacataggtatacacgtgccatggtggtttgttccacccatcaactcgtaatctacattaggtatttctcctaatgctatccctctgcttgccacccacaccctgaacaggccctggtgtgtgatgcgcccttccctgtgtccatgtgttctcattctcattgttcaactcccacttatgagtgagagcatgcggtgtttggttttctgttcttgtgttagtttgctgagaatgatggtttccagcgtcatccatgtccctgcaaaggacatgaacacatccccaaagagcgtttgtttacataggataccactatcaatgtttatcacattataaattgaaactgagaaacttaaaaaataattatttaactcacttaaaaataataacagtaaaccctttacatgttaacactacacattttgagggaaaataactatatattctgaaacaaaacaaaatatagtgagaacaaccacatcattttacatttacaaaatctctttaatatctggcattgtagcaggatgagccacagacaaaactcctcagacaccggattaaagaaggaagaggatttattcggccaggagcatcagcagacttgcgtcttaagagctgagctccctcaaaaagaaattcttggcccttttaagggcttacaactcctaaggggtccacatgaaagagtcatgatagatcgagtaagcatgggaaacgttactgggggctacatgcataagctaacagaacagaaagttttgcaatgctttttcatacaatgtctggaatttacagataacacaagtagtttaggtcagggattgatattattattattattattattattattattattattattattattttaactgccagggccagatggtgacaccaggccatctggctatttatcttctttttaactttttgcttttttcttttcctcctgtcttataaactagacaagggcaggtgggggtggggggcagcaggagaaatggtggtctccttccttattccccccttggagaatttcacttattagttgaagttctcacttttatttttactttctgagtctctttgtgagacagagtgatagtgattcatgtaatacacttgtgctgaagttttctgatgaaccagggtggcaacaaaaccttttatcatttgaaggagcaagggtaatacgcaggggagcagcaagcaagttcttattactagcagtatacttacaatgagggttttaaatcttcttatagctggaaactatttttctaaataaagacttaggattaaacctgtgctaaacctgtacagacacatgtgccaactttatcatgttctaagcaggtttgttcttttactgggtcttaaaagcctttttttagtgagcagcatagtatttcttaataacagaactttttaaacgccagacactggaacttgtgagcatctgtttggggaaagagtcagttaaattaaagttatcttgaggcattaacttttttgcttcttaaggctattggtctctcatgttagcttttctataaacataacatgaggaaatgcttaggctgctgacagtgttttcagccagctaagtaaacagggtttttttttttgctaaatgaggaggctctggtaacttctggtttatatgcttaaagaatgacttaaagactcagaattgttgctgggccagacaggttcgggttacttgaccaagtagtgtgtgtacagtggggacatctttctataggtgtttcttctagcatggttaagggggataacaacaacaaaacaatatacagcatattcatatctagcaaggacaaaagaggtccttacctgggaaaaaggttgaatacagcgacagaacaataggaaaacagttaatattacatgaaaactattagtcttaagatttttaactacatttacttgcttgatgagtcctcaagctttggctgtgcatagactagtcagcttccaggatgtgactagagcagagcttgctctagtccaaacagtttagtctaaaacatagttagatttgcatatctacttctgcattcagtctgctgcaatttgttattttggttgaagtagaaggaaatctggctttacatggatgcgtagttggagaagagaaagctattttaatagcttctttggatgattgtggatattcttttggtccatcaaaacattctaagtgaaagcttcttaaaagttagttgcaatatggaatctgaaattatatcaattttttacactgagtgacattaaaatattaaagttcattgttctacctcatagtctgaataggtcttttatccatcatgactttgtaactttatgcattgatcacttggaaaatatttgttcctgaattttgcagctcttccaaatgttgacacagtatcaaagataatcacaattgttaatattacccccaatcttatcagaaaagttttttctcttaagctgatgggggtggatacaagttttccaaaacccttattttcatttgaaaactcaaatgttatcatggacaacaaatactgttgcttgtttttcttgaagtgacaaactaacctcattcatttttgataatatgcctgccaaattcaaataagcatcgtttttctgtcagttgttctttcatataaagtgggttgcgtgaaaaaaggggctaattcaactcacgactcaattgcacaaatgcttttcctcaagacagccattgtattaggaacacagaaaaagtgcttcatgcatactttccattttgtcacacagaacaataaaaagatttgtactcaaatagaggtttaacaaaattaatgattttcactgcttcatcaagggatatttttaaatgaaactgacttttttcttttttactacaagtatgtgaagaatacaatgacttccaatacagccgggtgccactgctttgattcttgtttaggttctagcagttttacccaccattgcttttctcaatatagtgaagagggcagagaatgtcagtatttttgactctcagggatcatggaccacattttgagaactactacatcaaagtatttttgggtgctgggcatcatgtcagcaatttaatctaaaatgattcaggggaaaaaagttacttgtagaatatttacagctttcctggtttgagattatttcaaaatttaaaaaacaacatgacctttcaaatgttgaaaactgatatttgtgagaataattattttaaacttcagcaatataccagtaagttcttgtacagattggataacttaatgttatttagtagcattcttggagtatagtcaatgctcagaaattgataactgtattattactcctgtcttgttggtagaatattaactatatctctatacattttatatggtacctttagggaatcctagggtcaaaatgactttgttctttgtttgtttgcttttgagacagagtcttgctctgttgcccaggctggagggcagtggtgatcttggctcacttcaacctcctcctcctgggttcaagtgattctcatgcctcaacctccagaatagctgggattacaggcatgtaccaccatgtcaggctaatttttgtatttttagtagaccctgggtttcagcatgttggccaggctgatcgcaagctactgacctcaggtgatccacccgcctccgcctcccaaagtgctgggataacaggtgtgagccaccttgcctggcctttaaattcttattctttgttctgaaagtgttgcagaacagattgtgtatcaactgcctttgcttttattttgtattaatatgtaaaaactatgctcttttggtaaatgaagagaggctgttttctgtgttgaacagaaagattattctactcttgacaaaatattgttgaactatcttgatctaagcataaatggcaatgaagtaaatacttggccgggcacggtggctgacacctataatcccaacactgtgggaggccgaagcgggtagatcacctgaggtcaggagatcaagaccagcctggccaacattgtgaaactccatgtctactaaaaatacaaaaattagccaggcattgtggcaggcgcctgtaatcccagcttcttgggaggctgaggcaggagaattgcttgaacctgggaggtggaggttgcagtgagctaagattgcaccactgcactccagtctgggtgacagagcaagactccgtctcggaaaaaaaaaaaaataataataataatagtaaagtaaatactcatttcaatagctattttaaattttatggtgagttttctgcccccaaagttccctttttaaagaaaagaaataaaatcaactgttaagcttcttttttctaactaccaaagtgggagatccagaccttgaaaagaataattttttcctgtggcaagattttacaaaaccagagtggaatctcataagaacaaagtgacaggttaaaataaaaagagattacttttttaaaaaaattagctcaatcagcatttttaaaataaaggtactgtgtgatatttgacttctaattaattttagctatctttatgtgtgaaagaagaagggagaaatagtatggtgggttacaagaatatctctttttgctttctaacttgatttgtaggtcacggttatcctgcatggaaaattggtcagctctggcccaaatcttcttggtagtcatttcatttttcaagctaacaaagagagagaagtaacttacctcaagaaaagattcgttttactaaaaaataacagagagacacatttcatatgattaaaaaaaatgctgagacataatcacaggaacattgcctcatatgcagaactagaaagactgttttagctataaaatgtgatgtttcattaaccagatttctaaagcaaatgtttatacattttataacccttgtgttctgtctcttcatagagctgtttgtctgctcagttgtacagtcctgtgggctctcactcagaagtccctcccagcctagcctgccttcctcttcccactgctgtctctctctccatgggaccctcctctctcacgggactaatgaagcagctgctttgttctctgcctgccacctgtcgctttttataacaagctgtgtatcttctactctgccaccgtcatttccttcctcaaaaaaaaaaaaaaaaaaaaaaaagaagtgtgatcttgtaacttcccagtttaataacctctcctaagtaattgtaacacacaggaggaaatataaacttgttataggaccaattccataggcctgtgacctgagcatttgcatggagccccacacttagaagggtccatacttggtttaatgctctgctattgccatcttgaaattcttaataacttttgaatgagggggccccacatttttattttacactgggtcccacaaattaagtagctagtcctatttgttatcttggaccatacaacctccaccagctgtcttctacgaattttctttccgcttctctgtgccatccacagggattcttaaaacatgctgttcgttttctgcactttctggttttgccaacatctgccctttcttgatagggtcaattcctactcttcaccaaaaactccacacaaatgttacctagtaggtaaaatagcactctgcaagaatgagttgctttctctttgatgctttgtttatatttattagagcagcaattgggtttacacatatctccttcatcaaaatataacctatttgagggtatttgttattgtcctcagggtgaagcctgacacatgggcactacttagtatgtatttcttgaatttattcaatcaaaacatttattgagctcctataaagtaccaagtactgttgggctttgagtaaacagtagtaaagagcaaaaaacagacacagatcctgccctcatagagcttacagtttagggagtgagatgctttgccagattgcaacttgccatgctcctgaataaatgaatgagcacctgggccttggtttagaatgggaaatctttttgtctctttgactagcagtggtggtggaatattatgatccctagagtactgggaattttgtatttggaagctgacccaggtcatttggtgacattaaagagaagggtaggctagccattgtggtttcatgcctgtaatcccagcactttgggagctcatagcaggtagatcacttgagcccaggagtttgagaccagcctgggcagcatgacaaaacccccaaaattagatgggcatggtggcatgcacctgtggtcccagctacttgggaggctgagatgggaggatctcttgaacccagaaggtccaagctgcaatgagccatgaccgcgccactgcactctagcctgggtgccagagtgagaccctgtcccactgcccactgcctcccccccgcaaaaaagagagagaagcgtgactgtcagcagggttcccaggcttctttcatcaaatctgagataccattgatcatgaagcaacaatgcagcttataaccactaagaaagaaaattcaccaattaaactgacttgccatcaattataaaacaccttgatttcagagatgaaaagtgaactaaaatgtacaccttggaatagataacatacaataatttaaaggttaattacaagcaaattgagtcaaggaaatacttggacgctaaaagcaaggctaaaaatagtacatcatgaccattgattccatggatgatatggtaatgaatcactttttgaagcagagtcagatgttcatgccagcttgaaaaaatatgcagctgatgcaaggaggtaagagttaagaatacagattatacctacagcagcctatgctattaaggaaaaaacaactatttgccaagcagccatctttgtagatattggcagatagaggagtcccccccgtgtctgcaggggatatgccacaagatccccagtgaatacttgaaactgtggatagtgctgaaccctatatacctatatgtgctctttttctgatctgataaccaagagagatactaagtgactaaagagtgggtggtgtgtacagcatggatatgctggacaaaggtatgattcacactgagagcaggacagtgcaagatttcatcatgctaattagaatggcgtgcaatttaaaacttatgaattattatgggccaggcacagtggcttacgcctgtaatcccagcactttgggaggctgaggcaggcggatcacctgaggtcaggagtttgagaccagcctggccaacatggtgaaaccccatctctaataaaaaaatacaaaaattaacagggcatggtagtgggtgcctgtaatcccagctactcggaaggctgaggcaggagaatcgcttgaacccaggaggtggaggttgcagtgagccaagattgcaccattgcattccagcctgggcaacaaaagcggaactccatctcaaaaaaacaaaaaacaaaataaaaaaaaactgtgtagggtgggtattattttttgtggttttctaggctaagaaatggtattcttgaaagttcaaaggcttgagtgaagggccttaggccagcaaccagttgagttggcactcaagtgcaggtcttctaactgcatcccaggctcttccagtgaaccctgctttcatactgctagcagtagcatcttggaatcttaagtgtagtaatcttaagaatgatgttttgggccgggagcagtggctcatgcctgtaatcctagcactttgggaggtcaaggcaggcggatcacctgaggtcaggagttcgagaccagcctggccaacgtggcaaaaccctgtctctactaaaaatacaaaacttagctgggtgtggtggtgggtgcctgtaatcccagctacttgggaggctgaggcaagagaatctcttgaacctggcaggcagaggttgcagtgagctgagatcacactactgcactccagtctgggtgacagagtgagactctgtctcaaaaaaaaaaaagaagaagaagaagaagaggaatattttgcctttttctcccctcaaaaaacaaaattcaggtacttctgttgaccttttgtttaccaagtgcagaaaaatcaacgttgttatatgaaaatttcttcaagagtggtttgtacaagagtctacaattcctggaccaactgtagaacccagagctttcaaaaggatggagcctattcacgtcctatcaatagaacagattcacgcagcataaggtttttatttattgcaagtggttgttctagttaaagaggctataatgaaaaaaatataataaccttggcttaaaataaagaaatgcttggtttgagatagaatcctgatgagctatgattaattttttggaaaatgggtctcttcatatgagattaaaattgtcatgaatatttttccaagggcaacataaaaaaggaaatagaccattatttgtgtggcatctctgctcattgtaattaaatgggcctttataaatggagtcagatcaattattcccttctggtacacaatcaccttttccaaagtcatgtaaggcaggctttctttgttgggggatgtctcaccccaagggatagtagggatgtaaggatacggtaaggcctaggagttgtgggggaaagaagacaggaaaagaagggaagtggagagaaattggttagggtactttgtttttcttttccccttaaaattagagaaagtacaaaagacttgtcttgcatcttttaaatctctaaatactgtaaaacataattttagtgaaaatggagaggttttttaaaaaacgtgcgagacatttttatggttacaaactgaattttatgaatttatttttaagatgctaaaattggtacgcattgaatatagtgctgtttctctaagagtctcctctccccaactcattatcttttccaagactggaataagggagattggtacatgactaaaatatcctcaaccttcatatatgtgcccctgagccaagcttagagtactttattcatgagatgggatggtttctaaggtttcttataactctaaaatgtttgaatttatatgagaatgatagtccagacccgtgtatgacagatggaggaactgaattgtctctcaatgtaaccttttttttttttttttttttttgagagctggagtcttgctatgttgtcctggctggtctcaaactgcagggctcaagtgatcctcttgcttcagcctccagagtaggtggtactacaggcgtgcaccaccacaccccactctagcttatattttaatatgcctaatgttctgtcttatacatacatttcttaccagcatgtaagaaatgtaatttctatagggaggaattcaagaagtattgagaagatgattttaataaatcagctgtgttggcctagctttatttactcatttaacaaacattgagcagaatgacctctgctttatgccagacatggtgctagctgcagggaatacaaatatgacaaataatgctccctgtttaagaaacagactctttgcttaatatattaagtgcctcgtagggttatatagaaggtttctaggagcacagcagagagtggaagtagctttaccttggaggaaataggaatagtgaaaaatatgtccacggatgcagtaacatgacttgaatcttaaagaatgttataataatgttataatatggaaaaagtgaggaagggtgatatgacagaaatttcataatggatagtacctaaaacttacaggggaaggcaggctgtttatttggagcagatgtggggacaaaggagagtcaacatatatattttggttttattaatagaaaaaacacaaataacacacaagtttatgtaaattagacttcttttgtaacattctcagacttaatatccccagccacctaggggaaaaacttgaggaaagtccttctaaaatctataaaattatttttatagaaagagaaatttaaaaggaaatgccaatttgttgagcaaaatgaaaatgatgatggccagagctggaagtatggtaaacataaagccattctgaatatatttatcacctttcttggcttgtacctaaaaatgtgtgagttttaatattgagaggtgtttcagcagcatcttgagactatttgagggttcagttccttttctgtcaattccagacttgaccttgaatgaattctgaatactctgtgtcgtaaacagcagtgtgactgtaggagtggtgcatgtgctcttgcaggtgatggaatggcttgaggccagtgaggatattcattattctatagcactatcgttataaataatatttgctttctgcttttccacaattgtagttatctggttttcaatggagcagtagatagaaagggagtgaatagtatcagtgtagcttagcttcattctccactttttatgccagagttgcatttctgcctccatttctagttagttgactgcctcgagcagttcataccagtttttttcttcttggtgtttggtcttagccactaggctgagaggcagttggccaagaccatctgataattattttcatctgaaaataaagttgggatgggtcatgactatatgtaaccacaactgtaagtagtgggatgctagctcatacaatttcagataccgactgatttgtcaataggcatcaatagtattgagtatctgtatatatcatggaattctttaagtctttaagaatttacaaccacaagattttactgtgagatatttaaacaaaacatttgaataaatggagagcccggagggaatgccacattgtcattctttaattgaaatgtttaatgtaatcccaatcaaaactgagactaaacaggtgaggataagcaataagtttttaaaaaagaagaacaaagtagacttgcactactagaaatgttgaaacccattttagatgtagcataactaaaactagggcattgtgaaagaacagaaaaataagataataaacagactatacttctggaatcagaatcttgtaggtacaagctgtccaatcactttaaacattcaccgggatcagccattggatgaggatgctacggaaagagcgtgatcttggacaaggcaactctgcagctgaggctgacacccaaaagctgtctgctggtgatactcccacaattagggcaacatgagtttcactgaaggggtaattgtgtggctcatatcatattcattgcaacctccaaatccaattgtttgtgcatctttatcctacacacttgtgggatattgattttaacttatttcaactcctactctggaaaaaagagagaggctgtgtcatttcttagacctttgtaatgaggcaaggatcagagtcccagaagaagtactactccaaaaactttggtaaagtgcttattcttccctagcagtaggctgttgctgagttgtagactggtggttttatgaaaaaaaacaggttggggaggtgtgaagatggaaatgagggctgtgttatgtatatctggtatctacttctgttccaggtgcttaattcaccctcatactgatgtttaaagttagaggattcttgtccatttgtcttgtcttctgttggcagggtcacatgcagggtaataggctatgggaagggggaagatgcctagatttacttctaggctggtctccaagccccaagttcaagcctcctgagtagctgagactacaggcacacaccatcgttctcaacttttcttttttaacataggctagctagctcccaccttagccttctagacccctccattataattcttattcaattgccttggcccagaaagagacagttcctgtcctattcttatatatgcacatctatttttgattcacagaactcgatggtggaggtggaggcagttgatggaattctgaaagtccacccaaccatgtccctggtcaatagcatgcatgtaccatattccttggaaaggaaacgtggtgggagtctgctggattcttctggggaaattttctctctataaaagggacatatcacagagacatacaatctctgcctccgaacattgttgtctgcatgcgatgcatggaatggcaatggccctccaggaaaggagccagcctaagggaaaagagaggagggtgggaaaatcccagatcatttgtgccattgttgagcaactgaacaaaacagaaccaagtccttgtcttcttgaagcttaatttgagtcaagacatatagacaagcatgtacattattaaaatacactacctagtgtattagaaggtggtaagtacaatgggataaaataaagcagggaagggcatgaggagtgctgggggggatggttgcatttattaaagggtgggcaaggcaggcttctctgagaaggtaacatttgctcaaggacccaccagagacaagggatgtggaagagcattccaaacatagggaatggtaagtttaagtcccgagtgtacgtggacaacattctgtatctaaacaactgctaggatcccctatggctagaactgaggagcaacggggagagtagttggaggtgagttcagccaataaactcacaccgtttattaggctgttgccacagccttttggctcttactctgagtgagagggaaatctctggaggtttgtgaagaggtgggtatcatggtctgacctacgttaaataggaaaagccgggaacgatggtgtgtgcctatagtcccagctactaaggaggcttaagcccaggcttgagaccccatctcttaaaagaaaaaaaaaaatggaaaggctcacaatagaggcagtgaagaaaagttgttttttaaaaaaggcagtggtcactgtattagtacatgattctgggaaatctaggtatgagttcagaaattttaattaacctgaaaaacttgtaccagaagccatttgcttatgctaatgtgaatacaaagagcttgctttggttcattactaaataacattcttcgtgaaagtgtcattgaatctttttagcaacatatctatacaaaactctacaatgtaagtatgtacattcagcaaatcctgtgagatgcagaagagtgaatttggttcaggagttgtgagttggcttttattggtagaaaatttcctgaatgtcaatacctaatactagtatggaaaaataatttgcttttcaaaataaatagataaatttaccttatgttattcttgaatgaagtttttcatttaatcaaaggtatttttaagcttttgttttggggctttttttttcccttgtggatctgtggctataataaagtcagcattctttatttactggtgataaattctgtgaaatgttaaagtagacatgttggaccagctattgtgaaattacagctctgtctctaacttcccattacatgagcacacctataactcatttatattagcacagtaagtatacctttaacaccaaataaggtattttctaggtcaattcttcttttcagtttattcatggatttctacctagggtcagtacttttcattaagtctaactaagaatcagatctctcatgaaccaactctttagttttagacagaaatccttttaggtcaagaatacatacctcctacgaggattaatcctgcatgctctgtgatgagctgacattgactttgactaaagaaagatttatttttggaagcaggattttaaaattagttcttttgaattctcagcaagttctaaagaataagcattcctagctcactggacttgactaagtaagctgagtggagatggttgaggagagaaagagaatctagcctttatggactgccgtctgcgtaccataggtatcatgtgagcctcacatcatcatttgggtaaaattatcttcattttcaccaaaggatggtgaggctcaaagaggatgtgtgacttgcttaaagtcattttgcaaatatatgtggaaatgaaattgatgctcatgtctgtgtgacctcagagcctgtgctatctcttcacaggggctgtctattgaaggcaaaagtaaatactgtacattaactcagatgagttttgttcctccagggtctcatttctgaagctattattttcatcagcactgtttggaccttaatagacttgtgtaaagtagaatactgagttgtttctcatgttactttattcctttattactgtgcattttgtgtggattttaaaatgtagtgattattaactattaaccaagctcccaaattataagatcccattcattttatttccattgtgataagatagactttttgttttaatgtgtcacactttaaaatattttacaacatgaagacttcttcctgaagttacaaagcaccaatttacaattaaaatcacaaagccagtgatatttaaagagtatataactttatgatatgaatcatgttttattatttgtacctaagggtctaaaagtagttttcattattgatttacaaaagaagaactgattaaggaacattcagccagctctctgtgacgacattagaatttttattgcagaactaatgtgttgactctatatcatctcttagatggtctcatgattgcttaaaattatcctggtgtaaattttgtatcaaattgggtggggagaaacgtctgaaaggataatgctatcaaatgccttaatcttcactgccatgtactaattttccctgtctctccccgtttgtgttttctttttccctagaagaaaaattcaaagtggagacaagaaccattgctgttgactttgcatcagaagatatttatgataaaattaaaacaggcttggctggtcttgaaatcggcatcttaggtttgtatttttgccacatttataggttcttcttgtatttattatttgactttatgactttggatgttaagtggtaaaatgactagtgagaaaattgtcttatgattacgtaagacattatcagtgaataatatcactaggtgacattaatatatacatttgaatctgtgtttttagttctatattaacaacatacaattttggttattttccttgttatttctcttattctctgtgtatatttagatatacagttgtccctgggtatctatgggtataggttccaggacctcttcatatgctcaagttcctgatataaaatgccttagtatttgcgtatagcttatgcgcatccttctgtatactttaaatcatctctagattacttatagtacctaaaacaatgcctacacatcacttcatttgtgcagatttaatgtgtagacacactggtaaactcaagttttggtttttggaactttgtgtaatttatccccctgatatttttgatttgtctcttttctccccagtatttttgacccgtcactggttgaatccatgaatgtggagctcacagataataggactgatggtagttatattgtaataatcctttaaagtggatggtgctgactcatttacatacagttgaggaaatgaaggcttagaataatttattcagccttttgttcactattaccccccgagaagactttagagatttttcctaatctaactctcatgaaattttaataccacaaatacactgtatagatccgattatgtactatatgtatatctctgctttataaaaaaaaatacaaataagattcccaccccaccctgaccaaatttcatctactctgtggagctctgccccagttgaaaatggattgtttagaagggcacataaagattgagtggttcagctggggttcagtcttgtatttttttttctaagtcttataccccttttgttacatctcagctaccttgctcttattaccagaaacagatacttttattgggataatcagaatattgaactttgttatggaaacaattcagaaaattgtataggaaaaaaaatgggctttgttaactttcccaccgctctttgagagtcgtttctagaaagaaacagggcatctagttccaaaaaaaactaaacttcctcattaaatctgtttatcccactgccaaaattggtgggaaccaactaattgtcattgtttgtttagttgggctataaaagttggataaattaagataatttttaaaaacattttctaacatttctttagtcgtaaagaccccacttccctttctcatcctataaaagaatggtcttttacatgatttccataatagataagacagttgttaaaaatcagttaaacaagtatagccctgcatagtactgttgcacctggctttcacatgctatcctttcccagctcctgcctggtccatatcacacatcaccatgccccatataccgacaccactactccctcacttataggaagaccaataggtaaaaatgaatgcaaacacaggtctggtttttgcctttgtgtttgcatgttcttaaatatatgtattgctgggagtccttcacagtttcctcttccttagcctagatctgaaacacataaagcaccactgacatctataaaaaaatcttgacttccttcacctagatctggaatacataagtcaccactgacatctgtaaaaatccaaatcagcaatcataacttacagttagtatggaagctgtcatggttcatcttaacctcctttcaaactagagatggactaggggataaaggctagcttaggctggaagggagattgagaatccctaatgaaaaaagactgagggagaaaatcttactgcttctcttgagcttgtgctcttagagaatgacttactttcagaaatagttaaattcatcacagttgtgtttagttttgcataaactttagttgcttttcatggaaactatagatgctctgggactatggcattggcattggaaaatgttgggcatcatgttgctgcagggctggaggattgtacaaggcactctttagctgttctttcctgccccctatatggaaaggcttcaatatgattttaggcgtgacagatctgttaaggataagcatacaggacacatgttctctaaatactttttccccatttctagaatcctagcacttgtatcaatacataaatactgatatttggacataaggactgatattttcccaggcctcatacactaatgaaccattgttttgatagcctagttccttagtaagttgctgagttaacaatttgtgcccctcctcattcattcattcattcattcatcaatcagtgaactagagatacaacaatgaacaagaaagctgtactgggccgggcgtggtggctcacacctgtaatctgagcactttgggaggccaaggcgagaggatcacctgaggtcaggagtttgagaccagcctggctaacatgacgaaaccccatctctactaaaaatacaaaaattagctgggcagggtggcacacacctgtagtcccagctactcaggaggctgaggcaggagaatcgcttgaacctgggagacagaggttgcagtgagccgagattgcaccattacactccagcctgggtgacaaagtgagactctgtctcaaaaagaaaaaaaaaagagctatactgcattatttatgtagtataatgttctaataggaaatataacatgaaacaaaataattatctgtgggataagtgttttgagtagggaaggacagggtgtaatatgagtatgtgggggacaggggagttgatacagggagaaataatggtaacttgtcctagccagtggggtaggaaaaaggaggattccagaaacatttataaatgaagtagacgaagcaagactttgtaagagattccaagtgggaagacagagaagagagaatttatggatgactttcaggttgtggcttgaacatctgcattaacactgcatttgctgaaatggagaatccttgaggaggagccttttggggagtgaagatcatttaaaactagaaatctggggctcctctaagatgtctaagttgacttgtttagttgatagttggagatatatatatatatatatatatatatatatatatatgtatatgtatgtatgtatatgtgtatatatatctagatttcagtagagctctgtcctacagatatagtttggagattagtcatctatgagtagtaattgcactgaagcagtgggcctggagatcatccaaggagaatagagagaatgtaaagagaaaactgaagaaagagctcttttgagttcccttccttcttgtcaaaggctgcctggaatagatagcatgaagtgggggatagttttctgcatgaactcagtactgttcaatagaaatgtaacacaagccacagtaattttagcttttctaatagccacattttttaaagtaaaaagaaacagatgaagttaattttttttttttaatttttattttttgagacagagtctcactctgtcacccaggctggagtgcagtggcgcgatctctgctcactgcaagctccatctcccaggttcacaccattctcctgcgtcagcctcctgagtagctgggactacaggtggctgccaccatgcctggctaattttttgtattttttagtagagatggggtttcaccgtgttagccagggtggtctcgatctcctgacctcatgatctgcccgcctcggcctcccaaagtgctgggattacaggagtgagccaccacgcccagcccagatgaagttaattttaatgtattttattttagcctagtatatctaaaatactattaatatttcaatatataatcaatacaaaaaaatttaaaaatattttgcatacttttttaatactaagtcttagaaatctagtatatattttccacttaatagcatatctcaattcagactagccacactttcagtgcttagtagctacatgtggccagtggttactgtatttgacatctcaactctagttcaccttggccatctctcaacctcagtttgtatgagggaattatgagtataatttattgatttgtcttagcttttaagcagtggttctcaaccaaggacaattttgcagtgtatggcaatgttctgaaacatttctgattgtccttcttggctaggggagggtagttctactgtcccctagtgggtaaagctcaaggatgctactaaacattctataatgtgtataggacagccttccacagcaaagaatgatccatccaaaatgtcagtagtgctgaggttgataaaccctgctttaaaattatgctgtccttaaacagttcagatactcacacaactttgattttgatttctagttggttgcaaatcaataataaaaatcattatagctaatgtttacataatcctttaaagtgtatagctgaacttttgcatacattatctcattagctgagctgtaagtttagttttcttcctactctaccacaaatgtctccttaatcataagatttatgtaattattattgacatttattagcacatattttacacatggattgtaattttaatttctcaagattttcgatggaactattaaaatacttctgtgagttaaattttattactaggtcatatttcaactccattcttatggttccttcactagtatgggtataaccctctagaacttgttgtggggaggtctgatgtgtatatgttttctttctcttatgattacctgaatttatagccccatcaactttcttctctcccgcatccccatccagatcccacatactctcacctctgtctagtaagggcaaaataatttagtctctttcctctgcttatgcaattctcacttttataacattctctaaaatattctatgtatagactgatttctagtaagacctaggaatccatattaagtcataggaaggaatttttttctaccaagttttaatgaaactagtaaggataataagaaaaataaatcaccagggtacaccccatttgtttgaagtgttaagcaccaaacagtcagtgcttaataaagaaaattaatattttcagaattacaaaggaaaatgctaaagcccttagtcatgaaagaaacattaagttttcagtaagataagtggaaaggaaacagccatgaattgtgagaatttatcctgaaaggtcaccataacttgatgagactataaatgcttaaggttgagaagttggattcttaactccgttacttaaaaaaaaactaagcatctactgtcttctttcaggcaaatgccaagaaatacagatttcagaaagcttataaaactttggctatttagagaaaatgacatccttactgctttgagtaagcaaacaattggttaacaaagtgtgattaccgtaatgcttacttgattccttaggagagactctcatgtgtgctccagattggtttggaggactttgcacaatacaactcagggaggcgtaatttaccaaggccaaaagagtaggcttggcttttaagtatgccacagacaatacttttttcaaattctactactatgacttttttaactttgtgagattctgtattatagaaggagaaagaaaggtcctcttggaaaaatatacttagtttgtgattcatttaaaaaatcaaccatagctttatttaagcttttattgcattctagacaagaatttccccatgccagatgctctcaaggccttctctgtccatagtgttgatggcgtatacaagttgtagcatcctcagctggtacaaggtgacctgtgttgccctactggcttagtgcattcaggactttagtcatccatcgactttcttgattctttccatacgcattgctaataattttaagaagcctcattttaacaacaacaaaatgtgtagataatagaggtcagttgattgcaaagaatcactgattgccaaagctggaatagaacttattattctcttttcttcctgtgccctttataagtgaacacttgctccactaatgttcttggtgaattattttttaattggtgtccttcctttttcagctgaatgcaaactctttgttatccttgcctgtgccaccactttcctcattaaaccttatggatttggggaagcaattgtgttgcatttttctcccgaaaacctagtgtttcccagaaggttctaggatagagaatagttgaatataaatattttatttactaaactaaaagatagtttgagcaaagatacccatcagagttaagatcagagtaactctgtctctgtgtatacttacattttcaaagtttcttaacaaaagacccaagagtattattagctacttggggaaaggactagttagcttccaaatggcaaactcctagttaattggtttgggatccagagatggcttccttataattcagtccccagagaagcaaaggaagagcaatagatgtaggcctaggagagagaaccaaggcactacaggaacagtgctgaggaaaacttttctaggattgcttggaaggaaggaaaatggagcatactaggagtttatgcagcttcctggtccctgttgattaaggaagtcacaaataaaagagtcttatttcttcagaggctttagaaatacataatgctacagattctcttcttgctgttctcaatgttataaatagttttaagttgctctcatttgaagtgtaaatacctctaaagggctaatggcacctgttatttaattcttattggaactagtatattcagtttattccttgtctacttcttgctgggtcagttggctattttagttagtgaaagacatggaaaagtcattttaaaatggagaacaatagtcttaaaaaaggaaactatgtggtaggttgataatcagtggggtgcagagatggagacacgcagaaggacaaaataaaattatgttgagagagcaccaaaggtaaacttaatgtagttagaattattatcccctactcccgctttttctctgtagcccagtatatgaggatcaggcttaaggaagagcagaggctattattctaggtatataggaaagggttataagaggatcatgggatgattgtttgggaaaagggcaggatataacttttgtgctttctaagggtataaaacacttccaaaacttcccttttgtaatactgcaatcacattttgttgctaaccacccagagttactgcagactccacaggttcaggaacacagccccccaaaaaactgccctcagttcacatgctagctgcaagtttggagatcttcagaccatctacacttttgactaactggctacaaattcttgggttcgtatgacaccctcgggttcaataattagctagagcgattcatggaactcagaaaagcactatactcatgatcttgtagttttattatgatggataaaagtcaggattagtcaaatgaagagaaaccatagggcaaggtctgcggggagtccccaacacagaggttctaagccctgtcctggtggagtcaggacaccttaccttccaggcgcatccttgtgttcatccacaaggaagctctaccgggcttcagtttccagagtttttattgggggtttcattacccaagtaggcatgattgatggaatcattggccatgtggtttaacttgatctccaatcctcctctcttttctttaggttgggctggcttaaagccccagccctctagtcacagagttggtctttctggtgtccaaccccatcctgggtcatcttgattccactactgagtatatatcaaaaacgaagaaactcaatatattgaagagatatctgcactctatgtttattgcagcactattcacagtagccaaaatatggaatcagcctaacagtctatcagcagatgaatggataaagaaaatatagtataggtacacaatagaatattattcagccattaaaaaaaaaacctggaaatcttgtcatttgcagcaatatggatggaactggaggttattatgttaactgaaataaaccaagcccagaaaggcaaatatcacatgttctcactcatatgtgtgagcttaaaaagtagatctcatgaagatagagagtagattggtggttaccaaaggctaggaatggtgggatgggaataaagagaggtttattaatgggtacaaatgtatacttagatggaagaaataagagctgggttagatcatttggatgactataatcaattgtatatttcaaaatagctagaagagaataattcaaatgttcctagcgaaagaaaagataaagatttaaggttataagtatcccagttaccctgatttgattatatgaatgtaccaaattatcacgtgtaccctgaaaacttgtacatttaatatgtatcagttttaaaaataaaaacacagatgtgatccaagggcctgccatgaataagaaagacactgttatcaggaaattccagtggtttaaaacctccatcctattaacaaagatcagacaaaatgttaactgtacagtaccttttctttccttttttttgattgattcattcaatcaaccgtatactaattcattaaacaagtaaaattccagagctataacagtagacaaaacagacactgtttctgcttttctggaagatagccatcgaacaagtagtgggaacgtgttgcatgtaatgaaggagaatgttactgggaaagctaagggtgtcacagatagtatccctgagaaagtcatttaagtggaaacctgaaggctgaataatactgggagaatagacatgggaagggtttccaggtggaggaaacggcatgtacaaaaggcctgatgtgaatattcttagtgtgtcagtagaactgacaaaagccctgtgaatctggagcaagggtttcaaaggggacagtaacaaaagatgattctggagattaagcagacccagatcatgaaagtctgagaaaaccaagacaataagtttagacttcattggaagtacaatgggaaaccattttagaattgtaagcgtgacttgacaacatattagaattttagagagatctttctgactcccacatagaataagacaagaattgataggaggaggccagtaagactatttcagaagtgagacataagatgatgaatgtttacattaggaggatagcagaagtgaactgacaaagagaggtgtttaggaaatagaaataggaccaatttctgatgagggtcctcatcggaggtcttgagtaaagaagaagaagaatggttttgtgttttttaagtcattattgccgacatgcattgagcactctttcatgccagccaccatgctaatgaatttcatttaatcctctacaaccctataaggtagatattgatatttctatgcccattttacagacaagaaacagttacagagttagacatcatccagaattagacgactagcagttagcaacttccaggttctgacatgagcaacagggtaccatttccccaagacaagaaaccctggatcaggagcaaagtctgttgagaaaaatgatgatttcactttgggatatgttaagcttaagagggtggtgagaaagccatgtaggaattcaagtagttgggtcgctgggcacacatgcccttccttgctagaagggaaccttctttgtgttaaatgttgaagaagcctggtgtagacaatcatggcaaagagaataggtgcatggattttttttttttttttaatgtgctaggagactcatcaggaacattatcagactaagtatagtgccttgtagttccattaggtatgttggctgagattggatttgtaaagtgagcataggacttctagaattcatatttatttctgtttacttgaaaaccactcactaatggtattaattaaagcagaaccttttacttaaaactgggtaattagctctgttatttcagaaatgtaaatagaactgtaagtcatgaaattggtgaatgttcttcccaccagctaacatttaactaccaacctcatgtcatctttcttcattccctcttccaattttatgtatagcaaatcttacctagttttgtaatgaagatcacatagcaatttataattaaacagtggaagtgaaatgttctgttgtgttgcttctgattcagtcttaatttttcaatttctgattaaagcactgcaaatttaaagtcttgtaaactctcttttatttggaaattgctactcacaaatgtatgaaaactgtaaagtttgcaaaatgttttacatggtgttccaaatatcatctgtcagagtatgaacatgtgctagctaaagcaatatgttaaataaggcaaagatggaatttactttgcatcactttccaaactctctctataggctgtaagagtggatctaattgaatgaaataaagagggtagaggagcaattaggagaaatttaatcagtataaatagcagcagctctggttaatggatgtccagagtccactctctcagaaggatctctccactttgattctggtcatacgtaataaaagtagggtactttgggcttgggcacaaaacaggagtttgataaatttttgttgaataaatgaccatacaacaataacaactcttcctcttccatttattaacatattactacgtcccaggcattgggttaaagattttatgtatatgatctcatttaattcttaaattactatccccattttatgtcaaaggacaatgaggcaatcactagtttcttgttaggagctggtagtagtggagctgggactgaaacctggttctgttaggactctggggtctgtattcttttagctcaaaaatttaagacaggaagtttcccccacttttggtatatacactgttactaaagtatacattttaaaaattcagtttattttgaaatatagtgaggtagcagcattttttaaaatctccttttattggccaggcgtgatggctcacacctgtaatcccagcactttgggaggccaaggcaggcggatcacctgaggtcaggagttcaagaccagcctgaccaacatggagaaaccccgtctctactaaaactacaaaaaattagccggtcgtggtggcgcatgcctgtaatcccagctactcagtaggctgaggcaggagaatcgcttgaacccaggagacggattgcagtgagctgagatcgagccattgcactccagcctgggcaacatgagcgaaattctgtctcaaaataagtaaataaataagcaaataaataaataagatgtctttttattaactctaagtgctggaactggattagcatttataaccacaaatgttagtgaaatataaactttttctcctttgatacaatgagaaggaaacaggaggggttactttgcattatttgatgtatgtcgggaagcccggccattaggcaacatatttttaaaccaccttaatttcctatatctctgattaatctggaaaaagaaacaggttgaaggtgatctgtagggggttacccgtatctgttagaattgtttgttcaaatggatttttaatttctagtaatttattgttgtttgctcctctctcacgcctaacccagataccaaaaatctaattttctgatgacatcattatatctctatagcagctggctttgagagaggattctaagttcagtgagatcagcagcaaacgaacttagaagaaacagaaatcttgtaaatattctttttttaagagcataaaatttggaaatgattttaaagcagtataatttagaaattatatatatatatatatatatatatatatatatataaaattcagaattattccgtggattttctgtgtctttaaaatgcaacacataatgatattagtgttttctgaggttctggatgggggccgaggagagcgtagctaagcatggcctatgtcagttcttctctgcaaggatcaactcttaagaggatggctcctctgccctccaccaccttttctttccacttcctttggcattattcttggtctgttttcacctctgttctctgcctgcctcatctcttttattgagcgcttcccagtcttagacctctagtcagaaaccaatgggaaagattttgttactgtccagcaccctacagtgactgggatggtggtgggaattccatgatgacatagatatctgttgtttcctgagagacatcatgtgttgttacacaataaaaaggtttttcactgaaaaaaatgtttaaatctgtctctagtgcctcacttcaagaattcaagaaaactcactaataaacatgtttaatgctaatttaagatgcgaccatttagaagggatcttcaactatctgaataatgttggagcaacatgtgccattgtttggtttggcgaatcctataatgaatcctgtaatatgtaaagatggcattgcgtgcacccattcttaatgagattatattataatgggagtatttccatccttcactcctactcaaagcctgttctttctcttccttttgcaattccctgaaagctttctgcctgctgttaggttattgctgccacctgacgtctcaaaataaaattgccgtgggtttgcttttccaaaagattcgcactattctgcattttatggaaataactatttgagagcaacagttttttctctatactcctaaataagagcattctgaagtgattacttatggtggggagattatgggtatcattcattccacaagcaaaaggtggaactaatagtacaggagggaatgtaggagtcctaatccctagaataggacaaatcgccattgtgaccttggtgtgtacttcacctcataaaattggactcagtgctcttaacagccttattccagctttaacattgttttattgtgtgtacttttatttatgaaaacatagcccttctccgtgatactatttacttttttggactaaagttctcagtgttgaacaggttttctctcttttttttaacagatacataatatttctacatatttataggatacatgtgatattttattacatgcataggatgtgtaatgatcatgtcagggtggctgaagtatctgtcactttgagtatcatttctatgtgttgggaacattaaaagacctctcttctagccattttgaaatatacaatacattgttgttaactatagtcaccctactctgctattgaacattagaacttattccttctatctaactatatgtacccactaaccatcctctcttcatccctcacccacccacacacacctgccccaccttctggtatctattattctactctctacctccatgagaccaacttttttagctcctacatatgaatgagaacatgcaatatttgtctttctgtgcctggcttatctcacttaacacagtgacctccagttccatccatgttgctataaattacaggattttattcttttcatggccaaatagtattttattgtgtatatatactaaatttttctttatctatttatttgttgatggacacttaagtcaattccttatctttgctattgtgaatgatgctgcaataaacacgggggtgcaggtatctatttgatatactgatttattttcctttggataaatactagtagtgggattgttggatcatgtgatagttctatttttaatattttgagaaacctccatactgttttccacagtggctatactaatttacattcccaccaacagtggataagaattctgctttctctgcgtccttgccagcatctgttattttttggctttttaataacagctactctaactggggtaagatgatatctcattgtcattttgattcagatttctgtgatgattggtgatgagcattttttcatttatctgctggccatttgtatgtcttcttttgagaaatatctatccatatcctcagcccactttttaataagttttcttgttttttaaactattcagttgtttgagttctttgtatattctagatattagtctcttgtcagatggatagtttgcaaatatattcttccattcaacaggtagtctcttcactctgttgattatttcctttgctgtgcagatgctttttggttgaatatgttttcttatagagctatgttaaatagatgttcacattttcattgtgtgaataaatagctttgatagctttcctttgctcaattatcagagacacagctgaagactctctattgtttgtttttgtttttgtttgagacagagtctccctctgtcacccatgctggagtgcagtggcgtgatctcggctcactgcaaccttcgcctcctgggttcaagcaattctcctacctcagcctcccgagtagctgggactacaggcacgtgccatcgtgcctggctaattttttgtatttttagtagagatggggtttcaccgtgttagccaggatgatctagatctcctgacctcgtgatccgcctgcctcagtctcccaaagtgctgggattacaggcgtgagccaccacgcctggcaactctctattgttaatacagtcataaccagaataacacttctctgcttgcttagttattcagggacttcctttgcttaactttgtacttatagtacatgtaaagattacaaagtcaactgtgctgcttgcaaagttcctagattttttttaaaaaaaatgaaatctggattttaaaagatttataattacactgttcaattttcctttgcattttgaaatatagcattaatattcccataggctagagggaaatctgaagaaagttttcttgatatgaagagtgaagggagatagttcactgtacttcatgaaattttttttaattctgatgaatattacaacttggcaaagcctttcctggaagattctgttatcttaaactgatataaagaatattttgtttatgtgcaatattttaacagatattttgggttttgctgtttcttttagtcatattctaaattattcatcctttgtaattctgtaggtggttaaagcaaagtcaagtgaacataaagccttaccttcaactagttttggcctaattgtttacagatcttttatagaattgactcttgggatgcctggtgggtggagaacctattgaataaaataaaaatggatctggacctgctgttattaattatgtttagatactatccctattcagatgagtatgaatcctaattaaataaagtttgctttgtcattgtcttttgcttacatttcttctgacaggtttcagtggtattgttgtaaaatcttgcaacttacagcctcaagtgattggcttataattaaatataaaacccttactgagttcctttgaactattaattttgttagactattgaaaagttattattactaatatcaggtttatatggcataattccttataagctgtagcagactgatcataatgtcatcatcttcttgcaactgaaacttctcttttttaaatacttcataattttattaaacattgttatgagatgtttgtttattattcagttattatgatttttttttttctgagttgaatactggataaaggtgtgtgaaggttttaacatagtggttaaaagcctagtctctgaagtcaaatttcacgagtttgaatcccggcatactttgctctatcaccgggcaatttttttaactgctgtgaacttcagtttcctaatatgtaagaggaaaataataataggaactacctaatagggttgttgtgatgattaagtgtagataggcagatagatagatcatctatctcatgagttatttatttagttaaaataaattctaagatattttattcattgattgattcctgcaaatgttctttgttctgggattgtctttgtctttccagggctggggaaaaccataggatatttgagtattaaaatcttatatctaaatatatataggtttattcatatcttgtcaattgtcttgtagccccaactttaagttaggtgattgggaaggtaagggggtgtggtataaggaaaattaagatatgacctcaacttttgatagatggtttattggagacatttagtctgacccactcccttggccaccagaaagaagccttccctcactttccagttgaagtcaggctctgcaggaaaggctcccatggcactctgttctgtcatgaaataattgtttgtttctttcttttcctactagattgtatgctccgtgataccaacattttttccccactttttaaagttcctagcacatgtcttactcaaaagtgtatggcacatattttttgagttattaaatgagctctcattctggagcggaacaaaatgcgatgcatattgtacatgacttatcccaaatcacatgttttctgaaaactgttataactagaactcaagttttcagtatcctggaccacggtactctccactctttctactgcactatgaaaatttaaggtctggagaagagttaagtaatatctccaaataacagtatgatagaggcagaatatacatatcccaaagggctatggaaagtgagaggcaagtataagttctgtcagttgctggatggtaggtacaggaaggtttaatgaaggaagagacatttaagttggacttttaaggatagattttggacagaaaggtgtggaaaaggttatgctagccataaacagcattttatataattatatatatcatattagtcttgatatctttaatgtcattattttaacaaatctttaaaatatgcatatgttactcagctaatcatcttgttctatttcagtgaacaacgtgggaatgtcgtatgagtatcctgaatactttttggatgttcctgacttggacaatgtaagtctttctttgtgtattatggtaacaaaaataatgcatgcaggtattggtataatgattcacactatgacactggagtccagctgcctgtggttcacacgctggctcttctgtttactacctgagttccctgggtatgggcctagccatacttagtctcagtttccttgctcataaaatgggcagcttcataggggtattagaaagatagaatgagaaaatatttataacctcacttatacagtgccagattcaataatagctctagttttgttattactcttatttttgtttgtgttatatcaaaatagctctgttgtaagttttatgattctaaacatcaacttaaaaattgtaagtatgttaatatacagcaacgtggttgattcaggtaaaccagctctaccaaaatgaaagtgacatccttgatgcatgcataatcctttactgaaaacgagaaaagcatatcattgaaggactatgtaaaattttaaaaattattgaaaatcctaggttcagtaatttctatgctccatactagcagaaaggaaattgcaaagtgttctatttattttagatttaatgtgtctttttacttccagattttacttgcacatacactttggattctgcatgttagcatcaattatcaccttagttaggaaaatataacacggagagtaaaatgaaatctgcctctctaccccaactcttgtcatttttccaaaatctctgcaatatctggggaaatgttcaatgcttctctagattacctaagtagatatctaatagggtcactttcatgatcaagtgtatataaaattctcaatatttttttgcaggtgatcaagaaaatgataaatattaatattctttctgtttgtaaggtaagcatccttgttataaagatgtcatccttttttggttccttctattcaaaaacactgacataatcagcttgttcacctgagtctactcttgtttagatgcagatacatgtattccagatacaagtggtctattaacttatttcttcagaaaacataaagaactgaagaccaagcaggtgcctgtattatttgacttttcatttatttttattttatttaattatttaattttttatttccataggttattggggaacaggtggtgtttggttacatgagtaagttctttagttgtgatttgtgagattttggtgcacccatcactcaagcagtatactctgcacacaatttgtagtcttttatcccttaccctcttccacccttttcctgagtccccgaagtccattgtatcattcttatgcctttgcatcctcgtagcttagttcccacttataagtgagaacacaggatgttggttttccattcctgagttacgtcacttagaataatagtctccagtctcatccaggttgctacaaatgccattaattaattcctttttatgactgagtagtattccatcatatatatctatatctatatctatatctatatctatatctatatctatatctatatctatatctatatatatatatatatatctcgtggttttggtttgcatttccctgatcattagtgatgctgaacattttttcatatgtttgttggccatttgcatattgtcttttgagaattgtctattcatgtccttagtccactttttcatgggattatttgcttttttcttgctaatttgtttgagttcattgtagattctggatattagtcctttgtcagatgcatagattgtgaagattttctcccactctgtgggttgtctgtttactctgctgatgttcctttagccgtgcagaagttctttagtttaatgaatgagtcctagctatttatctttgtttttattgcattcgcttttgggttcttggtcatgaaatccttgcctaagccaatgtttagaagggtttttccaatgatatcttttagaatttttatagtttcaggtcctaaatttaagtccttgatccatcttgagttgatttttgtataaggtgatagatggggatccagtttcattctgctacatgtggcttgccaattatcccagcaccatttgttgaatagggtgtcctttctccactttatgtttttgtttgttttattgaagatcagtgggctgtgtttggctttatttctgggttctctgttctgttcagttggtctacgtgcctatttttataccagtcccatgctgtttggtgactatggcgttatagtgtagtttgaaatcaggtactgtgatgcctccagatttgtcctttttgcttagtctttttttttggctatgtggactttcttttggttccatatgaattttaggattgttttttctagttctgtgaagaatggcggtggtattttgatgggaattgcattgaatttgtagattgcttttggcagtatggtcattttcacaatattgattctacccatccatgatcatgggatgtatttccatttgtttatgtcatctatgattcctttcagcagtgttttttagtttattaaatgctttttgtttattaagtgccttctatatgcaagcactgtggtagctactgggactacaaaaacttaggctggagacttatttttacaaagatttcatccacacgctatttgtcactgataaattgtttccattttgtcttccccatgattcttttcagttgaggaacttaaatgttgtgataagcattgtacggggaatatggaagtataaagcaatgggtgtgatttttaatagttactcataataactagtctggttgctagttgctaagcatgtgttatagtcatgtcacatgtatgtgccaacaaaagacaacaagccaatacctgccaaaaggaggaatacttagcaagtatgagcatctcaacaccattttttcttatattgtattagtaactacaaaaatatactgtactttgattatacataccagagcagtgaaaaataattgcctgaggcagaattctcatgggcagtgtcagatacttgaaatttgaacatactcatagaaagccaaatccattttcagtaactcatatatactagtttaaggaaattcaaagcatgtttaactcaatgtttaactttgttgttattagccaagtttttttctcatataagattcagtttaagtgaggtaaactaattataagtggacctgtgagtgagtctggagcaagactctcatgcacaaaattgatgcatttaaaacatggctaataggaatatatctaatagtcccaagatcattataagggctctcaaaatgttattgttgttcttaaactcagagctgatacagattttaataatatgtggaactatgactttattttttagcaagcaaaggtttttgatcaaaaatatcacttttagtctacaacgtatatattttataatttttgccttttgaaatgaccaacgtgtactattattttgatatatcttttctggtacatttggccaagtgcttgaaaataataagtgttaaaaacaatgtacatgtgtttcataatatcttgtgctgagttaatgataaaatatgtttgttttaattttattttctagaattgttaatactaatttcagattagtcttctgataattttaactcctctgtcagataaactgtgtaagccatttactttagatccattagtattttctcttataacctcctgcttgtctacacttacatgtttgtatactcttatggtgtaaaaccctggcctcttctgtctccatgaacatgccatcccttggctcacagtctgcagaaaactaatgatagaaagccaaggtcctggccttaatctgtgagaatcagtcatcctgctgtgcttcatggtcacagactttatccttcatgcaggatctgagcacagatcagcatattcagtggtcattacggtgagtctctgcttaaagaccaaataggggaaagtatggataaaacagcacaaatcgaagagcaccatgaagtaactttcagtgttttaaatataatgatgaaataaaaatgagatatcatttttaatatcttgacaaattataaaatgcttctcccacctcttcatccttcctcttcttcattcttcattgacattggcatatatacttgttcccatgaaatgagttagtggagacaaatgctaatttattaaacacttgcatgccatattgatggtaagtgtcattggcagaactggatatctacttacaatttttatacataagctttcttttgcaaacctaatcccatttaaaaagcactaagggagtttgctatttaaagcacttcttcatggagccaaataagcatcccttcatttatctttaatatgaatctgaattttcctgtacctttgtgatgtgtacttctaatagaaaaacaaatcaaaactctcaacatgtggaatcaatggatcatggaattaataccatctggaggcttagccaattagtttttgttgtactacatgcagaagcaatgtagttaacattgcttctgatcacagttgactagtgaccattcagatagaaaatggcttgacgggagcagtgggaggtgagtgatgtgcagtggctaaccagcaggtaagaagaggaagttagggcatgactgggcaagaccttgagtgctgtgctcaacaggctagagagctacagaaagccttcaagtagatgtaaggtgtgatctgacctatgttttagaaaggcagttctattggcagagtgacacggtaataggtattttatgatgcatgtgtttttcttacttatactgagagaaaggcattcaccttgacgaaatttgtgtgacgctcccaggtttaggactctttggtgctgctgtgatttgccctataatatatttggatgaattgcacctattgttctttagttgactgtgttacgttgccagggccagggccacattttcagtagcaatggctgtttggagccctggggtaacttaaaagaagatgaaaattggtgcagctacagaatctccaaaggttttattgtggctggacatcaggggaactggggcatggatgtctgcagcctaatgccacaatgaatttctcagaaaaggcctgtataaggaagagagcaacctcttctcaccatcaatgttgggccaagttttatctcctcactaaactacatgacagggaataactggctgagaagtgttccaggagagattggtgaaatcagcttggccttgtgactttgggcttgtgccccctactttggagatgtttgctgagaaggaccccagcatcttattgtaaggcctgtactgtgccatgaacactgaatgacctggctttacattccttcagatccacctatttatgttctggatcagtaggtcagatgattgtaaaaatcacataagttccgtgtttcaatagaggaatgacagaagtgaaatatcctgagaccaaagaaattgtaggtcaccaccagataaaatggtagtgatgtggccagaaaaatattggggaagaaatattaatcagaaagttttggctatagacccatgatgtttaatcataagcagttcttccaggccacttagttctccagtttcatccgatggttttactttttaatcttatccagcattttgagtttattcctttcttccctctcagtggctcacttcaatgggctctccctttacaagggatgtttcaaagccttgttgcctgcttttccagttttactcttaaatccttcaggaataaatttagtcttgctcctgttccctgcctgcatacagttaagtgatatagaaactctatatgtaggtaaccaatatggcaggtagatcagtctcaaactgtaagagaagtcctaccagacagagctttcttctgattgcagatgctctgtgactaaaatctaagatacatcttatttctcatcaagaacaatgacctttatcccagaaacagtggagtttagagacaattgaacctcaagacattgaaccacacttttctaaaaatagttctagttttatacctggagggatttccatcccagaatactgagagagtttgcaaatgaaattattgaactgctattgattgctattagagaaatcatggagaatgggagaagtgccgcgtctccagaggcagacaaatgtaggtttcatttcaaacagggtgtacactgaggttcacatcagtccaaagacagattctaaaacaaatattgctgtgccgtttgtttctgatttgagagcacctgttttaacagctaccaaatttggggttgccttgcttttctgggccagattattcttttttattcgcaattttcagacttcaagagaccctagactcttcactcctttccagataagcactgcccaaacagtattacctgaactgcctgtggtgcctatggaaaggtgggaaaaccattccttcaggtgatactgaatcctaaaactgctgctgcacttagtgaatgaggtggaagctagacaatggccctgcctacagctgaatctcttaggaaatgtccaggccaccattctgacaagtagacaggatgttcttaccttctttattacctttttcttagagcagagaaggaaatggatgggtgtgcggcccaaagtgaaatatattaacagcctccacatattgcaaaatactgttctgttttgttgtttgctttatttgggaatggggaagagcatctcaagcagggggttatatagtaatttctttttacttttttaagtcaacttgagatttaatatttttttattatacttaaagttttagggtacatgtgcacaacttgcaggtttgttacatatgtatacatgtgccatgttggtgtgctgcacccattaactcgtcatttacattaggtatatctcctaatgctatccctccccactttccccaccccacaacaggccctggggtgtgatgttccccttcctgtgtccaagtgttgtcattgttcaattcccacctgtgagtgagaacatgcggtgtttggttttttggccttgcgatagtttgctgagaatgatggtttccaccttcatccatgtccctacacaggacatgaactcatcctttttatggctgcatagtattccatggcgtatatgtgccacattttcttaatccagtctatcattgttggacatttgggttggttccaagtctttgctattgtgaatagtgccacaataaacatacgtgtgcatgtgtctttatagcagcatgatttatactcctttgggtacatacccagtaatgagatggctgggtcaaatggtatttgtagttctagatctctgggaaatcgccacactgacttccacaatggttgaactagtttacagtcccaccaaccgtgtggaagagcatctcaagcaggggattatatattaatttctttttactctttttaagtcaatttgaaatttaatatttttatattaatttaattttttactttttttgggggggtcagtataagacttaaagcaggggcttataatttagttcttccttcatcagacattcaaccaaggtgggggcttgaaaccatttcttattaagggtgggtgtgggtagggcacctttctgaaccctccagagtgtcatgcgcccactgcatgtcttcccttcactgagcatttcatttttagactctttctttctttcttttgtgtgtgtttttctttttttgagacagggtatcactctgtcacccaggatggagtgcagtgacactatcatagctcactgtaacgtcaaactactgggctcaagcgatcctcctgccttagcctcctgagtagttaggactacaggcatgcaccaccatgcctagctaatttttaaattttttatagagatggagtgttgctatgttgctcaggctggactggaattcctggcctcaagcgatcctcctgcctcagcttcccgaagtgctgggattaccagtgtgagtcaccatgtctggactagagtttttcttagattgagtctctctttcagtttagagcctctctacagattgtaagcaccatgagggttggtatcatgtccttttcctttcctgctgaatcctacctgggcctcgcatacgtaaggtgcacaacacattttttttttattctaagaaataataataaatgaatgattttttaaaaacagaaaattctgaactgaaaaaactgaactgaaattttagttcaagttctttgggaataagggtcacactgattgtgtgtggccctagaaggttgaacttgaatcaatcgctatttatactgaagtaaattgtgagaatgtcctaatctttgaatctgccagaagtggaagaggcggaaggtgagtatcctgggtcagaggttgtaaactgttggtctgtgggccagaggtggctgacgaacacattttgattggctcagttttcaaagttaggaaattttacaccgagatttctaacttctcttgggaaaaatctgaaaattgggtaacacagacctgaattactacatggcagcaagtgactagagctgagtagcttccggatatatgcagtaagttaggcctgcagctctctagattgccacagtccccaccagtccctattgtttgacttctctcactcatttacattacctctctgacctttcaggcacttgagtttgggttcttctgttccaggtgactccaagtgttcaatgtactcaaacagaataactgcttggagaaattgaaggactagaatgacatcgactaaattaatctcttctgtcttagtccctctgggctgctctaacaaaataccttagattgggtagtttataaagagcataaacttatttctcagagttctggaggctgggaagtctaagatcagtgccccaccagatttggtgtcgagtgaggaccccattcttcatagatggagccttcttgccatgtcctcatgtggcagaagaggcaaacaagctccctcaggcctcttttataagggcaccaataccacgtgtgagggtggaaccctcatgatgtaatcatttctcaaaggccccaccctcctcttaatgtcaccatattggggattaggtttgaacatacaagttttggaggggtggaggttgggcgcagcggctcacgcctgtaatcccagcattttgggaggctgagatgggtggatcacttgagcccaggagttcaagaccagcctggccaacatagtgaaaccccatctctaccaaaaatacaaaaattagctgggcatggtggcacgtgcctgtaatcccagctactcaggaggctgaggcaggaggatcacttgaacccaggagtttgagaccagcctggccaacatggcgagaccccatctctatcaaaaataaaaaaattagccaggcatggtggctcacacctgtggtcccagctgctcaggaggctgaggcaggaggattgcttgaacccaggaggcagaggttgcagtgggccaagatcgtgccactggactccagcctggctggcagagtgagaccctgtctcaaaaaaaaaaaaaatttggagtggagggacacaaacatttagactatggcatcttccaccccatgattctctgaaatcagagtatgagaccctttgcatgctttttgaaaatctattttttcctttttataccacagtgtattcattgtatgtcacttagccagaagtgtcttatgcgatgccctgcccatggagtagatgataaaagtttagatgaatggacagatgggtgaaaagcacggaaacatttgtttttctcacctggatttgcctctggcatgtgacacaatgccagtagggggagccctctattaatttgaaaatccatgagaacagtctccgttcagcagtctaattgtatttaatttaggaattatgttaagaatgcatccgggcaccctgcttcaagaatttaacaacattaggaatatgataaattatgggaaggagagtaaaaccctcaccactaatccccatccatggcttttctagatgaaggcattccaagttaatagctagtcttttaattcattttgaaattagttatcattatgctcctaaaaaattccaaattattggatacatttagtccttagagtgtcatagtaatggcctgcttcaggcataactacaaaatgatggttttgccaaacggcatgataaccactctgcattgttttcttcttccaaaaatgagagagtagttatagattggtactgatgttgcttttcacctccaaatgaagctaggttataggataaatgccttatatacgagtgaaaatgaaaaatctctgacaactttagaaattattttctcctccccaaacctgtcacttttgagaagttagcttattttggaaaaatttaggtattggaaactcttagcatactatagtatgtgaaacttataaaaactgtgtatgattgtatatgcagtctttttttttctttttttttttttttttttgagacggagtctcactctgtcgccaaggctggagtgcagtggcgtgatctccgctcactgcaagctccgcctcccgggttcacgccattctcctgcctcagcctcccgagtagctggaactacaggcgcccaccaccacgcccggctaatttttttgtatttttagtagagacggagtttcaccgtgttagccaggatggtctcgatctcctgacctcgtgatctgcccgcctcgacctcccaaagagctgggattacaggcatgagccactgtgcccggctggtatatgcattcttttttaaaattttgtttagagtttatgaattatggctttggaatcattattaattggcatggagctctttgttctgaaaagttctttttcttttgataaattaatgtagatcaaaccaaatttattacaaaaggaaaaattttattttgaatgatataggattgaatttaaggttaagtaatatggagctgggaaaatggcaaggcagggctcttaactttcacaaaaacttaacattaataaaaagggaaatcaaataatacttggagatctcaaagcactcttagaaactttgtctaattaagctttccacccactgtgcaataaatattctattagctatacaggtgagattctaagaatttctaattaagttgtgttcttttttaccgcggtgctcaaattacacagtttgccaaaggaaatgtgtgctgtgtcattgtagcatgattttcaatggagttaccatctaatttctccaaaccaggcattgtgtaacactgttgtcactttctgtaattattttcactgttacactgtgattttgaaaaattattgttaatgattacagttgaaaacttgtttaaggtatttgcatctaagaaattgtttacttccaaattgtgtgggtacgtttttagttacttggattcagatcctatttatggtaagcaggtttctttggggtagagggagggcagatgtggacaaagtggctatttgtggtatcctaattctgggtatgaatatcctggattccaggggctttgcctggattctagggtgagttgttatactttattctctccatgtgtattatgataatacaggtgattaaagcatcttgaattttaatgtaatcttttaatttgagcttttgattgtctttttgaacattatgcaatcatgttttctttgtactgttctctctaaaaaatgaccaaatgccaaagattacatgatatgagaataatttgcttatattgtatcatttttcatactaaattaatgagtgggaaaatctacattggctcctgggtataaaataaagttccttctacaaactgttgattactgacgctacaggagtaaaacagaaaaagttttattcatattaggtttcttttagaaataagattgtggaggcttttctaattgtaaaaacaatgcaagattgttgccaaaagtatgagaaatatatacaaacactaagaagaaattaagtcacttttagtcgtaactgcagatggttacattttaatataacattttcaaggattttctaggccagccaatgcatttttgctgaataatctaatcatctaaataatcttaatctaatagtactgattttgattttgtataagcgaaataagcctcttatttatttcccagccagaatatacattgctataccagtaaatactagtaaatattttactcttgacattgaatcaaattctaaatttagctgtcatcaagacattcatttttcctcatatatttgtatactttttggctagcttgcatataaagtgataacaataccttaagtgtgatataacatatatattaaactatcccctttagattctaggcatctaggattttcttgtggtgaggattaatgatactgtcactgaaaatatatatgtatataaagaggaaacactttccctgcaaggacaaggatttcacactctcactgttgtagaagcacaattgtagaaacttttgtctacttctttttttttttttttttttgagacggagtctcgctctgtcgcccaggctggagtgcagtggcgggatctcggctcactgcaagctctgcctcccgggttcacgccattctcctgcctcagcctcccaagtagctgggactacaggcgcccgccactacgcccggctaattttttgtatttttagtagagacgaggtttcaccgttttagccgggatggtctcgatctcctgacctcgtgatccgccgcctcggcctcccaaagtgctgggattacaggcgtgagccaccgcgcccggccacttttgtctacttcttaggaaagaattaaaattgttcgctatacacttttggaaacagtcccaatggggaagaaaatgggtctggaaatcatgtttactactacttgtctaatattcttaaccactgaacttgcaagttatggtaacctttttttagaagtgtgttaagaggaacaaaaatttttctggtgcagcaattatcacctgcagatggcctaatattagcattgagttaactccagaaacagcctgtgagctgtgaaatggagttcagatagatagtgacaattcacagaaatgcctggtatattcatataaataaccaaatatcaagataccagctgatgcttacagataactctactaataacttagctaaaaatcctataaaaatttggtgttaaagaaaatttaatttgatctgaatataacgaagcctcttaactaatgcgtagaatattaacgatttgtatatacatactcatataaagaaggcttgaaattcaatttattgtgacttataatctgattagaaggaaagataatttcattatagatgaaggcattaatcaatttgataaaagcatgcagatttcaggttaagttttctcaggcttttcattgttattatttgacagattaaaaaaagatgttacattttatgacaaggacagagaatttagagtcagaatgtaaaaggaggagctcatgagctatgagaaagaaattaacttttgcaggggagaacttgtgtctttgctgatgaatcctctagtcgttgagcattcagcaaatatttctggcctttaatagccaggcattgaaatcagtgtttatgtcaagttattaaaacttcttgagttttaattcatatatataaagaatatattttgaacatgtccctacataaaaggcctcttgatgaaggaaacatttaatgtttagcatgccatgatataattttgtaagtatggttttatgttatggggttttgttttgtctcatgattttctagataatttttgccattcagaaagcagacatttaatatatacatgacatgcatatggtataagggaaaaaatagctcctgatattcccccatctccctgcccccaatattccaactggaaatagaagagggactgtttaagagagccaaacaggcagtggctaccccttctggactccacttagctgctttatagttaacagatctcatttccttaatacaaatgcgcacgcacacacacagacacacatacacctgggtaaagacatttttattaccagtctccttccttattctgtttctggtgatctcagaactttggagaactgaattatagcttcccttcacaaaatgctgggggaactctttataatactttagctaagcattatggtccctgatgaaatgtgctaaataaaaaaaaaaaagttttcaaatactgttagggttttgtataatctatcctttacaataaaatacccaccactgttaatatgcctgatgtacatctgtactaccatacaaagctgttcataatacatctggattggatgttcacatagcagaatttaccttgttaaatctggctggcattttatttcttcagaatatttctaggaaaacaaaattcccttctcatcagaatgctgtctactttaattaatatgaagtattattcaagatagaaacaacaaaatttctatgcttagcatgcattgaaaccttattattacaaaacagcatctgtttcttagagaattgatgatatccaggagtcagaaattcacgttacagcctcggtatttaactgtgaggtgattttgactaaaccattggacttctgaacttttcttggttaataatatatcaaaacagagtttaaaaatagcccctctcattatatgtatttagtcaacaattatggagtccttaaaaaatgcagatgtcaccttttcatgttggttactagagatcacatcttaactctctttaaggatgagttttacttacagctaactagaccaacaagagaaatgaatgtgaagttacacttactctttgccaacctaccactttatcgtattcttttaaagactttttttggctggaaaagtttatgtgagctcttgaggttagaaagcttaagtcatcttggtaggcaggatatttcttctgataacatatattcttttctgagaatgcattttgggaaatgtagattttcactgtaaatccttcattgtttgaagaactctgtgccagtattacatttcaggcaagactaattttagccaggttcattaaagtattccctgtgttctctccagtaatttcagctggttcctttttatgccctcttgacacagtcacattctacagtgtacagaaaataacctgctgtctgtagaagtggtgaatggtttcatgattcccttctttttagtgtgggtgagttttcttcactctttttctgttgcctgcatccttggccatcatgaatgttttgctttctctcttgcagatgacacaattggtactgcctggcatggtggaaaggtgagtcacaagctcacatacaaacactgtggaagcagagctcatgattatttagagggagaatccttgctttgaaaaaatcactgaagtgactaatgaaccaagcctccatgtcttagccacagagtgatgtaccaggcgagtcacagtagagcatgagtcatcggtggtggaggccttttccactcgattccctttttatttctctctctagggttgtagtggttcctttagatcaggatgaaaaagcctgcctgagtcaccatcactaactcaattgcctactattctgagggggcggatagagttcctgggatattcccgggaataccttcttaaagctgtattctctcaaagccaaaatcagtggagttggatgaagcaagacctcttcctctggtttttcactttttactgggagaatggctgttatataaagtgattataagatgtcaaaccaacccttggaggaaaaggcaatgtccactcgccccatctttgttccagtttgaattggttctgctagtacatgccgaatgtcttcattttgattgagaaatatgttgtagatttctgttatctgaaatagcatgaagtgtagaattgtaattaagctgtttcttccttggaaaaatctgaatgatgtctaggccttcaaagaaaagctgctaaaaagatttgggcttgcatcctgagctagctcgatcatttgctgaatttagggcatcgtagtcatctttttttctgcaaaataactatgagtttggaagagacccagaggaatcacagctttgaaaagggaagacccaaggaccctacttctgttaggaaacctctatgacctactccaggcagggattacagcttatgtttattgagtatatagtaagtgccaggaacttagtaagtgttaactcatttaactttgatagcctcccaccattgtacagatgaggaaactgaggttaggaatccatttgttgagcatctacagggactagttaagaaacagtttctcagcaaagctccttgtaatcccattttatatacactattttgtgtattttaattgttttattttagtaacacttccctttaaaatcttcaaactgcctattgttaggtgccagtgggagtggacccctgatggtcagatatataaatggcagtggttagaccagaccagaaccctagaagatggtagagttggggcaaagtagaacccaggagggattaaatttgggccatcaccttaatcctagttttgacatctgcaggtaacatggtattggttcagaatagtaaatctatccattaaaaaagaaacacttataaaccacagaggtattgtaaaaggaatttttaattatgttgatgaaaaccatatcaaaagagataatggttgcaaaatcattttacagcataaagtcttagagtcaaagagtcacagaaatccagtgcattaaattaattgacagtaacttccctcctttgacagatgaaaaaatagaggcccaaagagatggagtgctatgaagctatacagttagtaaataatacaaaaccaagaagctgggaacttcactgctatctctgtagacctgacagccatgatcacagctggagcattacataaaggcaatgcaaaaaaggagagtccatccattcaataggcattcatttagtcaagcgtctcaaggatgagttggatccttgccttttaagaaatcaagttgaagctgggcgcagtggttcacgcctataatcccagcactttgggaggctgaggtgggtgaatcacttgaggccaggaattcaagaccagcctggtcaacatggcaagacctcatctctactaaaagtacaaaaacattagctgggcgtggtggcacacagctataatcccagctactcaggtggcttaggcacaagaatcacttgaaccctgggaggcattggtcgcagtgagccaagatagtgccactgcactccagcctgggcaacagagcgagaccctgtctcaaaaaaaaaaaaaaaaaaaaaaggaaagatcaagttgattttaaactgaggttgagaaatggtgggaagttttcagaagctatgactgaacctgacaccacattaccattttgatacgtcttaagagctagtgagaaatatatgtggatgttatgaatcaatacttttggttaggaaaaggaacgtctatgtctacttgaattaaagaacttagttactagatgtgtcagtcaaggtaagctacctgctgaaacatgccactcccaaatctcagtggcttaacacataaaggtttacttttccctcccctctctacccgtcattcaggatctgaggctccttccatctaggggcgtcatcattttctagggtcttggagttctctgcatccagctgacagatgaaagacaagagagtaaagatggttttaagggaagtttcacttctgcccacatttcattgtgcagaactcagtcacaggctacaactactgcacagaaggccagaaatattagctgtatgcccaaagaggagagaaaaattccaagttagcagatcatattgaaagcattcttaccttacatattataagtggtttcattatagcctgctctttacaccatccccaaatggcttatttcctatggctggtttccatagcattagtatctccattgagtaacagcagagtcctttatcatgatcctttgttgttgttttccttccactgcttccacctctgatgtgggagattttccaaaccctctagaactatagcctagggccaactgactatcgctaaacaaatacctataatcaaactaaggtattgttaccatagatgtagaaagtacataattacattatagaggaaagttgctcttttcacttccctggaattataaacattgtgtacagctggagccaggaggtggttgccataacaaccatgggaaagctaaaaatagcccctttcataactgtattgcttaaggtggaattatgacatgttatggtgttttagggcaagtaattctctttcatgtgctgaatgtttgcaaactttcttccacaaagcaatatttgtacaatgtaagtatttggattgctggttctaattatacacctgacccctatgttctaagattctttttgacatagatctctatttttataggtttctcagtcttcgtgagcatctgttacagaactgtctgtgccaatttcagtattatatttaagctttaatatatatatataatgacaaccctccccctcaagagcctgcttttgtactccttgatatgaagtggaaatgtgaagaattgggatggaatttttttttttttgtacattcttccttggctacaatcaaattctgtatgcagttagcagtccccactaggattaaccctgcagttccggttcctcatagcagcaggtctctcttcccacctgcactgtgggacagtgatgaggtttctaaggaaggtagaaaacagtgacttacttcaaaggagacctattacgtcctctatgacagtagaatttttatagaggtgtggacaaggataccacaacagtctgatagaatattaaagcacttataaaataaaggcttggcaatttttttttaatccaggtgacaattaagggagtcttattgggaatttcacaggtctgagggaattccatgagagagcatatctataggaagctgtaagtgtgagggactgagttttatagagttgggcgaatttaatgtctggcttgtgggaggactagtaattaaagagaatatgtttatatgaaaaggtactttcctgtcagcaattggtgttttctgctttgggttttttcgcaacattttagttctagtagatcctcagtaatttgtaccactgagacagcattgtgtggctgttagcaagtaagcagtataatgaattaagaatgttgcattacagaaaacattgcttgacttgtttatttggatatttgtcataacaaactagaaaatgcgctgaagtatgagcaacatgagtcttcattatagaacttcagcaaaaattcttaatgtaccttccaatcttagaattgttcccgagtccccagaaaatgagagattaaccagggtttagtttcatgtttgtttctgtgtgcaattaagcgcagcccattttgtccttctgcttgatataacagagttgtcatgagtctggctgtgccatggaaactggtttgacgtcactaattctgcttagatggaggattagagctagacaacacggttgatttaaagggcgagtcttttgtgccttgcagtcccaaatgctcagccccgtttctacatagagaacagatactgtatacagtacaaagattgaggcaggctacaccagtatattagctgtgattcagacagaactaagttgaatattattgcctttggaaagaaagagcgagagagttttacactgttgtgtgtgtgggtgtgggaggaaggtttttgttagacaaatatgtgagcttaatggtaggacagagatttgtagaagggctattttctctactgtcactttggtacaattttaaatgctactcttttatttacttaggtcgagtgcattcttgctttatcatttattagtcttagatttgttttcatgtgttttagcatgcaaatactgtattttgtatgaagtaccctcaaactctgacttttcactaattcaaagcaactccacctcctagaagttttcaataggattagaatacttgagaaacaaaatcttagttgccttaaggagcaaacaagtaagggaggatgactgcatgaatgtgacattggataattgatctgtattgtattttaatatgggaaaggaacttttattatctttaaatgacttttcctgtacttagatcattgctttggtgagtgaagttttaagggtctgttttgatcaggtcaagatttaatttttaaagtgcacttgataatgttaaattttaccttttacagatttttaaattgcattttgttagcgagaaatgaaatttaaaatgtaaggtttctgttcaagggcacatataacaaccccagctaacttgagtataatggagcatttaatccagctgttaggccaagcagtgataggctgcagcttcagtggaaagcctcatttttctgcatctacttcaaactagttgtgtcttcacttgctgtgaatgagtttggacatagctgttcccagttatgtgagaaaaggttaaaataaaacactacccatacctacaaggatgcttaggatgcaggagaagggttgacttgtcaagattgagggttacttcttagaaagcatattgtgttgcatacgatacaatagctctcttagttttcacttgattgggatctgctcccagtttaaaggtgatacattccaatatgtcataaatatttttctctctcttttcatagatttgttgagataaatttcacatactgaacaatctacccattaaagtatacactttaatggtttttagggtattcacagagctgtgcaactatcaccacagtctaatttttgaacattatcaataccccaaaaaagataaagatattttaaatattacaaattaatactaaattaaaaatctcctgtaacaaaagtggtttttctattttcatcaaaggaatttctcagaaatatagataaaatgaaaggactagatattcattgctaatttaccagtttttatgttcgaattgttgggttctaactcctgatacaaattcttaccttaaaatttaaaaagaaaagacttttctgcttctgaggaagacacagacaaaaaataccagaatgatataattaacccattgactacttatttccaactttattcaaaaccctcctaatatttttaaatttgaaatgtaatttttatcatcaaaatcttaatgggtttcacagtttaggaaggcacataatactaataaggacttctgttaaacaacaacaacaacttctttccagtgacacagactaagctgaggactcccacttccctttgatggttgaagtggcatctcacctagaggctggcagatggagcgggtgacttttggggattatttcatttcagatttatgcctaaaataacttaaatgccatttaatcatgtatcctttattattttgcataaagggggtctttatagtcccttttttaagctaaaaaaataggtgttgggaagtaaattcagacaaagaacaatgagaaagtgggttaaggaaaggaacctagtatgggagataggaggtgggtgggatcaggttgcagtggctgaaaaaggggaatcctctgagaagaatggatttgaggggaagatatggtagctgtgacactcctaaaccataattctacactttacctaacctatacatactttttaacaactggtatctttatagcattgcttttctcaagctaattttcacttttttgtagaattagaaattcctggtaactttgattttaaactttcagtagtctctaaaagttacagtaacagttgagctttgccttttggcaaaagacacagtttgatgaactagagtcacataattttagagtcaactctttgttggtgcccaagtatctacaacccagggaaagtagaagtagacagtagaagtagaatctacaacccaaggaaaggacatagccattcactcattgccagaaagttttattaagtacctgttggttatgtgctcagtaccgtgtggaatattttgagggaaagtgggctattatatccagaagcttatggttttgttggggggaggagagaatgtttatatacatagaatgattaaatcctacagtaaagtagtatgtgacgatatgttaaaataaaggtgtatgcagggaatataaaagatctgtaagtaaaaattctcagcactgtggctagagaagacctcagagggtagagatcaactcgaggagactggagatctgatctggttatgccctgggttactaagactgggaaatgagctaatcgtgaagaagagctatttttagttgattgaattatgtctcatttactgaccaagcatagcacatactgatgaaaggcagggagagatatgtggtagaaaaacagctacattattctgtttcgaataattatatatctcaatctgtaattcacaaacaactgcatactgtggcttcactccttttacacggtacattttcctttttagatccaaaggggctattctgaacatttcatctggcagtggcatgctccctgtcccactcttgaccatctattctgcaaccaaggtaaaaaatattttcttaaatcatgtcaatatagtaataaggggtaatttttagtctgagaaattaacgtagatttaactttcctgaagttctgttcttggcagttttccagtagactgagaagaaaaggaaaataccctacttgagtttcaaaagaaccagagttggagacatactatatacttacaataaacttaatgtaaacttacaaatgggacaccaggatatcagattcacagatgctgtttttctccccccagcactctactgattttgaaagtgatacttgtgccttccatagacaggtgacctaggcagatagcttagttaattagaacatgatgttaatgagtctaagattggagatttgatacatgaatgagtccacttcacacagcatagaagaaatgcatctagtcaatgtgtaaatgtacatagcaggcacaagatagactgggcgagagtgtattttgccatgttgtccaggattcatagatattctttgtcacttttggggtgagacaagaattttccagaactctctggacaatgtcataatttcatacaatatcaccattaacctcttcacattactgataggaaagtaatttagaatgagtctcctactgcctgcaggtcaatggcgtcatcttcagatacattgttgaggcattgaatacatctctgaagggaaaatgatcacttagatgttgaaattaagcaggcttttagggaaaaataaacaaaaatatgtacagtaagaacttgaaacatttcagggaaggaaaagagcaaaactccgacttctttttcatgtgaaaaaacagtcaccactgtcttttgaaaagcttggtaccacctcccagcccctacaatctactttctgtatctgggaacatactgtaggcaaatttaaaatgaatgccatgtttcttgaagggattcgtgaacttcaacttatctgttctactccatggctacaaaactatgactaattaggacccttgaaaagtcacttgattctttgcatttctagtctgaggttgcgtccacatttgaaaaatggcacattgtattttacaaatagatttaaggttgtattatcagaagaagatgggctgtcacattcacctctatacttcttggatcttgtcatcccaaagcaccaagaggatgcttgttctgttctttttagcaacaacaaaatccccatagaacagagttgaatggacttcatcttgtgtttctatttgagtggcaagtggagagatgaaatgagtcttttgttatataagagaaaaatattttttcttggaaagtaattttctgaggggagaaaaagataagaaaagccttttccagttaaatcaaaatttgatctggatattatatttggtaatataatacttcatttagtggcagataaaaacagcttgaggttttcaggtgtttttctaagttctcttctgcgtttgaaatgaaaaaaatgatgagaaattatagcattaaatgattagtttattattttgtttccatggctacaaatcaggcagattgatgtaatgtgtgtgttttcttctcactcccactcccctcccagacttttgtagatttcttctctcagtgcctccatgaggagtataggagcaagggcgtctttgtgcaggtgagtggagtttgtttcacttaagtatccctgtttttgtgtggtttccagagcaactgttgctgtcttggcaataacaaaaaaaatcatattcctaagtaagtgaatgtgacattagcacaccattaaaaacgtggtttctttttccttaatgcacttgtctagatttttaaaaaattatcccctagaattttcaagtagggatacctaaagtggaactaaatgcagtataaatagctgaagcatactttttaagttcttagggttttattttgagagaccgagactatcggcatctctctcttttttaattgtggtaaaataaacataaaatttaccattttcatcatttttaatatgcagttcaatggcattaagtacattcacatatcgtgcaaccattgtcaccgtccatctccagaacttttttcatcttccaaaactgaaactctgtacccatcaaacatgaactccccatttccccttccctccagcccctggcaacctatctatctctatgaatttgactactcttagtacctcatatgggtggaatcatacagtatttgatcttttgtgactggattatttcacttagcatgtcttcagagttcatccatgttgaagtatgtgtcggaattttcttccttttcaaggctgaataaaatgccattgtatatagaccacattttgcttatccatttacatgttagtgggcatctgggttgtttctacctgttgggtattgtaaataatgctaatatgagcatgagtgtacaaatatctcttgcaaactctgttttcaattcttttgtatatgtatacagaagtggaattgctgggtcatatggtaattctgttttaaattttttgaagaacttagctattttccatgtcagctacaccagtttacacttccactggcagtgtgcagagttccagtttctccacatcttcaccaacacttgttattttctattttgtttgttttttataatagccatcataacgggtatgaagtggtatctcattgtggttttgatttgcttttccctgatgattagtgatattgagcattttttcatgagtttatttggtcatttgcctatcacctttgaagaaatgtctattccagtcctttgcatatgtttaataaaatcgtgttgtttggtttcttgtcattgggttgtaggaatgatctatatattctggatgttgtcccattttagatacatgatttgcaaagattttctcccacttcgtgagttgccattttattctgtctttagtctgcataatatctttttattcacaaaagtttttaattttgatgtagtccagtttatctattttttattttgttgctggtgcttttggtgtcaaatccaagaaatgcttgccaaatccagtgtcatgaagcttttcccctgttttcctgtaagagttttctagttctagctctttgatccattttgagttaacttttatatacctttgagtttattatgtagctagcagatataatgctgtgaaaacacaaaatatgagagaaagcaaatataggagttttgatggttggcaatttcaaattaaccattcttcaattgaaagaaatagtatttccatgctcaggcacttttaaaaaatgtcttgggagaagttgcaatttgtacctctttgctgctcctgcctatcagctaccccacctctgtgcacgtctggtgttcattgtggctttcattcctgtgaggcaagtatttcactttttgtatcctgaagccacaaatgatcgatcaaaataataatagtgaatatttgagtggatacttttcaggtacagtgctaaacactttaatatgtatcatttcactgcatctcataacaatctcatacaatggtgtgatgatgattattattatttttaattgcagaaattggggcttagagagggtaagccacttgcccatgttgaactgggactcaaatctgggtctgtttggcactaaagcctttgttcttaaccactaggctacttgctccaggcctgtaagtcaacattgaacacttactggatccatctgtgctcagggagtgatggaaccagaaggtggttggttagttccatttcctcctttatgcctgtagagcatcaagatgggtgtaaatgtcatgtagatgtagcttctaaacctttttattgagtagatactggtgggagctaagtcacctactgtgagatagaatggtaatgaaaggaaggggggatgactgtttcctcatcttccaggatcatctaagagcctgcttcctctaaaccccgacctgagctttcatccaagggaagcttagatgtcatagccacttggtgttatttctgacttgcagcttcccatatgtataggtttcattcggaaggacatgtgttctagaatcctggattttatactaaattactgtactctctttttcccctttccttgacaccagtcattttaatgttagtaatgcgaatgttctatgtagaatatgttgtattttagtaacaaggacaccagtaaaatgttcttgagaagctattacattccatgagaaggtattcatgggaaggtatcacatgccaggcaatggtataccattttctttctgatgaatctaattgtaattacactattaactgaatagtttgtaaacacctattgcgactaggcaggaatcctaaaaaggtccattggtgattgactataagcagagtgaccagaagctgtaagtgtctcagtgacagaaggtagcattaggccttgtgaacagacaatcaatttctaaaattccgttaataagcaagactgtctcctctctcattctcacaacttgtttccctcaaagatcttttctccagattttccacctagtaatctggtgtgactagaagctactgtaaaaacacattagcatttgtcttctgaaatattttattttgataaacttttgtttttccctaataatgaagtataaactgtcatttcatctgtcattgtgttttgtcatatgaattcattcaaggtttaaactttgaatgaatttgatgaaaaaataaagactcaaatgtttgtgagggaaagcacagtcgtcattctgtgtgaatacatcagaatgttgaagtagaatagaaagagaacctcttattaattctgatcaaaggggcaaaaaaaatgtagtctaaatgaagctcagagttaaaaatgattggtttttctttggcggtgtttatgcccacaaattttttggactaggagtatttatcagctgattctgcctcgtactccagcccacacatgtttcctgggtgatcttattaaaatacaaatcagataatgttgctttccttcctagtcctccagtggctgcccataaggtttaggattaaattcgaactccacaaggccatctcctttcttgccactccattgtcctccccgacgttcaggccagagtggacatcccagtgtctagtacatgctctgccctctgaagtgcccatgactggctcctctgttggcatcctttccccaactcctctccagttcttctcactgtatctcctcccagccctatttgcacctgaaccctatggctgctgtccctctctcaaggcttgggccacagttcccctgccctggaaagccttctctcagctccttggcacatttggttaggcctttctttgggctctcgttggagctccttgtatacctctgcctgctactgtctggcccttccctgtctccccacttccatgtattctcgagaacagggctttttatcttatttgtctctgtgttgctggcggcacttgttgtttgtggtaaacgggagacccaccttttccatggcatcacagaaaactctggttgtgcatggtcaagctttgtggtacacaggcatctgttttgatggctttttgagcttcttctattgctcccatatgctcctggccttgaattttcagcctctttatctgaatggcttctagactaatgctatgtggccatgtttccatttttttctaagccttgcaaagaatgctatctttttaggtctacctccgtgtgaatgtacatcagattgctcttttggggaaggaagagggtatattgttcaaattctagattgtttcagattacttcttaatatttttcttttgcatttctctccccatctttccctcaacttcttaacttctttcctataattttataagatcatttaaaattgccttcaagaattcagatttgccattatataatcatttcctgggaatgcaaaaacacagtaacaacaacaagtgatgtaaatgccctggaggtgaatgatgggcctgagagactatttgattttgaacagaggatgagaagcacattctcaaggaaaccttatcataagtgtagtctgttgatgaggactgtttgttctcattaccttataattaaagtccagtcaaaaaaaaaaaaagacacttgtgtctttcaaaaggcaaaattattataagtaatttgactggctaggtagtgggccctagccctgggctccttctgtctaccctgtactgactagcagttaatactgagcaagcaggaagtagctaagactaagactaaatcctaaaactatacctcttgaactcttattctgcaaaattttcataagccttctgtttttaaaaaaattatttggaaataatttcaagtctacagaaaagttacaagaataaaaatagtgcagacaatactctgataccctttgcttagatttcttactgttaacattttaccgcatttgtcttatcattggagagtaagtgcaaacattatggtccttcaattctaaattcttgagtgtgtacttctgaaaaataaggggttgtttgtttgtttgtttgtttgttgtttgaagacaggttctcactctgtcacccaggctggagtgtagtggagctatcatggctcactagagccttgacctcccaggctcaagtgatcctcccacctcagcctcctgtgtggctaggaccgcaggcacatgccaccaagcctagcattttttgttgagacagggtctcactttgtcacctaggctggtctcaaactcctgagctcaagtaattctcccgcattggcttcccaaagtgctgagattacaggcgtgagccaccacacccaaccagaataaggatattctcatatgtaaccacaatacccgtatcaactcagatttaacagtgatacaataattttatctaatgtattatttgtgcccaatttttgatcttacaatattctttatcctctcctcttcctccactaaagaatgcaatctaggatcaggtgtcatatttagttgtcctgtctcttttatttcctttaacctgggatatatctaaaacctttgtgtttcatgacagtgacattttttaagagtacagtattcctcctttttaattatacattcctcatttggggtttctttgatgcttccttagagaaacccaaaagtgagattcggattatgctttccgggccaaaatatcacatatgtatgtgatgttgtgtcgtcagggcctcacgtggggagacacagaagatccatctgctcttcattggtggcgatgtttctgatcccccactctaggtgttacccaacttctctgccatataattactattatttcccttgcactaacaagcaactgtggggagaccctaaaactgtgcaaatattttggcccttatcaaaatttcccctagatgtagcatcagtgatgtttcttcacaaacctgcctcataaagagatttttgatgctaaagaattcctgaagccctgcctggatatttcgtcatttcaaaatgaaaagtcacagctaaagcatggtcacagtgtcctcagtccaggctgtggttttatgaaaactgcattggtcatcggtgtgccttgaggcagagaggaaaggacactgagcttggagtcagcagaccaaggtttgagttctgccttcaacatccggtgatcatctgacctacagaaagttgcttcattactttatgccttaatctccccttctggcaagtgggataagtgatgtgagataaaagcactccaagctgggaaatgatatataagggtgaagaagagaggaaagagacttatattcattggatatctacaatatgcccaagttttcacctcatttgtcaactcattttacatagatattaacctagtcccattttacaaataggaaacaggatcaacaggagccctgtgctgggcacggtggctcacacctgtaatcccagcactttgggaggctgaggcaggcagatcacttgaggtcaggagttcaaggccagcctggccaacatggcgaaatcccgtctctcctaaaaatacaaaaattagccaggtgtggtggtgcatgcctataaacccagctactgtagggggctgaggcatgaaaatggttttaacctgggaggcagaggttgctgtgagctgagatcacacccctgcatactagcctgggcaacagaacaagactttgtctcaaaaaaataaaaataaagaggagtcctgaaacttgcttaaagtcaatttagtttatcaaacagctcctgcctgctatttattagacccttggctagacatctaggaaacaaaggtaaataagacccagtccctgtgctgaaggcacacacacacaaaagacaaatatttaaacacattacacccacagtaagtccaaaactggaggtatatatcatgttccacatgtcttcagtcaagaaatatttagaaagcacctaataatctggcaaaaggcacacagagcctctgctgtggttgaatttacatttattgggagggagacagacattaaacaaatccacaaataagacaattgtatagagtgatacgttctcgagaagaaactaaaaaagagtgatatgttcaagaacatggggaagtgtagagagaatgtactgatcttggtgtgagtaactccgtctgcagtgccatcctgtttctcaaagaggtgttgctctccgtcacgcagtttccttcctttgacctgggaggccgggtctctggaaatgctcttaacaaggagatcatctgccaagggacaccatcccctgaggttttctttaccagaagaaaggtggggatgcagatagaggccatctaaacccagagaactttcagctgccctgaaaatgaagtggactttttcattcttagcaggagattacaaaagaatactccatttacatttgaacttattgtcctgaagaaatcctctgggcgccatgcacggtggctcacgcctataatcccagcattttgggaggccaaggcaggagggtcgcttgagcccaggagtttaacaccagcctgggtaacatagtgagacactgtctctacaaaaaatagaaatacattagctgggcgtggtggtgcatgcctgtggtcccagccactcaggaagctgagacaggagaatcacttgagcccaggaggttgaaggtgcagtgagctgtgatggtgtcactgcactccagcctcggtgatgggtggcagagcaagactctgcctcacaaaaaaaaaaaaaaaaaagagaaatcctctaggctccatttgcttgttactactttccagtgcctttgtcttggtgatgagagttggtggttttgttagttcaggtaaaagtgtagtttttaatcagaatagacttgatttgggttaatccatgaaatttagaaaacaaataggacaaattgagatgagagaaaacacaatttaagaattttttaatgaaagaagatattccttctttgtatttttgttacagtattttattgcttagggtattcatatagttctattgggcttcaaagaactagaaagctaaatattgagaaacggctaccgggattacaaatataagtctccatcctttcttcctgttaattgccagtgactatgaaaggagttaatagagtgtgtcttttgtgcatatggagtctaaatagggagagttataaagcaatataaagattctcgctggaaatgttcatgtatggccaactataccaattttgaaaaatggcttaagaatagtaaaattagtccttttgggctcattggactcagatcccttccaaccagctgaatctcgattttttcagtgatctccttttttcttggccatttacaacagtgttgtaccacaagacctacaagcttaagaggtccctccaaaccattacatgtgtgtccaggagaactaagatattcagttggttacctcaacagtcagatattctccatggaaaatggcattcttatgcgtcttattggatataaaaagtcagccaagctcttctttccaaattcattctaaaaatatagattttggaaaacttagaaaataattgctaatacatactaaagtttcaaatcccacactctttaactgataatattttatttaattctcatgatagtataataaggaagattctatagcctctaattacagaggaagaaactaaggctcagtcattgagtgttttgctcaagatcacacaactagtaagtggtcaagctggaatttgaatccaagttggtctgattataaccaatgctgatttttttttcctgttaccctaccacctctattttcacatcccaaacttaatcctttaggaaatccttgcagcatacccactatttgactacttctcatgacctccactactaccactctatctgagccaccatcatagcttgtcctggacattttgcagtatcttactatctggccttcctacacccatcgtggtttaacagcccctatagcctactcatagcagccagaatgatctctttaaaataaaatccagctgggcacagtgactcacacatgtaatcccaacactttgggaggctgagatgtatggattgcttgggctcattgagttcaagaccagtctgggcaacatggtgaaaccctgtctctacaaaaaaattaaaaaattagccaggcatggtggtgtgcacctgtggtccttgatacttgggaggctgaggtgggaggatggcttgagcccgggaggtggaggttgcagtgagctgagatcgcaccactgcactccagcctgggtgacagagcgagactatctcaaacaaaacaaaacaaaacaaaaaaatccagttacttcactgctatgctaaaaattcttccttggcttctcatctctttcacaatgaaaccatgagtttttatgaccctcaatgttctgatttcaaacttccacgttatcatgtcccctccccaccttcctacttctgtggcctccttccaattctggaaacactttgaggatgccttcacctcagggcctttgcacttgttccttcagtctcaaaggctcttcacccagatattcttttggccaactccatctctttgttcagatctttggttataagtcaccacatcaaaggggcctttcttgagaactcacctgcaggctcagcctctatcagctcttttacccaggtatttttttcatcttgcttttttatcattgcctgccaatactgtacacctttgttttaattattatttgtttgtggtctatatcctcctactgaaatgtaagctctgtaagattagggactctgtttttattcacaatgaattttattcattaagttcccatgcctaaaacattgttctagtaggtgctcaggaaatagtttagtgttaagtgaatgccttttgtgagattacactgtttttctttttgttccttgaatgttaacatacaaattccacatctttggaggtaggttatttacaagattatcagccaacatttatcaaggatctttgtgtagagcacaatactttgaactccttcattttggatttagatgctaagatttatatgtattgttattgcagggccttttttcattgctatataaccagggatctctgcaccagcagaacaactcctttttcctaaaatttctagaaagtctaagggtttctgccaagtagataatcaagggcctttatatggaaaagctaatttcgtggtctgcaagtaaagtaatacgcactccaaaactataatataggtgtataattatttaagtttttgtataccagatcctgaaatcgtagatgaatacacagatttcaggaaatggagttttcctaatattcttcataggagccccagcttctgccttaagagtgtgtgctggctacacggttgaatttaatgctcggtaaaggcagatgtgacaccatgtatgaaatctcatactgtgcaaatacactagaccctagtgtattctgggtcttcattttcccaggtcattgtcatctgatgttctggtcatttttcagttgaaaagcatgtttagtacacagatgatgacacctgaaagatgccctaccatgttaagttccaaggttcaatccctgattcttgaatatctgccatgcagtttcaggcatctttctttccactactccatggccataagccttcctcttctgaatcaagccccctgaattgtactgtgcagtccagttatctaagcaagctgctccagtgggtgagaaaaaagataccaagttgtcgggcctggtgcggtggttcatgcctgtaatcccagcacttgggaggctgaggcaggcggatcacctgaggtcgggagttcgagaccagcctggccaacatggagaaactccatctctactaaaaatacaaaattagccgggcgtggtggcaggcgcctgtaatcgcagctactcaggaggctgaggcaggggaattgcttgaaccagggaggtggaggttgcagtgagccgagatggcgccactgcactccaggctgggtgacagagcgaggctccatctcaagataccaagttgtctccagtgattttattttttttatttttattgttttaaaataggctgagcaaggaagcaccaacagctttgctttatggcctaattaattatttgccatgtgggaatgctaaatttgaagaccaggatacttgcccacatctgcagctctcaaggtcaggttgtttctgagctggcaatatttgtaatgggaacttgttgaaattgagcaacttgaaaaatctgttctgcccacaatttcctataaaagtatgagtatcttcttgacctgtttcccataatgttttcctgagtaagcaggagaaatcaactaattatcccttgttgggtttttatttaacagttgaagggtgtacctagatggctttttgatatctaagatatttctttactttcatataacttggaatatttatttttaaatcattggcaagtagctataagtatgcctgtttagataggtgctcttatatatgcttcagaatttctaaaattttggcttaaacattcatattatcaacttcttggtgtaattaattttctggatcatagcagtggaaagagaccccagtactcttcttcggtgctgtccataatgaagtgtctttcaccaattcattcaatagatattaattgtacccctgctatgtaccaagtactgttctaaaacattaaaatatatgaatatgaccaagccttcatggagcttgtgttctagaaatggatactgcccagtgattggattcagttttctgtaccgttttgcctccctcctgccactcttcacacatttccaacatttgaaccatcctgagctatgcagttccctgaaaaacatcatgctcttctgtggctccttttcttggctcctgctgttcccttatttgtttacaattagggaaattcttgcacttcatttaagacttagctcaaacgctgtttcgtctttgaaccctccactaggccatgttaactgccttgattttaaaccatcgtggaaataaatatactttctagaaaagaatttacatttcttagctggaaaaacataacccaacttggaattcctgagtatgcatctcttgtccccaccccttgatctgggggttctctagactagctctatggtttagctgcatgaagagttaacttgtggcaccaccaagtggttcagtcaggcagtgcaacttaattctcctacaagatcaaagtagtccaatttataccatgttacatacgaagggagggaagaagatggcaaaaaggatggacgaaaggaacaaaaaattataacgcagttgagaggtataatgattagaccatctctacctctagaagctcaaaatcttacaatacctttaccaggcttgtgatctatatttgggtttttttttttaatcttcactattttgtgacctttaaacctaatgcatagaaatgagaaatggtttgcttatgttccttcattatgtgagatcagagtatttacatatactctttctttccttactgctcaactttactctgggaaataaccttttctttactgacccattgtgagagcctcactgaactctgcatttcctactcagtctgagtcggagatctcaccctagtgtgtgctctcatagactatatccttgtggcaaaatggtccttaaaagatgtgacaaaaaatttttttttctaagtgagggataaatatatagtgataatcccaataaacaaattctcagaaatcaaaagttacctaatcaaagttggctcaaatattgaagtacttcatacttagtatgagtctgtggctgcagcaacaaggaaagaggaagatagagagtgacagcactccatctggggttcttggttctaatgaagaggctgaggtttcatctaacctgtcaaggagagtgggttgcattccttgacttagacttcggagtgggaaaaatgcaaagcacacacgtacataaaaacccagagacggccgggcgcggtggctcacgcctgtaatcccagcactttggaggccgaggtgggtgcatcacaaggtcaggagatcgagaccatcctggctaacatggtgaaaccctgtctctactaaaaatacaaaaaattagccaggcgtggtggcgggcgcctgtagtcccagctactggggaggctgaggcaggagaatggtgtgaacccaggaggcggaacttgtggtgagcagagatcgcgccactgcactccagcttggggactctcgctgagactctgtctcaaaaaaaaaaaaaaaaaaaaaaaaaaaccagagacatgggaccactccttctaggtctcagcaggacggaaatccatagaatggaacagatctcaatttgattgaaattttaagattttgaccaccatgtgttagaaccattccttttctttaatggaagtgtcattgggccaagcgtggtagctcacacctgtcatcccgacacttggggaggctgaagtgggaggatcacatgagcccagaagtttgagaccagcctgggcagcatgttgaaaccttgtctctacaaaaaaaattttaaattagctgggcatggtggtgcacacctgtggttccaactactcagaaggctgagacaggaggatcccttgagcccaagagctcaaggctgcagtgagctatgatcgtgccaccgcactccagcctaagcaacaagcaaaaccctgcctcaaaaaaaaaagaagaaaaagaaaaaaagaagtatcattgcagtgatacttcacacatgtgagataaacaatacattcactctttgttgaactaccatgcccaggttatttcaaactacagaaggacctcttgtatcatgactcaggacttgttacaatagggtttccttatactctgtgttgaatcacatccaaaatgcagcaagcttaagcaataaagaacctaacattattgaagttcctctaaaggtcatgtccagatttgtcaccctacacccatccagtcaggtgtcttttagttacccaaacagtttccatattgttagactgtgtttcttctaaaaaagaaaaaaagggaggtggttctatcttatcaataaaattgtttataaaactcagaagtagaatggtgagaaactagggaagaaaagtagtaacgcaagtctgagaaataagatgtctattttagaaggatcaaagctgatagaacaagcttaattagccataaattatggagaaagttggcattatcccattagaagaataaagtatcaaagatctcctacttggtggttctgtctcaatgttgagtttactaagtgtgaaaagtatcctatcctgaatctgtgctctctggattatttaatgctttcctttttaaaggttcaaaaaggtagatttctgcttatttttaatactttctctggtctcaaactctgttttattgagagattgatttgttacaatttgttttatggtatcatgtgttctatcaagttggctttagatagccacttctcttttcttctctctctgtaaagatacagatgtttctaccactaagagcagtcaagcaccactgtacattctgagtttgtggccttactaatcaatggcatgttttctggggtgggtgttccctttctagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatggtaggtagattttttgaatcacaaatcaatactttctggcttggggtttctttcccattgagttacaggatagtatgtaatagattagcacatatacattgtccagccatagtaacaagatatctatatcttgttataattataatggtcgtatacccaagaactttaaaatctacctataaataaaaacaacactataataaaacattaaatcatatgcttcaatttagcccaaattgtaggctataattacatatctctctcattctgtttccctagggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactcttttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacaca

SEQ ID NO: 2658 - DNA, 57963 bp, Homo sapiens
agcggaggccacccagagctcacagcctcctgccagcgcgctctctgtttctctgcagccccgaagctcgcgaatgtagcaggcgccccaagctcggtcctcaagaagccatggcggaatccaggggccgtctgtacctttggatgtgcttggctgctgcgctggcatctttcctgatgggatttatggtgggtaagtgaacaaaacactctaccccgactccggggctcgtgattctctgcagagataaagggagaaatcctggagctggaagggattgggctgtgcgctagccctggccggctgggctagatatgataaactctgcacatttcagcaaaactagaaaccagatggaatgtattttgggcttgctaatagataaagtgtgcttgaaattcaaatttattaaatgttcactgagttcactaaagacaacctacagctgtcactgtctgcagggatgaaaaaaaatcgttttatttccaagcaacattagtgagtcaaaactttcaactaatacgggcagcattaaaaacaaagcaaaacgaaacaaagcaaaacaaaaccctgctctatacgtaaataaatatttgtggaatgttccctatgtgtcagggactagagatccagggaagaacaacaaaagccatgccttcatgcataacgtgagaaaatgaaagagcttctcttaaataaaactccttttaagcatctaaaaattatattacatatcagaatttacaggttttctgcatttaatataaacattattttttaaagctcaccatgatctacttgtcagataaaggctttttggggggaaggacagaggggtggcttctagttttaataaagtcaaagtgattttgtgtgtatgtgtgcatgtttgtgtattttttttccttaggctggtttattaagcctctcaaagaaacgaccacttctgtgcgctatcatcaaagtatacggtggaaactggtatccgaaatgaaagctgaaaacatcaaatcatttcttcggtaagtttattttacgtatttgatcttaaaaatcatgtttaaaatatcacagtgagaagcatattatacctggttatatgcatgaggacagtcttctctgtgtgaaattacatattagtcatcaactttttttttttttttaatgtctctttacaccagtcttggggtgaaaaagtaggtctttcttccctaactttatgtaacaaaaagtatctggttggcttattgagagatgtttcaacttcatgtaactttggatctaactgaatgttattctttgttcatcagtgcctgggttttaatcagcaattttcttagataccatattctgtcagggaaagttagatgatggttgactaagtgatttagtggaaaagtgatcaaagtgtctgattctgtctgccaaaagttaaacctttatcccatcttgcaggtataaatttgttttttacaaataagacaaaatgaaaccaaaaagaatcattgccattcctccagcttctaaccatgaaaaacagtggaaattgggggagtgatcataaactccttaagaacaatggccatggtatttatttctgtattcagactctttcaaatgggtgttattttttaaaatcagctttagtgaagtataatttacataaaataaactgcatccctataaagcctacaatttgagagttatgacagacgtatgctatgctgaacaaaccacctcctccatcatgctacaaaaatattccattatgccctttgcagtttattccccatccccctccatctctgtcactgggcaatcactaaccaattttatatcactggagattcatttgcattttctagaatcttatttaaatggaatcatatagtatatgttcttttgtatctagcttcttttactcagaataatgattttgagattcatctagattgttgcatgcattagtagttcattatttttattgcagactagaattccattgtatggatatattgcaatgtataattgatggaaatttgggttgattatagtttttgactattgtgaataaagctgctatgaacagatgtttacaagtctttctgtggatatgtggtttatttctcttgaaatggttgagtttgatgataagcataagtttaactttttaagaaaatgcctaagataagtgaaaagtggttgcatcattttgcatttctacctcaaaataaggaaatcagtattccaaagagatatgtgcactctgatatttaccacagcaatattcacaatagccaagataccaaatcaacctgatgatcaacttccatcaacaaatattatggtgtatatacaggatggattattactcagcataaaaaagaaagaaatcctatcatttgtagcaaaatgaatggaactaaatgtcattatattaagtgaaataagccaggcacagaaagacacatattgcatgatctaactcatatgtgggagctaaaaaaaaattgatctcatggagacagagaatagaatgatggttaccagaaactagaagggtagtgaggagggcagacaatactgaggggttggttcaatgggtacaaaaatacagttagatagaaggaataagatctagtattacatagcacaatagggcaactatagttaacaataatttattgtatatttcaaaataactagagtggatttgaaatgttccaaactcaaagaaatgataaatgtttgaggtgatagatatcctaactactctgatttgatcattacttattgtatgcttgtatcaagatatcacatataccctataaatgtgtacaagtagtaggtagccataaaatttaaaaataaataattttagaagtctattcacggctttggcttattttgtatttagatataagttgttttccccctgtggagttttttgtttgttgttgatgttgttgttttgagacagagtctcactccatcacccaggctggagtacagtggtgcaatctcagctcactgcaacctccatgtcctaggctcaagggattctcccacctcagcctcctgagtagctgggactacagacatgcatcaccacacccagctaatttttttatttttgtttattttatttattttgttgttgttgttgttgttgttggtagagacagggtctcattattttgcccaggctggtctcgaactcatgagctcaagtgacatacccacctcaccctcccacagtgctaggattacaagcataggccaccatccccaaccctcctatggagattttagagttctttatatagagttgactcttgagtaatgtgggcatagggtgctgaccccccatgcagtcaaaaatccacacataacttttaattcccccaaaacttaactattaataccctactagtgaccttagcaataacatagacaattaatatgtattttgtatatgtattatatgctgtattcttacaataaagtaagctagagaaaagaaaatgattttaagaaaatcataagaaagagaaaaagcatttactattcattaagtgagtgtagattttcatgaaggtcttcatccagtcttcacattgagtaggctgaggaggaggaggaagaggaggggttggtcttgctgtctcaaggatggcagaggcagagaaggtagagaagggagtcaggaaaggcagtcacattccatttaattcttagacatcatgtatgttttttgctttttcttttctctaaaaatatttttatacactaccagttcttcttccatcatttgctttagttttagtgcctatatcatagaaaggaccgtgttgtaaaagaagtcaaaagcagtcttgaataatggaaacccttctgccagattgtctaatatcatcttgttttctggcattgcttcttctgtgtcttcttcctcatcacctggtactggtttagaagtattcatctccatcaaatcgtcttctgttaatttttctggtgtctactaacttttgaatttttccaagattactatcatgaaacccttcatccctcaacttttttttttttttttttttttttttttttttttgccatattcacaatctctttcatgattaccttgtttggctctgtcatcaatcctgtgaagtcatgtcaacatctgcacacagttttctttagcaggaatttgttgtgttgggcttgatggctttcacagcattttctataacaatgatggcatcttcaataatgtaatttttttcagaatttcatgaagttctgtcagggttctcttccgtagtattgacagtcctttccatagagtgcagtgagccttaaaattcttattatgaccccttgatctagggggcaaattagagagatgtgtttgggggtaagtagactacttgatctcagggtttctgggtagccagaggtgtcttccaataccaaaagaattttaaaaggcaatcccttcctggcaaggtatttcatgactgcaggaacaaagtatgggtggaatcaatctagaacataggtttctgttgtccaggccttcttgttgtacaaacaaaagactgaaagctggtgtttatcttttccattcaaggcttgggggttaacagcttcatagataagggcagtccttatcataaacccaagtgcatttgcacaaaacagtagaattcgcctatcccttcctgccttaaatctcagtgcttacatctcttccttactcataaataccctttgtagcatccccctctgcccccaggatagggcattttcatttgcattaaaaaaccttttcaggcagatatgctttctcctcagtaattttcttaatgtcatctgaagacttgtctactgcctcttggtgagcagaagctgctcctcctcttatctcgacactttaagttaaacttctttctaaatgtatcaaaccatcttttgcaggcatactattctccacctttaccttccttttgctttaaattatcatagaatgactttgctttttctcaaatcacattaattagagtctatagatatgcctttcttataacaatcctacacccacataaaagctacattttcaatacaagaaaaaaaggtaatttgcaaaagaacaaagttttcacatttgcaggcatagctgccatgacagcttcacaaacttttcctttttttttttttttttaacaatagtccttatgctggatttattttgaaaatggagggcaatcacagctgcatacctcagtctacggtataccaagcaattcaaccttttcttataatgtatcattagtggcactttgtatggatcccacggtgttattcaaggtttacagtattgtactaaacatggtaagaactacatgagaaccatgggagatcattttttaaactgccataagcaatttactggagaaacaaactgttcaggtagtgatgattagggagatgattaatatcacacagtggtttaagcagatagtcacctcacaagctcacggcaagagcaataagctgttgctacaaaagtattactgtagtacacaatgtattacagttaattttacataattatgattttatattgtatctttatgtttgtttacatttctctagactgcaaatggcaccatgtagtctgtaactgtatgcctacgttttgatacattttaactttttataatagattcatgttattttaaaacagtaaatgataaaatacttttacatgtacttcatgcattcgtgacaaacctcttcttttttttttaatatttctaggctatgtggttcatttatgagttttttttaaattgctgcaaatctcaaaaaaattttccaatatatttattgaaaaaaattcatatataagtggacccatgttgttcaaacctatgtttcaagggtcaactctattctagatataagtcttttgttggaaatgcagtgaacaaatattttttcccagtctgtaatttgtctatttgcccaccctcatttgcagatcagaagttaaaaccttattttgatgaggtttaatttatcaatttttctctttttggatcatgcttttgggttcatatctaagaactctttgatctggactttgaccaattttgtcttcttttttcccccagagatttataatttaccttttacattaaagtttctgacctattttgagttattttgtgcataaaggtgtaaggtttaggttgagtttattcttttgcttgagaatggccaactgctctatcaccatttgttaaaatgttatccttctttcatttaattgcttttgcacctttgttaaaaattggttgggcgtatttgtgtgagtctatttctagattctctcttttgtagagacagagtcttattctgtttctgggttttatattctgccctatttatccagtaccatactgtcctgattattaaagtgacatagtagattttaacaaaacatagaatgatttctcttaccttattcttttaaactattattgtagctatactatatcccttaccttttcatttaaaatatataataaacacatatttgtctaaaaaactattggtggagctttgataggaattacattaatcctatagagctatttgggaattcttgacatttttgctatgtccagtcttctattacatgaacgtggtatgtttccaattgtagatcatctttcttttatcagcattttgtaatttgcattaagcagatgctttacatgctttgttagatttgcatctttcattttctttggagcaaatgcaaattatattgtgttttaatttcaatttccacatactctgttgttagcatatagaaatactgttgtgtttgtgtattgatgttgcatcctgtggccttgctgaactctaagaaggttttgtttgtttgtttgttttggttttgggggggttttctgagacagagtcttgccatatttcccaggctggtttcaaactcctggagttaagcgatcctcccacctaggcctcccagagttctgggattacaaatgtgagccactggacttggctggaaggtgggaaagagtttggtttgtttgtttgttttggtttgtttcttgtagattcattgaaattttctatgtagacaataatgtcatcttcaaaaagggaacatttcatttcttttttctttctaacctgtatgccttttacttttttaagaaaaattgcctctttgtgctgactggaaactccattactctgttgaataagagtagtaagagtggacattcttttcttttttctaatcttaaggagaaagatttagtttcaccattaagtatgatgtagctgtcgttattttgttgatgctctttgtcaagttaagaaagctctcctctattccaagactgctgagggtttttatcatgaatgggtgttgaattttgtcaagcgctttttctgtatcaattaatatgatcatatgatttttcttttttagctggtcggtagggtaattcctttatttcttcactaatttgggagggggtcaaatttaatccagaggtatgttatagttttctccacgaatgcgaaattgtctatttgtcccattaacttgctcagtttttactctatgtattctgaggctcattcattaggcatatacacatggacgttgctatgttttcaaaacagaatgaccttttatttttatgaaatgtgcttagttatctttagtaataatctttttaagtctattttatttcatatgaatggagccacgtcagccttctaatacttatgtttatatacgatgtcttcttccatctacttacttttaactatcactttcattagaattaaaatgtaccctctatagagagaacacagttgtcatttgctgttttatccatttttgtaatcttaatttaagtatgccctctgtgggccgcatataatagatatttgcttttttatccactctggtaacctctgccttgtgagtatttagtccattaacatataatatagttattgattgatataattaaacttaagtctgccactttttggtttgttttctgttttctttctgtacctttactcattttctgactttttgatagtggggaaaatatatgaaattttattttatttcaatttatcttttggctatacctctttggctatactttttagtggatactctaaaggttatattatacatctgtaatgtttcactgtattcttaaatttactactgtgtcacttaatacaaaatggagaaactcacatttctttatgtccatttactctctcccccaccatcctttataaagtagctgtcatatgtattatacatacatgaaatataaacctcaaaaaataatgttatattaatgttatattttttctttgaacatgtatatgtattgtaaaccaattaaagttaaaattagtatttcatgtttcttaggtatttatcgtttttgatgcttttcatttgtttctgaagatttaggttgccttgtgctatttctgttgagtctgaataacttccttaagtatttcctgtaatgtggagtctgatggtgacaaattcttagtttttcttcacccataaaattctttacttcaactttattctccaaacatatttttcctggacatagaattctgggttgactccgctaatacacatgaagtttttagaactttaaatgtttcactgtcttctagctgctatgtcatctgatgagaagtttacagtcattaaatcatgtaacgtcttatttttgtctttgattttcagcagttttactatgtgtctaggcatagttttctttaaatttagcctgtttaggctctctgagcttcttgacaatgtaaatttatgtcttctattaatttagaaaggtcttgtttactatttcttaaaatatctttctgtaccattctttctcctcttctcttttaatactccagttaaaccctacagacagatacactgagcgaagtacatacactacagttaacagacaatccctgacttatgatggtttgatttagaatttttcaactttatgatggatttatcagggtattaaatgcattttcaatttagtaatatgtttgactttcaatgcgtttataggaacataacctcaccataagttgagtagtatctctattttctacccatctgtgctgttgatgagatcacaaggttccatgttagtgtctatggatgaactcgagtgagctattgtaatgaggaataaatcagctataatgttcttattaaatttcagcttatgtattatcaaggcacatcagatatcaagagattagttcaaaatgtctgttgtgaggtgcttttttgatgatacaggaaaagaatgagtaggaatgaacatcacttgaagagagatacacatacaaaaattacacaccaagaatgatgacaagaacagggatagagggaaatacaccatattaggagcccccaactttaatgaatgaagaggcatgactcaaagttttgtagatgacagtacatacctagaaggtgtagtgggtggtgacttttgttgtaagcttcaaaaaagctgttagtttttaaagaagataaaagagatatatttgaaagagccagtggagagtaagaaggcctcctagctgaattttagccatgagctatatgggatcatggaaaataaaacagccggcatgtgagcagggtcctcagaggaaaccagttaagacaaggaggttggctgggcacgttggctcatgcctgtaatccctgcactttgggaggccaaggagagtggatcacctgaggtcaggaattcaaaaccagcctgtccaacataatgaaaccccacctctattaaaaatacaaaaaattagctgggcattgtggcatgcacctgtaatcccagctactcaggaggctgaggcaggagaattgcttgaacctgggaggcggaggttgcagtaagtcgagattgtaccactgcactccagcctgggcaacaagagcaaaactccattaaaaaaaaaaaaaaacggaaaagaaagacaaggaggtcaaggaaacattcagagaaggtgctgaagatataagcgaatagttgattgcagagctaaagggttaatgaacacagcagaagagtttagaaggcaaaggagggcttgaagagtgggttaaagggcttaaatgtgggaacaattgtatttctcccagccactttctttttaacagagcctcaactttgagtgttctccctctctcaggagggtatgtgttcagtaaaggttaccttcctcccagcccaggaatctcttgattagtccataagccaatcattaccctccctctagcaatggttgatttgagaaggggtaaatgaccctattttgcctaatgaaatgggagaaaaacttggctaagatcttctagaaaaatgttcctttgttaaacacaaaagaaggaatagttgttctagtttgtacttgtttctcctgaagttactgggtgaatatgtatgcctggcgctgtaatgcccatcttgggaccatacagagaaaccctgatataaaataaaggatgttctaccttcctactctttttctgtacttctctatttcatttcagggggttcttgaaaagatgggaggcaaaaaagttcatggctaatcctccctcctaatttaaggaaatatatatattttttctaattgcaagaatcatatctgctctatgtagaaacaaaaataatgaattgtataaagtagaaattaaatatctctagctgttttgcttttttattcctatacatataaaataacttctgtctgaacacatttgtacttttaaaaaataaatatggtaagaaattaaacatctgatacctgcagttttcattttctgatatagagaaagacatcttctgagagaagatgatgcttgaagagtccttatggatgattaatagtttgcagatgagaaaggagagtgattagaagtggtgatagagggagattcaggtagatgggacaatatttttggttgagataagacattgtgcaaaggctaaaaggtattaaagatcataatcattttatgagaaaaataagtatactcagtgacagagagtagaggaatttataagagagtgatgtggaattaacctgaaaagacagaagacaggacctaacctaaaagtgctttagatgccatgttggagtgtggactttctaatgcagggtacagggagttgtagaagagttttaagcacatgggtaataacagcagatgaattatttagaaatatcactatttctcaggatcgggtaactacaattttggattccagttccagcatttattagctgtaaaattatgagtagattattcagtcactctgtcagtctcctcatttgcaaaatggggatgacagaagaaggattgtgatgattaaatgagaaaacacatgtgaaagtgaatgtagagtgcttgtcatacaacaggttttcaatacatgttaatttccttctactgctgtatattttgtggctgtcatccggttaactaaaaaaaaaaaaaaattaaaaaagggtttatttttgttctactgatggtgggggagtttaatttttttttttttttttttttttttttttttttgtgatgtagtctcactctgtcacccaggctggagtgcattggcatgatctcggctcactgcaacctccgcctcccagattcaagcaattctcctgcctcagtctcccaagtagctgggattacaagcacccgccacgacgcctggctaattttttgtatttttggtagatacggggtagttcaagaccatgttggccaggctggtcttgaactcctgacctcagttgatccaccctcctcggcctcccaaagtgctgggattacaggtgtgagccaccatgcctggccagggactttaaaaatattattcaccccaagtaaaataaatctcactaagaactatgtttgtggggtcacttaaatgttacaactcatttacatccaaaaccaagagaacactgcccaaattaaattcagcaagcctgtacattttgggtaaaaggcaagaactaagcactaggggatatgaaaaataaaaatgcatggactttgagatcaatgagataaataagcaactgcatacatgatacaatcaacagtagaaatatataagataaacatggaagtgcccaagtggtccctgcgagaggttaagatctattttttttttccaaaatgtctctgttctctgacaaacagcaaaaaggaacattattggtatagaagtatgacattcttccagggtgtcatctcatatctgagcctttgctgattgtatctaccatgaaatgtgttcttttctgaggaagcataatatgaaaactgcagttgtacacaaataacttaaaaattggcctatctagaaactggtagcattagctgtgtttcttttatctgtcatataggaatgacaacttaatgcccaatgcataagtagtgcatttagaatagttcttaggcacatcgtctgagcatagtctttaatgccctcttatgttttattttcattttagttcttttacaaagcttcctcatctggcaggaacagaacaaaatttcttgcttgccaagaaaatccaaacccagtggaagaaatttggactagattcagccaagttggttcattatgatgtcctcttatcttaccccaatgagacaaatgccaactatatatcgattgtggatgaacatgaaactgaggtatgtgaaattgttggtactttttatattttgcaatccgaccgttttatgtggattgtaatgtagggtcaagtaaaagtagaaatttgttaatagtgaattattcagtatccactatgtgttcgacatggtgttaagtcctgaggccagaataagactaaggcatggttcctttgcctaagtaagttgaggcagacaatggaatacttcagacctcaaattagtatggtaagtgctatgaagattatgattagaattcattatttacccagaaaagggtcactcagcccagcctgggagttagacaatgtttcctgaagtcttgacacgtgagtcatgaaaggacataggagttaaccatgtgacaaaataagctaagaaaattctcaacaaaagacaaaatattggcaaatgcttggaggcatatactagcctagttttattgggagaatgtaatgattttctgtatttcaaaagtgtaaaatatgaagtaggccacgatatgagataaaccagtaaatatgttctgggaacagatcatagaagggcgtgtatgctgtcctagggagcttaaacttcaacttcagttcacgggagccaatgacaagtcctgagcaggggaaggatgtggctagaggggcattttagatagacaacgtcctctatggatcacacctaggctaagcaacgggttaaagttgttgtcttaagacaatagtccaggtaaaagataataaagttttaaattaggatgttagtaggaatgaggatgagggatggatttcagaaatagtaaggaaatgtattagcaggacttgattagtgattgacttggggaaggaggggaagatagagttcaggatgactccgagactgtctggtgtgggtggctaatgactgaagctattaatagaggtaggaaatgcagatcaaaagcaggcccagggtgagagatgataaatttgaattttaacatgttgagtttggacatccaggatgaaataaccaccaaacatttaaatatatgaatctgaaaaggtaagcatcataagcatattagctattggtaaaattctgatacttaatgaagtgtcgcagggagggagtacagaggcaagcaatgggctggggataaaacatggggaaatattatttaaataaagatgaaagaaaaggagcccacaaaggaagctgaaaaggcatagtcaaaaaaaagaggatcaccaaagtgccacctttgaagctctgctgttacactttataaggaaacttttggttacctgggattgcatgcatttataaaagtttctattgttaggaagacaataataatgataaggctctttctcattgttgtcagtgtaatttatctattacagaaccttgttccaggatgcttaatctgaagtatatacttggaggcaaaatgaattatatcttaataataatctggaatttttctaacttgacatattttaattcttgctagattttcaaaacatcataccttgaaccaccaccagatggctatgagaatgttacaaatattgtgccaccatataatgctttctcagcccaaggcatgccagaggtaaaataaaatacttttgtaatccaagtctttaaatggttcttttgctatgtaaaacctgtatggaggactaaaaccaaggaaattaggtgaatcattcatgcgggttccttgtttgatattcagtactatgaaaacctcatccctcaaattaaaaaaattacaataaaataaaatagaaaagaacaccagagaaaaaagaaacaaaacaaatacattaaaaactgaccctgctgaagcagttgccactctctgaaataacaaactgctgaacatgcctttcagtgaggcagtaggtgtttttttgtttgtttgtttttgtttttgtttcgttttgtttttttgagacagagtttcgctcttgtcacccaggctggagtgcagtggcacaatctcggctccctgcaacctctgcctccgaggttcaagcaattctcttgcctcagcctcccgcgtagctgggaccacaggtgcatgccgccacatcctgctaattttgtatttttttttagtggagacggggtttctctatgttggtcaggctagtctcgaactcccgacctcaggtgatctgcttgcctcagcctcccaaagtgctgggattacaggcgtgagctaccgcttccgcccagcagtaggtgtttttacaagcttctttccatttttcataatttgaatattttatggattcatagataggattttatagatcataccatagaggttcttaaattaatgcaatggttggaaattaaataaatatagttaggatctttaaaatgacatttatttactctattccctgtggctttgtatacactgatgatttcttcaacacaggacatgctgtttagatatgtctggctgggtgtggtggctcacacctgtaatcccagcactttaggaggttgaggcgggcagatctttggaggtcaggagttcaagaccagactggccaacatggtgaaacccatctctactgttaaaaaatacaaaaattatctgggcatggtggcgcatgtctgtaatcacagctactctggcagctgaggcagaatcacttgaactcagaaggtggaggaggttgcagtgagccgagggagtgctactgcactccagcctgggtgacagtgaaattccgtctcaaaaataataaataaataaataactcttatacattgtcgttttttaaacttttcaggattttaaaagattctctaatgaattctgcataattactgtgggtctgtttattactccccaaataaagaaaggaaacacttttgatgatgtagtattgtgaagcaaacttattttttgtttttttttttctttaattttagcagtattatatatattttcttttccctatagggagatcttgtatatgtgaactatgctcgcactgaagactttttcaaactagaaagagagatgggcatcaactgtactgggaagattgttattgcaagatatggaaaaatcttcagaggaaataaagtacagtattatttgtttttctacagagaatgagaggatatatatattctgtaaatgtaaatgaccaacttgcttctctgtttccaaattgctttcaaacatttcttttctttttttcttcctatttgccatgggtacacggaaactcatgtttttatgttttcttacatacctggaaaaggagattattttgaatcatttttattataaaagtaatatttgcttttagaaatttaattgaaggaaatttatataaagtaaaaaatgaaaagcttctctgcattacccacttcattattcagatataatcaatcttaatagcttttttcaaacctaattctgtgacatataaatacatctgtccctatatgtccattttacatatatttatttatttacttttacattgtatattataagactttattttttttcattcagccatgactcatattcttcatgtccacatgttgagagttatgtaatacattggttaagagtatagaaccctagatccatatcacctgggttcttgtctagtctggctcctattctttctagatcttttactgtgagcatgttacttaacttctctgttgcaaagtttcctcacatataaaatgcgaatgacgagggcaccaatctcatagagtccttattgaatgactttgtttgaaagcacttaggaaagtggctggtacttagtaatttctatataactgcttattaattacctcagtattttaaatgatggcatcatatttcacagaattgataagccatttatttaaccattccgctactgacgatgtttgtctcatcttgaatttgttactattacaaataatttaattgtgaacatctttgtccatatatgctccagaaatttgtgtgaagattattgtagtatagattcatagaaattaaatggctaaataatagtgtatattctttcaaaattttgatagacatcatcaattttccttcaaaaagttgtgacagattatactcttagtgatataacagggtgttctctaaatattggaatgcatttttatgaatcaagactgttatccatcttctgctacaatacttttggtgaagaagaatttagtatctcacagggtacattttcctatttttggccagtttggattgttagaaagatgtttacaaaaaccctgggctgtttttcacaaatatgactgctctgcatacaattttaaatgagtttagttccataaatatttgtagaatgcttactctatgatgtgcgagattttacagggcagtagtttaaaattaagaacacatggttcaagttttcaaaaacaccctcagcctaataggagagatagatatttaatagatgttttaatacattaagagctatcctataatatagaaaatatagaactacaaagaagggacatgaattctacagttgcaggttgtaataggaatgtttcacagaagaaatgataactcgtttagatttccatggaataatggaagtctgttaggtctaataggtgggaaattgtgttcaaagccaagagaactgaatgtgtaattgtatggtaaaaggcagtgtctaaatatccttccattattaaattaatgtctttcttatatgaataagccaaccatttgccatatctgcattatgaattgcacattgcccctgcaggttaaaaatgccatgttagcaggagccataggaatcatcttgtactcagatccagctgactactttgctcctgaggtacagccatatcccaaaggatggaatcttcctggaactgcagcccagagaggaaatgtgttaaatttgaatggtgctggtgacccactcactccaggctatccagcaaaaggtaagggatgagcctatcagtccaccaattttgcaaaaatactccttgcccttttagaaggaatacaagcaagcatgttcagaataatattaaactaaaattgagtacacttatatcattttggattactgctgctaggaattttaaaacatttgctcttgtattattttagttttaaattttcatgagatgtcggcatggggagtaaacactcagttcatactctccttcttcctttattagagttcagaaatactgatcctcatacctaaagtaatgctccttttaacaaatgacaatttaggtttgctgaattaccgatagattgtatttttaaaaatacaatagatagattgaattatcgatagattgtatttttgaattacattttttaaaaaaatgagtttttgtgttatttaaaacataaaattggaagttttacatatgtgaaatgatttctacaatcaaaataattaacatacccattatctcaaaaaagcttcctctcgtctctttatattcccaccctcccaactcttccttcccacttcatccaatccctaggcaaccattcatcttggtttctgctgtcagcatgattattttgagatctgtccatgttggcatctttgtcaatagtttttctttcttttgctgagtagtattcccttgaatggctatagcacagtttattcctttacttgtagatggacatttggattgctttcagtgtgggggctattacagataaaggtgtaatgaacagttgttgtacaagaccttgtatgtacatgttcttttatttctctttgggaaatacttggaagtgaaatgcctgaatattatggttagttggatatttaacttttacagaaattttaaaattgttttctgaagttgtttcactttatatttcaacagcaatgtatgagtgttctatttgctatgtcctcaccaacatttagtatgtcagtcttttcaattctacattctaacagatgcatacaacttccaggttacaactcttctattttcaaaacgttttgtctaattttggtcctttccatatgagttttagcactaatttacaattgccaccaaaaagcctcctgggagtttgattgagattgaatgaaatctataaatcaatttggggagaattggcaatatttgggagaattgaattaacaatattgaattttctgatccataaataaaatacaactttgcagtctttaatttctttcagcagagttttatagtttcactgtatgaatcacacataccttttgtcagatttatccacaaacatttcatagttttatgctattgtaaagtttcaataccaatttttctttactaggaaatgaaagcattattctatttctagaagaaatacattggtcttgtatcctgcaaacttgttaaacccatcgattctgctaggtttttgtagcttctatcagcatttttacatacatgattatgtcatctgcaaatgaagataattttatttcttggctttcaatctacatgcccttccttcctctctctctctctctctctctctgtctctctctctctttctttctttctctctttcttctttttgctttattgtactggctagaccctccaggacattttttttctttcttttttgtatatacattttatagaggtactccagtacaatgttgaatagaagttgttacaacagacatacttgctttttatttctgttccaacagggaaagtatccagtctttctctgttaaatattatgttagctctaggttttttatacattccctttgtcacaatgaggaagtttacttctatcctaatatactgggcgttttcattagaaatatatgttggatgttgccaaatgttttttctgtgcacatagagatgatcatatgttatcatttacttttgttaaattatatgatgtttttaatgttaatccaaccctgtcatcctaaaataaatcccatttggtgacaatgtattatccttttatatattgttgaatttttgatatatttttcttaagaatgtttctgtctatggtcataagggatgttaacctgtagatttagtttcttgtaatatctttgtgtcatttggtatcaaagaaatgctggcctcttagcatgagttgggaaccatttcatcttcacttttttgcaagagtttataaagaatgggttcaatgttgtctataaatatttggtagaattctccagggatctatctgggcctgaagtgttttatgtagaactgtttttcactacaaattgaatttcatatatatatatgtaatatatgtaatatgtaatgttacatagtatatacgtatacataatatgtatatattatatacgtatacataatatatgtatatattatatacgtatacatatgtatatattatatacgtatacatatgtatatattatatacgtatacataatatgtatatattatatacgtatacataatatgtatgtgtgtatatattatatacatatacataatatgtatatatgtgtgtatatattatatacatatacatatgtatatatgtgtgtatatatattatatacgtatacatatgtatatatgtgtgtatatataatatacgtatacatatgtatatatgtgtgtatatatattatatacctatacataatatgtatatatgtgtgtatatattatatacataatatgtatatgtgtgtgtatatattatatacatgtataatatatgtatatagaatgtatatattatatatgcatatatgtatatataatgtatatattatatataatatataatgtataattatatatattatatattacatgtataatatgtaatattacatattatacatgtaatatataatatatataatgtaatattacatattatacatgtaatatataatatataatatgtaatatgtaatattacatatacatgtatatattatatataatatattatatataattatatataattacatattatatatgctatattatatatgatatataatgtgtaatatataatatataatatatatgtaatatatatgtaataatatatattacatataaattacatatatattaatatatatataattattacatatgtatgtattattattgtatgtatgtaatacatacatacatatgtatgtattattattgtatgtatgtaatacatacatacatatgtatgtattattacatatgtatgtattatgtatgtaatatgtattattacatacatattacacatatataatatataatatatatgtaatatatgtaatatatatgttatatatattatattatatataatatgtaatgtatatgtaatatatattatatattatataatatgtaatatatatgtaatgtatatgtgatctatttattctcaagtgagccttggtagtttgcattttctcaaagatttttgtccatttcatctaacttgctgaatttatgagcatagagtggtttataatatttttgtactattcttctgtctgcaggtactagagtgatattctctcctttattcctgatgttagcaatttagtcatttctcctttagtcctgatctgtcttgttggaagtttattagttttattgatctcagataactagctttgggtttcattgattatctttactattatttttgtttcctatttctttttttaaatttaaatagagacagctcttgctatgctacccaggccagtctcaaactccttgactcaagcaatcttcctgccttggcctcccaaagtgctgggattacacacatgagccatcaggaacccagccagtttctatttcttagatgtctgctgtgatatttatcatgtgctttctcctgcttattttggcctttatttgttctttttctagtttctgaaagtggaatctgatgtcatttgtcagaaacttaactttttttctacgatggattatttagtgctatacctctccctataagcactactttagctgcatcctacagtttttaatatattgtggttttattttatgttagagacaagattccactctgtcaccctgtctgtcacccaggctggagtgcagtggtccaaccatcgctcactgtaaccgcaaactcccaggctcaagtgattctcctgccccagcctcccaagttagctggaactataggcatgtgacaccatgcccagctaattttttaatgtttacttttagagatgggtcttgttgtgttgcctaggctgagtgtttttatttttatttggttccaaatactttctgatttcccttttcatttctactttgacccatggtttatttataaatgtgttatttaattttaaaatatttgaggatgttctaggtatctttctaatattgatttctaatttaattccactgaggtcggagaacatactgagaatttactgagacatgtcttatggcccagaatatggtctctgtaatacatattctatatgcacttgaaaagaatgtatattctgtttttggttggagtattctataaatgtcaattaggtcaaattagttaatagtgttatgaaagtcttatatacttactgatttactatctaattatattgttacaattttgtttcagcagtcaattatctcatgaagctacttacataataaaaatctcatgatagaactattattttacatattttattatttttaaagtgtttcatttacataaaataaggtgaataaaaaataaggtgtttcaggcatgaaggtaaatttggtccctttaactctatcttggctgaaagtcacagttccaatgaggttttaaggctggcaatacttttcaatcttccttgaatgataatatatcactatttgaataagatgtttctcattttttcccaagattgcatatgttctcttgttttttttccaattatttatagtttcagaatctgggacacattttctaagcatctggttaataacatttctctaagaaagattcaagagatccttgaggaaataaaatattcttgtaaaggtcaagaaaattatgtgaaatgtcaaaacaaatttggaaaactgccatctctataattaacattaccttaaaatataaatgatttattaaataaagatgtattaggtaaaacaattgtctgacttttggggaactttttttttttcagacagagtcttgctccgtctccaggctagagtgcagtggcgtgatctcgggtcactgcaacctctgcctcctgggttcaagcgattctcccacctcagcttcccaagtagctgggcctacaggcatgcgccaccacgtccagctaatttttgtattttcagtagagacggggtttcaccatgttggccaggatggtctccatctcttggcctcatgatccgcccacctctgcctccgaaagtgctgggatgacaggtgtgagccaccacgcctggccaggaacttttaattttggcataattgcaaatgtatagcaaatctgcaacggttatgcaaaaaatccctgtatatctcttgctcagatttttaaattgttttcattttatgcatttgatttttttagaatacactttcagacttgatgttgaagaaggagtgggaatcccccgaatacctgtacatcccattggatataatgatgcagaaatattattacggtatagttttcttgttggatatgagattaagatattttgcactagttgtctattttctcattgaaaaccaatatggcattcttatgttaaacacaaagttttataactaaataactcctgaaataggaataacagagtatactatctttttatttcataaaagtagtcattttagtgactaagaaatcaaaataaaatatcgctctgttcgctacaaatgaaattctcaaatacaaagctatgtcctaagataattctgatttgagatttttcaagcaattgaattttcataggtattcattagatatttatattcaacgtctagtataagaatatgacaatgccccccacttactagaggtatgaccttggatcagttgcttaaactttctccagctcagtttctttatttgtaagatgaggctagtaactgtttctccttgatagggttattataagatcatatgagtaaaatacatagcaccgtatttagaatatagtaaacaaacaattattgtattctataactgatatttctttacatatcccccaactcccatttttaaatgcctgtatgtgtattacaacttaataattgtttgggtgcctactgtgtaatcagcagcttttttacaaatacatttcttctccttaatgcagtcattaatttcctgtatttaggatatcttggattcagtgagtccccacataaataattaaggtcaaaaataaggagatagccttcccatttgccatgactactttattttttctctttgctctcatcactaacatattacgtattttacttactgatttcagtatggctctcttgctagaaaataagctccacaaagggcgggctttttgacagtacctggcacttagtaaatgacaaatatttgttatatatatgaatgaaatattgtcatcaaactttaaaatttctccttagaaattgtggtagcctttttctgtcactttcattttattttgtcagctacttgggaggaattgctccaccagataagagttggaagggagcccttaatgtgagttatagtatcggacctggctttacagggagtgattctttcaggtaattttgcattactttaatagtctgaaaaagttttatatttttaatggaaacatgtcaagataactgttctgccaggggtattttgcttatctctttttctctttctaaacaaccattttacattacttaagaagtacttacacatgaaatattgaattatttcactagcagcatcacaatattagtttcacagaatctcaaaaattaatatatttgaatataggtttaacatttcaaagatttttcaaaattctctcttcagctattttttaaaaatagtttttcaaataacttacaaaatgatatacatgtgaaaaactaggtgaaggtgctgggtgtggtggctcacacctggaatcccagcatttgggaggctgaggcgggcggatcacctgaggttgggagttcaagaccagcctggccaacaaggagaaaccccgtttctactaaaaatacaaaaattagccaggtgtgatggtggtgcatgcctgtaatcccagctacttgggaggctgaggcaggagaatcacttgaacccaggaagcggaggttgcggtgagctgagatcgcgccattgcacttgagcctggccaacaagactgaaactccatctaaaaaaaaaaaaaaaaaaaaaaactaggtgaagttaagggagaggtaaagatgaagagagaagggggccaaaatgtatagatcacttactgtgtgggttaaatgagtttaaatgggtaaatcacatagttactataagactataagcctcaatagaattaatattacaattattactgttattaatacatgataatactcttctagaagagatgtgatcacaaattgtgtgtttattgagcttagtcttacagaaagagtaaaagtttaccactgggtaaagggaggcaagaaatgccaactagagaaatcagcttgtacagagtagttgaacagcgtggcatgatcagaacttcaagaagtttgatttgcctgaaatgtgatgggagagagaaatgtaacactgataaatcagagtgcatatagctgtttttattaaaccaaaattattaaatcagtcttctttgctaacaatttacccttaactacgtgaatttggattctcagaatattttttagtttctgtaggatttcttgtattccagaaattttaaagtattagaagtccaatttccttgttttataataagtttataaatgtttgatttatatgtgtttatctctatcattaaatcagaacagtgctcttttaatttgggactttattatctaatttgtgtatgccctccagagaaaggaaaatgtaacttactcaatgaaacataaagccctttctgatttacaaacagaaacatacagacagagaaaacatataacttcagttctacaattttagtcacaaagagtaaactcaaaaacataaacattcctaggtctagatataaaatagctgtgctccttcactgtgagcatagaattctctattggttagaactcaaagtggacaaataaacaacaacaaaactaaaaactagattctctcatgtctcacctcacagagatcttgaaaatccattaatccatttacagatattatcaaatgacaagacataaaggccaactccaaatcattgctgccaccaatgaggactaacttaatttgccctaagcaaagcagaaacataaaacaaaacatcagtagagaaaaaataaagctagagatatagagtatcagcaaagttaaatttctactgttgtttagaatttacatatgagagccaaaagaagatatgaagaattggtttaagctgcccatacctggttctgcaaaatgaatccattttacctcagagtggagcctccaaaagtcttccacagtgaggaaaggaacacaaaccttcactagacagattgtgcatttcagtggatttgaattatttgcattactgtcatgtttctataagttaacttctctttacagagctgtaaaacagtctagttaaggacactgacaggtaaagttgaccataatggatgaaccaaagtttttcccaatttttccttacaggattatattcatttatttcatgaatatttattgagcatttcctatgccccgggaaccattctgggttctggggattcagcagtgaataaagtaggcaaaaatctcctccctgtggagcctgcattctagagttcagtttatttgaaacgtgataagtttgaagtaataataggacaaataaatattcttctggagctcaaaaatactaaaaacgagaaagacgtaggtttaaagacgtagatgtgcttctttgagaatcttagcagatagcctatgtttttgtttagactaatatcaatttttttcattcctcatatgttgcatttttctttacttaattttcttcttttaatgacacaataccgatgaatttgggtttcttactaatcatatatctaaggctcatatttttagaaacacatgctaaacaatatttctgcttttctgctattaattttcatctgtcagtagcaaaaagaaatcatttacttaatgccttaaaatgaaaaaaaaaaaaacatcgattagttttcctctgaggtacttttagttgaatattgcaaatggattaaatatcagaagcacagtatacttttggtgggggtgagggaagccagaatttgttcttaacaatatacaagtttcgggggcttattcattcttccattaaaaaacgatcacaaactagaaacaacggaggtctccctacctttagaataaatgatgattaattttgttcccttggggaaaagtagcattttcccatgtcatcttggattcataaaatgtgagtgatactttgttttttctgtctggctgagcttgatattttcccttgttttctaattcggttgattgtaactcatgaatgaatatttaaaagcctgacccaaatcagaatcaacaatcatggcctagaaacatttcattatgtagttgtgcattgtagcaggagcttcccaaattctcatttaacaacagaattttttatgttttttataggtggcactcaaccagctcttaaacttacatatcatttccataatcataaagaaaatttttgaacctcggatttaatataaatataaatagatacatttaaataatatgcttatacttttttctttattacataatgggctgtcttcttcgttttcataattaactggggtatatttttacattttagaataaatatgacattttgaataatagaatattttgaattttaaataaataacaatttagctatgagaaaataatataaaatagacagcttttaaaatttgacttcaaggtgcatgcttaggtgcttagaagtaaattggcataatgtctgtaccttacttgcaaatgcttcaacagtgttaacaattattgaatttaggtggtagagatatgagaatccattatgctattgcacagcttttcataataaaacactattatgaaaatagttttttataataaaacactgtaaaaaacataatttgctgtactaagtaatttattccttttaaaattctaggaaggttagaatgcatgtttataacatcaataaaattacaaggatttacaatgtagttggaactatcagaggatctgtggaacctggtgagtcacataattttttaaaacattttgtttttacaaaaattaaagggtaagtaaagataaattgtagtcaacaattgaagtggggttttttggctgatttgaaactactaaattttgaggaaaactgtacaaatctaaaagaagattttactttatagtgttgtcttctatagaggaaactcaagcaagaggatgtttattttaaaaacataaattacaaatatttataatgtattcaaagttgtaggtttcttgaacgtattattttccagacaggtatgttattctgggaggtcaccgggactcctgggtatttggagctattgacccaaccagtggggttgctgttttgcaagaaattgcccggagttttggaaaactgatgagtaaaggtaaacaacctttctttcctaggtgatgacaaaaagtgacttactgaattttcttttattttttaggcagttgtacctaaccacgtgtgttaacaattcttacaggctggagacctagaagaactatcatttttgccagctgggatgcagaagaatttggacttctgggttccacagaatgggctgaggtaaataagacaaagaaggttcttattatttttttggtcaacagggaacaaatatgtatgtgtctcaggatgatcaaaaatatattccattacctaatatggttttgttttggagaatgactcaagacaatttaagaaatagtttatttttactttcacatcagtttggcaataaccttttagtactagactgcagacagagttattgcctcttgtcaaaatattttcgttgccatttgcatttgttttataaaaaataagaaaaatcagtaagctcagaaaataatcaaaattaatgagatatttttgatgataatttacttatctaaaaactgatacagatgcttagagctaattttcaagtttttgaagtttctttagagttcttccatctgagaaaatataagatgttctattaagatggccatatattgactatattttcacattgacagattccatttaaaatggcaaccataagtatactttagcatttacaacagatatgtgcttcattgttaagtataaagtgataattctgtgaattgaattactttaataaattgacctgctttacaatttcataggtggggttttttttcttcacatatgattgtcatttgtcactgactcttaattatttatatttaagtgtctctcctagggcccttttcttccaacttcttcctttagtctctctgtcaagtaatctctaagttcttaaatgtagaaggtaagcacattcatttttttaacttttaagttcagggtacaagtgcaggtatgttacataggtaaactgtgtcatggggatttgccacgctgttcaactactctgtacaagctgatttctctagttggcatttcctgcctgccttgacgcagtggtaaacttttactctttctgtaagagtaagctcaataaacacacaatttgtgatcacatcttttctagaagagtgttatcatgtattaataataataattgtaataatatttctattgagctttacagtagctatgtgatttacccattttaactcatttaatccacacagtaagtgatcaataaatgttggctcccttctctcttcatctttacccctcccttaacttcacctggtttttcacatgtatatcattttgaaagttatttgaaaaactattttaaaaactaggtgaagagagaattttgaaaaacctggtttgaaatgttaaacctataactcaaatgtagtaatttttgagactctatgaaactaatattgtggtattactagtgaaagattatttcatcacccaggtattaagcccagtacccactagttatttttcctgaccctttcccttctcccaccttccaccctttgaaagtccccagtgtgttgttcccctctatgtgtccatgggttctcatcatttaactcccacttataagtgagaacatgtggtatttatttttctgtttcaacattagcttgccaagaataatggtcttcatctccatccatgtccctgcaaacaacatagtctcatcattttttacgactgtgtagtattccaaggtgtacatgtaccacattttcttcatcaagtctgtcattgatggatatctgggttgaattcatgtctttgctattatgaataatgctgcaatgaacatatgtgtgtatgtgtctttataatagaatgatatatttctttggttatatacccagtaatgggattgctgggtccagtagtatttccaggtaggtgcactacataagtacttaccttccctcctccatctgctagttatcatttataagtccagattttatagagctgttttaaaatatggcaaacctgtcttgccattgtgtttagttttgaaaatgctttcctcctaactcagtttctcttacattagtttaaaatactataataggaataatatgaattaaacaaatacagagggggtaaaaatcccactcacaattacttgtctggtatcaccctttgttgattacatttacactgcgaattgttattttcacattggtattattaatgggcattttgaaactataacattaatttgatgaatcaaattttattagttcaggtcattatcttttttccccttgcccctgtggtgggtgaggtcatttgcttttagaaacatgcgatttagaaacatgtgatttcttgtgatacatatataaacacatataaacacatgcatctgttttttaaatttcagcagctgaacataaagaaatctaatatataaaataataaaaacgctttgcattaatttataaacatgtgcattaaaaggcaatttcaatacactttccagttttgtgccaggttcttgattatattcagtagcatgcttaccttctttaaatacacataaggaatcttctttattttcactataaatctgttataatggaaactctgattttatatttctctgtaatggagtcaactatcacctggcctatgcaggcaagtgcaaagaggtgacagtttttatttgtgccataaccacacacagctttaaatgtttttactataacatattttagaaagctaacaagctagagagagcggtgaagggctctctcagcatgttcctctctgtctgtgtgttagttttgctttactttttctttaatctgtgtctgtgtgtgtgtgtttgtgtatgtgtatgagagagagagagcgaaagagtcttatttttgtcttaatgtgtgcctcctctaattttttgtcttccttttttctttcacttcatatacatagtaaatataaacaaatggaaattttatatttctcacttttgaaatgataaatttacttgggtatcccctccataaatggatgtcaaacttcaatgtatgtaagtgtcaattgccagttatatctattaggaaatacagattggctgggcgcggtggctcacgcctgttatcccagcactttgggaggccaaggcgggcggatcacgaggtcaggagatcgagaccattctggctaacatggtgaaaccccacctctactaaaaatacaaaaaataagccaggcgcagtggtgggtgcctgtagtcccagctactcgggaggctgaggcaggagaatggcgtgaacccgggaggtggagcttgcagtgagcagagacagcgctactgcactctggcctgggcaaaagagcaagattctgtctccaaaaaaaaaaaaaaaaagaaaatgcagatttccacccggcacggtggctcatgcctgtaatctcagcactttgggaggctgagacaggtggatcacctgaggtcaggagttcgagaacagcctggccaacatggtgaaaccccgtgtctattaaaaatacaaaaattagccaggcgtcgtggtgagaggtgacagcatgctggcagccctcgctcgctctcggcgcctcctcggccttggcgcccactctggccacgcttgaggagcccttcagcccgccgctgcactgtgggagcccctttctgggctggccaaggctggagccggctccctcagcttgctgggagctgtggagggaaggagcgggcgggaaccggggctgcgcgggcgcttgcggcccagcgagagttccgggtgggcgtgggctcagcgggcccgccctcggaggcgccggccagcctgcaagcccggggcagtaaggggcttagcgcctgggccagcagctgttgtgctcgatttctcgctgggccttagctgcctccccgcagggcagggcttccgacctgcagcccaccatgcctgagcctgcgcccccgccgcggccgctgcacagccggagcctcccgacgagcaccgcttcctgctccacggcgaccagtcccatcgactgaccaagggctgagaagtgccggcgcacatcgtgggactggcaggcagctccacctgtggccccggtgtgggatccactgagtgaagccagctgggctcctgagtctggtggggacttggagaatctttatgtctagctaagggattgtaaatacaccaatcagcactctgtatctagctcaaggtttgtaaacacaccaatcagcaccctgtgtctagctcagggtttgtgaatgcaccaatccacactctatatctagctaatctagtggggacgtggggaaagaacttttgtgtgtagctcagggattgtaaacgcacctatcagcaccctgtcaaaacggagcaatcggctctctgtaaaacagaccaatcggctctctgtaaaatggaccagtcagcaggatgtgggtggggtcagataagagaataaaagcaggctgccggagcagcagtggcaaccctctggggtctccttccacgttgtgaaagatttgttcttttgctctttgcaatattgctgctgctgactccttgggtccacactgcctttatgagctgtaacactcaccttgaaggtctgcaactttactcgtgaagccagtgagactacgaacccaccaggaggaaggaacaactccagatgggccgccttaagagtaacactcaccgtgaaggtctgcagcttcacttctgagccagcgagaccacaaacccaccagaaggaagaaactctgaacacatccgaacatcagtaggaataaactccggacacgccgcctttaagaacggtaacactcaccgcgagggtccgcggcttcattcttgaagtcagtgagatcaagaacccaccaattctggacacagtggcacacacctgtaatcccgggtactccggaggctgagtcaagagaattgtttgaacctgggaggccgtggttgcagtgagctgagatcgtgccgctgcattctagcctgggcaacagagtgagtctctgtctctaaaataaaataaaataataaaatacagattgccaggcctcacttttagcctcactgtgagttctgattcagtagatctagggcagggccctagaatatgggagccacatccctgcatagtctgatgcagggaatcaaggaaccacactttgaaaatatttttttttcttagggctctctgctattgctataaacagtagctattgcttcatagtatccttaattcttatattaattgcgtaattgttgttaacaaactggttttctgcattttctcagaaattagggtcacagatggacctagctatttaattgtgaaagatacttgtaaaccgcttttccacgaaattaatttgcttattttgtttacattttcacaactaagtaatgtgaattaagtaacaactttgcttcaactacaggagaatgtcaaaatactccaggagagaagcattgcttatatcaactcggattcatctatagaaggtaaattttatttcaatttgaagtgaaattttcagaaaggaaattttacttcaagtaacttttattattgagtagaataccatctactaagactataaattctagcttattaagcacctcagatatccccttcctttgagatgcctcagtaatacctttatttttcattttgccacagagaaaataattaggattcatatgaattgatatgattcataactaagctattgcttttaatttctttgatatatttactatttgtttatattactacttaaaactctagtattaaccacatattttctcgataaagatattaatggaatttggctaaaacagttcagaagaaaggttttgcagactattctgtgtagaaatatttcctgtatttgttgtaacaaatttgaagtaagtgtactcacttactcactccttttgaactacaaactcctattgaatctagctcaggatcacctgagcccaggagtgtaagccatagagagaccctgactctcaaaaaaaaaaaaagaaaaagaaaaagaaaaaaactgatctggattgtctacgccaacaggacttgatttctgattagcactactatggagacagtatgattcagaaaatgaagagattcgtgtctctaggctttcattgcattgtgattatttctaaataaatgttagaacctaataattactgacatggctttgtctaatatcttgatatatactattgcatagaatgaaacaagtaaaaaattaatgctacagacttaccacttcctttgccaaagtgcccctaagaattgctgccatgagaatgacccttataatcactgtgacagctgctgccttagcaaccaaagtccaccaagaccttctactattcagaatatttggtgcaggctctcttgctcctgaagaactatttccaccctgttttattctttgggaataaaatctttgatttgaagatcattatatcttgtttaaaattagaaaataaagttagaattaaacaaatggaatttcatttagaagtatgaaataatactctgtgtcttatttatttttcaggcaattatactctcagagttgactgtactccccttctttaccaattagtgtataaactgacaaaagaggtatataaggaaatgtgtcttcatatgttctcttttgaatggataaatgaataacgtgtgttcccccctaaattaatggtacttatttttaagctggtgagagaacataatagaatcatataaacaaaacaaaatctttaatatgccatttacctatatgacataactaagaagatattatcaccagcttctttgttctagcaatagttcttattaataattgtgtaaatagttgtaacatgtatttatctggcagaggtatttgatatagcagaaagaacactgagttggaatagaaaggcatacagttaaaaaactgtcttagctactcattcattcattcaacaaatattcactgagtggtcactatatgtcagattctacaaaatgaattatagcagcaatagtgataaggggacaaggtcactgaattcgaagactttgtaatctagagaggacacagattggtaaatgaggaattagaattcactagaatatttgatactatgtatgatggagaacagttatggaatagagaatattaaatcctgaggtggctgggggaagttgaggagcataagaagaggtttgcagagtcactgatgtttggactgtcaaatgaagggatgtagaagtaagggagagggcattctaagcagaggacacagtatctaaaaaagatgtggaggtttaaaagaacgtatttcctgatctgaaggtagctcagcatggccaagccaaaggcgttggtgggaaagatggtaagaaatgaggcataaccaatgggccaaggagttcagaaatctgttatggagaaatcattaaagaatttctaacaaggttgttcattgttttatgtcagtgtagtgaatacattaagtagttgcaagtctaaaggcaaaatggaaataattctgcaggcttgctaatctcccagtaatttataaatattaaatgagttatagatattttaagaactctaaaatctaaaggactctgaatctctaaaacttatataatctactcatttaatatctgtgaacatcatttaaatagttccttgccaaagaatttacctgtggaaatgtttgcttcaaggtcatccttagataacaatatgaagtagatatcacttctctctgggtactattaatatttcctcccttaatcttacccctctctttttcatgtctttaaaaactagttttccaaatgaaactcctctcattttcctcatcacaatgctctcaccatcttgggtagctgatgtctttgatcctttcattggaatgttccataaaagcatcttatctaaaagtaagctgaaaagaaaatctttactgagagaaccctttttggaacaggaatttatgatttgtgctgtcctagagagatgatccctggccttgatgtcaggaatgataagaatttggtggttgataagggagaagttgacatctgtgcctctttgtacaaagataaattcttatctgtgggcatgccaagacccagtagacaaaggagacttgtttttactctcctgtaaactgattattacaattttattaatccctagtgtgtgttagcacaaatagtcaagccatattggtgacttgaggatagtgtaggggtgagagacaaggctgagcttggagagaagggcagctgccagatgcagcaagaaatggggcaaagtgttgctaaataagaggagggctatcaattctgacaatgcatgtagctgaggtaagactcatctagccgagtgtggtggcacatgcctatagttccagctgaggcagtaggatcacctgagcccaggagtgtaagccatagaaatcctgacaaaaaaagaaagaaaagaaaaaagaaagaaagaaagctgatctggattttctaggccaacgggacgtgatttctgattggcactattatggagacagtatgattcagaaaatgaagagggttttactgggagttcaatccaagcaggatgtaggaactggaacagaatctctctcaaccattgtaaattggcaggagcagagtagagagtagaacccagtcagctggctagaaatgagcagaacatctctgcagctgcctcatgttggtgaggaagggtgtagagtgccaagactttctaagctgtggaccctctatgcagtcataaaatatcatctcattcatacaaagctaagggcaagtgaccacttcccagccctaccattactctgtggatggcagtggattcaccactgttaccttctacttgaaggctgatgagggcttgtgttatcagtagacacaacacatttgtgcctctaaataagtggggtgagattgaaacagggaaattgttcaaaatcatgtgccaatacccaacatctttattagatgctcttaaatttaattgccattttctcagaaagcccttacttggagacatatctatctctcatccccacatctctttatagcactttgatattttcttttaaactgcttattataattttgtattacaaaatttgtttggtgtgtgtatccccaattagatttcattgtgaggtccaagagggtagagactatgtctctgtttccgcatctcttttctgagttcagtgcttagtaaatatctatagaaaaattaagaatagtggcacagaagttagaataaccaactctgtctaaaggccagagaaaataccagatgtttatattcagaaaggtaccattatccccagttttacaggtgagaagactaaggttcaaagaggggaacaaatacaccaagttataatgctttcacagttacttaagtagggtctgccttgggtctatttttgagcaaatcagtgttataaacaaacaagaaaacaaaatatagtcaatatgtgtagtagtctagatttaaaatagaccaatttgactccacagtccacaatgttttcaccacatgtctctgctcttcttagagtgtcaaaagacaaggcaagtataagtttgtaaatgtatttttaatgaaaggagtaaaaatgtatatatatacacacacacacacacgagctcttaaaaattcccaagtagaaatctgaggttatgtagagttttttaaaaaatccataaaattttaactttgtttaaacataataagactgtctaaaagaatagtcccagcgctaacccctgcctgccctgcaaaaccaagacttataggttaagaagctgagcttgaaattatgtcacctctattgttctgagacctctttataggtcttattaggcaaaaataatttacaaaagcaaatgttttatctgaagttttctccagtgtcttcccactaaaagaaatctaagctgccaaacattaattaaaatggcatttgtaaagattttaagttctatttaaaagtttaccaaaataagcaggaaattacatcttaggtacatggcaaaattaccaacacaggtagacatcatgaataaaaaataatttgggctagatttatttcttgccatttgcaaaaatataatttttctataaaacatatacatgtgtataaatatatacatgtacatatgttattaaaagtagaagttgatgacaaataatatatagttttattttggcataaatgtagttgcttctacccctaatttccagtatttgatttctctttccagatccccagccctgatgatgggtttgagagtaaatcactgtatgaaagctggttggaaaaagacccttcacctgaaaataaaaatttgcctaggtaagttactgatatgcaccttttctactgtaggataagttatgaattcccctctgcctcttgtttctccaagcatgaaattctcaagcgtctcatcaataatttgagccaagaaaagataatgaagaattcctggccgagcccagtagctcacgcctataatcctagcactttgggaggccgaggcgggtggatcacctgaggtcaggcattggagaccagcctggccaacacggcgaaaccctgtctctactaaaaatacaaaattagccggtcatggtagcgggcacttgtaatcccagttactcaggaggctgaggcaggagaattgcttgaacccgggaggcagaggttgcagtgagccgagatcgtgccattgcattccaacctgggcaacaagagtgaaactccatctcaaaaaaaaaaaaaataagaattcttctatccagttttgttttgctgattagccagcatgtgaagtctttcagtctatgttagagcacaaatagatctagttttgcaaatttttagccaaaatagtttcgctacattattagccattagttggcattcttgcttaaaatttcatttacatatgtattaggtgtattaatatataatataacttcagatgataatgatgaaaagacaaatgctagattatttgcttgtaaatttattaaggaacattatcagtaaccaccaaattgtgtctttacctgtgatttagaatttatataaatattattttattttttatgtcatctcattcatgctacagcagctttcttaaatttattttatatttatttgtttttattttcttttttctaaacattatgtaataaaaagtatatatttgttttctactgtagtgccatttctaatacagactgagcattcctaactcaaaaacctgaaatctgaagtgctccaatatccaaaactttttgagcaccaacatgatgtcacaagtggaaaattccacaccttatagcacttaacacaaactttgtttcatgcacaaaattatttaaaatattatgtaaaattaagtttaggctatgtttataagatacatatgaaacataaatgaattttatgtttagacttgggccccatccccaagatatctcactgcatatatgtaaatattcatagttggaaaaaaatctgaagtccaaaatatttctggtcccaagcatttcatatgggatactcaacttgtacaagcaaataatagtaacagtttatagctttattcctcatttcaaatcagtcttgtgaaagtttgaatgtgggtccattataaaactttcacatgccaattcaacaaaaacagtaaaatacaaaaatgatttctaaaacattgaagaggtcagtctcaaaaacatatctactaacctaatagtttggaaataaacagttatgttattaatgaacatgcaattttatattctgctttcatgacttaccattattttactaaaaattttcatgtcttacattttatttatgtatatgcatatatatgtgatagatcaacagaggtttcctaatcatatgcaaagaaataaattataattagatttatttctaaaatgaggcacatttatattcttcatgattttaaaagtagatttttttatggcagttttcttactagatgatagttctctgagggtagggcccacgtcttcattgttttcccctctaaacaaaaatgtaaatgctgaagatatgatggagagcatcatcacaagatgcagtctttggtggcacagcccaattcttgttataggttggtgcaaaagtatttgcagtttttgccattatttttaattttcagcattacttttaattttacagcaattttcctgcagattatgggaaaatgtcttgatggtggttgaccttttttaaattcttataaatgtaatatataattccttgctattcttggggcaggattccttgtcccatctatttaactttgtatcatttacttgtttatgtgtgtgtgtgtgtgtgtgtgtggattgcattctacatctagaatcaataagctgggatctggaagtgactttgaagcttattttcagagacttggaattgcttcaggcagagcccgttacactaagaataaggtaagccattttatcattttgaatatataacatttcatctacagtcctttggcgaagaatgtcactgagttgtttggcaccagacacctggtggatgtggcctgggaagagttcccagggatagagatagactgcatgtccctttccagatggacaaggaagcaatttgagtaattttgtgaaaatttcattgttagggttaatcaaataaatggtgattcacagagtaatgccagacacttatctggttaatcagtactaagtagttcacatccttttcctgatttgtcagaaaactctcattctctagactagtcttgcaggctctgatgtacttttcatgaggataaatgcagttggagaacatattttggtcaagaggagcattagggtaagattcattattgtcggtagctcctcttcatattgccacttctgcctgtcacctgagtcaagggttcttggttgggaaataaagcaagtttctcttttaacttgatccccttttctgttctgcactgactggtttgcactactgtcacacagacatcctgatgatatgcaggtacttggatataaccaatatataccatgtttgctcatcaatgttataaattatttcataaaccaaattgaagattacagtagcagacacagatttgtcatagattttaatcaatcttcaaatcataattacagtacatctaaatcttgcttgcccattatatgtatatcacttgcaaatttgactgttcagaatacaacaaagaacaaagaaataaaagcaaccccagagtaacccaaaatagataaactcagaatgcttacattcattacaattaatacataaatgatgtgttttaactctttgtcaaggcctgttcacttttatactctgtcttctgtaatttgctcaaagttatctagtttctaagaccactttagattagaagcagataattagatagaaggagaaggactgataaggagattgctttttagtgatactaacagcagtaagaacgatagccatacaaggtggcaaataataaaaactaaaattagaaaaggcagaccgaagaactaaaaagaatatttatacgggatactactatgtaataattcatattcataatggtaccttaattatgtaataaagcttaaatgacatttagatatacactgtttgagaaggaagggaagttacttaaataaatcatccttaagctgtgtacttagctgcccagaaccttttttttttttttaccaatcaattgatagataactttgaactatgctgaggtgcaatttgaatatgtattccctaattttagttatcgaagatacaaggagaaaatgttcaaggtgtagcatcttgaatgaaggttacataaattataaaacaaataatgagaaaatttttaaaaccagtgaatatttggctatagtgttttcgttattagcgttttgcctccttgtggtaaaactcagggtgttatatggttgtattttttctttttcttgttttttttttttttttttttttttttttttttttttttgtatttttagtagagacagggtttctccatgttgcccaggctggtcttgaactcctgagctcaggcaatccacctgccttggcttcccaaagtgctaggattacagatgtgagccaccatgactggctggttgttattttttctatagttatttttatgcttacataaaaatattataacttgaatatttaatgtttatttatacttgcctctccatttttttttcagaaaacagataagtacagcagctacccagtgtaccacacaatttatgagacatttgaattggtagagaaattttatgaccccacatttaaaaaacaactttctgtggctcaattacgaggagcactggtatatgagcttgtggattctaaaatcattccttttaatattcaagactatgcagaagctttgaaaaactatgcagcaagtatctataatctatctaagaaacatgatcaacaattgacagaccatggagtatcatttggtaagaaatagttgggcagatattttacagtctttaagttagagctttaagatattatctcctatgatgatcaatgcatattgtttcatcctagaatacatatttgccttacttattttgacttctacacaaaaacttaaaacaaacacctattaaagaatctgatttaatctggcatgtatagaatgaatccattatggctgagttattaccacaaacattgggatggtaaacatttttcttgtattatggcctttaaaaacatttttactggctgggtgcggtggctcacgcctgtaatcccagcactttgggaggctgaggcgggcagatgatgaggtcaggagatcgagaccattctggctattatggtgaaaccgcgtctctactgaaaatacaaaaaactagctgggcatggtggtgggcgcctgtagtctcagctactcgggaggctgaggcaggagaatggcgtgaacctgggaggcagagcttgcagtgagctgagatcgcgccactgcactccagcctgggcgacagagcaaggctccttctcaaaaaaaaaaaaaaatttactgttatagaaacaatattagaaaaatgtaacattatttgcaaaagattgagaaagccacaaatactattacatacgtatttttaattattgtcaacaaaatgattattactgcatatatcttttagtgtttgtctatatgaaacattttttccatggttataagtatactttccttttattaatgactgtttagtggttgctcttctgcattgtgcatctcctatacagcaaggatgactcataatgcagtgtatgtagtagcattgaggattgagtttggaagtggtttgcctggttcagatactagctttaccagttcttcgttatgtgaccttgggaaagttacttaacttctctatgtgttagctttcatacaattaaaagataaaaaagaacatatcatgtttcaaagatcattgtggagattcagtttggtaatatatagaagctgtggtgggtagcacttagtgctcattaaatattacctattactgttttattacaaacattgtcttttattattctgggggcacctatttttagtatatacccaaattatcaaatatgccctgagtttctactgtgtaccaagtactatgttattacctgggagatataaatgtgtacaaggcatggtcatagtcctaagaaagcttaaagtctcatgtggggaataaagcaatatacagataataggttactatggggctatgtagagagtactataaaaacacagaaaatgggtatggaatagtaatgacttctgaatattattatataaaggattagtaatctttatataatattatatacaggattagtaataatagcaaatactatggtctagaaaaaaaatgaagcaaataaaatgtgtttatatcaatacaattggagtatctctgcagtgatgggggaaataaggagagataaaaccagagaaataagcagagcctacagcaaaatggacattggtagttctgtggctattcagcatccagttgtcttcctaaattccctgatttccttttggtgaatgatcttttatcagtttttataagtcagggtccaattaagagacagaaaccacacagttagagtggaagggctctctttagacaaggttaattcttctacctacttaccttcttagaggcctggtttgatctgttaattcctttccctgtcatactttcaaaaatcaccattactattggtgactatccattagattaattattcttatagcttttctatttcaaaaacatttcttctgcctgatgtgtcccactttcttcacaatcaaaattcttcatttagtgccaggcagaaacagttcctgagaaaatgtgttagtgtaggaatgaaggtataattgatgaatgaatgaatgaatgaatgaatgaatacataatctacactccctgtctatagttttttacctctcactagccaatccactgtgctgtcttatgtcctttctactctagtaaaactgctcttgcaaaagtcgtcattgacatgtgttactaaatcccaggacacgtttcagttatctatcttgacttctgtcctgcatttgaaatttaaaattctgttttcagcattctttcctcatagtttctattctatctcttattacattctttggtttgaacttggcttaaaacaacaattaaaagttaaggaaaatctaggactaaaagactaggactaaaatctaggactaaaatctgggactaagaaggtttttaaaaatactgaatatacttatactgaatgtaccacttactagctaaagcatttagagctcaggatttctattaggtcagacctaatagaaattaggtaatagaaatagaaattctttccattaggtgtgacctaatagaaatcctgagctgtaagtgctttatctataaaatgaatatcgtatctcctgatttgcttgcaccacaggattgatgcaagcaacaaatcaataatgtatgtttaaagtcctgtgtagaaaatatggaaaataataaattgttgtaataaaaatataatatagtcacctctctatattggtgagttctgcatccatgtattcaaccaactgcaagccaaaaatattcagaaaaaaaaacccattaagtttcaaaaaagcaaaacttgaatttgaatttgttgtgctctgagcactacattgaatccacatgaagttatatataggcattgtattaggcattataagtaatctagagatgacttaaagtataggggaggatgtgtgtaggtaacaggcaaatactatgccattttatataagggagttgcttccatggaatatggttatctgcaggggattctggtacccaggcctcactgatactgaggtatgactgtactgagaacctaatcactttcctcagaagcattgtgaattaaagaagagtttgaccagatcaaatctgatcctctttctcagtatctggttatatcagtttgtcacaggttgcctgttgaacaagatcttaaatgcactatttgaaaacaagaattggtatttttttttgccctgtaataattacagaatcatatcctatgcatagctgtatccagtgtctagcatacagttgttgtcccaatgaatgaatgaattaataaaaaaatgaattctgggtttctggtaaactatgggttaaggaattatttgtgtcctagatttttgaaagtcatttcctttaagaaacaatgttaccattttttgttttcaaacaatattactttgttatattttctactaattttcatggatctgcaagaagactcagtagaaaaatggcttcgacatctatgtggtcatatcaatctggaatggggagggtgggaaagcgaacctctgaaatatgagctaatttctcttcttcttttctatttttaaaaaagactccttattttctgctgtgaaaaacttctcagaggctgcttcagattttcataaacgacttatacaagttgatcttaacaagtaagtttcaaatccctttttttttaaaaaaaaaaaaaaaagcaatctggttactagaatgaactgtttcactcatattagcattaacctctaaatcactactattcaaattatagtctgcaaatcagcaatagcagtagtacctgagaacttgttagaaaggcaaaatatcagacaccaaccaagacatgctgaattagaattttgcattttaactaccacccccaccccgcccttcaatgatttatactaacagtaaagtttggggagcactgctctgaatggtagactaaaaactcatcccaaagagacaagggccaaaggtacctgtcattaggagtctgcatgatgaaaattctgactacagctgtaaattcatagctttatgagtttaagtgcgtttgtaatatattttactagttctttgttcagtactcctgtgtaccagtttagaaattcttttttcatggataattttttttgcattttatttaatttcttgccactttcacattgaaaatagtttcaaagtacattcaaagtaaataccatgtaacaagcataaatttatccacagatgtgtccatgtcacatttattttttcagatgtaatcagaataaactttgctacttcccatattggaagaaagctattatcagtagttttaagggacctcattctcctttggattgtaggggagcccagggaacttactcaactccccaaagggatagtctgagtgtgacaagggattccctatccattatgtgcagctatctcttaccctccttacaggcttctgaaaccttcattcactctttgttgtccagcctgttatctgctccttttttcagcagtagaaccgaatgacttatcaggaataacttgatagctcactttgtctgcctttccaggaggcctggctgtcctcctagaagtatagaatgtctttgagtcccttttgattggtgtgtgatgtaaaaaaatataacaaacgattttccaataggtctctctgctgactgtaaatattagaaagatgactctgctgtttgtggctcaccatgtaaagcattactgtgttaatattcattttgttaaaaattgatcaattttagaaatatattttcccaagccttgtttttatttaatattatttttgaagcatgattctgcggtttgcgttataattatgtatatgttcttctcgaagtcccattgcagtgagaatgatgaatgaccaactgatgctcctggaaagagcattcatcgatcctcttggtttaccaggaaagctgttctataggtaaggaaacaacaggcgccaaatacatcactgtgaccaaaaccagcatacctaaagttggctttaaactaatgccattagatgggtgaaaggcaaatatgtacactctagggaatttgggtaagattgtacatttaataataggtataatacatattagaaaaataaatttcatattgtttattgctttgctgtgagggaaaatggtaaaggctagttaaaaaagaactctttctaacaaaatcttcaaactgtagaatcttaaagggaattttagagcttatctagttcaaccttctacataatcctttttatagaatctcagataaatagttatccagtctcagaatcttttagtgatgagaagcttactacttcatgaggaggctcatttcactttatgaaaggtctaattattagaaagttttcttcataaagatttaacatctattttcctgtaatatttttctctttgagtttgttctgttaaagtcaaataaaataagtttagctctatttccatatagtattttaggtttttgagatggttctcaacgatggttagatttcatttttcggcgttatgatggtgcaaaggcaatacacattaagtagaaaccatacttcaagtacccatgcaaccactctggttttcatattcagtgtagtattcaataaattacatgagatattcaacacttcattatagaataggctttgcattagataattttgcccaactgtaggctaatgtaagtgttctgagcacatttaaggtaggctaggccaagctatgattgttggtaggttaggtatattaaatgcatttttgacttgtgatattttcagtttatgatggttttatcagaaaacaactcatctttaagtcacgaagcctctgtatcctattttcctatctgtatctctacatcatgttctctttcagtatcttggctgcatccctttggatgttctccattttctcaaggtccttctaaaactggttctctggtggaaattagaaaggtcctagcattcaaagccagaaaatctatattctagttcacttgcagatgtgtgacttaaagcaagtaacttctagggttttcccatccgaattaagatgatgataattgctactttaaaggctatttatcatcaaataatatgcaaaaaaggtttatatgttacctttcttataaatgttaatgattaatattaacatttagataattacaagcatacgcttttagaacccagctctgccacatacttcacgtgacctggaaaaattatttttctaagcttcagatccctcagctactaagtggagattataattgcttttactcaataggcctgtagatttaaggcctgtagaagatttagctcaagagggatgcactcaataaatggcagctatttttataaataataaaaacacaaatgtttgtttcttcattgatgcaaatgaaatagcaatgatcaattatttatatggatcaaacaaaagccgaaagccgtatctacagtgtttgttagtcctctcaggtgttgttattagtctatctttatatatttattttctatttatttataagaaatctatattttgtcattattttaaaaactcaggctctgtagaagcatataaaataaaaaggagcagtgcttcttcagcattccccccttgccccctacacccagttctttattctcttcagtgaaactcaatgttgagtttggtgtaagttttaatgcacttatatacatgtttatatatgtatatagtcagccctctgtatctgtgagttccacatctgttgattcatcaactgcagatagaatatatttgaaaaaaaaatgaatggttgtgtctgtactgatttacagaccttttttgggtcattattccctaaatacagtaaacaactatttgcatagcatttacattgtattaggtgctgtaagcaatctagagctgatttaaagtatctgggaggacttgtatatgtcatatgcaaatagtaagccattttatataagggagttgagcatccttaaattctggtatccaaaggggattctggaaccaatcccccatggatactgaggaattactgtatatacttacatatacatttatatatacatatattacatttatatactatatatgcaaatatttccataaaagtgtacacacacaatatataaacaatttttatttacataaacatctatatttaacatattataaatttacatatgtaatcatttatatttacatgtataaatatgtaaacccatttatatttacataaataatgtatgggaccatacgttacaattttatttttttccttaagaatgtatcttaggctgggtgaggtggctcacacttgtaatcccagcgctttgggaggctgagaaaggaggatcgcttgaggccaggagctcaagaccagcctgggtaacacagcgagaccctgtttctacaaaaaattttttaaagtagctggtgtagtggtgcatgcaatcctagctacttgggagggtaaggcagggggattgcttgaacacaggagcttgatgttacagtggagctatgatcatgccattgcactccagcttcgacaatctctaagattttttttcatttttttagataaaagatttgactcttgtgaaaatatctacctcttactgaatttcagattaggatttttccacaattatttactattatgaaaagtaatggcattgtatggatgtccttgagtcctatttgaacatttgttaatatctctataatcaggacctgggatttcagggtgaaagggtaaacacttttttttttttttttatatacatttaaaattttatttgttttcacagaaatgagcaacttgtacagccatatttgccttttctggctcattggcttttgatcacatctcatgactttttgagtccatgatattttgcttacactgaagaacttgtaatcttttttttttaaatttatttattatacttttaagttttagggtacatgtgcacattgtgcaggttagttacatatgtatacatgtgccatgctggtgcgctgcacccactaactcgtcatctagcattaggtatatctcccaatactatccctccctcctccccccaccccaccacagtccccagagtgtgatattccccttcctgtgtccatgtgatctcattgttcaattcccacctatgagtgagaatatgcggtgtttggttttttgttcttggcgatagtttactgagaatgatgatttccaatttcatccatgtccctacaaaagacatgaactcatcattttttatggctgcatagtattccatggtgtatatgtgccacattttcttaatccagtctatcattgttggacatttgggttggttccaagtctttgctattgtgaataatgccgcaataaacatgtgtgcatgtgtctttatagcagcatgatttatagtcctttgggtatatacccagtaatgggatggctgggtcaaatggtatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagtaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcgaaggacatgaacagacacttctcaaaagaagacatttatgcagccaaaaacacttgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaatagcatttgacccagggtaaacacatttttaaatttgattaggttactaccaaactgtcctccaaagactaccatatttttaaaaatgcactttgaactattagctgaatgttaagattatattctaatgctaattcatattattatgttttagtctactgcagtagtatggaaataagttcttccttcatgatcataaggattactttatggattgatatgacatattgcatatgcacactttttccaataactgctaagataaatgtagctataatagcaattccagctacccagaatttctcatttgtcttaaagaatttatttcaaaattattttttcctcatccagcaatgtatatcaggttaaaaatgatcttgtaaatcttataaaacctctaagagtaaaaactttcagtacgtataatggatcaatgacatttttaagatctgctattttatgaacctcaagaatggagagattaccaaatctgtagtgtaataaaattgttctaccatgtagaattgatagactaagaaaattagactaatctgatgtatgtatgtatagccattatatatatatgtacattacatatgtatgtattgttaaaacaaaaacattagccaaattatatttaacagactttaattgagcaaagaatgatagactcagagagactccagtgcagccacgtgatggatgaagagttacagacagaaaaaggaaagtgacatacagaaaacggaaatgagtaacagaaacagccagactggttacagcacagaatttaccttatttgaacagtttgaactgacccctttaattggccaaaacttggtgatcggcacaagagtagactcagtctgttgacaactccatttaggttatagttcactatgtacagagaaacctttaggctgaacttaaaatatttaaggaggcagctttaagttaaacttgatttaacagttgagattcagtaatgaataaatcagaaaacattgtacatattttaaaataaaatgttaatgtggaacatataaaacattcttcttaaaattcagaagtataactaaatgtttattgtgaataaaaaacgtgtcttagtccattcctgctgctatatcaaaatacctgagactgggtaatttataaaaaacagaaatttattcctcacagttctaggggctgggaagtacaagatcagtgtcaaccaattcaatgttttatgagcacctgtcccatatatggtatttttctcagggcgtcctcagttggcagaacagatggaagggctagctagctttcttcattctcttttataagggctctaatcccttaatactgtcacactagaaattaagtttcaacatacgaatttggggaatgaacacattcagaccatagcagcatgcttgataaattttgcaaacttaattatttttgagttgtgggtaatatattgtaactatcacaacaaaggcaaataagtaataaatccttatctaccactgagctcattttctatattctattactcctcgttttttccctaatgaaagttccacaaaaattaattgctctgtgtggtaagcataataatggcctcccaaagatctctattttctaaccccagaacctttgaatatgttaggttacatgacaaagaggaattaaggtggcagatggatgagtcacactaatcagctgagttaaaatagggacagtattctgaattatactggtggtcccaatgatgcagtcacaagggtccttaaaagtcttcctgtaagaggcaggcaggagagaaagttagggtgatgccattgcgaaaagactcatctaaaatgcagttgcggattttgatggtggaggaatgtggtaggcctctagaagctagaaaagcaaggaaaaggattctcctctagtgcctccaggaaggaatgtgaccctgatcataccttgattttagcttggtgagacttatgtcagaccaactgtaagataataaatttttttaagccactaagttggtggtaatttgcacagcagcaatataaaatgaacacactctgtaatggaatctaaaaaggattaaataaagcttccttttttgcaaacatcaagtgaaatactgtaaaagtctttaaaagctgcaaagcatttaattatgaaattctagaaacatttgtggccgggcatggtggctcacgcctgtaatcccagcactttgggaggttaaggcgggtggattacctgaggtcaggagtttaagaccagcctggccaacatggtgaaaccccatctctactaaaaatacaaaaattagccaggcgtggtggtaggcacctgtaattccagctactcgggaggctgaggcaggagaattgcttgagcccaggaggtggaggttgcagtgagccgagatcatgccactgcactccagcctgggccgacagaacgagactctatctcaaaaaaaaaaaagaaattttgcattatcacaactcatcagtgaatacttactatgtactgaggggaaggttgaggaaaaaagactatgaagtgttgaccatattctctagtctgctcagtagttcttgatgcctcttaaaaattcagaaatgtccattgtggagggtaattaaatcatcatatacttgaaaccttgagaactagaccagagtttgaattcttatgggactagaatagctatttgagtccaccatttcataaaagggtatttgagttgcttaagcattaccaattgtctgatcatttcttttagcttgctgcctgcttcttatctgagaaaattagggaaaggatttagtttcagaatagctaatatttactgaacacctattaaatgtcaagctatgcttttcatccaacatttgattctcacaattcttttagaacagtacttttatcaccatcatttttaagataacaggcacagggaggttaaataaccagtgcaaggccacaaggctgatagttgatagtattctgttgatagtaaatatgctagtattctgatttttaaaaaacaggcagtctcagtctacaacctgctcagtcactactctaagcagagtctacattatttcaattattttacaaatctgggacaaatttagacaacttaggcaatttgccaaaggtcactgagatattaaatgccatatcaatgattcaaaggttattcgcttcctatatcaaattttttttgctatattcttcctttacaattctccagaagagggtaagtatactaaggaatatctatgacttgcatctctaatttcttgactcatatacaggtcaggataccaatgcttataaacaacttagcacataaactgattttaattttaaaaaaatccatctgaggccatattaagatttaaaagccaagataataaatcctgatgtactttggtaaatctgaatgatgagtgttatagatttgtcattaatcattaatcattaatactgacttatatggagctctatattgcttcatacagatttactctagaataagctttggggtttgactgttggacctaattcctgatgtattaataaaatacatccctttctggaaagcaaaattctacgtcattattgcggaaagtagcttgatcccttgagctacttatgttgaagtagaaaagcaactataaaactttctttttagatcaaaagttgagtgtctttgcgggcaacccacatataactgtcttacctttgtggaatggacgtcattatccttgccatttgtaacactttgaaatacaggcttctttaattacttgttttttaatgtctaaaaagtattgggaacaactgtcattcttgtttaatctatttttaaaaggcaacacaaaaataaattatctttctcaatctcctcttactaaaaacatccataaacttacatgttatcaccatatttgtggatgcttacgggacgctgagcaattattctgcacaacttaaaagaacctgctttcttccatctgctttgggttcgcaacatggtatatgattcctgagatatgtcttagcgaatgcatattgttagcttctttcctggcttgaaattatgattcgcataagtatctcagatcaactgtcttcttattataggaacaaaagtgagtatcacaaggaaacatcatgtggtctaaacaaaaagcatgcaaaatgcatgtatacactttagttcaatttgccttgttttcttccttttaggcacatcatatttgctccaagtagccacaacaaatatgctggagaatcatttcctggaatctatgatgctatctttgatattgaaaataaagccaactctcgtttggcctggaaagaagtaaagaaacatatttctattgcagcttttacaattcaagcagcagcaggaactctgaaagaagtattatagaaggtctcaagtggctagccattaaaggtgttgctaaaagtctgaggataaaattcacctttctgataacttatgaagccagggtgttctaaactcttttcatgtcatgttttgattataggctttggtcttttcatctgcaaagccttttttttttgctctttaaaagttaataattatattagcaaagtgttaatctaatgaagtaaaaaactcctgtgtggcagaaagtaaaagaaaattccctaaattatagcaaggaacatgaattctcagacattgtgagtgtgggaatgtaaaatggtaaaatcacttttgaaaacagtttggcagtttcctataaagttaaacatacacttttactttaggactccagaattccacttctagttatttattcaagagaaggaaaaacaatgatcacagcaatacttgtatgcatgttcattgcaacttaaaagcgtaaaaaccccaaatgtccatccacagacgaatgtataaactgtggtatccattacacaatagactacttactactcagcaataaaaatgaagtaactttcaataaatgcaatattattggcagacattgttgaaggaaaaaagccagacaaacaactacataaaatatgtttctatttagatgaagtggcaaactaatctgtagtgttaaaaattagattagtgattgcctgggccaagtggcaggttggggaggatggctgcaaagaagtatgaggaaactttctccaatagatgagaattttccgtatcttgatctgagtggcaaattgtaaacttaaaatatatataaaatttattgtatgaaaattaagcctcaataaacgtgattataaaaaacaa

SEQ ID NO: 2659 - DNA, 504697 bp, Homo sapiens
cgtgctgtggcggcggcggcggcggtagtggcggcggcggcggtgcctgggcggcagcagcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccggggaggggcggagctgtaggtgaggcttcgcgaccccctccccctcctcggcagcccggggggtggggaggggcgggccccacccagaccaccggcgcccacccgcgggctccacccagccgggctccgggatcgggcgggagccgaggcggtagatgtggggatcctggggcgggaggtgggggagtggggactggggctctgggcacttggggagcggagggggggaggcttaggactagtgaagccgcggacgaggtagtggggagacggagaaattggggagccatgaggttggggtgcggtcagggtggatctttgggttaggtgagtgatgtaaaatgctgaagatgattcttttcttttcgatgaaatggtgagataaaagatgaagtgtatttcaaaaggacgatgagctgtgcatgttgcctttgaggcagttgcagaacctattttattgcactagatctcacgtttctactttagggttcgattctttttcttctggcggggtgggtggggggtcggagagggaagagaatccccttactttggctcaggtaaattgtgagcgtggatgtatctgaaagttttacaccgaagaagagggagatcttcggtttagacaacttcgttccggcagccaccatttgggtcgcattacgcttagctccttcaaggtggtgtcttccagttttttttccccccaatgcctaaaagatctctttataccacccttttacaggctttatcctggccccttgagagaaggccccaaactcaggtggttgctttggaaggcacattgctgaataatagttgcaggtggttgtggttgactgctttgggtggataaagtgaacaattggaatagttctgttggagctaattatatgaaaaatgcttaaatgttttaaagtacaaccgtcttttatagcgtgttgcttgctcagtacaccttgacttttagacattttgtgttcagtgctaaattgttgaaattttatttctcatttgcagttatgtttcttgcagtctttattaaaacactttaaaatgaaatggaactctttttttttggtaggctcctcaatttctgagaaatgttcttggagtcaagtgctttaaaaacattttgggggcaggtgtgtcactttgtatggaaatattagagtaagcagtgttcaatgttcttcacatcactctttcacaacttagcactgtaaatcagaatcttcttttctggattcttgctccctgttagattacagtattctctggccctacttatcagttagtgtcatttaagctatttcttgttcagaaaacaggtcccatgatggacatgtattatgtaatggatggaagtagacatggctctcaataattcatttatggaggaagagaagctgtcagaaagtgggatttaagcagtgactttcccaaggcttgcctagtttatttgggaaaatagccagagaagtgctttcttgtaacccaaaagagaaatatacagataagaatttcagtagttgcagatcgttgctttttctaagtgcctacttaatgagcagattattgtcttccagcaaatacttctactttatagagaggtatgggaaacaggacataataggtattaagtgagaaagtgtgtgttccaatttttaattataaataaaagatttaattaactgtattcagttaattcatttggtaaagtgaacagttttgactttggattagttagaaggaaaacaaaattgacatatctagttttcgcttttaaattatacatagacttaattaattgggacaaatgtgaactaagatactgggtaaaacttgtgtgtactcctaaaatgacatttgcatggctggtagtaagctgtgattcttgtccttgtaggaatgaaatcacataatttggggaaagtcttaaggtaaaagtaagctatttcgtttagcatttcttgtgcctgaaattatgcctacattttatttttcaaaaaatgttgcttgctagtcattacttgtgatatccttgttgagtctactgaggtgttttttttccttcattacctgtgtcatagataagtatgccagtctgttaattcaacattaatactgcaaacttaaaagtgaaggttcttggccgggcgccgtggctcatgcctgtaatcccagcactttgggaggccgaggcaggcggatcatgaggtcaggagttcgagactagcctggccaacatggtgaaaccctgtctctactaaaaatataagaattagctgggcgtggtggcacatgcctgtaatcccagctactcaggaggctgaggcagaagaattgcttgagcctgggaggcagaggctgcagtgagccgagatcatgccactgcactccagtctgggctacagagcgagattccatctcaaaaaataaaaataaaaattggctgggtgtggtggtgcacacctgtaaccccagctactcaggaagctgaggcaggagaattgcttgaacctgggaggtggagcttgcagtgagccgagattgcaccactgcactccagcctgagtcacggcaaaactccgtctcaaaaaaaaaaaaaaaaaaaaaaaaaaaaagtgaaggttttcatagcaacagctgctcggttttacactatgtttacatttagaagtatgagagttgttaaatgtgtattttacacatatttcatcagaaacattaatggaaaaagatcaagaaatgaagtattttggtttaagaatcagtagtacattgattatcagttttcagagacatatagtaaaataaacttagcatacagattatgtggaatataatttgtttttttttcttatttattttttgtgtgtggaatgtaattgaaatctgttgctcaccaagtctttcagtgtactagagtttgggttctggggtcagagtgcctgagttcaaatcctggctttgccatggtatgatgtagggcaaactgcttaatgttgtttatttcctaaccttaacctgtaccttaatttcttcatctgcaaaatagaaataataacagtagtacctaacctcttaagctggtcaaatgaattaattcatgtatttagaacagtttgggcacataattagctggttcactaacatcatttgaagtttaactgtgtatactatttttacttaataagtatatattaaatacatattatgtaccacatattctagatgctggtatcatagtagtgaacagttctcccagcactttgggaggccgaggtgggaggatggctgggcaacatagcgagaccatgtctctacaaaaataaaaaaattaggccgggtgcggtggctcacgcctgtaatcccagcactttgggaggccaaggcgggcggatcatgaggtcaggggttcgagaccagcctggccagcatggtgaaaccccgtctctactgaaaatacaaacaattagctgggggtggtggcgcgtgcctggaatcctggctactcgcaaggctaaggcaggaaaatctcttgaacccaggaggcggaggttgcagtgagtggagatcgtgctattgcactccagcctgggtgacagagcaagactctgtctcaaaaaaaaaaaaaaaaattagcatggcagtatgtgcctatagtctcagctactcaggagactgaggcaggaggatcacttgaacctaggggttcgaggttgcagtgagctgtcattccgtcgttgcactccagcctgggcgacagagtgagggaaggctatctcaaataaataataaataaataaaagtacgggcagtagtcaggagcttatgctgtattgttccaggtgagggtatctctgaccaaggtgaaatggggaggaggggttggattttgtatgtattttgagggtagacctatagaatttgttggtggttgtttgcgggatgtgggccaaacagaagaataaagaataaggtttttggcctgaataactggaagaataaagttgccagtaactgaattggagatggtaattcatggagcatgtttgtggagaaaccagaagttcagggtgatgtccaggaagagtgagaaatgtggctgttttcagcttctttgtagtatttatgattatgagataggtgagatcatcaggggagtgaattttggtggagaagagatccaaacatctgagcctaggggactgattcattcacttattcattcataagttacttagtgagtatggttcttctaggtacctttttaggcattggggatataaacctgacaaaagttttcaccttcatggaacttaccttctagatacgtgaggggaaatcaagaggaaccagtaaaggagagtgataagaaatcattgagttaggagggaaaccaggggagtatgatattctagaagtgaaggaaaggaagctttcaagaaggagggaacggtcagcggtgtcattgtttaaagttgtgtcagaatgttgagtaagagagaattctgcttgattatgatgtctaataacagggaaatgactaaataagttttagtgtgagatagatgagacaaatgtaagagtcttttagttttttacttctctgttttttttgtttttttttttgagatggagtctctctttgttgcccaggctggagtgcagtggcgcaatctcggctcactgcaatctccgcctcctgggttcacaccattctgcctcagcctccggagtagctgggactacaggtgcccgccaccatgcctggcttttttttttttttttttttttttttgtatttttagtagagacagtgtttcactgtgttagccaggatggtcttgatctcctgacctcatgatccgcgcgccttggcctctcagagtgctgggattacaggcataagcgaccacacctggcctcattctccgggtagatttttaagaaatatttcagccaggcacagtgtcacatgcctgtagttccagctgctctggaggctgaggcaggaggattgcttgagtccaggagatcaaggctgtagtgtgctatgattgcatatgtgtatagccactgcactccagcctgggctacatagtgagaccccatctgtaaattaaaaaaaatcattcttttcagaacaaaataggcaacctgggagtgctaaggaaaggcacatgacttcttattgttgttgttaattttatgtacacttattttaagaaataggtaatatatgtactaaattagaaggtataagagaatacacagttaaaagtctctcctatcccatctagttctttctgaaggcaatcactgtttgcagtttcttgttttttctttttagccagtgaaattttgtgtaataggacattacctattctaaaattgcatacatataagaaacattttatcttccactctgacactgaacactggcaatattttatactttttgagaagggtcttggtctgttactcagtctgaaatgcgatggtgcggttatagcttactgcaaccttgaattcctgggctcaagcgatcttcccacctcagcctccagagtagctgggactgtagccatgtgccaccatgcctggctaattaaaaaaaatttgtagagagacaaggcgtcattatgttgcccaggcactattttagaatagcttatttaaaagatagttttagaagcctgtcaagggaaatagtgactgctaggatcaaacatggattcactaagtcacatcagacagtagttgcctagaattgacttggttacttgactgataaataaaggaaatgcagtagttggaatttatgtatacgtcagctaggctttttcatgtcgtctttgtggaaagtacgaacatatgtgtcctagatttcttgaggacaggaactatctattagatacttattaaatacttgatgaatgaatggatgctagcataataatgtgaattcacaagttgaatacccaggaaataaagaggtgcttgttgaggatcttgggtttgaggaacttggtgttagactcatccatacatttattgaaatgacacaggatggtagcaagactggtggcatagaggataatggcagctgtgaactagttgccagcatatccttactgagtatgggggatgtccaggtggtcattagctgatagtgaagaggtagaggttgaagactgtgctgctgaatagcatgagaattagactaagattttacgtaagggtttgggaatagtggtctggaactggcactggcaggaaggaaggtaccagcctcatttcccagtattgggtgtggagtggaagagactgagtagctttcacttaaaaggactatatgagaagaggtgtcctgattggaaagtcagctttcagttaaggcagagaggtagcaagaacatttcccaaggaagttgaagacttttagaggagtttcttgataaaagaatgaagttccatgagagtgtatttttccaccctattggcttgttatcatcatttaaactttaaaatgtctcttcatcttaataaaaaactccagatttatactttattgctctaagttgctctctgctttacacacttaagagttttctgcatttgctgtgtatctccatttcttcacctgtgacttctcaacctatttctgtcttgtttctatcgccattatttcagtgaaactgaaaatagctagtgaaaatatgtatgaaaatagccaatgtctattttactatcctgttcttatttaacctcttagcagctgtgctagtttctattggctatataacaaattaccccctaacttaagaaacatttattgtttcacagattttgtagatcaggaatgtgggtgcagttggcacctatgattcagggtctctcacaaggctgcagtcatctcaaagcgctacttggggaggctgtttccaagctcactcatgcggcaattggcaggcctgaggtccttgttggctgcttgctggagaggtgagtcccttgccatttgggtttctgcgtacgactacttaaaatatgatatctcagtgcttctgtcttcaaaagaggacagatattagccagaatctttttgtaaccttatcttggaagtgatgtggtatcacttttgttgtattctgttatcagccagtcactaggtccagtgcactcaaggcaggatttcacaattgcatgaatgctgggaggcagagatcactcatagccatttcaggactgtctaccacagcagcatttgacagagcggatacccctccttcctttgtaaagctctctcttctcttgaggtcttcagagcacttttctgtttttcttgctggttctctgggctctttctctgtcacttttttttttttttttttttttttgaggcagagtcttgctctatcgcccaggctggggtgcagtggcacaatcttggctcactgcaacctccgcctcctgggttcaagtgattctcctgccttagcctcttgagtagctgggattacaggtgtgcaccaccacacccagctaatttttgtatttttagtagagatggggtttcaccatgttggccaggctggtctcgaactcctggcctcaggtgatctgtctgccttggcctcccaaagtgttgggattataggcgtgagccaccgtgcctggcctctcagtcaccttttgagtctttctgtgctcatttattaaatgtttgaatttctttgggctttctcatcgctttctatttcatttttcatctgtgtgctgagtattcatttttatgtcttcagtttttacctctctcctgagtctgaggaccactctatcgaattgctactgaatgtttccatttggatgccccttaaaccgaacacatccagaacggaatgtatgattcctacacttcctctggtgtttcttaatttgttaaatgacaccactgggtgcttaagccggaaatgtgtgtggtgttcttgatttctccctctcctccaccttccattttactattgctttttatttttctagagccatggctgttcagtgatggtgtgaatgtttctatgaggtagtgcatcctctgccaggttgcaagcattgaacctggtgctaggtgatttttttttttttttttttttgagatggagtttcactctgtcgccaggctggagtgcaatggtgcaacctccgcctcccgggttcaaacgattcccctgcctcagcctcccgagtagatgggattataggcgtgcaccaccacggccagctaattttgtatttttagtagagacgggatttctccatgttggtcaggctggtctcaaactcctgacctcaggtgatccgcctgtcttggcctcccagagtgctgggattacaggcgtgagccactgtgcccagcccgctaggtgatttttaagattccttccaatcttgagatactgcgtgtgtagctattgaagatttctgagtaggagatgcatgatcagggctgtgcttcagaaaggtggcaactcttgaacagtcatttttagttgttcaccaaagaatgaaactaaacacctgtattctttttaactttattatggtgtgctaagtgatgaatagataatttttatgtgacagcccttttgtatatattagtttcattttttctcattgttaatgcatttatgtttggaagcccttttgcatggaaataagataatcaggccaggcacagtggctcacgcctgtaatcctagcactttggcagactgaggtgggtggatcacttgaggccaggagttcaagaccagcctgagcaacgtggcgaaaccccatctctactaaaaaataaaaaaattagctgggtgtggtggtgcacgcctgtaatcacagccactctggaggctgaggcatgagaattccttgaaccctggaggcggaggttgcagtgaactgggattacaccactgcactccagtctggatgacagagcgagaccctgtctcagaaaaaaaaaaaaaaataacccaatgggatgaaaattttgggatgaaaatttgtgtgaacttaaattaagtgtctctgccatcctggccaacatggtgaaaccccgtctctactaaaaatacaaaaattagctgggtgtggtggtgtgtgcctgtagtcctagctatttgggaagctgaggtgagagaatcgcttgaacctgggacgcacaggttgcagtgagccaaaatcacgccattgcacccagcctggtgacagagcaagattctgtcttaaaacaaaaaaaattaagtgtctgaaattgtaaaaacttctcaagaaataaaattcagaccttaaacataattttactgtaggaatataacttaccttttgaaggaattctttcttgaagccattatttgtgtatttatttatttttaattaacttttttgtttgtttgtttttttgagatggagttttgcccagactggagtgcagtgatgcgatctcgtctcacggcacctcccaggttcaagcgattctcctgcctcagcctcccaagtagctgagattacaggtatgggcaaccacgcctggctaatttttgtttttagtagagatggagtttcaccatgttggctaggctggtctcaaactcctgacctcaggtgatctgctcacctcggcctcccaaagtgctgggattacaggcgtgagccacactgccggtgcttgccaccttgcctggctaattttaaaacttatttttgtggatattgagttttggttttttgtctaggctggcatcgaattcatagcttcaaatgatcctcctgtcttggcctcccaaaatgctgggattacaggcatgagccactgtgtccggccttgaagcccgtcttgaatgtaacacatatgtagaaaagtatgtaaaacaaaagtaaagctttacaatttatgaatcagacacttgtataaccatgatgtaggtcaagcactaggaccttactgacattccacaagctttccttgaagcttcccaatcacaacccagtccttctctcataaaggtaatctctgtcctgattgtaggagaatcaccttctttttttgtgtgtgtagacctttttagttttggcttagttttgattgttttgcatctttatatgcatggaatcatattgtatgtattcatgtctggctttgactcaacattttgtttgtaagatttagatttgtatgtagctgttcgttcattttcattgctaaatagtattccattgtataaatatactacagtttattgtattattgatggatatttaggttgtttctagttttgggctattatggattatgccactatgactattcttgtaaagtcttttttttttttttttttttttcctgagacggagtctcgctctgttgcccaggctggagtgcagtggcgcaatctctgcttactgcaaccaccgtctcctgggttcaagtgattctcctgccccagcctcccgagtagctgggattacaggtgcccaccatcacacccagctgtttttttgtattttaagtagagatgggtgtttgccatgttgaccaggctggtctggaactcctggcttcaaatgatccacctgcctcagcctctcaaagtgctgggatcacaggtgtgagccaccatgcccggctttttttttttttttttttttttttttttttttgagacagtttcactctgtcgcccagactggagtgaagtgttgtgatcatggctcactgcagccttgaccttctgggctcaagtgatcctcccacctcggcctcccaagtaactgggactacaggtgcataccaccatgcttggctaattttttttttttttttggtacttttttgtagagatggagttttactatgctgctcaggctggtcttgaactcctgagctcaagtaatctgcctgccttggtctcccaaagtgctgggactacaggtgtgagccactgcaccttgccttgtgcaagtcttttagtgcatatgtgtatgtaattcttttgtgtatttggccaggagtgaaagtcctgggtcataggatatgcatatgtagaattttagataattgccaaacagtattccttctttgtggttctacaaattacatgccccaaagagtgtttgagagttcattttgttccatatctttgccaatacttagtattgtcactattattaactttagccgttctggtggatttgtagtagtatctcttggttttaatctgcatttcacttattactaatgaggttgaataattttatgttggttacttaggaaaccttttgtgaaatgcttattcacatgtcttgcccaattttatcttttttttcttattataggagttccttatatattttggatatgaccccttctttggttatttgtgttgcaaatatttccaccttactctgtggcttgccatttaagacttcttaaggaggccaggcaccgtggctcatgcctgtaatcccaacactttgggatgctgaggagggtggattgcttgagtccaggagttcgagaccagcctgggcaacatagtgaaaccctatctctatgaaaaatgcaaaaaaaaaaaaaaaaaagactcaaaaaaaaaaagagaaaagaaatgtgttaggaccctaattggactttaattggatttgtagattaatttgggtagaattacttttttgtaatgaggaatctttgactaattcaatatgatatccctgttatttatgttgtatttcatatatctcagtaatgttttatagttttctgtgcagtattacacatcttttgttaaatttagtcctagtatctgatggtattataaatagaattctaagatcaatgttattttccattacttgttggtatattgaaataaaactgaattttgagtgctgactctgtattttgctaatcaagccttataataattttatctgtagattcttttggctttccaacttacataaccatatcatttgtgaataattactgttttctgtttttcttcgcaattcttacacctttttcttttcttcactggctgggatttctggcatgttgttgaatagagataggagacgtcattgtcttttcccatctcaaagggaaatctttcaacttttcattgttaggcatgatgttgtcaagcacacttacacaagacaaggcaaggctaagaccttgcctgtctgatttgactggcaaagacacagagagcctctttagactcagacagtttatctgttacatagtcggcagaaagaagaataagccaaaggttcctgctccctgtgatctttgtcccacataccaaaaaggataacaccacaacaaaaggggctgatgcctgcagtgtgagctgggggatactctgttgatgaggagcctattctaggctgctgctaagtggttttgtattctacagcgctgttctaagttaggcagggctgaaggttcaatgccttgtcagaacccaggatgccatgagaaactgtctcatggcagcttctaaggaagatagggaagaggtgacctgggagagctccatataggccttccaccatctcctgttatgggaggatcacagggcattcctccaagactcagataagctgcaggtcaccagaacaccatggtggaactgtttccctacagatgtttgttatagttgcttttgcacatgtcctttattagattaagaaagtttcctcctatacctagatttttattcattagtaaatgttaaaatgtgtccagtgtgtttcgtatctattggatgcttccccccctttcaacccattattatggccagttacatggatttaaaaattcatttctgctggttaataaatttctttctttttttctttctctttttttttttttttttttttttgagacggagtcttgccctctcgcccaggctggagtgcagtgacgtgatctcggctcactgcaacctccgcctcctgggttcagacaattctcctgcctcagcctcccaagtagctgggattacaggtgcccaccaccacacccagctgatttttgtatttttagcagagatggggtttcaccgtgttggccaggctggtctcaaactcctgaccttgtgatccaaccgccttggccccccaaagtgctgggattacaggtgtgagccaccatgctcagctggttaacacatttctaagcatttttttcctttgaaagattttacttacttgaaaaaaaattgctgttgatgactttcttttctctggctgcctgcctttttctgtgtgtgtgtgtgtgtgtgtgtgtgtgtgtgtgtgtgtgtgtataaattttttttttctcattgttcatatagaattcaggtatagaattcaggttgctgaacttttcaaggaagaaagaccgtatttaacttctgattcatcattaagaagttattaatggtcccagagactcataggggtttcttctgaagtaagaagaagccatgttttacatcttcagatgccacgtaggtgacttttctaccttcatggtagtattcactttactttcattaaaggcaagtaattttgagtacttcaaattagttcccatcccttttctaaactttaaacatttttaaagaaatctttatttattttcacctggggtttcactctgtcacccaggctggagtgcggcagtgctatcatggcttactacagcctcgacctcccaggctcaagcgatcctcttgcatcagccttcgagtagctgggactgcaggagtgcaccaccacacccagctaattttttgtagagatggggttttgccatgttgcccaggctggtctcaaattcctgagcttaagtcatctacccaccttggcctccgagtgttgggattacaggcatgagacaccatacctggccccttttctaaacttttatatgaaatttaggctgaacctttgcttgacgttattctcccttgcatttagatataaagttattaaacagaaaaagttactgaaggtagataattattggctatttcatgtgatttttctggtggttactgtagtcaattttatagtattgccaagtttctgaatccattctgaataatgtgattgtttattcttatgctttgggcctgataatttttgtagagcagcagttcttatctggtttcctgttatttttaaaataaattaattgaaaatgggcataaattatttgttaagtttgaacttgacaaatgcaggtaaagtataatgatattatatttcttctgtacagcaagtatatacatgtatattttaaatcatcaatcaggatttccttccaaagttcagaattaggttttgattcttaacagtttatattaaaattcttattattattactttttttttgagattcttaacagtttatattaaaattcttattacttttttttttttttgagacagagtctcgctctatcgcccaggctggagtgcagtggcatgatcttggctcactgcaacctctgcttcccgggttcaagcaattctctgcctcagcctcccaagtagctgggaatacaggcgcctgccaccacacctggctcatttttgtatttttagtagagacggggtttcaccatcttggccaggctggtcttgaactcctgacctcaggtgatccacccgcctcggcctcccaaagtgctgggattacaggcatgaaccactgcacctggccagtattattactattttttgagacagatttttctcgctcaggctggagctcattgcagcctcgaattcttaggcttaatcaatccttctgcttcaaccttccaagtagctgggactgtaggcatgcgccagcatgcctggcaaatttttttttgtttttgagacagagtgttactctgtcacctaggcgcaatttcagctcactgtagtcttgaccttccactcctaagtgatctacccaccttgcctcctgcatagctgggactacaggggcgtgccaccatgcccagctcatttttgtaattttttttgttttgtttttaagagatggggttttgccgtgttgcccaagttggtctcaaaaccctgggctcaagtgatcccctcaccttggcctcccaaagtgttggtattgcaggcatgtatcactgtatctggccttttctttttttattagagacagggtcttgcagtccaggctggtcttgaactctttggcctcaagtgatcttctgtcttggcctccgaaagccctaggaaacaattcttgtaaatagtatagcaaaaatgtctgctttataaatttttcatttttatagttgttcaagagtacatatgtatttccttttttctttttctcgttcctcattcaaaaaatatggaaaatctaatatacaatatatatgtgtatatagtatatataatatagtatatatatggtgtatagtatatagtgtatatatagtatagtgtgtatatatatgactctgtattgtgttccatcttggcagtacagtgtttgaggcactgtctccgccctcaggatgctggtgaccagggagggagacagtaaacaggcaattacagtagagtgtgataagtgttattgatacgtgcaagaactagaaggtttaaggagtggccaaagaggcttgaaattgggtttggatcatgaagggctttgtaaaccctgttaaaatctgacttttaccttggagcaatggcaagactttggagacttttgagtaaaggaaataacaggagtatatttgtattttacaacaaatggttaagaggaggctatgtgaggaagccaactaggaggctgtggacctgttcccactaaagcctaaaaactaaagtagtgacagtggggatagagacgcgtacagagttaaaagctttaacaggactgggtaattcattctctctctctctctctctctctctctctctctttctctctctctcactgggtaattctctctctctctctctctctctctgtgtgtgtgtgtgtgtgtgtgtgtgtgtacacactttgtggggaaaggacagttagttgatggggaggaagaagactaaagtgactcccagactttcagatggaacccctaggctaggaacagtgctattgggtacagtagccactagccatgtatggccattaaggtatgtctaaactaatttaaataaaataagatttaaaatgcagttattcagttgcactagccacacaaatatagaattacagactcttaaattctgtaaatttcatccagagtactatgaagttataaattcaagagtatgcacagagattcaagcagaaaataatatctggctacatgtgtttaacagcagtatgggactggtggcctctgtattggacagtgcagatatagaacatttctgttacagaaggttcagtgggacagcagtggtctgcagtttttggtttctactttcttttccccgccagaggagagtcagaataacaggtggttttctctcgtctcctaagaactttggttccacagtattctgttgtgtgatattgttacccagggattctgctagataccgttcactactgtcaaccaccatcacccagtcatcaggtataggacgtttctgtaatcagagaaggttcttttggacggcactgagctagagagatggtgatgtcattcatcgagctattgatggttgtggtgggacaacagtagctgccagaaagcgctgtttattagaaatatgagccacatatgtaattaaaaaatttttagtagccacattaaagagtaaaaagaaacaattggattttataacttatttaacacagtatgtccaaaatatgatttacaacacattaaaacatttaaaaattattgatctatttacataattttttttaatttttttgagacaggctcttgctatgttgcccaggctggtctcgaactcctgggctcaagtgatccatccgcttcagcctcccaaagtgctgggattacaggtgtgagccaccatgcccggccacattattttttaatactagctctttgaaatcaattgtatactttcatagtatatcttaattgaaatactaatttttttgttctttcgttattttcaaatgcttagttttatcagaaatatttcatctgtatttatatctgtaaatcataaaatttacagttgaaaaagtagatttatatgcccaggttattccaaacatgcttaaaacttttccagtaatggaattaagtatcggtttttaaagtttcaattcccgtgaaataagaataaaaattcagttcctcggtctcactagccacctttcaagtgctcagcactcagcagctgcatatggctagtggctaccatattggacaacacagctctggaataactgctcactggatggttggaaattcaggtctggagtttaggaaagaggtagcaagacagaagttagaagggaggagctgtgaggaacatggggatttaaaaaaagaagtttgtgactttgagcaaactaattttaaccttggtgctccatttaaaacaaaatcgataaaagcatcttggtgagagtataatagtagatgaatatgcagtatcttgtggtggtaaagatttttttttttttttgagacagagtctctctctgtcgcccaggctggagtgcagcggcactatctcggctcactgcaagctccgcctcccgggttcacgccattctcctgcctcagcctcccgagtagctgggactacaggtgcccgccaccacgcccggctaattttttgtatttttagtagagacagggtttcaccgtgttagccaggatggtcttgatctcctgacctcgtgatccgcccacctcggcctcccaaagtgctgggattacaggcgtgagccaccgcgcccagccaagattttgactttagagtttgatagagctgtgtgatcttgggcaacttactgggcctaatacaatctttctccttgaaaggggtttgctgttgggattaaatgaaatattgtgacaagtgttcactgcatataatacgtatttctttacttttaagttgccatttctttttggtgaggtgtactatcaacttaataattcattctttttagaaaaaaagaaacataatttagttatacatgttaattataagctgcatcccaattcagaaactttaaaatatgaaaaactgtttatcttaaaatattaatattgatgagtgttcattataaactagatactgtgttaaatgctttatatggtgatgtaaaaggtttgatttttataaatatgcaatgtaatatgatatttttgttataaagtttcatttaagtagattctgcaatacaaatctcttctggaaactttaaaatgcatgatggtataactccttttttcagttatttcaggaaccactgaattctgcttgaatctctttggatacttctaaatttatgatttctccaggctaaatctgcagaatttgagtctgtaattctaccttagtgagtacacatataaagaattactatttaaaaaactgccttggtagagtttattcagagaagcgtggtaaccgaggggaggaaaatggacttttccaggtcgaagagaaaggaaatattggctgggtgccatggctcatgcctgtaatcccagcaatttgggaggctgaggtgggcagatcacttgaggtcaggagttcgagaccagcctggccaacatggtaaaaactcatctctactaaaaatacaaaaattagctgggcgtggtggcgggtgcctgtaatcccagctatttgggaagctgaggcaggagaatcgcttgaacccgggaggagaggttgcagtgagccgagatcatgccactgcattccagcctgggtgacagaggaagactctgtctccaaaaaaaaaaaaaagagaaaggaaatatgatttttttttttttttttgacagagagtttcattcttgttgcccaggctgtagtgcaatggcatgatctcatctcactgcaacctccacctcccaggttcaagtgattctcctgcctcagcctcctgagtagctggcattacaggtgtgtaccagcacacctggctaatttttttttattattattagaaatgggtttttaccatgttggccaggctggccttgaactcctgacctcaggtgatccgtccttcttggcctccgaaagtgctgggattaccgaacccggctggctatatgatttttgatgctctgcaaattcttttctgaggtctttttcttaagtctcatcttctggcagtgtgccattccacccgtttcttggagaagaccagaaacatgtttataatgcgtacccatgcgttatatacacagtgtgtactaggaaaccttactgccttatttgtggtagtttcagtagacccactcaggtctgaaataatattaggcattttacatccgtattattggaaataatgaaaaattttatatgtgccaactgcatttggtgatagcaactgcaagtgctgtgttgaaaatgactttgagactaggtacaaaaggatgaagtgttcaccctggaattacagtggctctccttttgtttctgtttaagtcttcttaacatttttcctttttttgttttttgagacaaggtctcactccgtcacccaggctggagtgcagtgttgccatcaccgctcactctcacagcagccttgaccttttgggctcaagctatcctcctacctcagctcccaagtagctgggactacaggcatgcaccaccatgcccggctaattaaaaaaatttttttgtagagacagggtctctccgtattgcccagattggtctcaaactcctaggctcaagcgatctgtctaccttggcctcccaaagtgccaggattacaggtgtgagccaccttgtttggccaacattttcctttttaaataagtagtgtttacctgtttggaaaattttgacaactattaggaaaaaactaggtttcagctcatcttttggctgtgcttatatttgcaaaattgagagtatactgtagattaaaatatattcttgaaggctgggcacagtggctcatgcctgtaatcctagcagtttggaaggtcaagttgggcggatcacctgaggtcagtagttcaagaccagcctggctggttagcctagctaacatggtgaaaccctgtctcccctaaaaatgcaaaaattaactggatatggttgcaaatgcctgtagtcccagctgcttgggaggctgaggcatgagaattgcttgaacccaagaggcagaggttgcaatgagcggagatcaccccactgcactccagcatgggtgacagagtgagactctgaaaaaaaaaaaagcatatcctttttcattattgtgttataaacgttttttaaatggcagacattggtttgtaaatggtttttgtaggcttcatgttaagtcataaagatttcacttaaacatttctcaatgaagtgagtactaataaagctggtgtatctttataaacttttctctacattttggatcatttgagtagattggtttttcctgttcatagaattactggatcaaaagatatgtttttaagacccttactgtaaccattttcaaacttgctgcttctcagatacttttattatttttgggaagaaacaaatacttactgggttcctataatttttcacttaaacccttttaaacttatgatatgcttcagacatgcaaaaagatacagagaatgatgtaattaatatctgtgtatctaccacctagcttaagaaataaacagtcacagacttaaaattcctgtgcagctcttcctgattataaatgtctgtatttaccaacagtgatgtggatatttaatcttttttttttttttttttttgagacagagtcttgctctgtcaacaggctggagtgttgtggcgtgatcttggctccctgcaacctccacctcctgggttcaagctattcttctgcctcagcctcccaagtagctgggactacaggcccagctaattgtatttttagtagagacggggtttcaccatgttggcaaggatggtctcgatctcctgacctcgtggtctgcctgccttggcctcctgaagtgttgggattacaggcgtgagccactgctcccggctgatatttaatcttaaccattaattcaggtctgcgtccaagatcttttggaccagaattcagaatttttttcagatttttagagagatgacatgcatatattatatataagctaacttttcaagtatgttttgggaatggtccctaatttcttcattaaacactttgggattactgacccagtccaggtctggttttactatcatattagttataaatttttggatttttagacatttttgttattcagtcttgtgaatagacgtttgtgaacaggtacatctgttttactttgttcagcttaatcactggtagaatttgttgaactttgtgttgagctgatcacgatgtagtatgagatgtataaaatgcaaggtaacataattttatgtccaaacaatttaatattttaggattttatgaaatcaggttatcagtgagcactagagtcgttggggaaggctacacaacctagaacttgacttgtttcaactaagtggcgcagattgctgttacaactggagaacaactatgattaacaaccttgtgtttatttctaagtatctagcttgacaaaatatttgtcatgatgagaactttgagagaacttataattaacttgattaattgataagaattattaaaaactgcagttaacttgattgtaaactgagttacccttccattaaaaaaaggcgaaatagtaactgacaagtgttaagattgctcgtttacaattgatgtgtcattgctgctccaagcagaggtggcctttcagataggtatgctctgaaacagtgctgctttagccacactgtcgtgtagttttagtctctagtcagtattggagaatcagattaaggttatacaactagatgcgtagtgttagcagacttaatacattttagttacatgctgagtgtagaggcagagaaatctgtgccttcattaacttgtagatttattttctttctgtctttctgtctgtctgtctttgggtctgtctgtcttcctttgtcacccaggctggagtatagtgatgtgatcataggtcgctgcagccttgaactcctgggctcaagctgtcttactgctacagcctcccaagtagctagggctaaagatgtgtgccaccacacctggctaattaaaaaaaaagttttttgtggagacgaggtcttgccgtgttgcccaggctgatctgaagtgatcctttcgccttggcttcccgaagtgttgggattataggcataagccatgtgcctggtgattttttttttttttaaacttcctgctacttacagagatattagcaatctgtctatgcctagcccattaattgctgtgtaaattagtgccgaatggttgtggaggtctttatttaaacctgtagtttataatgagacttaaaaaaatgtaagtttttttttttgtttgtttttgagacagggtttcactctgtttcccatgctgggatgcagtggtgtgttcttggctcactgtagcctctgcctctggagttcaagcaattcttatgactcagcctcctgagtagctgagatcataggcgtgtgccatcatgcctggctaatgttggtatttttggtagagacggggtttcaccatgttgcccaggctggtctcgaactcctgagctcaggagatccacccatcttggcctctcaaagtgttgggattacaggcctgagccaccacaccaggccaaaaaaagtaaagtaatacacactcactataaaaagaaaatggaacagagaagaaaagtatgtaagtaaggaaaaaggtgattccatctggtctttcagaaataggcttttaccgtacaaatcatttctgtgtatatacaaacatacgtgtatatatcctttgtacacaaatgagattgcctcgtaagcattcttctgtaacctggtttttttcccacttcacaatatgtttttgcatgtcagatctatatcttagatatagatatttacttaatttttttttgtttttgtttctttttcctttttttgaaatgaaatctcactgtcacccaggctggagtgcagtggtgcaatctcagctcactgcaacctccgtctcccaggttgaagtgattctcctgcctcagcctcccaagtagctgggatcacaggtgtgcgccaccatgcctggctaatttttgtatttttagtagagatggggtttcaccatgttggctaggctggtcccgaactcctgatctcaagtgatctgccctccttggcctcccaaagtgttgggattacaggcatgacctactgtgccctgcctctttttctttctttttttttttttgagacagtcttgctctgttgcccaggctggagtgcagtggcatgatcttggctcactgcaacctctgcctccggagttcaggcaatcctctcacctgagtaactggtactacaggcacacaccaccttgcccaggtaagttttgtattttggtagagacaggaattcaccatgttgtccaggctggtcttgaactcctgacctcaagtgatctgcccacctcagccttttaaagtgctgggattacaagtatgagccaccatgcctggccattgtttttcttttcttttttttaaattaggattgcctgaaagaaattttttttaaacagcagcattgtcttttgtagttgagagatacataaatttattcaactaatctctttggaaatttaagcggtctccttgctggtacaaacaatgcaataattgaatatcattgcacattatgtccttgaacctgtgaaaatatattttatggagaatattttttaaagtgaaacttctagttcaacaatgtgcacattttaaattttgatagattgtgccaaattgtacctcagtgggattttaaatttttggtttattgttcatcttttcacagggagcctaggatagcagcatatttctcgtccctagtaatatttataaccctttaagaaaatgaacaggatctttaaacatgttgaaatacagtattaaaaatatttgactcgttgatgagcataaccccattacatcaggttgtactagtaattttgagatttatgtgagaatttcacatataattatttaaatagctaatgggtggtatattacatcaggttacatcaggttggactagtaattttgagatttatgtcagaatttcacatataatatttaaatagctaatgggtggtatattacatcaggttggactagtaattttgagatttatgtcagaatttcacatataattatttaaatagctaatgggtggtatattacatcaggttggactagtaattttgagatttatgtcagaatttcacatataattatttaaatagctaatgggtggtatattacatcaggttggactagtgattttgagatttatgtcagaatttcacatataattatttaaatagctaatgggtggtatattacattttctggttcaacttacaaatatagcacatctgtgttagcctagtccattatagttagtttgaagtaaactgctgtgttgctattaaagaatttttttgctttcatttgtcttaatgatatttggtgttcctttggagactcagttcataaagagctattattatttttctaatctatgaggagagtgagagattgctgtctgcagttgcatgttatgctcgtagctatttgtgggaagagtgagaattaaaggctaacatataatcattgtgggtagaagtatttttatttttagacttctgagtataatggatttctgtggggtgaggcgagactggggctgtttttctctcacagtatgtatataaccattgggatcagtgcttttcttttctttttttttttttttttgatttttttggatacactgtttcactctgtcacccaggctggagtgcagtggtgcgatctcgatctcggctcactgcaacctccgcctcctgggttcaggcaattctcctgcctcagcctcccaagtagctgggtttacaggcgtgtaccaccatgcctggctaagttttgtattattagtagagatggggcttcaccatgttagccaggctggtctcaaactcctgacctcaagtgatctgcctgccttggcctcccaaattattgggattataggcgtgagccaccgtgcccggcttcagtgcttttcttagggaaaaatgattctggaatttttgaatatttttatttattatttttttgagatggaatcttgctctgtcacccaggctggagtgcagtggcatgatctcggctcactgcagcctccacatcctgggttcaagtgattctcctgcctcagcctcctgagtagctggggttacaggtatgtgccaccacgcccagctaatttttgtatttttagtagagacggggtttcaccatgctggtcaggctgatctcaaactcctgacctcaggtgatccacccgcctcagcctcccaaagtgctgggattacaggcatgacccaccatgctcgtcctgaatattctttgtgtttttttctgacaggctttgtgatgtgaatagtagtgaattgatagtgaaactgtattgttaataaacacataatttaagataagccagatttctggtaatattcttctcagaattagattttaggaaatttctctaaatgtaaatcctggaaagcttgcagagatttaaatgttgttctggtattttttttttttttttttttgagacggtgtcttgctctgtcacctaggcttggagtacagtggcacagtatctgctcactgcaacctccacctcccgggttcaagcgattctcatgcctcagcctcccaagtagctgggactagaggcgtgcgctatcacaccccgctaatttttgtatttttcgtagagatggagtttcaccatattggccaggctggcctcgagctcctggtctcaggtgatctgcccgcctcagcctcccaaagtgctaggattacaggcgtgagccaccatgcccagcccatctggtatttttaaaaaactcaaaatatagggtacaaaattcatcttaagtgcttggtacatctttagcttggtaggtctctgacatagagtttaatagagatttttttagtattgagaacccatttgtccccacagacatattttctgcgtgtgattgctctgtgtgtatgtgaatttttaatttctttcttagatgagaggcattagtctgtttttgagcttatgccatcttcttggaattaagatttagctacagaagtttgtattcttattaatgcaggaagaacagttttttaaaaaattgaaatcttgcccatttagttaattattttcaggggatagatgacaaaagtaaattgcaagacatgtacagaaggaggttgtcagttcatggaatttgttttatttatttatttttattcagagtctcactctgttgcccaggctggagtgcagtggcatggtctcagctcactgcaacttccacctcccggcttcaagcgattctccaagttgattctcctccctcagcctgtggagctgctgggagtacaggtgtgcgccaccatgcctggctaatttttgtatttttagtagagacggggtttcgccatgttggccaggctggtctcgaactcctgacctcaagtgatccgcctgcctcggcctcccaaagtgctggggttacaggcgtgagccaccacacccagcctaattcataaaatttggatactgtttaaagatagagaaaactttcttaacttgaggaaaatgttaaaaattgctttcattatatttgttttagattacatttagttgcaggttccataaactacattcaagattagtactgctttttaaatgtatatgaactatctaatggtttttacgtggatttaggttaattgtggcgttggcaaacacttactgcctgcttgatttgtattagacactgtgctaggttttggagatggagtaagacattcctttacttttaaggaggtgattaactaaaacaataattacattattttaaaagcccctggttacctcagaggagcacctaaattagactgaggggcatgaaggtttgtgtaggattgtgactgttgaacttagtttggaaaaatgagcagtagttagccagttgatggggcagaagaaggtcatggaaaccagagacagcttggtatttcagggaattgcatagacctgattatggttgtcacgtggagaaggacagtggataagtagtagtttcagagagataggcagggccaaatgatgaaaaatctcatatgcactaccaaggaattcagattaaaaaaaaatattttttgagacaacgtctggctctgtctcccaggctggagtgcagtggcatgatctctgctcactgcaacctccgcctcttgggctgaagttaccttcccacctcagcctcccaagtagttgggattacaggtgtataccacctggcccagctaattttttgtatttttagtagaaacgggattttgccatgttgcccaggccagtcttgaactccttagctcaagtgatcatcctgcctcgggttcccgaagtgctggggttataggtatgagccaccgtgcccagccaagacatttttaaaatgtgagaatacacaagcacacattccattagctgtcagtgggatattatcacatgtcatgtagctctggaaaacactatcatgcacttgtgagagaatcacggtgaaaaaggccaatgacatcatccttttatggaaatagttttgccctcatggacctcctgcaagggggtcttgagcacccctggaatcccttacccatctggagaatcatattagaagatcattatggcactggtgttgagaattgtttagaacctataaaaagaatcacatttatttttgcttttttgagacagggtcttgccatgtcatccacgctgtagtgcagtggaactatcgtggctcgctgtagtgcagtggcactatcatggctcactgtagccatgaactcttgggttcaagcaatcttcctgcctcagcttcctgagtagctgggactgcaggcatgagccactatgctgggctatttttttttttatttttaaattttttttgcagagataggatcttgccgtgttgtccaggctggtcttgaactcctagactcaagcaattctcctgccttgtctcccaaagtgctaggattacaggcatgggccactgtgtcaggccaagaaggacatttcatattgtgatccaatatgcgcactttaaacatcgcagaaaacaagactgtattatctcttgctgctttacaaattacttcaaaacttactggatttaaagaacatctggctggacacagtggctcatgcttgtaaccccagcactttgagagaccaaggcagatggatcgcctgatatcaggagtttgagaccagcctggccaatatggcgaaaccccatctctactaaaaatacagaaattagcagggcctggtggcacatgcctgtaatcccagctacttgggaggctgaggcaggagaatcgcttgaacctgggagacggaggttgcagtgagccaagattgtgctactgcactccagcttgggcaacagagtgagactccttctcaacaaaacaaaacaaaaagaaacaaacatctcagattttatgaagagtatgtattgggtgattctgactcagggtatctagtgaggttgcagtcaagatgttgactgctgagtttacactcatttcaattcttgactgggattggaggatctttgaagctatctcacgtggctgttggcaggagacctcagtttctgaatatgtgactctcttcacagggtagtttgaagtttgagtatcctcacgacatggcagctggattcctgagagagagtgatttgagagagtgacgaagacagaagccccagtgtcttttaagagttagtcatgaaagtacatcattggaagcaagtcattaagtccagtccacactcaaggagaggaaatttagtctccctcttgaagggaggagcattaaataatttatgaacatactttaaaactaccacaaataattgtcaggagaatgaatcttccatgagcttcttatttcttttgtttgagatggagtcctgctctttcacccaggcaggagtgcagtggcgcagtctgggctcactgcagcctccacctcccgggttcaagcgattcttctgcctcagcctcctgagtagctgggattacaggcacatggccaccatgcctggctaatttttgtatttttagtagagacggggtttcaccatgttggccaaactggtctcaaactcctgacctcaagtgatctgcctgtctcagcctcccaaagtgctggggttacaggcatgagccactgcatccagccgagactcttatttcatatacaccctgttgagtgtgccaggaatgcaagcaaggccttgactgttcctaggccaggccatttttcaggattgtgtttgcagcgggccactttgcgggaggaggtaatgtcttccattgggacaaagagcaggcctacttactacttactataaaagtggtggattccggccgggcgcggtggctcatgcctgtaatcccagcactttgggaggccgaggtgggcggtcaggagatcgagaccatcctggctaacatggtgaaaccccgtatctactaaaaatacaaaaaattagccgggcgtggtggcacgcacctgtagtcccagctactcgggaggctgaggcagaagaatggcatgaacccgggaggcggagcttgcagtgagcccagatcgcaccactgcactccagcctgggcgacagaacaagactccgtctcaaaaaaaaaaaaaaaaagtggtggattccctaagcccaatgttccttagctgtgatgcaaacccactgcctgtgtagcatccatctgagcccctccatgtcaccttatgggacttggggataacagggagacagtgcaaacatgttcatgcttgctgcgctgtgagtaataaaagttctttgtgtttgacccaggagactcatgtattctgtcagtatccatgaaatggtcataggctaatgtattaacctgtaagtagggttaaataaaatcctagttccttcacagttctcaacattacttatgtttactttagtgtgatacactgtgaaaataagctatacattttattttctgttctatttatctgtttattttagagatcctatctctattctcctatagataggatcttgctatgttgtccaggctggtcttgaattcctggactcaagcaatcctacttccttggtctcccaaagtgctgggattacaggcacaggctattgtgcctggccaagaagtacattttatattgtgatccagtatgcacatgtgcatgcatatgcacacctgaaacattgcagaaaacaatactgttatctcttgttgcattacaattacttcagaacttactggatttgaaaaacaaacatctcagatttcatgaagagtgtgttgggtgattctggctcagggtatgtagtgattttatttcatttaaaacaaacaagaaaacaagcttggttgcagcttatcaagctgatttcacaacctactattgggtcataattctaagtttgaaaaacactgactggggactgttaccgtttggctgtgtccccagcaatctcatcttgaattgtagttcccataatccctacatgttgtggagggacctggtggtagctgaatcgtggggtcggttaccccatgctgttctgatagtgagtgctcacgagatcgattttattttttcttttttgagacagagtcttgctctgtcacccaggcttgagtgcagtggcataatcttgggtcactgaaacctttgcctcctgggttcaagtgagcacgtctgggtaatatttgtatttttagtagagatagggtttcaccatgttggccaggctggtcttgaactcctgacctcaagtgatccactgaccttggcctcccaaagtgttgggattacaggcgttagccaccgcgcccagcctagatctgatggttttgtaaggggctcttccccctttgcttggcacttcttcctgccgccatgtgaagaaggatgtgtttgcttccccttctgccatgattgtaagcttcttgaggcctccccagccctgcagaactgtgagtcaattaaacctctttcttttataaattacccagtcttatgggtagttctacatagagcttgagaatggactaatacaggactctgaggctagaggcaggcagtcaggttagaaagttgttttaattcaggtaggataggatggcataaaccaaggtaataattgtgggaatggaggaagaggatcaatttaagaggtacctagaaatcaaagcaacaggaattgtattgttttgataatatgtgtgtatatggagtatgaagattttgggaggactctcaggctctggcttgagcagctgatgttattcatgtgaatagatgttgtccactaccatgttctttttttgattttttttttttcccctgcagcagcaggtttggttttggaatggggagaccttgatacggagttcagtttgggggcatggtgtatttgaggtgcatgtgaggagtataagtgaagatgtccagaagtgggatacatagttttgattctcaaaggagaagtaaaaaagtactggagaagtagtgaatttggagtctttgttgtacatatgttattttaagctggtggaggcagggagaaaggatttcttaaggatgatattgtagtgtgagaataacatagggatgaagatcagaaacatttaagggaggaacgaacaaagaaggaggagggttagaagaaaagagcatatgatataaagaaaccaagagaggagagtgtcaaaaaattgggagtgcttaagaaacaagatgtattatagacagaagttaaaaaggcattagagaggaaaagtgttcattaactaaggtttctctggagaagccagagggaatggggactaaagtaccctgtggaaggattagctgtagcccacttccatcagaatagaggaagttaaggatggttgttgctgtcaatgaacatgtggagagagaaagttgagatagttcctgtttgatttctttgtttctctcttatgtaggagatgagatacgtaaatttgatagggctgctgtaagaaagtaccatcagctgggcacggtggctcacgcctgtaatcccagtactttgggaggctgaggcaggcgaatccgttgggcccaggagttcgagaccagactgggcaacatggtgaaaccccacctctaccaaaaatacaaaaattagctgggtgtgctgatgctcgcctgtagtctcagctactcgggtggctgaggtgggagaagtgcttgagcctgggaggttgaggccacggtgagctgtgattgtaccactgcactccagcctgggtgacagaggagaccttgtctcaacaaacaaaaacacaaaacatctcccgcctctccaccccgctccccccacaggtttgaaaccacctgcctgttatttcaaaccacctgtgtgttcacatttttgaggacttttaacctgtttgaccagaatagatactgtctttagaatctcatttttgacaatatgatttacttggtactgttttcaatgaagaaacacttataagaatcaatttacataacaatggattttgggaaaatattgtttaatatgctgaagcctgttgttacttgacctaagccaatgctttgaaatgatgctaggaaatcagagagatctagtttagatctatattgtctttgaaagaagtctataaagttgatagctatagtttagtgggttctgcatccacagctcaaaccacctgtggaccaaaaatatttgggaaagaatcttaaagtcaccttgaaaaaaaaagtggaaaaaaaaaaaaaaagaaaatacttgggaaaaaataatacaacatggaaaaataatacaaataaaaaacacaataagtataacaacgatttacatagcatctacattttattaagtattataagtaatttagagatgatttaaagtatgctggaggatatccataggttttatgcaattactgtgtcattttgaatcagggacttgagcatcctgggatttttgttgtctggggcagtcttggatatctggatacgttctactggagccagtccccagcagataccaagggacaactgcctgtggttttaaaatttgttttagttatacttgtagagtatgaacatgttttcttttttgaaaaaaaaattcaggtgctttatggtagtttgagtgtaaagctttctaagttgagctaaagcctccacaaacatttttcccctttataacacaagtttccttccctctaattatcgctgtttcaaaattggcatttcccgtgtaggaattctttacatactctgtttacagatcattatacttatgttcactgtatttttcacctagcttttggtttatcttttaattttatttacagcattttttggtataatactttgtcattttgacataattaagtgtgttggttgtttttctttatggtttttgcttctggttttttatttaagaagccttttcctaactcaagttcacaaggatattcttcaaaattttcttctagtacttttaatggcttaaaaaatttatatctttaatgtatatggaatttattttggtgtactatgtgaagacgagtatacgttatgtttctcaaagagcaacaagtatttaaacttcatttattgagtgatttttcatttcctcactgtattagtctgttctcatgttgctaatacagacatacccgagactaggtaatttaaaaaggaaagtttttttttttttttttttttgagacggagtctcgctcttgtcacccaggctggagtgcagtggcgcgatctcggctcactgcaatgtctgccgcctgggttcaagcttcttatgcctcagcctcctgagtggctgggattacaggcacctgccaccatgcttggttaatttttgtacttttagtgagattgggttttgccgtgttggtcaggctggtctcgaactcttgatgtcaggtgatccacccgccttggtctcccaaattgctggaattacagatgtaagccactgcaccctgccaggaaagaggtttaatggactctcagttccacatggctggggagacctcacaatcatggcagaaggcgaatgaggagcaaaattatgtcttacatggcgacaggcaagagaacttgtgcaggggaactccaatttataaaactatcagatcccatgagacgcactcactaccaccagaacagtagaggggaaactgcgcccatgattcagttaagtacacctggccccacccttgatacatgaagatgattgcaattcaaggtgagatttgagtggggacacagccaaaccatatcactcactgtttggaaacgttacttttaacatatattaaattcccatatataatttagaccctgttcttgggctagtactatacagttttcgttattatagttttacaaggctacaatactttgtaagaaaccttgcaggtcagatgtggttttgttgtcaggaattttttccagtaatacttagtggacattatgtagtatccagtaatcacacacattgttttcttaatgaaatatatgaagtcacactatgtgggatacatataaacagtaagtaagctcagatcaggtcaaggtttgctgctagatgagttaaaaggaaaatcttattttcagaggtttttggatttttgcagtacaaatgaagaattatggatttgtaatttatgttgctgttgagggctgtcttccttccttgttcatctattttaaattgtttggttactcttgtatctttactctccatttgaattttagagtcagcttgttgagttacttgaaaaatccttcaacacctgtgaaaggaagggatctatagctggttagcaaaatcctgtagagatttttcactgggattgtgctaagtagttggggaagaactaaatcttagcagtgtttgtcttctcatccatgaacacagataactttgtttaggtgttctttcatgtctttcagtaaaatgttatagtttttttcccccaaaattcttgcacatttctgttgatttacatcaaagtacttttatggttttgttgctgttgtgaatgggatttaaaatttcctttaaattaaaaactgcattttctagttgttactactgatgtatacattgatacttatatattgatattgagtttgaccagtttgttgagttctgttattctaataacttgtcagttgattatcttgggttttcagttagcaagtcagatattcagacattgagtttaatcttttccttgtcaatctttatacttcttgtttttttttctttttcttttttgtagacagggtcttgctatgtatcccaggttggtcttgaactcctggcctcaagcgatcttcctaccttggcctcccagagcgctgggattataggcatgagccattgcacttggcactttttttgtttgttttccagttgcatggtatgttttcagcgttcagttttgagacatctaaaatatctctaaaatattgtttactatgagtacattatgctgtaatcacattctgaatgcgtgagtacatacatggtagaagggctagatcttctttaagtgggggtaatggaaagtctctgagaagggaaatatttattattggaggatttaatgtgtgatcttttcattacagatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccaggtaagttctacgtgtgtttacctttattggctgaattcatgtatataaatgaaatagcctttttttcccctttcctagatttttcccttcgtagtatatgtatcttcctttttcctattgattttactgttttgtgtcctccatttctcagccctttccaaatttggtcctgtaccctgttttcttctagctgcccatgtctccttgctcccattcttgcttggttcttttctctggtttctctttctcttcgtgtctttcctttcagcatatgttatcttttttttttttttccaattcttctgagagtataattttgccacactctctaatatctattaccaaatgtattttagagtaggtaacttaaatgtaaggtataccattaagatttgtcataatgtcaaaaagtcattcttaaaaacaaaacaaaatgactatcacaggataagtcagtgttgtcagctgagaacagaaattacttttaaaaagttaatgttggccgggtgcaatggctcacacctgtaatcccagcacttgggaggccgaggtgggcggatcattgaggtcaggagttcgagaccagcctggcgacgtggtgaaaccctgactctactaaaaatacaaaaattagccaggtgtgatggcgtgtgcctgtaatcccagcttctaaggaggctgaggcaggagaatcacgtaaacctgggaggcggaggttgcagtgagctgagatcccgccactgcactccagtctggagtgagactctgtctcaaaaaagaaaaaaaagttaatgttgatgatgtatttattaagtacaaacaataagtacctgttctttttgttgccattcatggaagtttaacttcaggatgcttttgtagcttttcgttctgtaattctttacatttaaggtggaggaaaggcaacttggtgtgattgtttacttgtagaaaataaatgagatgactgggcattataattatgggctttgcaatttgagagctaagtgctgtcacattagctacaggaaatattcacttatttttctgtgctcctccaggttatagttgatgtttgatgatagccatgccacattcagtgaggaagctgatgactccaaagatgtgaacaaatcatattcaggctctactagttaaaatgttaaacatactttttttttttttttttttttgagacggagtcttgctctgtctcccaggctgaagtacagtgacgcaatctcagttcgctgcaacctccacctcccaggttcaagtgattctcctgtctcagcctcctgagtagctgggattacaggtgcccgccaccacgcctggctaatatttgtatttttagtagagacggggtttcaccgtgttggccaggctggtctcaaactcctgacctcaggtggtccacctgccttggcctcccgaagtgctgggattataggcgcgagccaccgccaggcccatactttttgtttaaaagacttttagaatttttctcttttcacatttttttcccccatggcccaagttgtctgtacttttagaagttttcttaaacttgcaagcttgagtttttttcctccttaaaaaagctgtcttatactcttaaaggagaatatgtaattagctacctcattgttggtattacactttatttttggattaggttaataaaaattataaagaaagcaactgatatcaatttctgcagtgttcttaaatgatactaagaagtaaagaagcaatcagaaatgatctgtgtctctgatgaagaagtcatctgccacacaaagatgtttaggtcaatgatggacctcatgtatcactgtggtcccataagattacaatatagtgttagccaggtgtggtagctcgcacctgtactcccagcactttgtgaggctgagagggtgcggattggttaaggccaggagtttgagactagcctgggcaaaatggtgaaaccctgtctttgcaaaaaaatagaaaaaaaattagcagggttttgtgatggacgcctgtactacttgggagactgaggcaggaggatcacctgagcctgggaggtcgaggccacagtcagccgagattgggccactgtactccagcctgggtgagagtgagaccctgtctctaaaaacaaaacaaaaaacaaagattataatacagtgttttcactgtatcttttctatgcttagatgtgtttagatacacagatatttaccattgtgttacagttgcctacagtattcaatacagtaacatgctgtacaggtttgtagcctagaagcagtaggctatatcctatatcctaggtgtgtggtaggccgtaccaggtggatttgtataagtccacttgatgatctttgcacagtgatgaaatcgcctttctcagaacatatctctgtcattaagcaacatatgactgtaaatctaatttaagatttcggttgattgtcttaccattcttactattatgcagtccagatattcagatctactgttttggctacttgaagatctctagttacattacattttgtatgttaaagctccagacacattttcagctataaaaatagctcaatttttctgttcataaatataaaacagaaaagcatagatatgaaagcaaaatatattccagatcctcccatctactgacaactttgctattccactgttaacattttgacatttctctttactgaaatatctctatgcatatacacgtaacggatttacctgaatggaatactgttggtattatgctgtgaccttcttttagctaacaacatttctactgtatattagaggcctctaatatatatctaaatcgttatttttaatgcctcctaccattctattgtatctattctagttaatatcacagggccaaaattcttcagatttacttggtagtacaacgcaaattaaaaaccttgaattcatttgaatcagatttctaagtaattagaaattatgataattttattctttctcagatacattataacttcaaactactttgcttttactttttaatcaattattaagttgtcactactcaaaatttgaatgttttaatatacttaaatctctttcttagagacttagcttctttaaagaagagaaattgtcctttaaaaaatattccttagaaagttctttgagtttgagtcattaagactttaagaatgtgtaaagaaagaaaaaaagctaaaatagaccccactgatggggtctaaaattaaggacagggttcttaaatgctggctcagaaacatcagcatcaacaggcatatttggttaaaacatagattgccaggcctcccttcataccagctaagtacaatctctggagatggggtccaggaacttatgtttcgaacaagcttctctggtggttctgatgagaaaccactcttgggatctttagaatttagtaaatctaatctaattcttttttttttttttttgagatggagtctcgctctgtagcccaggctggagtgcagcgatgcgatcttggctcactgcaacctctgcctcctgggtcctggttcaagcagttctcctgcctcagcctccttagtagctgggattacaggtgccccccaccacacctggctaatttttgtattttagtaaagatgaggtttcaccatgttggccaggctggtcttgaactcctgacctcgtgatccgcctgccttggcctcccaaagtgctgggattataggcaggagccactgcgccgggtgtaaatctaagtcttaaacttgtctgttgcctgtttgtcaatttgtgatggttctgttgtggcacttttgagctcaaccatgaaaggaaaagaaacaagggaccatttgctcagtgtgtctcatcctttattctaccactttatatctcagggatgtgacctactcttgttcgtaatgatcattaactgtgacagggaccctcagtggatggggcatgtgtaggggaaaagggtgtttaaaattttagatatgtttagttacaaagagccctccaggtgattttgatgtctcttcaccttgtgaatcattgatgcaccagataaatgttcaaatgatatatgacagcagagcagagaagtacattttcttcagttgacatttttgagttgtcagtacaatactgactttagtttttaatttgcattgcactaccaagtaaattagttgaatttgtcagttgaagtacaacaccaaaaagaataattcctaaatataaaatgatagtacattctcaggtttttttttttaattgttgttgttttgagacagagcctctctatgtcacccaggctggagtgcagtggcgtaaccttggctcactgcaacctccatctccagggttcaagtgactctcctgtctcagcctctggagtagctgggattacaggtgtgtgccaccatgcctggctaattttttttttttttgaaacaagagtctcgctctgttgctcaggctggagtgtggtggcgtgatctcggctcactgcaagctccacctcccgggttaatgccattctcctgcctcagcctcctgagtagctgggactacaggcgcctgccaccacgcccagctaattttttgtattttcagtagagatggagtttcactgtgttagccaggatggtctcaatttcctgacctcatgatccgcccacctcagcctcccaaagtgctgggattataggtatgagccaccgtgcctggccaattttttgtatttttagtagagacgagtttcaccacattgaccagactggtcttgaactctcaacctcaggtaatccacctgccttggcctcccaaagtgttgggatcacagtcatgagccaccgcacccagcctttttttttttttgagctggagtctcagtgttgcccaggctggagcgcaatggcacaatctcggcttactggaagctctgcctcccgggttcaagcgattcttctgcctcaccctcccgagtggccaggattacaggcgtgtgccaccatgcccggctaatttttgtatttttttttttgagacggagtcttgctctgtcgccagctggagtgcagtgacacgatctcagctcactgcaacctccgcctcctgagttcaagcgattctcctgcctcagcctcccaagtagctgggatttcaggcatgtgccaccacgcctggctaattttttgtattttagtagagacgggattttgccattttggccaggctggtctcgaactcctgacctcaggtgatctgcccgcctcaacctcccaaagtgttgggattacaggcatgagtcaccatgcccagcttaaattctgtttttatagtttggtattgaattgtaaatatcaggagaaaaaaatgagtttgctttctttagttttgtggttaagtatcaatataacctaggtcttggaaactgtatctgtatttttaggggttgtattgggttctttttctttttcttggtaaaaatgagattggtaaatttggagtatgtaatggtgtatactagtgcccaaatatgagattctttatatgtatttagataattatcatagtgtatcatatttgaatattatacaatttcaaatgtattgttaataaaaaatcacagtttgatttaattgaaaagtggctgagacataattttttattataagaaatattgtgagctgggtatggtaatatatgcatgtagtcttagctactcaggaggctgaggcaggagaatccctcgagtccaggagtttgagtccagcctgggcaacatagtgagaccttgtctcttaaaaataaataaaaaaataaataaaaatttaaaataattaagaaatattgtggaaaaattgcatgtgaataaacacttctttttaaaggctctacttttcaagaatggattgacagtatatgtgtgtgtcagattatacgtgtgtgtgtgtatcaaatttagagtagatttgaagttactggatttatcaccattatacctggaattagctagtcaccgttataccttgttgatgatgctgaaactatgcccctcactaagatagtttttattatgaagtgactcagaaatgtcaattttaatgaaaaaagttattggcgtacttgttcattttggaataattgaagcaattgtttatgcctgtacttcagaagctgtgtggaaaatacgtaatatcctttctaagtatcagtctgcattcaaagacaaaatatttgaatcttctgaatacttcagttccagtgaaacagtccacaggattttcatgccaaaaaacccatatgtgctgaagaatggtgaacaccgccttatctagattccaccccttgccctaattaaacaccagtgctggcagcgatgcattctccgtatacccactgtaattactacacaatcctaaaattgtataactttggtccaaaaaacgaagggtgcaattttaaagtaaagtgaaacactgcaatgagatacagagacagagaatgctaattaatagattatagtcagccagcagtggggcctaattaaactctgcattcattataccctccatagccctcagaggtcaggcatcttccacttgataaagaagattggtttaataggatttacagtaattaaatggtttccccatttcagtttgagactggggatttaggtccattctaaatattggatctgattggaccatagagatcttgttctaggatcctattagatgtaaagacgcatttgcttagaattacttgatatgtgtggttctttattatggagttcttttagaagatgtttctgatataaatactcagcaatttttatgtctcatccttttgttactgaactttcaaatactgctggttggagagttagaatagtatgtaacagggaaggctttttctttttcttttttaaaattgggagtcaggaaggtttttggtgtatgtttgacaaagaatgaaaatctagctgtgagcttggtggaactgcagagctactaagactttggatggggccgggctcagtggctcatgcctataatcccagcactttgggaggctgaggtgggcggatcacgaggtcaggagatcgagaccatcctggctaacacggtgaaaccccgtctctactaaaaatacaaaaaattagctgagtgtggtggcgggcacctgtagtcccagctactcgggaggctgaggcaggagaatggcgtgaacccgagaggcggagcttgcagtgagctgagatcgcaccactgcactccagcctgggagacagagcatgactccgtctcagaaaaaaaaaaatactttggatgattttttttttaaattctaaacagcatttaaccagattatcatcatactttttaaattatgccttgaaataattctgtatgttaaatttagttggaagcttattttaaaaatgtttatttaaagcactgtcattgaaatatttcatgaacaaaatactgtttaatattataggacggcaggtgaatttaatgttttttgccttgtgtgttgtgtttcttctctttttggagtctgatttttatgttgctcatttacttaggaatcgagaatttctagttcagaactgcaaaaagataaccttgtgtaattctttgtcatttttttttctcattatttggagacttttgactattaacatttatataattttaggttgtatcttgatttgccgcatgataaaagccattattatttgccattaaataaactttttttttttttttttgagacagagttttgctcttgttgcccagcctggagtgcaatggtgcgatctcggctcagtgcagcctccacctcccaggttcaagtgattctcctgcctcagcctcctgagtagctggaactgcaggtgcacgccaccacgcccggctaattttttgtatttttagtagagatggtgtttcgccatgttgggcaggctggtctcaaactcctggcctcaggtgatctgtcaacctcggcctcccaaagtgttgggattacaggtgtgagccactgctcctggccttaaataaactttgtcatgaggttgctagttgtttcactgtcatttaaagtctgatcttaaaatttgggatctatgtcttagattattgttttaattttctttttgataattctgttttaacaaggagatgtagataaattggtatccttgtttattgcccagataagtttaatcttttttgttgtttcagaaggggaatgtgttaaaggcactatgcagagtgccatgagaaaatgaaatcaaatgtaaaatggataatgttccttttggggagttaacaatcatttcgagaagcaaaatttgtacatgtatggcttacagaaatttgaactatgcatttatcaggtcttgatcataggtgaaggtatttaaatcagtgtgggaaatttgcttcttttacagttggtaagtttgcttatctggaatgtagtgaagtatgaaaaataattaagcagagctaataaaaatgttgcacaaatatgagatagggcttatatgaagaaataagggcagagtttgccagataattgcagtttctctctcactttttattttcctctgtctttttggatctcatagtgcagtgtagtgtgtgatctcatctcagtgaaataaaattgtttttagagatttgctaatttacagcaaatttgcagatagcatcttaaatataatttgggggtcctctttattgtgcaaaagaaatcagaaaatgggtttagtttttagttacattaatgttaatcagtggaggtcatagtttcattttttaacatttaaaaccgtaccaccctctggaacttgccatctgttatgagtgcactgttatgcccagaagagtataggaggtgcttagaaaccatactttataagaaatggctgaaggaactcaagaagagaagacttgcaacattttaattatactcttaagtatttggtggacagccatgttgaaggagatttttccttttttctttctttgttagtattgtttttggagaacaaacactggaaaaatgagcacaaatattaaggttttaaattttggctgcaaggaggaatggatttttgaaaaaagctatatccggcctggcgcagtggctcacgtttgtaagcccagcactttgggaggccgaggcgggcagatcatgaggtcaggagatccagagcatcctggctaacatggtgaaaccctgtctctactaaaaatgcaaaaaattagctgggcttggtggcgggcacctatagtcccagctactcgggaggctgaggcaggagaatagcgtgaacccgggaggcggctcttgcagtgagcccgagattgcgccactgcactccagcctgggcgacagagcaagactccgtctcaaaaaaaaaaaaagaaaaagaaaaaaactatttccatttgatgaaagaacagtttcacaaagtaatgcttcatcatcactagaagtggtcactgggaggtcagattgccttctgacagctgcgtgggtgccctaagtcattgaactcttcacaacgcccaagggggtatggcatcaagtggtactttgtggagaaacatttagggagtttaccccatcctcccaggtccttttgtcctttttctccctccccatctcctttccttcttttatgacaattttgttgagatataattgaattcaccctttaaagtatagttttttctttttttttttgagacggagtctcgctctgttgcccaggctggagtgcagtggtgggatctcggctcactgcaacctccgcctcccaggttcaagcagttctctgcctcagcctcccaagcagctgggattacaggcacacgccaccatgccctgctaatttttgtatttttagtagagacagggtttcaccatcttggccagactggtcttgaattcctgacctggtgatctacctgcttcggcctcccaaagtgctaagattacaggcgtgagccactgtgcccagccttttctttcctaatctgatttactcaatgaagattttgaagaaagtaatagtaagttgccctagggagttcttgaacgagggcataaatgatgtaataaaaaatactgttcaggagcagcttttactgctgtcagcagagtggattgaagaaaaggtggggaaaggaaatgagtttcttgtagaagacctggattaaacagggtaataggaatggagaagaaggtgcacatccatgagattttcaaagaaatatttggatataggcagggaacgatggctcgtgcctgtagtcccagcactttgggaggccaaggtgggcaggttacttgagcccaggagttcaagaccagcctcggcaaaatagtgagaccccatctcttaaaaaacaaaattagggccaggcacggtggctcacgcctgtaatcccagcactttgggaggccgaggctggcggatcacgaggtcaggagatcgagaccatcctggctaacatggtgaaaccctgtctctactaaaaatacaaaaaaattagctgggcgtggtggtgggcgcctgtagtcccagctactcgggaggctgaggcaggagaatggcgtgaacccgggaggcggagtttgcagtcagccgaaatcgcaccactgcactccagccctgggtgacagagcgagacgttgtctcaaaaaaaaaaaaaaataaaaataaataaataaataaataaaaaattagctggcatggtggtatgtgcctgtagccccagctacttgggaggctagggcaggaggatagtttgaccgcaggaggtggaagctgcagtgagctgtgagtgcactactgcacttccacctgggtgacagagcaagagtctgtcaaaaaaaaaaagaaagaaaagaaatatttggatatagacggcaagagagaagaatacagtgaaccatggtattgagattggggaactcttttccctacgattaacaacggaaatggattagaaagtggaactaaatttagagtaaggaatgatgaatttggttttaattatttgaataaaagtttttcataagaatttggagataagagactaatgactgtgacctcaggtacatgcatatagatgttataaaggtgtgcttgttaatgttggggaactcacttttctagttaattcagtatcagctacatgcctctgcttatgggagtaagaagtggagagggagaagccattagaagatacagttttatatatatgttctcatccagctcgatttgtgttttggttctctgtctttattgtggtatttttgtttgacagcagataccttgagtgattctctcaattcctgaaagttattatttattaaagttaatactgatttatgatttttttacaaacttctactattagatgtcccttattttgttttagttaacaacaagtttattggagatcatgtacctacctctgttgtgataaattaggagtgactttgggaaaaagagaaatattacaaaaaatgtgctttcagtgaggaaatgataaattttgtttttgaaaatgttcttttcttcccttatggacaagattagaaatgcttttatgaactgtttttgtgctaccatacacatttctaaaaatactcatttttctttttctttttttcttttttctttttttttttttttgagacggagtctcgctctgtcaaccaggctggagtgcagtggcgcaatactccgcctcccgagttcatgtcattctcctgcctcagcctcccgagtagctgagactacaggcacccaccaccatgcccggctaattttttgtatttttagtggagacgggatttcaccgtgttagccgggatggtctccatctcctgacctcgtgatccgcccacctaggcctcccaaagtgctgggtttacaggcgtgagccaccgtgcccggcctaaaaatactcatttttctttccagatttggaaagttagtctttaacgtagatcttttcctttgatttttccatatattaacaatacttactgaaccctttccccctttattttgccagtcttttctacgtaataggctttccttcctaatactggattgcagtgacacttgcttaatttcatatgtggtgactgtataggccgagaaagtgagatagttcagccttaatgtacacagtgtaccatctcttaccggtggctggtagcttatgtactttcagagaatgtggtatgcaaagatctgtgtagctttgaagtcatcctgagataactgctctgatcttaaatgatcctcagatacttgaagagtcctctgtagcagtaattcttaaacttgttggccacaggacctctgtatattgtaaaaattattaaggaccccaagcagcttttgtttatgtaggttatatctaccaatatttgtcatattagatactaaaataaaaaaataatatttattagtacatttagaaacaataaacctaataaatgttatcataagtaacgttttaaaatgaaaaacagttttgcaagtctctctttctttttttttttttttgagacagagcctttgcactgtttcctagactggagtgcagtggcatgatcttggctcactgcagcctccgcctcccgggttcaagtgattctcctgcctcagcctcccaagtaggtgggactacaggcatctgccaccatgcctggctacttttgtatttttagtagagacagggttttgccatgttggccaggctggtctggaactcctgacctcaggtgatccacctgcctcagcctcccaaagtgctgggattacaggcgtgagccaccgtacccagcctagttttgcatgtctctctaaggaaaggaggactacaaatctaaaggccttatgtgggtcttctgcctcttgtaagaggctgccactagagtgctcactaggtcactctttagctgagatctctgttacttgttcagtattgtaataaaatattatgacctgtgacatcaacatggattaacaagtatctggcttcttggtcaagggttaggaagttacactgttctttagtaacagtgagcaatgggaaaatgctgtgagtaatggtgaggaatggtaactttgttgatttgttgttgatagcatgtatttcttgacccttagagaggttctttgggtgggctgtcttaaggaagcccttatattgtagttggctaaccaacaggcctgcgccatcacacccagctaatttttgtatttttagtagagacggggtgttgccatggtggccaggctggtctcaatctccagacctcagatgatccacccgccttggcctcccaaagtgctggcattacaggtgtgagccactgcatctggcctaccagtactagagtctggctctgttgcccaggctggagtgtgcagtggtgtgatctccgctcattgcacgctccgcttcccaggttcacgccattctcctgcctcagcctcccgagtagctgggactacaggcacctaccaccgcgcccagctatttttttgtatttttagtagagacggggtttcaccgtgttagctaggatggtcttaacctccagacctggtgatctgcccgcctcagcttcccgaagtgctgggattacagatgtgagccattgcgcccggcctgttttttttttttttttttctttttttgaaatggagtttagctctgttgcccagatggagtgcagtgacacgatcttggctcactgtaacctccacctcccgggttcaaccggttctcttgcttcagcctccagagtagctgggattacaggcacctgccactatgctcacctaattttggaatttttagtagagacagggtttcactatgccaggtctcaaactcctgaacccaagtgatccacccaccttggcctcccaaagtgctgggattacaggtgtgagccaccgcactcggcctagtatttttaatttttttttttttaaacccagttgcattgtatttatgtgataaacctacagcatttgttgtatttcaaagaagcatttttgggaactaagtttgttttataggacttaaaatttgaaaaattgggagaatacattcaaaaaatgttcttttgattatctttcatggatttgatagcctgcataataagtaatttcttcttttcacatgactcctcttcctgggcataggaacttaaagtaggtactacattcttaggagagaagcatattgtaatgagtgtttccagtctttcctgtcttgtaattttaggagggtctatttcttatttttctatgaaaacatgttatctatggtacagagtatcttctttttctttctttttcttttcttttcttttcttttttttttttttagacagagccttgctctctcgcccaggctggagtgcagtggcgcgatcttggctgattgcaacctttgcctcccgggtctaagcgattctcctacctcagtctcccaagtagcagggactacagacgcctgctaccacgcctggctaatttttgtattttttagtagagacagggtttcaccatattggtcaggctggtctcgaactcctgaccttgtgatctgcctgccttggcctcccaaagtgctgagattacaggcatgagccactgcgcccggcctgtacagagtattttcaagagatgaagcaggtaaaaggttatttacttaaatggtagcagataaatttttggatttctcttggtatttctgatgaaagatacttattttaaagggatagtgtattgggtctcaattgttggaaagttgtgggaacactggctgttagaataactgggggcagaaggtgtttctaggatttagggtggagaggtcttaaagttaccacattcccctcactgcttaggacaggtctgcatactgaaaagctttccctcataccatatgattttcatatgtcttgctaggaatttgataggtgaaaaaaatctgcttatagtcatttgagccaagatcctataactaaataaatgtgtgtaagtgcattagcattgtttgactgaggacgaagttgatagaagattatacttcgttttgtttgtaactttacctagaacttttgccattttggaaaagcacttcaacagcaacattgcattgttgctaatgctactgtctctttagcttctgtttgcatagtcttttggtgtagttgtgccctggcatttacatgttaacatacatactattttattataaattctttcttttcatttttccttcatacagcattatataatttttttttgaaaccgtatgtgggagtgggcttattatctgtgcatttcaggatagtgaagggcatatttacaaaatgtttgttataaaatgggagagtattaagtctgataagcctgaaattcactggtgtcatagatggaacactgaatcaggagagctgcattctagttctgatcctggctttgccaggtgtgtagccatggcagtatttaagcgttttgaatgccagtttcctcatctttaaaacccatagagttggactaggtgatctttagagtctttcttctgaaattacttgattttgtttttgtcagttatcctagtggaattctctaagagtctgttcactttgatcataatgcccaaattcaaaactgattcatatgaccaagttgagtgcttctgggaaggagaaatacatgactaatgaagttcttttcaaggtagatgggagaaaatcagtgtttacatctaaagggcaaagagccttcatgtgaatttcatcagttgacaaatggggatcataatacttgtattgttgttggaatatttaagtgagattaaagaagataatatttataaattatggacaagactacctgacataataggtatgcagataaaagttgaattaaaattaagtcaaacatttcttaaatacaaatacattttataatatattttgaagtatgaaatatacctttcatgatctgctaccagaggcaaacagtagcatgggacctataaaatttttttagaaagtgggtcacagtggataataagtttcatttggataactaatcactaccagcccagccttaatattcctgtaggagttatcaggaactttgagtagagtaattagctctcaggattttcagttacagtcatattcattatttaacatttttatttccacaatgactcatccatgaattatggagtgctttcccaaaaggaatgtagtattgctggaaatgaattttttattgctctattttctttctttggtaaggggttccttgttggttagttgggcccaaaactctccacaaataatttaaaatacgtgcttttgtatgaagatgacttaacaaggcagtggagatttctcttgaatgggcaacatagaatgcttaaattttcttattctgcttattttaaattattaatttttgtactgtggtcctgtactgtgctttttaaattcttacatgataagtgtatgtcactaaaaggtatactttgctcacaatttccctattatttactccactgacattaaaattgtagcattacatctgaggttccctttggtttttatgtatcatttgctgttgtatcctttaaaaaatagtgtaatagatttgtcagtgaaaatgatgtcttactgtgatgctgttatcaaaggcatctctgagtacctatgatagagaactagtgaaggggttaatatctattgtagatatagatgctaatatatctagactcttatagatgctagtaattattatagaacatttatagataccatcctagatgctttcatatacattgcttctaatccttactaacagttctgtaggtaagcaatgttgtcctcatttataggtgaggaaattgaaaattaagagaggaatttgttcaggtttcacatctagcaagtgacagatattggtccgtctggctacaaagccaaatgtcattgtgtttttgactaaggacaaatgaatgaagtgtacatactagtttaaaatatttattgaaaaattaatattcagtcatttattaaatgtaaaagatggcattaaaattcctctgtgttttgttggaggaggaaatacaagaataggtgtatcataggatccaaaggctcctgagaaggggttaacattgagagaaggggtagagaaaagagataataggtgatcagttgagaagatgataaatataatttgattactttaaataatcagtcaacatcagcaggtgtaaatgacatacatcagtacttttcttgttttgattaggcaggaagcagtagagtaatgattcccagacttgcattttgcacactagcaaaataaaatataaataacagaaaaaaagtgggggagactggcataggattgtcaaataaaaacaattaaaaagtgatacatgactacatagtattactgttgttttataaggggaaggtcaatctaacaccaaaggaattgtgcatcattccacaataagagacagttctttcaagaaaatacagattttaactttgtagtgacagttttattaaggcaacttggtcatggactggctttgagaaacattagtttataatagggaacaccacattatagccaaatccttcctacaggagttgtacatcctataagcaaagaatggcttttacatttttaaatgattaaaaaattaatatattgtgatatgtgaaaattatatgaaattcaaaattcagtgtgcataaataaagttttattgggacacagctatgtttatttttgtattatatatggctgctttcacaccagtggtagatagagtagttgtgatagagtctatatgacttactagacctgaaatacagtgtctactctctggccttttacaaagtttttcaatactttgtttggataacagagtaaataataatagctaacacttgtgtagtgtttactaagaaacaggccctgttttatgtgctctatgttattaaccatcataacaattttatgaggtaggtactgtttattgaagtggaaactgaggctgagagtaagttgcccaaggtcacatggctgttaggtggcagaggcagccttctgcctagatggtgccactccacggtacatgcttcatcactgcacttggctagcagagaaggaaatcagagacttcaggatgtgacgcacccttcacatttgccgtagttgttttaggaaaagaggaaagtagccttattctatagttgcctgaagtgttatcactgagtagttgaatgaagaattcagcattaattacttcatgatgcatgaacatttggtgtatttttatgtgacccagtggattttccccagaggtctgttgattgaaatgtcctacttattgatgtcctacttattgaacttttgaacaaataaatctgttatttctgaactattgagttcatttttggtataattagaataataaattacactattaacttggtggagggtaactgtttctctatcataaatatttatcgtgttgttcttaaggagcataaggcataagccccccgtcattgatttaatttaaaaataaaacatttattgacacatacagaaatattttaattaaaaattgttaaatggcttttttaatgtctatatatattctaccccccaccccccaaaaaaagccattgtatgccaaagcccgaaagaagaattacattaccagtagttggatttttggctgaatctattcaaggggaaatcactattttcgttttagagatggctttgggtggaggaggtaaggtttcaagaactggttgaatgaaagaatattgacaagtaagtgaataaactagaattagtgtgaccacttctgatttctcaaataatgtgtttacaaacagtgttcctacattgtaatggcagtataaaatgctgatttaaataaatagaagtttagtggctacactttttcttagttaaacctcactatattctggatttaaaaatgacagtaactaatgttagttttgtgctcctctgaaggttagaaacctgttatatgtgtctaaaacgggttttaatgggtttaagaccacagagaagataggactgacactttagtaagattctttttttcaatctatttaattgttctatgattttaccttattcaaggtgatggagggtgaattagggtgggtaaagggtagggggaattgagacagtggttaaggttgatttttgacttgtagttcgctttcatctttaaattgtggaagtcgccttcctttgttcattttgaagttttgggcaaaatgttctcaggctagatgcaggtaatgcaggtaacagcggccagcacttcccatactagagggcgttgactttctcaaagtgttgactcgtttgtgatgtttttgcatttgtttggtttctgtttgctgctatgttgttgctcttcccagtatgggatagggttatggtattagtagaattacagtgttagtggtttttcttcctcttcccattccatccataaccttgacactcataattttgaaacctatcgttcattacaagggttaaaatctaaaatgtgactgtgcaggttgagatggcatgttacagctcctgccacctctttttcttgtgacagatggcttcccctcctggttgtaatccactgctgatttttttcaaagagcgaataccatgtgttccccattttggctctggttgtgttctgcccactcattggcttcagaggatcttgaaacaggaggtacttgctgctggcatttatggcaggaagtggatacaattgcgatactttgtgccaagtgttcatttattagaaaaattgtgcttcctaaaattaaacattatttctctgtcacatcaagagtaaagctaaattttattactttttagaatatgcttttcccttaatgttgtattataaaaattttttggtggcaaatttattacaaaatagatttttaaatctgaatttcacatactcaaagatttatagtctgtgcaagacattgaatgagtagctctaattgcactagtataatataattacgaaagggatctgtatcacagagacttctgatcacagaaacagttggaattgtttgtgatgtgtggtattgaacttgtgattgcatatgctttgtggtacctatagacagtagtgtttgtctattttaactctcttgcttcggatctccccttgagtagattcagctaaataagttataaatttcaccatcttaggccttcttgaaaattataagtatctgagacagcttaatttcataaagctactgtgcatatttggaagtatggtgtttggttttttaaaaaaacctggcaggccagagtaagcaaattgtttttttatgtttttgtcaagaaacaccccaagataaatgtaaacaaatatttgcgcattaccgtcattgatactggaatttgacatttctgtcctcagaagtcactgttctgtcagagtctgctgtacttgcctgagtgaatagtgcaggattggcaaaaacgttgcctgctcatggcagatcatctctaaatctctcttgacaacatctctagctgaacccagatcagtgattctcaaccttggctgcatattggtatcactgagaaacttaaaaaacaaacaaaccaaaacctgatgcctgagtctcacccaaaccctcagataatttgatttgattgggcttgggggtggtcttgctgtggagatttaaaaaatctccccaggtcattctaatgtgaagtcaaggttggttgagaaccactggctactacaaatggataagagttggtagtgtgaactgaaatgtatttgccatcctcagtctagtgaggggattttctaaccatgccacaatatataaacaatttgcagtttgaatggatagaggttggttatcattggaatttgaaaggacaaatgacaagtaacatcggatgatttaccagtgttttgtgatcttttttttttttttttttttttaagatggagtctcactcttgttgcccaggctggagtgcaatggtacgatctcagctcactgcaacctccacctcccgggttcaagcgattctcctgtctcagcctcctgatttacaggcatgtgccaccatgcccggctaattttgtatttttagtagagacagggttttaccatgttggccaggctggtctcaaactcctgacctcaggtgatccgcccgcctcggcctcccaaagtgctgggattacaggcgtgagccactgcgcccggccaatgacattttaaaagaattgccttcagagggtagctggaaaagcaaatggatgtgggacaagaggttgttccacaacctcctggggtggggatacccgttctgtgatggcattaaggagaacgagagggctgagaagagagcaaaatgatcagccctggattttgggacttggccaaaaaagaaaggatggaacaggacgtcaggataagatctaagacttgaagcagaaactgtacttcttcctgacccaggaggtgtgagacagggaagtggtggtagcaaacaggatagaatgagaggttcccttttacacccaaacttgttctttgcttagtggcagaaggctcaatttttctttattagagcattttctttattacagcactatgagctttactatatgtgaatcacctgtgagcacttgttaaaatttctggatccctcccaaagtttctggtttaggactgctgggggaaggctcaggaatctgtatttgtgaaggttaactgaaccttttttgtttgcttaccatctattcagtgttttccctattctttgttctatttatttagtaatttaaaaaattgactcattttaaaaaactgaatcttattttaaaatgaaactgtcactactacacgtggaaaacatttgccaaaaaataaaaaatgaaagtgtaaatacataactattaagaaaaaggtcaggccgagcactttgggaggccgaggcgggttgatcacgaggtgaaggaatcgagaccatcctggccaacatggtgaaaccccatctctacaaaaaaatgcaaaaattagctgagcgtggtggcgcgttcctgtagtcccagctactagagaggctgaggcaggagaatcgcttgaacccgggaggcggaagttgcagtgagccgagattgtgccactgcactccagcctggcaacagagtgagactcagtctcaaaaaaaaaagtcatatatgtaccactctgaagattatttttaatatcattttgggaactactagcgattctgatacagatagttttgtcatcatacttggagaaatattgaactagagacaaaaagtttcacttagattgcatgattttcagctactgttgcacacttggaatctggggcatttttaaaatacttttggtcagcccccatcccccgatttaattggtgtgggctacaacctggacatcaggatttttaaaacactctcctaaggtaatcgtaatgtatattctgggttgaggatttagaggttaaaaagcatataatgcagttagactaagaagcataaattcatgaatactaaaatacacttatctcggtataattagaaataaagaagactggctgggcatggtggctcatgcctgtaatcccagtggtttgggaggccgaggcaggaggatcacttgaggcgaggagtttgagaccagcaagggctacatagcaaggcctcgtctctaccccaaaaaaaaaaaaaaaaaaaaaaaaagggcagaagaaaaattagacaggtacagtggtaggtgcctgcaaatcccagctactcaggaggctaaggtgggaggattgctggagtccaggaggttgaggctgcagtgagtcctgatcctgtcactgcactccagcctgggtgacagagcgagaccctgtctcttataacaagaatgaaaaacaccacagtgaccacctgggggatgtgggcagggggagaggaaaagaaggtgaattaataaagcactaaggcaccgtgtccttatgatcgcctctgctcctgcctgcttctcttgttttctgttcttgatgaatagcgtgaattaataaagcactaaggcaccgtgtccttatgatcgcctctgctcctgcctgcttctcttgttttctgttcttgatgaatagtgtgaattaataaagcactaaggcaccgtgtccttatgatcgcctctgctcctgcctgcttctcttgttttctgttcttgatgaatagcaagagcttttaaattgtcagctagtccccaaacgtaagtgtgcatcagaattaactggagggtttgttaaaacacagattgctgggactcatcctcagaatttctgatcgagtaggtctggggtggggcacaagatttaatttcccaggtgatgcttctgctgctggtcagggaacaacacttgaaacactcatctagttaaccaagctgaaaactttaggacattagcctgacatttattgtctctgtgtattttatatatatccagtgaactttaaaaataattacgtaaacacaaacctgtgtttccatcacctagaattagtaaatgttaatgggtgtgtggataaatattaattatgaataaatattgcctttttggtgataataaaccgctgtgttttatttcacacttttgagtacaaggaataaaaaaatacaacttttctgggcttgagataagtgctctttaggttaagctataacaccgaagagaaaatagtgctccattaacttgtttcatcagtcttttaggcaaccaaatgagaaaagcaaagaaaaacagtacagtctagattgtatactccatctgagaaaaaacattaaaaagtattacgtatctgaaaatgaaattgtcggacaggcgcggtggctcatgcctatagtcccagcattttgggaggcggaggagggcggatcacctgaggtcgggagttcaagatcagcctggccaacatggtgaaaccccgtctccactaaaaatacaaaaattagccggacatggtggcaggcgcctgcaatcccagctactcaggaggctgaggcaggagaatttcttgaacccaggaggtggaggttgccgtgagccaagatggtgccgttgcactccagtctgggcaacaagagtgaaactatgtctcgaaaaaaaaaaaaattgtcagctgcaatcattttatcctgtttttctgtttgaatagtttatttgaatagttcatggaattaataagttgaatttatttctatatctagaaacttgggaggggaagggtaaactgttatgtatggtataaaaaatttaaaagtgttgtgaaaatactattttcaattctaaaacgcttgttcaattctaaaatgacttgtttcccctatgcttgatatagatcaagagggaaaaagtattaatgggtattatttattcagcaaacattgagtttacattcaggactgtcaacttgactatggaacaattcaagtagctttcgttagtcttgcctagcttttcgttatgcattaaatatgtgcttcattcaggaggagatcaccccaccccagccaggttagttttgtcaggtagaaataatgctgtttttatattctcatgaagagtgtatgtattttttcatcgtggagctaatgctaggattccctgaacttgctagcttctataaatcctcctcaccattcttcgaagcaagggctttggaaagtatggacttaactgtctcatgaaaatccttgtatagcttcaattgtcctccctcctatttatttttcatgaaattattctcttgacacacttgtttattttctatttagtctttctagactcttctatttgcttccttcttggactatttgttccctcttgctagaactctttatcttcactcattaactaaactttaagaaaagagtccttcccatgtttcctttaacagggaggccagcttgtttttacagctcatataatatatgcaggtagtagaagacagatgaaagcaaatactttgcaaattatggtatgtttgcttcagttttcaaaaagtctgggagcttggtctcttttccctggaaaccacctctgttttgtcttgcagatgagagtgtgatctttaagctagccttgaccttttgggtggtctgtgcttatctttcaagtgtttgcagtaattaggaccagtatatcaaaaaaagcatgctacctatgttatttgtattgtcctgatcttctagattcagaaaaaaagagaggttattatttttataactggatttcctatatttgtggataagaattccaaaactaacaaagagaaaatcatcttgactgttacgtgctgtaaaaatcatgtattcaaagtttgtactatcacaattctggattcatgaggatttgccagacattcaaattaaagcctaatcaataactttcttcttcgtagagggccattctaaggccagtgctttcccagggcctgggtatattatgtagtatgatgaatatcacagagcaattgcccttgtttaggaactgtgtattgggattcctttaagatttttgttttaacatacttacatttcactaggattcttccctaccgcacccccggctctttttaaaaaatttacctagtttgtcccttgcctgtttggctactagatatatttaactgaccttagacagtgctgcaggcagagttcagcatttaggcaaaacggatggcagtgttagctgtttttctcctggcatgtcactgtgcattatctgggatggcatgctttgtgagtatctgtatggtttcccaatgagagaagggaggtctggctgcattcactcgcacaaggtgacctttgtttctacacattctctgctttaacaaagcattgtctaatcagtctgtcaatacatatttattgagtgcctactgtgaatgcccagtagtatgctgtgtactttgagagatttttttcaaaagggggcagggtagaaagaaagagaaatatgcatttgagtttagaataatgttaacatgaaatatgtataccgtgtgtgattttataaacatgaatttctggaggagcagaattctagagtattctggcccacattagcttcaagaatggaattattcttaagagtaaaatcacttaagctagaagttccaggctgctgtgagcagtgcctctacactccagccttggtgacaggagacccctacctaaaacaaaacaaaacaaaacaaaaaaagaatgaactgtttcctcattaaggtgcaacttattcatgtaagagagatgtttaatgttaaggatttcctttcctttccttttttctttcctttttctttcttctttcctttcttttctttgacagagtctcactctatcacccaggctggagtgcagtggcgcgatctctgttcactgcaacctctgcttcccggcttcaagcaattcttgtgcctcagcctccccagtagctgggactacagtcatgtgccactacacccggctaatttttgtatttttagtagagatggggttttgccatgttgcccaggctggtctcgaactcctgacctcaaatgatctgcccacctcagcctcccaaggtgctgggattacaggcgtgaaccaccatacttggcctgttaaggatttctttaaatgtggtatttgatatataggcttacacaattagtatatcttaaattatgtaatgaatttcccacaatctcagcatttaaaaaaatgtttggaataggaagatgctcataatattttaggggaaatacatgtatatatagtgtatatatgtatgtatacaatgatcaatctttggagcagcatagtgtaaaaagcgcaagctacggagtcagactgctggatggttctgccacttcaactgacctagggacaggtagattttattatttgtttccttttttgtaaaatgaaaataatggtacatcatgggtgagatgtaaactttaaatgagttagaatgcataaagcattcagaaaaggagctggctgggcgtgggtggctcatgtctgtaatcccagcactttgggaggcccatggcgggagaattgcttgagcccaggaatttgagaccagcctgggcaacataatgagacccctgtctctaaaaaataaaataaaataaatgaaaataaaaataaaaatagaacatggtctggcctgtggaaaacattaattgttacttttattgtagcctttttttttttttaaaaaaaaggtgaatgtcagcagagaaaaactgttttaaaggatatccataaaattttttttgtgatttttctcagattcataggattattaatttttctttttatctgtaattcctttttcccccgtaatgaacacgtttctagtgtaataaagtagaagataatgaagaataagatttagtctgaatatttatatgaatccttatgaagaagtgtcgttgtctgtcattgatacccaagatttgttgtctcacggccatggaaaactaggacgcagacacacaaagagtgaggttcagagtggaagtttaataggcaaaagaaagagaagagctctctgcgacagagatgggtcctggagaggctggtcctggttctgcggtggaatgcaaggggttttatagataagcttgaggaggtggtgtcatgatttacatagggcatgaaagattggttggaccaggtgtgccattctggaaaactggttagggctaggtgttccatttgcctagggtgcaaaaatctggccacccccaccctaatcttttattatgcagatggcttctctgtctgcccagcgcagtgtctgtttctttactatacatgtggtgacaaagaaaagggaaggtgaagcctccatgttgaacatacctggcccccaggtagccgttttctgttagcatagctgctgacattcacccatgcaagcttccagcttgcttttttatgtttgcagcatgatttttcaggctgctctttgttagaaaagaaattcttttggggctgctttttgttaaaaggggaaattacgccgaggactctattgcccttattatctgcgtaaataatttctttctacctcctgtatcaatgatacaacaaaatctagaatttgttgccaggaaattagtaaatatttgaatgatattgaatggtctacataggtgatgttattttatcttgaagctgttcataatttagcataggaaacatggcaaacatggcagaaataccatggatcatatgcttgttttatttttagtgtttttttgtttgtttgttttgttttttttgagacagtctctcactttgtcagcgcgatctctcggctcactgcaaccaccgcctccagggctcaagtgattctcctgcctcagcctcctgagtagctgggattacaggcgtacatcaccacacctagctaatttttgtgtttttagtagagactgggtttcgccctgttggccagggtggtctcaaactcctggcctcaagcagtccatcttccttggcctcctggaaagcgctgggcttacaggcatgagccactgcgcccagcctgtatatcttcttttgagaactgtctgtttaaaatataaatgaaaataaaaatagaacaggggctggcctgcagtaagcattaattatgacttttattgtactttttttttaaaaaggtgaatatcagcatagcaaaactgttttgaaggatgcgcatggtttttttttttttttttttttttttccttgaggtggagtcttgctacgttgccaggctgaagtgcagtggcttgatttcggctcactgcaacctctgcttcccgggttcaagcgattcccctgcctcagcctccttagtagctgggattacaggcacttgccaccacgcccagctaattttggtatttttagtagaggtggggtttcaccatatttgccaggatgctctcgatattctgacctcgtgatccacctgcctcggcctcccaaagtactgggattacaagcgtgagccaccgcacccggcctaaaatttttttttagtgatttttctcaggtgtgtaggattattagattatttagatccttagatctagactatttagatcctttgcccattttaaaatcagattaggttttttttgttttgttttgtttttgtttttttgtttgtttttgctgttgagttgtttgaattcattttatattctggatattagtcccttctcggatgcatagtttgcagatgttttctctcattctgcagattgtctcttcactctgttgattgtttcctttgctgtgcagaagctttttaagtttgttatagtcccatttgtctattttggttttctcaccagtgcttttgaaaccttaccaagaaagtcttttcctagaccagtgtcctcaagtgtttcccctacatttttttttctaatagttttatatgaatagtttcaggtcttacatttaagtctttaatcagttttgagttgactattgcgtttggtaaaaggtaggggtctaatttaatttttctgcatgtggatatccagttttcccagtactatctattgaagagggcgtccttttcccaaagtatggttttggctcttttgttgaaaatcagttggctgtaaatatgtggatttatttctaggttctctgttctgtcctattggtctatgtgtctgtttttataccagcaccatgctgttttggttactatagctttgtagtgtattttgaagtcacatagtgtgatgtcttctgctttgttcttttttgttcattattgctttggctattcagggtctttctggttccatataaacttgagaattgtttttttatttctctgaagaatatcattgatattttgatatggattgcattgaatctatagtttgctttggaaagtatgttttttttttttttttttaagagacgaggtcttgctctctcatcccagctacagtgtagtagtatgatcatagctcactgaaacctcaaactcttgggctcaaatgattctcccacatcagcctcccatgtagctgggatgacagtggtcattttaacagcattcttcctatccatgaacatgggatgtctttccaattttttttgtgtcctcttcaatttcttttatcagtattttgtaattttcattgtagagctctttcaccttcttggttcaatttattcttagagtttgttgttgtagcttattgtaaatgggattgcattcttggttacttttttagctggtttgttattggtgtatggaaatgctactgatttttatatgttgattttttatcctgcaactttagtgaatttgtttataagttctaagattgttttgatggagtctttaggtttttctagatataagaacatgttgtctgcaaacagggacatttgactgcctcttttgcaatctggatgccctttatttttttctctagcctaagtgctctggctgggacttccagtactatgttgagtaagaatggtgaaaagttggcatacttgtctggttctagttcttagaggaaatgcattcagcttttccctattaagtgtgatgttagctgtcactttgtcatatgtggccttgattatgttgaggtatgttcctttattgcctagtttattgagagtttttatcaggaaggtatgttgaattttatccaatgtttttttctgcatctattgagataatcatatggattttgtcattcatgctgttgatgtgctatattacatttatcgttttgtgtatgttgaaccatccttgcatccctgggataaatcccactttgtcttggtgtattgtcttttgaatgtgctgttggattttgtttgctagtatgttgttgaggatttttgcatctgtgttcatcagggatattgaccatagtttttgttgtttctgtacccttgtctggttttcgcatcaaggtaatgctggctggccctatagagtaagttacaaagaattacccctcttcagcttttgggaatagtttgagaagaattggtgttagttctttaaaagttttgtagaatttagcattaaagctatctgatccagggtttcctttgttgagagactttttattaaaattgattcagtcttgttacttggtgttgttctgttcaggtttactacttgtattagtctgttttcatgctggctgatgaagacatactgagactggagagaaaaagaggtttaattggacttatagttccacatggctggggaggcctcagaatcatggtgggaggcaaaggccacttcttttttttttactattatactttaagttttagggtacatgtgcacaatgtgcaggttagttacatatgtatacatgtgccatgctggtgtgctgcacccattaactcgtcatttagcattaggtatatctcctaatgctaaccctccccccttcccccaccccacaacagtccccagagtgtgatgttccccttcctgtgtccatgtgttctcattgttcaattcccatctatgagtgagaacatgcggtgtttggttttttgtccttgtgatagtttactgagaatgatggtttccagttgcatccatgtccctacaaaggacatgaactcatcattttttacggctgcatagtattccatggtgtatatgaaaaggcacttcttacattgaggcggcaagagaaaaatgaggaagaagcaaaagcggaaacccctgataaacccatcagatctcatgagacttattcactatcacaagaatagcatgggaaagactggccccatgattcagttaccttcccttgggtccttcacataacgtgggaaatttttttttttttttttttgagacggagtctcgctttgttgcccaggctggagtgcagtggtgcgatctcggctcactgcaagctctgcctcctgggttcacgccattctcctgcctcagcctcctgagtagctgggactacaggtgcccaccaccacgcctggctaattttttttgcatttttagtagaacgaggtttcaccgtgttagccaggatgatctcgatctcctgaccgcgtgatccacctgcctcgggccccccaaagtgctgggattacaggcgtgagccaccacgcctggccacatgtgggaattcttggagatacaattcatgttgagatttgggtatagtacactatatcactgcttcttcctggtccgatcttggcaagttctatatatccaggaatttatccattccttctaggttttccaatttgttggtgtatagttgttcataatggcgtctaatgattctttgtatttctgtggtttcctttttcatttcagattttgtttgagtcttctctcttcttagtctagctaatggtttgtggattttgcttatcttttcaaaaaaccaagtttctggctgggcgtagtgggccatgcctgtaatcccagcacactggtaggctgagtccgcagatcacttgagcccaggagttcgagatcagcctgggcaagatggtgaaaccctgtctctactataaaaaaaaaaaaaaaaaagttgctgggcgtggtggtgtatgccagtaatcacagttacttgggaggctgaggcatgagaatcacttgaacctgggaggcataggttgcagtgagttgagattgcaccactgcactccagccggggtgacagagcaagaccctgtctcagaaacagcagcaacaacaacaagaacaatccccaaaacaagttcttgtttcattgatgttttatatgtgtctctctctaattatctaatctaattgaatctctctctccccccccatatctccatatctccatctcttgctttctctttctctctctctggtttctattttgcttatttctgctctggtctttatttcttacactaattttgagtttggtttgttcttgcctttcaggttccttgagatgcattgctaggttgtttatttaaaatctgtcttcttttttgatataagtatttattgctgtaaacccccctctttgtactgcttttgctgtttcccagaggttttggtatgttgtgtttttttttcttcttttcttctttttttttttttttttttgagacggagtcttgctctgtcacccaggctggagtgcagtggcatgatctcggctcactgcaagctctgcctcccgggttcactcccacctcagcctccctagtagctgggactacaggcacccaccagcacgcctggctaattttttatatttttagtagagacagggtttcaccgtgttagccaggatggtcttgatctccagacctcgtgatctgcccgcctcggcccccgaagtgctgggattacaggtgtgagccaatgcgcccggccttttcttttctttttttgaaaatgaagacggggttttgccatgttgcccaggctggtgtcgaactcctgagctcaagccatctgcgtgcctcagtctcccaaagtgctgggatttcaggcatgagccaccacaccttgtcattatgttgtgtttctatttcggttttttttccaacaaatcttttgaattccttttaaatttctccatagacccagtggtttttcaggtgtttagtttccaaagttcttgtttttgatgtctagttttatcccactgtggtctgggaagatacttgatatgattttagttttacaaaatttgttgagacttgtttcgtggcctaacatatggtttatcctagagaatgttccatgtgctgatgaggagaatgtatattctgtagctgttgcatggaatgttctatgaatgcctgttagttccatttggtccatagttccactgaagaccagtgtttctttgttgattttctgtctagatgatctgttcagtggtgaaagtggggtggtgaagtccgcaattattcttatattgggatctatgtctctagctctaataatatttgctttatagctgggtgctttggtgttaggtgcatatgtgtttatagttgttacgtccttttgctgaattgatccctttatcattatataatgtccctttttatgttttttgacttgaaagtctattttgtttgatataaatatagctactccttcatgcgtctggtttccatttatgtggagtatctttttccattccttcattttctttttttttgagacggagtttcacccttgttgcccaggctggagtgactgtagtagcatgatcttggctcactgcaatctctgcctcccgggttcaagcagttctcctgccttagcctcccaagtagctggggattacaagcatgtgccaccacgcctggctgattttttgcatgtatgtatgtatgtatttatttatttagtttttgagatggaatattgctctgtcgcccaggctgtagtgtggtggcatgatcttgcttcactgcatcctccacctcctgggttccagtgatgcccctgcctcagcctcctgggtatctgggattacaggcatgtgccaccacgcctggctaatttttgtatttttagtagagacggggttttcaccattttggctaggctggtctcgaactgctgacttcaggtgatctacctgccttggcctcccaaagtgctgggattacaggtgtgagccaccgcacctggcttattccttcattttctatgtgtgtttttacatgtgaagtgagtttcttgtagacagcatatagttgagtctttttttaaaaaaaaatccactcattcagcctatatcttttaattggggaatttaaaccatgtacattcaagattgttcttgatatgtgaaggcttactcctgtcattttgttgttttctgattgctttgtatatcctatgttccttttttcctctcattgtttatccttgctgtttggtggtattctgtagtgataacatttgactagtttctctttctcatttgtatatttgctttgccagtgaattttatacttttatgtgttttcgtgatgatacatattattctttcccttccagatgtaagactctcttcagcattttgtatggctggtttagtggtgaattttttcagttttcatttgtctgtgaaagactttatttctccttcatttctgaaagatagctttgctgggtatagtattcttggctaacaatttttttgctccccacccccttcattcagcagtttgaatatatcatttcattctctcctgacttgtaaagtttctgctgagaaatctgccattagtctgatggagattcccatacatgtgacttgaggattttctcttgctgtttaaaaaactttttttttttttttgagagacattattctgtttcccaggctggattgcagtggctagtcacaggcacaatcatgtctcacgacagccctccaactcttggcctcaagcaatcctacccactcagcctcctgagtattctcttgctgttttcagaatattcttttttattactgtgattattattatttttagagatagggtcttgctccattgcccaggctggtgtgtgatggttcagtcatagctcactgcagccttgaactcctgtgttcaagtgatcttgcctcagcttcttgaatagctaggactacagctaaaagattggccatccctggctactttttacattttttgtatagatagggtcttgctatgttgcccaggcttgtgtcaaactcctggcctcaaagaatcctcccgcctggcctcccaaagcattgggattgcaggagttagccaccgtgttcagtgtagaattctgtttttatcatttacttttgacaacttggcaataatgtaccttagagaggactttctttgggctgaatatgttttgggatctgtgaataccaaagattcgagggatatatgcctgtatctctgctgagacttcggaagttttccgctattatttcattaaacaggttgtctatgccatttaccatctcttctgaaattcccaaagtgcaagtagttgttcacttaatggtgtcccatatgccatgtgggctttattcttttttatcctctcttctttttcttctgagttttttctttttttttctttttctttttttgaggcagagtctcgctctgttgcccaggctggagtgcagtggcacgatcttggcttactgcaacctccgcctcctgggttcaagtgattctgctgcctcagcctcctgagtagctgggattacaggtgtgcaccatcacacccaactaatttttgtatttttagtagagggagggtttcaccatgatggccaggctggtctcaaactcctgacctcaggtaatctgctcacctcggcctcccaaagtgctgggattacaggtgtgagccaccgcgcccagccctgtctgagattttgcaaaagacctgtcttcaagttcagaaaatccgcttgatgtagtctattctattttttatttcactcattgaattctttaatttcacaatttgtttgtttgtttgatatatatctccttgttgaatttttcactgatgaattgttttcctatttctttgtaccgtttgtgtgtgtgtgtgtgtgtgtgtgtgtgtgtgtgtgtgtgtttgtatattgctgagtttccttaagatcattatttttcatttttttcaggcatttcagagatttctttttttggggcggggggggacggatttcttcctagagaattaattgagtttcttttgaggtgttgtatttcccttgcttttttatgtttcttgtgtctactttggcatctgtgcatctggtgcagcagctgctccttccaattttatggagcagcttttgtgcagaaatactttttcctgcaggtatatctacagtattggctggataacgtgctttggccgtacaatagagtagtattcagccatgaaaaggaatgaagttctgatacatgctgcagtgtggatatacctccaaaactttatcctgactgaaaggagccagatacaaaagatcacttattgtatggttccgtgtatatgtaatatattttgtagataaatctacagatgtagaatgctaattggtggttgccagaggctgggaagaatgaggaatgggaagaaactgctgggtaaggagttttaactttggagtgatggaaatattatggaactaggtagaggcagtcattgcggaacactgtgaacgtactaaatgttactgaattgttcactttaaaatggttaattttatgttatatgaactacacctcaatacattattttttaaaagttttatgaacagtcataaattaaaacaaatattcgctatggcgattaatataattgccctgtgttgaggatttaccgggagctggagccttcacatatattgattctaagccttatgtcagcattgcaagatagattaggaagaacaaagaactatattagtagtttaaaataatggctttaaactgctttacaccttgtttatcaaatcaagtgagcccttgaaatttaatcagggactggacggtagggggcacccatggtacttatgttgctctggctatgttgagagcgtcttaagtcataaacacagatttgttgaatgagtttgatactttgaaaattatcacctagaggctgggtgcggtggctcacgcctgtaatcccagcactttgggagactgaggcaggtggatcacgtgaggtcaggagtttgagaccagcctggccaacatggtgaaacctcatctctactaaaaatagaaaaattatccgggtgtggtggtaggtgcctgtaatcccaactattcaggaggctgaggcaggagaattgcttgacgctgggaggtggaagttgcagtgagctgagattgcgccattgtagtccagcctgggcaacagagcgagactctgtctcaaaaaaaaaaaaaaaaaattagcaagaaggatcttattacgaacttatgtttatttgagtttggtattttatctttcagttttaagttttgtagttgaaaatatggaactataggcatgtgccaccacacccagctagtttttgtattttttatagagacggggttttgccatgttgcgcagactggtctcgaactcttgggctcaagcaatctgcctgcctccacctcccaaagtgttggaattacaggtgtgagcctctgtgcccggccaaaacataagttttatgatataatacttgctctatggacgatgttagatgttttaagttttattttcttttaatgaaaaaagattggcaaccactaaattgtttttacaactcattttttaacaagccagtttgaaaagtttttagtgtaaaatgccagtgtttctgctatccgatgaaaagcatcaggttctataaaattttactattggaaagttagggtttggggaagagtattctaaatatatgtaactttgtaatcataacacaaacagaagtaatgttaataaatggtacctcaggagattacttggatagcactaggatgccaggtgatagtagccagagaatgcttcaacatatattcaaaactcaccgaagtaatttagtagaaatgcttgcttacagtgctgagaaattgctgatggaagtggatctctgagcgcaggaaaaagtgcagcctgtcttgagcagagggccatgagtgctcaggggtgtgcccctgtaggaagggagccctggatacaggtgctctgttttagttttctcaaaatagagctgaaaggatcactatttattcagcagccaagcagagggcattttcctttcctgctgaaggctgcaattctgcctgtctttgtagttctcttgcctaggaaaaggtacatatgaatcagcacagctttgttataatgatagttctctatttatcatgatcatgtatgagctaatttatattgtaaaaaatatatttagaacaaaactgtgtgtgtgtccagtgtagtttgccaattttactgtatttcattttagccactgctttttttttttttttttttccttctgagacagagtcgctctgtcgcccaggctggagtgcagtggcgcgatctcagctcactgcagcatccacctcccgagttcaagtgattctcctgcctcagcctcccaagtagctgggactataggcgcccaccaccaagcccagctaatttttgtatttttagtagagatgggttttctccatcttggccaggctggtctcgaactcctgactttgtgatctgcccacctcggcctcccaaagtactgggattacaggcgtgagccaccgcgcccggcgatgctgagatcttaattaagactctaagttttggagagagatgttcaagtttttcatctttacctgagaatccctacaaaatgccaaatactgtaattgtacactaaggtgccaaaattttgatctcaaagatccgtatgaaattatcttggagataaggaacctgaaggcttaaaagacacaagaatcaagtttctcttctggccctttcttatttattacatacaaaaataattacttttccctttaggaattaaaaaaaaaagtagtcactcagggatacctgattctttactgatgcttagcatttttttgtgaataatttttatccctctaacagtaaaatgatgttaaaagcccttgaaaaaatgaaaattaattgcatttcatacccttgaagctctgattttattgataattttgttttttaagtgaacaaaacctcaaaatatactagcaaggtaaatttattgatttctcctcttatgcccgattgcttatcaatttggttcttttgtctaagaatgatccaattagcagactaattttttttcaacagggaactttcgccttcttacactgtgttctcattggagcattgcatagtctctgcatacgtagagcgtgaagatggtgtctttatgtataccttcttaagtaagctaaactgtcttgaaaatggcagtaagtggcacattaagacacaaaaggttatttcttttttggcgaatggttgtttgtttaaatggagaaacataaggtcttatattgagaggtagatttatttaatattccatagatgtaattttaaaaatatttctcctgtctcagaatgaagtgagggttctgctaagacagctttgtaattcacagctttctttgaaaatgctgtacctctattccttattgatggacttgaatgcacaatcatttgtggggtttttttgttttgtttttatgaaatagcagtttgatcatttataccaaaagttagtgctatatgattagatatcaaggttccttagatagaagcattccaggctggatatctgactccttttatcatctgcatggtgtacttagctgtatataaaatggaaaagtagcaagtttaaatgactggtaaagttggaggcacactctgctacccagcggttctatttctgtgtcttcttgagagaaacttttacccatgtgctcaaggatctatatagatggaggtgtaatttattataatggtgatctagataggatctagatagatggaggtgtatttattataatagtgaataagtacaaaaatacttaactgttcctcagtaagtgaatggatacattgatattattcgtatagtggaattcaagtaaacaatccttatctccagaatacttagggcagatgtattttggaatttagaaatttttaaactttaaaggtaattcggtatgtataccatttattgtataacactcccattgggatttgggaaacacctcataatcaaacatactaatttttctgtagcaaaatttatgaatattcatattaagtgggataaatagattttaaatggcttcatactatttgggttaattacattttttaattaggttatgggaaaacttaagagctttttggattttagatttttggaaaaagaattgtgaacccatattataaagttcataaaatgaatgaaatcgagctacatgtatcgatgtggataaatctgaagcatattatgttaagtaacaaaaggaagttgcagagataaccttgtgcaaatgacatcatttatgtgaattgttaaataagcaacagtgagagagagagagagagctctgaagcaaataaggcaaattattggtagtggttttcttactttgttgtatgtttgaatgtgtctttataacctcaaacttcagcttttaaaccttctgttttaccttaagaatgtaaggttacattgagttaggcaataagagtatgctacaaagcatgtcagaactggaagtgttctttaaaatcatttaaattatcatcccttctttttttcttactttctttttttcttttcttttttttttggaggcagggtctcactctgccgcccaggctggagtatagtggcatgatcatggttcactgcagcctcagactcctgggctcagggaaacctcctgagtatctgggactatagatgcatgccactgtgcccagctaatttttttaatttttttgtagagacagtgtctgtgttgcccaggctggtcttgaactcctgggctcaagcagtccttcctcctcggcttctcaaagtgctgggattataggtgtgagccactgtgcctggtctactcttccttcttctaatccaagtcattcctacttgttaagagattctcttgaatatttatttattttccctttttaaaccttagaccttttacttcttttcaaaacatattttggttgagatatagtttccatacagtgaaatgcacacaccttaagtatcttgtttccatgagttttgacaaatgccaacacccgtgtaatccacaattctgtcaagatacagaacatttccatcatcccacaaagttcccttgcatctctccccagttcgcatcatccctgccccgcagcacaggtagtgttctgattcctttcactttaattttacgtgttctcgaacttcatttaaatggaatcatacagtctgtaccctgttgtgtctggcttttgttgctcagtgtgttgttttttacatttatccatgttgttgcatgtatccatagttatccttttatatactgagtaacactccattgtgtgaatgtggtactatcagtttatccaatcttctgttgatggacatttgtgttgtttccagtttttggctcttatagataaaaccactgtaaacatttttatatggttgtgtttattggtacatgttttcatttctcttggggtgatacctaagggtggaattcctgggtcctagggtggtgcatacttcacttcgtgagaaactaccagagcagttttcagtgttgcttctggctgcttccatccttgccagcatttggtattgttaattgtctaaattttagccattctagtgggtgtgtagtgatatcttattgtggttttgatttgcatttccccagttactaaagatactagtcactttttcgtttgcttattggttagttagttcaattgcttattgtccttagaagaacgttcatcttccccaggaatgtatttttctttttgaagtatctaagtcttctacccacttttaaaaagttttttttttttaattgagttgtagaagtagtttatatattctggatacaagtcctttaacagttatatgtggcatgccaattttatttttatagtggtctctttctttttaaaatttttcctcatcactctttccatatgatacaatgttctcttttgataagcagaaattaaaaattttgaagtctaatttgtgaatttaaagttttatcattagtacttcctaagataaccatccaaatatctttcccttaaaagtataaagtctgaggctgggcacagtggctcacacctttaatcccagcactttgggaggccgaggctggcagatcacctgaggtcaggagtttgagaccagcctggccaacatggagaaaccctgtctctactaaaaatacaaaaactagctaggcttggtggcgggcacctgtaatctcggctacttgggaggctgaggtatgagaatcgcttgaacctgggaggtggaggttgcaatgagccaagattgcgccactacactccagcctgggcagcagagcaagactctgtctcaaaaaaaaaaacaaaaaagtgtaaagtcagctgaagtgatatgaaagcttttgtgatcatagacctaagcatttgaattgcaaatataacttggtgtgtgaaagctctgcagtatgcatgcaggaattaaatgtctgtctggaaataatgccaacaaatatatttattggggtttgtgtgatagaattggcagataaccaaggaagcaaatttattttccttttaaatatgaaggaaaatttatgaaggaagagcaaatttattttcctttcaaatacgaaaacatgaagtaatcttttgtaatgtttactacctacattgattgcctttctctgcattaatttctcaaaaattttcttcattaattttcttgaggagctcttttatctgcttaatgtctttacaaacacatgtgcaaaagagtctcagacgcatcttatttgatgattgtcatggaaaatattaagggtttgtgtacaaatgtttatactgcagtgttttgcttcaagaaaaatgtatggtcttctctatgcaagttttatcatttttgttgttgtttttatttccaagtcctttctgtgttttaattttaatttttacttttatttttgagacagagtctcgcactgtcaccctggctggagtgcagtggtgcgatctcggctcactgcaagctctgcttcctgggttcaagcagttctcgtgcctcagcttccctagtagctgggattacaggcatgcaccaccatgcccagctaatttttgtatttttagtagagatggggttttaccatgttggctatgctggtctctaactcctgacctcacatgatctgcgtgccttgccctccctaagtgctgggattacaggcgtgagccactgtgtccagccaataaatactttaaaaataaattttcaggccaggtgcggtggctcatgcctgtaatcccagcactttgggaggctgaagcgggtagatcatgaggtcaagagatcgagaccatcctggccaatatggtgaaacctcgtctctactaaaaatacaaaaattagctaggcatggtggctgtgcacttgtagtcccagctacttgggaggctgaggcaggagaatggcttgaacccagaagacggaggttgcagtgagctgagatcacgccactgcactccagcctagcgacagagcaagactccttctcaaaaaaaaatttaaaaaaatgtttttttcagcaatgtgtggaaaatatacacaagatataagaccaataaaatgctactgtctaggagatgaggtgcctcatacctgaatccagcaccaaggtgggcggataacctgaggtcaggagtttgagaccagcctggccagcatggcaaaactccatctctactaaaaatacaaaaattagggggtggtggcgtacacctgtaatcccagccacttgggaggctgaggcacgagaatggcttgaactctgaaggcggaggttgcagtgagccgagatcacaccactgcattccagcctgggcgacagagcgagactctgtctcaaaacagaagggacttggaaataaaaacagctaacaacaaaaacccgtaacatagtcatttattatcattatcaagtattatgtactgtatataattgtatgtaccacacttttatatgactgtcaacgcattaggtttatttacactaacatcattgcaaacacatgggtaaggcatgtgttacaacattatgatggctatgaccaatgtgataggaattccccaccctcccacccgagacggagtcttgctgtgtcgctaggctggagtgcagtggcatgatctccactcactgcaacctccgcctcccggataagcgattctcctgccttagcctcctgagtagctgggattacaggcacgcaccactacacccagctaatttttgcatttttagtagagacggctttcaccatgatggccaggatggtcttgatctcttgacctcgtgatctgcccgcctctgccttccaaagtgctgggattacaggtgtgagccaccatgcctggcctgtgataggaattttttagctccattgtaatgttatgggaccaccatgatacatgcagtctcttgttgactgaaacgtcatgtggtgtatatagaatgcatttatgacagtaggacttacccattttgatagtgttttcatttattcctttttcttttttttccgagacagagctttgctctgtcacccaggctggagtgcagtggcgtgatcttggcatcctccaactcctgggtgcaagcgattttcctgcctcagcctcccgaatagctgggattataggatgccaccatgtccagctaaggttcgtagttttagagatggggtttcaccatgttggtcaaactggtctcaaactcccccaccccaagtgatctacccactttggcctcccagagtgctgggattacaggcatgagccactgcacccgaccacattttcatttattctttaacttctattctgggttgtggtagcataaagatggattatgtttattgctgaaataaacctgttgtccaaattttgatgttttccagccattatcttgctacttagatttatgtacagcattcgcagagcaaaaagatagatgatcttatttttcctggattcagaggcagagagtagttgttagaattctagtgtaattgctcattcattttcttgactctgacatctttttttagaggaaaataactttggttagtaagctccaaataatgggtgagaatgttaaacaatttaatccatccctttgagttctagtgcgggtcttttttgcattttggtgagtctcctgcttgtgtttagattagtctgaaaactttgatttggtttaatatttgagggctttcagtgtgctttgctgtacaggaaataaatctctgtcattaactcaaagaatactaaactaacaataaggaggagtaaattaccttggaggctcttcccctgtctcattctctgtggttcagactcattaaattagtttcttcttttaaaatgtttcttcttttaaaattatggaaattagaattcagttgacgtttgtacaaagtggggttatatctgtgtataagttttgacaccccccaaatttaactattaatagcctactgttgaccaggggcctgataacatagttgattaacacatattttgtatgttatatgttaacatgtattttatgtatatactgcattctttaaagcaagctagagaaaagaaaatgttattaagaaaattgtctgggtgtggtgcctcatgcctgtaatcccagctctttgggaggccgaggctggtggatcacacggttaagagatcaagaccatcccggccaatatggtgaaaccccgtctctactaaaaatacaaacattagccaggcgtggtggtgctcacctgtaatccctgctactctggaggcagaggcaggagaatcgtttgaacctgggaggcggaggttgcagtgagctgagattgtgccattgcactccagcctgggcaacaaaagtgcactccattgcactccatctcttggaaacagagcaagactgtctcgggggaaaagaaaaaaaaagaaaatcacaaggaagagaaaatacacttactattcattaagtagaagtggaccatcacgaagatcttcatcctcatcatttttgttttgagtaggctgaggaagaggaagaagaaaagggattggtattgctgtctcagatttggcagaggcagaagaaaatccatgtgtcagcagaccctcaaagttcaaacctgtgtggtacaagggtcaactgtactttgttttcatagagatatattaaagttttatgagtttagctcatagtgatcttataggttctaagcttcatttgaatatattgcatgtaaaataaatgctttatctgtgttccttttgtctttcttgaatattgttgttaatttaaaatttgtaataggttataactcttatgttttacccatttgtgagctttatttttggataagaactttatcctgtacttttgctgtgcttcgtatagtacaactatgaaagattcttgttgactgttgattatctgaaaatgcttctttttgcttcaggtcaaatattgaataaacctagagcatataattaacatttttattaggactgtggtttgtattttggccagttgggatttaagaattacttgtattggttggtgtagaactgattttttttttctttttcttttttttttttttggagatggagtctcactctgtcgcccaggctggagtgcagtggcaggatctcagctcactgcaacctctgcctccccggttctagcaattctcctgcctcagccccctgagtagctgggtttacaggcgcgcaccaccatgcctggctaattcctgtatttttggtagaaacggggtttcaccatggtggtcaggctgatcttgaactcctgaccttgtgatccgcctgccttggcttcccaaagtgctgggattataggcatgagtgatttttttagaataagagtaattggctgcattatttttttaaggaagaggtataacttcccagatacttgcaatgcggctaatatacagtagccatttactttcaacataatttctcaacatttaatttttgtcagtttttcataaaaaatttatgacagggtaaaaagatgacattcctaagtcctagaaagtttattgatgataaatacaaagaattaaattgcagatcagtcttagaagtgctattctgtggataagcatacagccctgggcagcacagacgggaacatcagatagcccaaccaaaccggaagcttgacttggttgacttaagaattctttaaaactcttttgcgtgttacattaataaagtttatttaatacatgtatttatatgtttcagaaaaaaatgttcttaatttaacatttgtaaaagggtacaatactggtgttttctctgactctgatcttcttgataaacagtgtactgagttctctgtgatatattttgtttgtaatcatgaccatttcacgtgtccataattttttttctctaaaaatatctctagactacatagttctgttattttaggaatgagaataaacgggatcaaagtgtactcttgttctaagaaactaatgacagtttatttgttggaagttctgcctcagaagagcttctgatatttatctaaaatatatgaatagtagttgtgatctgtcattgtttttgcagatatctaattgttgtaataaaagtcataggccctgtcagatagttaagaattttcattattgttgttcacaatatcctaccatttcattgagatatagcttggtgtaataatagtacagtccctggagtaaattttagacaaatactttcccagcctttcaaaatcaagctgagtgttagagtgagaagtagactagtgagtgttgctataaaatttggagtgtgagatcattttgcagtgtgtcgggaacagacttcccaaatagacattctagtattatcttacaactcgatctttccttaaactcaatgtatctgtttttggttgatcattatagatgtctgtgatgtgtgaatatgcccattttatcttctgtatgaatatgctggagaaagagtagccttgcttgtagtctgcttttttccttcttctaaaggagttggcaggaatttttataaaataaagctagcctgattgtagccaaaagaggaaatgttggtttatattttagtggagaaaactgctgtatagacttctaggctaccaagtcagagcattgttttatttttatactatagtaaaatgggtgcaggcggagctgaagaaccagacacactagtagttaatgttttctttctttaccaaaatagtaattgccatgctacatttagccatatgtgccaaagcgtatgtgaaactgttaactgtagccaacatatatttctcctgacttgaatgaattgatgacgaatggtcagaaaaggaggaacagtcatacctagaaatcagcttccctgttgaatttcacttctggtatttccctttgggatatattcactcaggagtgtcaggattttttttgacttccaagggaaagaaactaggcttcagagaattagcattttgatacatctttttattgaaggtcttttgaactccagcaactgttaatctttaaaagatgatgctggtagtgaaatgcattttaaaatttatattcatgaatttaaattcctgatttttttttttttggtgagtttattcttcgaaagaaatagcagtgcttttcaagtgtttgaagactaccagaattgaaagctcactgcttgctaaaagcataatacccaaaccggaaatgataaaggaaaatgtcattgtctttgtattaaaaaagaaaatatctattaaaagtcatcataaacaatgttaaaagaaaaatggcagacttggaaaaatatttgtaacatacacagcaggtgaaaggttattttcctaatatgaagagctcttaaaatggattaagaaaaaatgttcaataacaaaatgggcaaagaacaaggagagaggagtcacaaaagttgatatacaaagacacagatagaaatgatttgtaatatgacaaaagtcgatatacaaagatacatatagaaatgatttgtaatatgacaaaagtcgatatacaaagatacagatagaaatgatttgtaatatgataaaagtcgatatacaaagatacagatagaaatgatttgtaatatgacaaaagtcaatatacaaagatacagatagaaatgatttgtaatatgacaagtcgatatacagagatacagatagaaatgatttgtaatatgacaaaagtcgatatacagagatacatatagaaatgatttgtaatatgacaaaagtcgatatacagagatacatatagaaatgatttgtaatatgacaagtcgatatacagagatacagatagaaatgatttgtaatatgacaaaagtcgatatacagagatacagatagaaatgatttgtaataagacaaaagtcgatatacagagatacagatagaaatgatttgtaatacgacaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagtcgatatacagagatatagacagaaatgatttgtaatatgacaaaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagttgatatacaaagatacatatagaaatgatttgtaatatgtatcagaattacaattgtacatactttgtgatccagcaattccatctttgagagttcccaagaaaaatgtggattcatgtgtaaagatacatatgtgaaggtgcatcttacaatagtgaaaaatgagaactaacctaaaatatccgtaagtggaattttatgaccaacatcttctctccaaccaatttttttattatggtaaaatatatataacataaaatttaccatcttaaccatttcgaagtgtacagtttagtggcattcagtatatcccatctatctccagaactcttttcatcttgacagactgaaactgtatacccattaaacaataactcctcgttctgtcccactcctatgtcctggcaaccactgttctagttccttctttatcaattcgactgctctagatacctcatgtcaatggatacatatagtgtttgtctttttgtgattggcttatttcacttagcacaacgtcttgaaggttcatctgtgttgtagcatgtgtaagaatttctttcctttttaaggctgaaaatcattagcaggtgatatggtttggctgtgtctccattcaaatctcaactggaattgtatctctcagaattcccacatgttgtgggagggccataggaggaggtaattgaatcatgggggccagtctttcccatgctattctcgtgatagtgagtaagtctcacgagatctgatgggtttatcagggggttccgcttttgcttcttcctgattttctcttgctgccgccatgtaagaagtgccttttgcctcataccgtgattctgaggcttcctcagccatgtggaactgtaagtccaattaaacaagtgccttttgcctcataccgtgattctgaggcttccttagccacgtggatctgtaagtccaattaaacctctttttgtttccagttttgggtatgtctttatcagcagcgtgaaaacgaactaatagagcagccaccttatttccaaaaaaaaaaaaagattttttcaatggataatgcaggtatttatacccttatttaaagtatgagggatctgaaacccagaaagatggtgacatgtctaaatgtcataactagtcagcgtgagagtcagaactgaaactcatgttttctcatcacagtttcgtgttcttcccagtatggtacactgcttaggccttgaatacaaggaatgatcttttattgttgcttcttcattcctaaaaataagatttttgatgtcacagccttttggaattcattgtataatgtgctggaatttacataaccattcagattaaaggttcgtgtaccttctttagggatagaagctaaagatctaccctctcaaacattttagtagttcatctgcattaacacctttatttaattagccacccatgttgttaccgtcccctgtataaaaagctttgcatattctaacttaaaaaaactttgctatattattatctttgggtattaccagttttgatttctgcaatctgctctgtttttgctactagaggaggaaagctgatttggagttttctttttttcttggttctagttttagtgggctgcaaggattgctttgaatgccagctctatcacttactctgtgatcttggacaagtgcttaaacctctctaagcctcgtgccctcatttataaaattaaataatagtacatgtgttgggtatctaaaatagtcaaattcacagaatcaaagtgtgtaatggtagttgccgggggtagggggaaatggagagttactaatcaacaggaatataaacttttggttgagatgaataaactctacagatttgatgtataacattgtacctgtagtcagcagtaatgcattgtacacttaaaagttgttaggaaagtagatgtcatgttaagggtttttactacagtaaaataaaaaaagagtccatgtgtcataatgaagattaaataacataaaaaatgtgtggtacaatctggcatatacaaactacttgttaaatgttaatatttattatttaatgtttataatacttaaaagtcattttgtatttcgctgtccttcggttttgcttgtttgtttgtttgttttgacacggagccttgctctgtcacccaggctggagtgcagtggtgtgatcttggcttactgcaaactccacctcccagttcaagcaattcttctgcctcagcctcctgagtagctgggattacaggttcgtgccaccatgcctggctaatttttctatttttagtggagacggggttttaccacgttggccaggctggtcttgaactcctgacctcgtgatgtgcccgactcggcctcccaaagtgctaggattacaggcgtgaaccaccgtgcctggccaatttttgtatttttagtagagatggggttttatcatgttggccaggctggtcttgaactcctggtgatccgcctgcctcggcctcccaaagtgctgggattataggtgtgagcccccgcgcctggccatcctttgtattttttgatgaaaaaaaaaaattttttttttttttttttttttaagacagagtttcactcttgttgcccaggctggagtgcaatgagtgcagtcttggctcactgcaattcccacctctcaagttcaagcgattctcctgtctcagcctcccgagtagctcagattacaggcacacgccaccacgcccggctaacttttgtattttagtagagacagggtttcatcatattggtcagactggtcttgaactcctgacctcagctgatttgcccaccttggcctcccaaagtgctggaattacacaggtgtgagccaccacgcccggctgttttgatgaaattttttgaaagaatgtattcatattcctgtagatttcccatttcccacattccctcaaatttagtttccgtgttaatatcttctattaattttgaacagtgtctttattgtagtttatgcaaagtgaggagtgagtgccatacttattttgcttcctgttgagaataaactgaagttaaattactgacattttgcatattatctcaatcattttttaaggacctgtaaaacagaataaggtgaatcctaatttgctagatgcagatttcttgtagctatttttgattcctgcaggctgctctgatttgctacttgaggaggaaagctgatttgggggttttctttttgtcttggttctagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggtatgtgactacttttttagttttatgatttgttggttatcttttttttcactgattaatcagcatcttggccccagtgaatctacgtgctctgccgtgctggtggaagagaatttcatcctttgtatttaagtgcgtcactgatttctgttctgatttgccctgttgtatgggatgacattgtctggtatgtatgctggctcagtgactttctgggtcttttctctcctgctcccctgattttgagagttcatttgttgctaaaggggtaaaaaattccttgatttttcactcatctctagatctgttcatagagacaacaaacacaacaaaaccagaatcagaatagctaaccattgcttaatttaaaaatattagtaaaagagagtaagcggttatctcagcttatgtgtgcttataaaagtccttggcagcaataatggatatttgccctgtggtttccatggaaactgttgccttgctgtaaaagatacgtgataaaaatcattggctgccatggaggcatagctggagagagtgatgtagagacacagtgttacttatttttagctgacctaggtgactactgataattttttacttttctaaataatgtatcattttaagaaggcgtaaaggaagaaaccatcttatattgaattaaaaaattaatagccataataacttttctatatatagttggacttcaggtaattttcacttttgggcaggggaaaataaatccctaatctgtgttagtatgagtctgaataattcctttttaaataaaatgtgaggaaggaggtttaaaaaatggcgtattcccaaagcagcaaaataataatttttaaaaatacttctaaatttgtaggttgttctataatttttccttttgtaaaaagtctgaaatcttttttaacagtgagggcatttttatttttgaagtagaacatcattgttttttaaaaacatgatgttattacactggaaatccattgtagtaaaattgggaaatagattaacaaaaacttataactcaaagtattgttacctagtagtaattattaacttatgtatatgcttccagtcattttttttttattttaaatttttattgtttttatttttagagatagggtctcactctgtcactcaggctggagtgcagtggcatgatcatggctcactgcagccttgaaatcctgggcttaggtgagccttctgccttagcctccctagtaggtaggtctacaggtgcatgccaccatgcattgttaatttttaaattaaaaaaaaaattttgtagagacagagtctccctatgttgcctaggctggtcttgaactcctggcctcaagcaatcctccctccttggcttctgaaagtgctgacattacaggcaatatgcctatgcctggcccattattattattgttgttgttgttgttgaaagtgctgagattacaggcaatatgcctatgcctggcccattattattattattgttgttgttgttgaaagtgctgagattacaggcaatatgcctatgcctggcccattattattattattgttgttgttgttgaaagtgctgagattacaggcaatatgcctatgcctggcccattattattattattgttgttgttgaaagtgctgcgattacaggcaatatgcctatgcctggcccgttattattattattgttgttgttgttgaaagtgctgagattacaggcaatatgcctatgcctggcccattattattattattgttgttgttgttgaaagtgctgagattacaggcaatatgcctatgcctggcccattattattattattgttgttgttgaaagtgctgagattacaggcaatatgcctatgcctggcccattattattattattattgttgttgttgttgaaagtgctgagattacaggcaatatgcctatgcctggcccgttattattattattgttgttgttgttgaaagtgctgagattacaggcaatatgcctatgcctggcccattattattattattgttgttgttgttgaaagtgctgagattacaggcaatatgcctatgcctggcccattattattattgttgtttgttgttgttgaaagtgctgagattacaggcaatatgcctatgcctggcccattattattattattgttgttgttgttgaaagtgctgagattacaggcaatatgcctatgcctggcccattattattattattgttgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccattattattattattgttgttgttgaaagtgctgagattacaggcaatatgcctatgcctggcccgttattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccattattattattgttgttgttgttgaaagtgctgagattacaggcaatatgcctatgcctggcccgttattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccattattattattgttgttgttgttgaaagtgctgagattacaggcaatatgcctatgcctggcccgttattattattgttgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccattattattattattgttgttgttgaaagtgctgagattacaggcaatatgcctatgcctggcccattattattattgttgttgttgttgaaagtgctgagattacaggcaatatgcctatgcctggcccgttattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccattattattattgttgttgttgttgaaagtgctgagattacaggcaatatgcctatgcctggcccgttattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctgtgcctggcccattattattattattgttgttgttgaaagtgctgagattacaggcaatatgcctatgcctggcccattattattattattgttgttgttgttgttgttgttattattattattattattattattattattattattattattatcatttgtgacagagctttgctctgtcccaggctggagtgcagtggcgcaatcttggctcattgtaacctccacctcccgggttcaagctattctcctgcctcagcttcctgagtagctgggacaacaggcgtgcacaagctaatttttgtatttttagtagagatggggtttcgccatgttggccaggctggtctcaaactcctgacctcaggtgatctgcctgactcggcctcccagagtgctgggattacaggcgtaagctactgcacccagccccatttttattatttatagattccttcattatttgtttctttttttatcttacaaggatggaatgctgtgcatcagcactgttcagaaagactttctgggtggagtgctaattaagttgggaaggggattttataacagggtaagtgtcctttagtaggtaccctttcagtggagatctgaagagaagaagccagctttgccaagtaaaataatttcatgaagaagcattaacagttttaaagacctcataggaaggagttttgaggaaacaggagggaggctggagggcaagaatatactgtataaggggaagacttaatgagatgcgaaattggagaggtggccagagtcagattcacttatcacgtatttactggacaccaaccatgcgcacagcactaaggatatagcagcaaacaaatccatgctgtctttgagaaaaagtacctgcctttatgatccttgcagataatgcaaccattttattcaaaatgggagagaaaaccattccaccgttgaatcaagggagtgacacaatctgatttgcttttaaaatttactctggttgtgctgagaataaatggaggaaggagagaagagtgaacaagggagtatagtaaggaatttaactgctgtaatctagattaggggaatggggacttgaaatgattgctggagatgtacagaatatcactagcgtatcaggaagcagcacaaagaattatgggctggcaatgctagggtatccagaaatttcattagttattgaattattgtccatcttttaaaaaaaagtggcatttaatcaattctttttttttttttttgagacggagtctcgctctgttgcccaggctggagtgcaatggtgcgatctcggctcactgcaacctgcgccccctgggttcaagcgattctcctgcttcagcctcccgagtagctgggattacaggcacccatcaccaggcccagctaatttttctgtttttagtagagacgaggtttcaccatgttggtcaggctggtcttgaactcctgacctcgtgatccgcccgcctcggcctcctaatatgctgggattataggcgtgagccaccgcgcccggcccacatttaatcaattctaaaagtcacaactttccctgttttaacaatgaaattgagttaagtgttaacacttggtgtcatgttaacagtctatatcagcaaagcagcagtcctggtatatttgtttgcccgtgtattcacaaatataatcatgtccattcattttgtcatcatttcagctgaggtatgagcattgttggcatttcccatgttaactttgttgttcagtgtttctgcataaatattctgtgaatcagcattgaaacaaaattacccggtatggagaaagttatgaaaacagtttatgatggtatgtgattaaactctgtttaaataagtttaaaaaaactaactcttgcaatcagtattaagtaaaaattctagggcgggtgcaatggctcacgtctgtaatcccagcactttgggaggccaaggcgggcggatcgcctgaggccaggagttcgagaccagcctgggcaatatggcaaaaccctgtctctactaaaaatacaaaaattagctgagtgtggtggtgcacgcctgtaatcccagctctttgtgaggctggcacatggtaattgcttcaacccaggaggcggaggttgcagtgagccaggattgcaccactgcactccagcgtgcagagtgacactctgcctcaaaaacaaacaaacaaaaccctaaatttatgataaagttttgtgtcatgatttatttggaggcatttccactatttcttttcagcatgtacaacagtggtgtgtcttataatcagtggcatcttagatttgatgaaataagatagcattaaaatggcatttgtagctattagtagtaacatttgtaattagttttacgttttctttattaacatgattttgtagctggcaggtaaataattctcccccccaaaagccgagaggtaaaaagtaagatttcaatgaagcattgtattttctgtttgtactcaaatcacattgttgtttgaccgcttattcttagcttttgtattatttcgctgtagctcctttcatttgactgttagaagagtggggacatctcttggacaaatgctgaattacaggcaagacttggttagtgctgagggcttgacaggtgattctgttatacaccaacatttgaggccccaactttggttttcagtccgctagcagaggatacctaagttggctgtggaatttttgggtcttcaatccatatgcataccaaacattgtctataggccaactaaataatatatttcagtatgtgctcctacttacttaaatgctggtatgctattgtgattaataaaatacaactttgttttaaaacattattgcagcctactagttttttgtctgtattttaatcaacaaaccgtattagtacaactgctatcgtgttaggtttgcaaaaatctttgaggttaaaagtgctaatatttgaatatgttctaggctagggaattctgaatctaactagcatatctgaggactgcttgtcagtttgtcagtattactggcagatagaaggtataagcagaggagattaaagaaaaaaagaaacatatatatatgtttatgtgtatttatttatatataaatatatatttttctatatataaatgtatatttttctatataaatatatatatttttctatatatatatatatatatatatatatagaaaaacatagaaaatgaataggaatttaaaaagaaattttttttttttttgagacatagtgtggctctgtcgcccaggctggggtgcagtggtgcaatctcagctcaccgcaacctccgcgtcccgggttcaagcaattcttctgcctcggcctcctgagtagctgggactacaggtgcctgccaccatgcctggctaatttttgtatttttaatagagatgaggtttcaccttgttggccaggctggtctcaaactcttgacctcaagtgatcctcccggctcggcctcccaaagtgctgggacaacaggcatgagccaccacacccggccaaaaaagaaaaagaaattcttagtttgtcttttgtagcaattttggaagatgagaacagttgcataccttatttatttaagttattccttctctctcttttttttttttggcaacagagtctcgctctatcgcccaggctggagtgcagtggtgcgatctcagctcacctcaacctccgccacctgggttcaagtgattctcctgcctcagcctcccaaatagctgggattacagacgtgtgccaccacacctgggctaattttgtatttttagtagaaatggggtttcactgtattggtcaggctggtctcgaactcctgacctcaagtgattcgctggtcttggcttcccaaatgctaggattacggacgtgagccaccgtgcctggcccttcctctcctttttaaattacatcatttgtccttcatttccattttgacaaggtgacattttctgagcacactactattaccagagatggtaatgggttcaggtacaatggtgtgtgacactgggcaagttaagatacgaaaaagtggtaacagttctttccatttaccctcccttcttttttatttctgtctccgctgtgttgtcagtatgataaattcagaaattgaatctgtgaagggacttcccgaacaatgtggagcttctatccttgaaccaagggtgctgagggctaagacttgaaacttgaaaaaaaattttcagacctaagttttactttttagtcacacatacttctttctctcaggtgtgcaagtaaaagttgacttacttttacaaagaaacaactagggaaaaggagaattattaaattttgtttctcaggcgtggtggctcatacctgtaatcccagcactttgggaggcttaggtgggcagatcacttgaggtcaggagttcaagatcagcctggccaacatgctgaaatgccgtctctactaaaaatacaaatattagccaggcatggtggtgcatgcctgcggtcctagctatttgggaggctgaggcaggagaatcgcttgaactcgggaggtggaggttgcagtgagccgagattgtgccactgcaccaaaaaaaaaaaaaaaattgtttctaacttgtttattttctaaatataaattagtcattattctttagttatttaaggagagaaaatgaacatattttttatggtctaccacatttgaaagtatattatagcaacattaaatggactaagacaaaaaaagacaaatagactatataacaagattcagatacttctacctctaattttttcaaatgaaaattttcagccaaaaaggagtgaaataaagtgaccaaatagcatattctacttcttacacttctttgaatagtacttctatttccagtcttctctctctattgacaatgcgggaggcataggcttgatgtgcttggtgggaaaggggagcttatgagctcactgactggaagatgtgttcatagtgaactgtaaggtgcaggcttctgaatgggagtttgttttgagcaatgggttttaaaacgtctttgtagaaaagctttatgcctatggatggtttaaaatacaccccaattctttattgtacgcagggaaggattttttttttttttttttgagatagggtctgactttgtcacctagagtgcagtggcgtgatcttggctcattgcggcctccacctcccaggctcaagcagtcctcctgcctcagcccccgcaagtggctgggactacacatgagcaccaccacacccagctagttttatgtgtttttcatagagatggggattcaccgtgttgcccaggctggtctcgaactactgagctcaagtgatctgcctgccttggtttcccaaagtgtttggattacaggcatgagccactgcacccagtcaggactttttattcaaatggatttttcggttttctttaggaattaggtgatgctcaagaggagaaatcagatgaaataagttgaaaatctaaattgtgtgttattttttaaaaaatgcagttttaatattttcaagtagatacagaaataccaaataaaaatgttgtaaagtataggttataaaattttgttaataaatgaagattgtttacagttagcagagttcattttatttttactcagacaatttaaagttcgacactcatttattgaacaaatactgttaaatatctaccgtgtgcccagtcaatcaccttgtagtgtgcagaacagattcaacatggacaaactaggctgggaggaggctgacgagtttgtcgttttaaggcaggtgagagattattatggcctaaactaattaatgtgttaggtgttgggatggaagaaaacaaataattttaagagattttaaaaactcttttttgatacaatatggaatgcatgtaagaaatagaataaaacaggtgtatagttaagtaaattataaagtaagcaccctcataaccactacctaggtctagaaatagaactttcacagccacccagaagtcctgtacgtgaaccaacccagccagaactctcccttccctctaaaagtaaccagtgttctgggttttatagttatcatgcctttgcttattatacttatcacatctgatccttactatcatagtattgttatcttgtattatatgttaaattaatatcattcctaggtatcatccctaagaattatgtctttgttttgtctgtttttcaaaaatatgctttaaatctcttaattaccgatttgcccttaattcctccttttttttctcgtgcagttggagcatttcttggcttattagctggaatgacaattccatcatctttgtaatatccatgtttatttcagtggaatgacttctctcctggttgtaggtcatattttcctacttcgtgtgtatagaatttgtggtatgatggacattttggacacaaggtgattgagtatctggattttggtaccttccttaatgaagggttgttttgtctggcaagagttaatttacttggggattaacttgatcctttcaagacttgcttttaaactctgttaggcctggtttagaatagccttttctctaggctacatcagctctactcctaagcttgaccttttagtgtctctactaaatgcctctgctgttctccccactatttggaacttgaatttttcccagccctatggggttcaggtagttactcaactcatggctctctgatagttgctctttctccagtagctcttgatcttattttgtggcagcttgccctatacatgcacagcttagtatttggccaaagactcaaggggacccttgtcaggttagacagtgctgcttttctggtaagctcccttctctgtgttttgtttttaatttttaatttttttttttttttttgagacagagtctcactctgttgcccaagctggagtgcaatgtcgcgatctcggctgactgtaacctctgccccccaggttcaagcgattctccttcctcagcctcccgagtagctgggattgcaggtgccccccaccatgctcagctactttttgtatttttggaagagacggggttttgccatgtttgccaggctggtcttgaactcctggcctcaagtgatctgcccgccttggcctcccaaagtgctgggattacaggcgtgagccatggtgcccggacctctggtattttgctccgcaaagttttgcagattaatgggaaccttactcattaaactgtctttggagctttgcaagactgctgttctttgtttgggctttccctccctacgccccatactagacatatctgggccatcaccttgtttattttctctcaaggatcatagtcctgtattgcttgttatccagggtctgaaaacagttatttcatgcattttgtttaattttatgatagtttatgacaggaaggcccatctcaccttatggtcaaagtgagaagtataatggtaaatttattgaaagatttaaagcagattaatgccatgatttgtggatattttatcaagatcaccctggtgctctcttgaaaatagacaaaggaggtggaagaaagctaactagaggctgttgcaaactagactggaaatggggtgaaatggttagactcaagaaatacttccgcactagaacagttaggacctgctgttgacttggttgtgggaaatgaatatcaggaggagaaaaaggagagctttggtgtttggcttgagccactggaatggcagtgccatttaatgagacagagaagactcatctctcatcagagtcaccagatgatgggtgagattgaagaagaggaaatcaagaattttttttgataaaataagtgtgagttgcctgttagacatctaaatagagatgccaaatgggcagttggatgtatgagtcctgaaatcagagcagagggcaggcctagaaattcatcagcatttccgttgtattttaaaccatgtagtagattaaagagtttagatggaaaagagaaaaaggttagaactgatcacctggtcactggtctaatttagacctggaggtctgatttagaaggaagaacctgtgaaggaaacagagaaagtgcaactggagagtgagaactaaaaacaggagagtgtgatgtcctaatagtcaagagaaaacaagtgtctaggagggattgggccgttgctttgaatgcttctgagagttccagggagatgaggacagaaatgtgtttgttagagttggtaacttagaattcgttggtggtcttgatgagttgtttcaatggaggggtagagaaacaagccagattaggctgcttttatgaggtaaagggaatcttgtatgtctgaaatattttaaaattaattaaaataaaaagagtgaatgggagagggagaggaagaaggagagatagcaggtgtggaccagctgtcttcagggcaggcatttgaacaccttggagttcacagagactctgcagtggtgtgtgggcagtttcagattctcaactcccatgtgtcattctctggattttagttggccgaaaacatacctgtgagatcatctttcccctccctttttatggttgcactttgcccactctaactcctgttcatccttcagctctcaggtgttccttaggaaactttacaagatcccaagactacgtcaggatctcctaattactctcttacagtattgtggatattttctttataacactttttacatatgaattatacagttacttaaaaagtattttcattcatttgacaaatatttgagtactatcattgtactgtgtattgttctgggtgctgatatacatcagagaataaaaaagaaaaattcctgggataggagagacaaacaataaacaaacagttataaataccaagaaaaaagtagatcttggttagggagattggggatgtatattagagtcaaatcataagtgaaaatggggtaataaggatgagcctgcttgagactttgattttttttttttttttttttttttttttttttgacagagtcttgctctgtcacccaggctggactgcagtggcaccatctcggctcactgcaacctccacctcctgggttcaagccattctcctgcctcagcctccccagtagctgggattgcaggtgcgcaccaccaggcccagctaatttttttgtatttttagtagagataagattttaccatgttggccaggctggtcttgaactcctgacctcgtgatccacccgcctcggcctcccaaagtgctgggattacaggcatgaaccaccgctcccagccgagactttgacttttgaacagacttcaacagttaagggaaggagagagcctgtcaaagggagcagtgagtgaaaggccttaagtcaagagggtgactgacatgttgaggaaaagcaaagaggtgagtctggctggagccgactggatgagagagaggagtataagagatgaggccagagaggtaacagggccggatcatgtagagccttctaggtcagcataaggactgtgacttttactgtgagtaaaacgagaagcttttgataattgcaagcatattttgacttctgctttaaaaagatcactctagatgctctattgtgaatggtgagatagatttgggagactgttggtgtaatccaggcaaaagataatggtggcttagagcagtgtgatggtggaggtggtaagtttcaggatatattttgaaaatgggaagagcaggatttcctgatgagttggatataggtgtaagaaaaaaagagactcctatgtttttggcttgaacaactggctggatgcataccatgaatcaaggcaggatgagtgaagcaagtttagaggggaaggccaggaggtcacttgcagatgtgttaacagtggggcagatatttgatactccaggaaagtaaaggtacatacgagtatggatttcagtaggaggtaaacatttgggagttatcagtatgtgcatgatactgaacggtaaataccaagggaatgagtataggtggaaaagagaagcctacaaaggactgatgcttgggacactcctgaggagttgggaagaaaagcttagggtaagataggaggaaaagcttagggtgccataccttgaaagccaaggaaagagagtagaataaggaagagggattgagcagttgggtaaaatgctgctggtcaggtacagtgactaaggatgcatcatgggtgctagcaatgtggaggtcgtcagtgaccctgatgaattgcatagatgattatttgattaaactctatttttcctattaaagcttccatgataaaagggaccaaatatgttatttctcattattatatctccaaaacttagttcctggagtgcataaatgggataaatacataggtcccagagcctctgggaggactagagaactgggctccgaagttatatagacaagaataatgcctcgaatcaatcacacttctatattgctttagtgatgacagtgctgcgtggcacaggcatgtgagtgtgttacgccgacatcactgacactgctcaccaccactggagcctctgctgttggtgtgtctggaagcctgaggtagctgctgcctctgccacccactgctggaattgtctgtaaatattcatgtcccggcttcttcatgtcacaagattctgtttcaaagtacatgacgaatgtgtctgattgaggtgattaggtcatgtacctgggctttaatcacaagaaaggctgggcaacaagtatgtggcattttcaatttctgttgtgggaggtagactctgcctttaaatgtggagttcccacacatgctaaggaattcagatatcacacggcgaggaagagtgatgaatgcctgccacggtgcgagataaatagattttgtggggtatacgtgtaaaggtaatagttgaaaccataggattagggaagggctattttggatggttatttgtacgggttgttcaccaaacaagagcttcctgctgatggagcccgtaggccctaaaattcagcctgtgcttcatggtgatgttgcatctacccaagaagggttgctttttttctaattcgcataaagttactctgtggattagtgaaggctttggattcaggctatagaatccagatgttccaaggacaggaatttagaaaatgtctgcaggtaggaaaggaaaagggtggagtttagagctaggataattctttaatggaagccggttgaaaattttaaagacgttccttctttaacttaaatttttttttttctggtaccagctagagtttgcaaaggaggtgaactgacaataactattaggtttagaaacaaggaggttttttatttgctattttagatcgtatggttcagtggagaggtgaggatagaaactggctgatcattcattcatcattcattccttcatctaacaaaagaggaacagatagagaggagaagtaatttttaacgactgcttacatatcagacagtgcctgaggaatacagaagacagtttctaaaagagttcacagtatggtatgttagagaagaaaaactattgctaatacaatggggtaagtgctcatggagctatgtaagctgtgtagcatgctgtatgagaaataggaggtgtacaaaattcagcacaggagtaggaagggactaaaatatttcctttctagctaattcttgaacgtttggtagccatttcattcattcagtattcattccttaaatgtctattaagcgcttaccagtgtggcagctactgttgtaggtgctttggatccatcagtgaatgaatgaaacaaagatcttagcttttgtggagcgtacattctcgtagagaataataagtaaacataataaatcataaaatatgttagagggtaagtgctatacacaggaaaaagtagagcgaagtaaaggggaaggacacatgcgttcttttttggctgtgttaaattttaaaataaggtgtagattatactgaaaacgttgaacattcattttgttatgaaaaatttcaagcctacacaaaagcagtaagaactgcatgatgaatctccacatgctcatcactcagatacaccagtttcgaaaattttgccacacttcctccatgtattcttttttctttttcctcttttctttaccaaagattttaaagccaatccctggcatgacgtcattttcctctgcagactttaatatgcgtctctaaaatatatggacattttcttgcatagcgacaatggcattatcacaacaactaaacctaatactaacacaaaagaggcatttgagccaagactggaaagaagtgaagtcttcccctagcagcttgtgcaaagggcttaaggatcaggagcatgcttagcatatttgaggagcagcaaggagtccatagtggctaaagcatggagacccagggaagagcgatgagatgaggcctttgcaggctgccgagaggacttgggctctagttggagtcgaatggggagccatgacagggttttcagcagaggactgacaaggacaactttatgtttacaagggtcacttgaagtgctccattaagaaaacactgtagtggagcaagataaagcagagctcagttagaaggttgttatggattaaaaggtatatttttgtttagtggttcattccaggtggtggccgtggagatggcaagaagtgcttggattttgggtatgttttgaagctagagctaactggatttcctgactgcggcttgagagcgaaaggaaggcattaagaagactcataggtttgtggcctgagtaacaggaaggatggagcaggtttgggggcaccatcaggagtagagatgacatcttgccatgttgcccaggctggtctcgaacccctgggccaaagtgaccctcctgccttggcctcccaaagtgctgggattacaggtatgagtcatcacgcttggtcaggagttgagttttgagcatgtagagtttgaaatgtttgttggacatgaaagtgagatgactaggtggatagttaaagctggaagtagggagagaggcagcagaaagcattcatctctgtattccctggattcccaagagcctgtccccagggtacttggaagtactgactgatttatttagagacattcacagagtctgacaagaaaatcactgaagtggtttggtaacctggaaggctctgatatcccttccttccttttctatcctgaactcagtaaaatttgggtaaaaaaaaaaaaaaaagctatgtttttctgacattttctgaacctgaactacttaggaaacttgttcaacagtgtcatgtttttcttcctaactgtagcaccactagagagcgagcttcatcgtaggtaaccaggtggtggttattctgggggtggatgccgtggaaaggatgttgtcaacacagattgctttccacagctgcagtcagcaatgcagactgattgtgatggtatttatttctccttttaaaagggagcatttctaatccccattttggatcatttggaattctgattatatttcccggagttatgtggaagattgacacacaacctgaggatgtgaaatcgtagtttcagctgttatggtagctcgtgtctgtgtgactgattttaaataactaggtgttcagagatagggatcctcctatgcctgcatggttgagtgagcctgaatgcagtctgtggattccctgattcacagggaaaggttggtaacacagaaggggtcattgtctcataaggctgtagtgatcttttgcatacatcggctctcactcctctttgaaaaaaatgagggtgaacaggagagcactgaatctctttctgcctcttttctacaggagatgcatcgaaggtttgagaatgctcctgattctgccaaaacaaaagctctgcaaactgttattgagatgaaggtaagtgagaatctagtaaagaatcttatgaattaccttatacttttaagtgatcaaaaacttccatgtgtgagtgttaggaaatggcatgtaatagtatttcacttatttggagattaagagtgagaatcaatgaaaatgacatcttaaaagaatttcagttttatttccttttacttgtagaccataattcaaattggaccaaaaagagttgaacagaatttctttaaatcagctattcgcagatgtcttggtctcaggacccctttattctcttaaaatgacagactcacttccttcattttaagaaaatgtctgccagataccaagtctgggtaaccatagcttgtcagttttctttcaagtaaaaatagtgttccgtgaagaaaatactgaattcagtttacaactcaaagcaacacgagtcctgtgcttagggacagccatcgtatttcagtacgcagcttcattccatttgtcacacacaatattaaaagtatgtgtactccagagttgagatttttttttattattttttatttttattttttgagatggagtctcgctctgtcgcctaggctggagtgcagtggcgtgatcttggctcactgcaagctccgtctcccgggttcacgccattctcctgcctcagcctcccaagtagctgggaccacaggcgcctgccaccacgcccagctaattttttgtatttttagtagagatggggtttcaccgtgttagccaggatggtctccatctcctgacctcgttatccgcccgcctcggcctcccaaagtgctgggattacaggtgtgagccaccgcacctggccaagatttattaaaagtaatactttttactgcttcttcaagggcggtattaaatgaagtagtcttttaaaaattttatttcttatttttcatttttttcctacaagtacttgacgtgacaaatattaatataatgactacaagtatggtttgatgccattgccttgatttgtgctaaggcactagcagttttgcccatcattgctgtatatctttagtgcagacagtggaaaagtcaagtgacatcatggtattattgtgaaaatagttttgatcatgcatactttgtgaaagggttgagggtaccctgagagttccatagaccatcctttgaaaacctctgccttaagttaatgaatatttagaaatctttaggctgttcagtatagtgattaagagcttgctttctaagttaaactccctggattcaaaatctcgcttcacttaaccaactgtaagatatggagcaaattacctatgcctcagtttctttatcaacaaatggtgatagtaatagtactcatccagtgggtcgttttgaggtttaaattagttaaaacatgtaaaaacactttgaacaggacctagcgcatagtaaacattcaatccatactagctgttgcagctgttatttttgttcacaatctgttctttctcataaaagttcatgtagttagggacctccccccacaactacttcttcatatcctctagaaagctcaatactgtgttttgcattgtgggccttcatttaatatttgttgatatgacaagaatatttagtcaatggtatataaataattttatgtaaatagatacttctgaagtagttatgggaactgttgtcttaatttggatgatttcctcttaaaactttatatcgtatacatctttattctcggtggggaaaggatttaccaaacaaattccgaattagtggattctgggttctttgtagttaattggtagtcttgagtataatcttgtaaagggcctttagaatcgttcagttgcatggttttaccctttccacattcaccacaagtttgttgtgttatttcctgatcccttgttaacacctaagaataaaacacatgaatgtacctatgtccacaaaatgatttgtttaactgccttttgacagaatgaggacgagtaatagtattacttggtggcaatggatgcattttaagttgtgtgaaccttcagccattctgctaagaaggagaaagattctggtggcccagtggggtcaagaggatgtgatgctgaaatcacaacagaaatagctgtgttgctgagaatgtggaatgagcttcagagaattatgaaaatctagtgtagtctttagggaaaatagggaagaaaggtgattgaagtaaaagagcccagtaatcttgaaggtgatgcaattttctttgccctctcctctttcgcctcttcttcctctctttcctcttcttatcccttctcccaccattttccctcattccagcctttccttctttgttcctcttcttctctttctcttcctcccctttctctactatttttttgtttgtttgtttgtttgtttttcctttaccagtggaggaacagggaagaatgactgtactgctctagggttagagttttgctgggatagataaagcagagcgagtgattgggatgcaaatgaattgagggtgatgatgacagagtagtttggacgttggtcctggactgtaccctggatctggaaagagtaaaattcaggtggactgacaggttgggagaaaatgtaaaagttaggaaagtggaattctctgtgaggttgaacaggaaataatcagagtgagggtatgacaggccaggggaagagagttctggatgatgataggatccatcagtcctataaactggatcacccaaatggactggaggatgagatcattgcaattaagggcgtcaaagaattctgacattgcaatcctcggattatggcaagagtggtgattgaaggggatattgtaagccaggtgccaaagacttccaaaaatgggcaggagtgatggagaagtccctggatggcagcaatggggagggtagggtgaaaaggagtatgagctttccataaagggaaacagccttgaagaactgggagaatgtcaaccctttcccctgctcctttgtggtgttggggtgttattgaccttcactggagagagttcatgggaaaaaggttgagaatttggggaatttgacaaagagcagaggatttcagtaagtccagtgggattggttggttaatgatggaagggctggggctggggaagtacagagtagtaaagtgaaaaggaatttttttatttaaatattacacattctaggaataagaaacctggttggaatgactttccttaaacccagcattggtacccgttgggttggtgctagaactagttgagagtatcaggccttaattttctggcctgatttccttggtaggttcttcttctggtcagtcagtacctgcctcctggttttcagagctggagtcatgatccctttttgggaagaaggttttatggctcatgatttggtagtgagggtgctaatttgtcaaaagctgcctttgtctgtgtttagggtaggggagaagttagattatatttttaagggccttgtagagactttctagaggctctgtacaggttccggctgccatgtgatgtacagagttggagttcttacctgggactaaattgtcttgagtggagccccagtgctgctggagatacacttccctctttcagctggtccagtttcattaccactcaggctgatgacagaggagaacttacctttaactttcactttctttcatttgtaggctagtcatatgcttatgcctagtattttagtcttttttaaggtgctgtgttctgatatttccagagaaattttatagcaatcttaaaagtgaattttcaggtagtgcaattgaagtagtactttttatgggtcagtcattccacatgagtaaataaaaatcctggtttaggtatagaatgactctgattgtattaattcagtacaatggattttgaacaggtacattttaagtttaatttgaatgaatttataaaagacagttttcattgtgatatttttaaaggtcacgtgatgagcaagacagaggaatacatcctctcctcccctcccttgaacctgaaaatagctaggtgtagttttctcgatataaagccttaatctctctcatctttatgctctgagaataaaggagacttaatcaagaaattattgaggtaaagtagaaaaggagttaatttcaaaatagcttccaaaggaatggtttatctaaaactccaagtgaaataaagctaagctatacttaatttatgctctttaaggtctctatttctttggtgagtaagcacctgcagctacagatacataaaactattcattccatgtaggagtctttctgtaattcatgacatgtaaagtagcctggggagaaactaggtactgcgacaaacaaaatcaagagatcgaatatgaaataatgttctgttggaaggtgatatttgtggtagagatgatggtttataaggacagtgatttttaaaaattaagaattattttaaatgtatgaagtacagacaataaggattgctaacatgataaataacttaattattcccccatttttctgcagtgggatgttatgtaatttttattattgcacatatagctgtacacgttactgtataaatctttgaaaccctcttacttttttcccctcctttggggcataatatgttttttaggggtcaccaagtaaaatgataaaatactagaactagaaaaggctttactattaatattggaaatttttttcaccagaaatttgtaatttctgatgcaaagaaattttaaccagtttttcattgcatttacttcttcagtaatttagtaattattttcaactttaatttaaagggtgcagagctggaggcagccatagaagaaaaatcatactgtggatatgagtgcttctcctcccactcaaatggctgtaaaggacgtattttagaaggaaggcactggctgggcatggtggctcacgcccataagcccaccacttttggaggccaagacaggtgtatcacgtgaggtcaggagttcgagaccagcctggccaacatggcaaaaccctgtctctactaaaaatacaaaaattagctgggcatggtagcgtacacttgtaatcccagctacttgggaggctgaggcaggagaactgcttgaacccagaggcagaggttgcagtgagctaagattgcgtcactgcactagagcctgggcgacagactctgtctcaaaaaaaggaagcaaggcaccaattgccagacagcattttttctgtatatttgtctatctttattaaatgtaacttctttaaatatcatgttattcagcttttctgggtttttgtgaatacttcaatcactaaatcttccattgtcttcaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtaatggcatgtgagacttttgattcttaaaaggagtttgaaaaattgatgcatattttttacttctctagtgatgataaagccgtattttacactcttttatcaggtttcagggaagaatacttttagcatagttctttcaaatgaaacttctccagaattaaagtcagaattactgacatagatagttactacaagtttttacttataaagacaattctctgtatgaggctacatatgtattgtcatggtttaagttttcatatctattagtacttccgaaaaacttccagatgagtttttctcactatatgaaacatcaggttctttacctcttgtgaattatttaaaaagtcaaaaccctaagaggcttgagatggagtttcgctcttgtcacccaggctggagtgcagtggtgtgatctcagctcactgcagcctctgcctccatgttcaagtgattttcctgcctcagcctcccaagtagctgggattacaggtgcgtaccaccacacctggctaattttttgtattttttgtagagatggggtttcaccttgttggcctggctggtcttgaactcctgacctcaggtgatccacccacttcaatctcccaaagtgctgggattacagacgtgagccaccgtgcccagccctaagaggctttttaatgaaatgggtgaaatgaagttacgtttcccctccaaatacagttctgtaacggaaagccctttctttgccctatcctgtggggaagatccacttgctgtcaggtttattgcttcccatgtgcacttcaggcgtaatatgacaaagattgataccaccaagacctatcagtctgtgtttatcatcagtcacaatgttccttccttgtatccaaagtcatttagtttgattctgtaaactatttaggcaagttggaggatttagtttatcacaattatcaatttaccagttttgttgtggtttcattaaacattatgattgtaattataaagtttaagccagaaaataagtgttttccccctttatttcccagttgtattctccaggttcttagaaatgaaacccgcaacatcccagtagtgtgaaggaatgataacatcacttcccctccagtttctggcttcttgccatggtgcccatacctggcatataagtctacagaatattcctctgctacctccagactctattattaattatttctactactttcatttcagttttagaaattaaaaactcacatacccaactttttttttttttctttttctttttttttgagtcggaggtatgctttgtcgaccaggctggagtgcagtggcgtgatctcggttcactgcagcctccgtctccagggttcaagcttcagtctgctgagtagctgggattacaggcgcccaccaccatgcccagttaatttttgtagttttagtagagacgggtttcactatgatggccaggcaggtctcgaactcctgacctcaagtgatcctcctgccttggcctcccacggtgctgggatataatcataggtgtgagctgctgcgcctggcctcacataaccaactttctattagtttggatttttcaccctgatttgagaacaagacatagtgccgtatgatctctgtgtttatgtttttcatttgttgattagcacattccagtccactgtggggggaaaaaacctgtgaacttagaaactacctatggctctttgaagagggaatgaggggaacagatttgattgtattatataagttattgttatttctagttaccattctgcctcaaaagtagacaagaagaagacctaagttgacacataagtgaaaaagaataataatgtcgtgacaggtagaacaactgaaggaggaactaagttcgaaagaggctcaatgggaggagctgaaaaagaaagcggctggtcttcaggctgaggtctttgccgtaagatttacctctttgtgtgcagtggtcccacagtgggaccctgctagctctatggcttctgggtggcttaccctttcattctctatggttggcagctttgcccattactagcactaaccagcctgctctgctctttaactgactcctgttcactagtttgacccacatgtcactttgtgtgcagtgagccttcacgtgttctggaagccttgtacctggtactttattgttgcttttgtcactctgtggatggtatttcaaagcctgtttctttctcaaccctttattgttggtttatatgaatggcggccttcttttcttcctaggtacaagaatatatgcagttgttctaggcctatcacctagagtttatttgaatttgaaactcttgagcaaagtgctttaccttatgtagacattatctttaagtctccagtgagtgattttgccacaaatgttactttctttaggacagatgtatagaaagtatttatctagtaaattgaaattactaagagacttatttcaggtatctaaatctagttcaatattctaatgaacttaaaatttcaattcagaacataataataaaataaatacagttggccctccatatctgtggatttgcatctgtgtgtttaaccaactgttttttattttcagggtaaaaaaatggatgttgtgtctgtgctgaacatgtacaggcttttttcccatgtcattattccctaagcaatacagtatgacaactatttacattgtaaatatttacattgtattacgtattacaagtaatctagagatgatttaaactatactggaggatgtgcataggttatatgcaaattctacatcattttatatcagggacttcagccttcattaattttggtatccaaggtgtgtcttggaaccagtcccccatggacccatggataccgagggatggctgaataataaagtagctaacacttgcacacttactgtaaacattttataacgtgctgagttagacatattatcaactccaaattatagacgaggaaactgaggtaacagaatggtgcctaggaaaacacagctagtaagaggcaggatttggttttatacaggcagtcttcttccacatactgcttacaagttctttactgacctatactaggctgtgcacacatttgtcaaagtgtcagcaaaaactgcttctgaaaataattgtggctaagactggaataaaaaaatacagcatttaaaaaaccaaacttgggctacttttgtagatttgctatttatggtccactttatagtatatattaaaaagggaaatattttggtggaaagggtctaatttggtttatggaaaccatatattggctagagggaaggttgatcaataacttcctttttaaaatagctactattagtaatttctgcattgagtcagacaacaggctaagcacatttcacgctttattttactgaatccataaacagtacagtggcattcgtataatttctccttattactaattaggaaactgattaggaaagtaattattcagggacacatagctagcttagttctgataggtgaatgtctgcaaagccttgtgctcctaagctttgtattatatttgcttcccctttataatgtcttcccttctcagtctttaaggaaaatttgtgcttctaaactctgcttttcttttctttttttctttttctttatttttttgagacagagtctttctctgtcgccaggctggagtgcagtggcgagatctcggctcactgcaacctctgactccctggttcaagcgattctcctgcctcagcctcctgagtagctgggattacaggcatgcgccaccatgcccagctgatttttgtatttttagtagagatgggtttcactatgttggccaggatggtcttgatctcctgaccttgtgatccacccgcctcggccttccaaagtgcaatgattacaggcgtgagccactgcacccggcctaaaccctgcttttcatttaaaatattttcttttctttcttagtctttaaggtcaatatagcattatttgaagcttacttaataatgcagatgatgacgaaacagatttttatatttatttttgaccacgtgattggaggtagctggaaatttgaataatcttagtcatagttctttagctgagaaaatggtaacactttgaacatcccccaaaatattcattcatacaacaaatgtgtttttgttacaatcagtgtgttagggaatggaatagtgttaatgggttgtttttattggtgaagggatatcataaaagactccacgttgttacagtgtgtgctaactcttgggtacatactattttgcaggatgaatatagccaccgtttaaaattatcttccactgatgtttttagtatcctcaggtactttgtatacaataagcatacagaaatatttgttgaatgaatgaataactatatctctaaaaagagattttatgcatatgagaaaaatacttaatcttttttgaaacagaaggctaaattggaaatttatttttggtgttcctcaaaggtctaattttaattaatgtgaaatttatttcttcatgggaaattgttctcaaaagctttatcccttatacctaagattattacaattacaatactttagatacattcaagtttttgaaaatgaaaagataactttttgtttcatcagtgacaccgaaattactgacttgtcaaatgtatacttccaataattagtatcttttttagttccttgttaggtggtagacataatttaaaaggagatgtaatttctgtttacatggcttccatttagggtaaaaaactatttttaaaattcttagaaaacaggaatgtaaagaaggtgttagaaagaaaatactttcaatgttaagagagaaattaatcaatacacataacatcaaattataggattttacaaaaccatgttatgtataacattaaaagtggctttttaagataagaattttatgcaaacttttgagaatgaaaaagataacagtgaaaaattagcacaacagcagcagattttgaattttaaatagtactaggaggtttctaaaaccttttttgttatatctgcactcatcctgcatttgatccatcatgttctgaagaggtctcacctagaaaaatgaaaaccatttcatcagtacagtggtgttcagttgcttactgctgtctcatagtcatctaattgaattggaatttcctttccctccattccctttctaagaggtttcaaagaatatttagaagacacaataaatgaaaactggacatttccctattggttgaataagtttagtggttttttttggctcagggttggggagatccaaggttatgtcatgcaaaaagatgaatatgacctatcacacagttcgtgctgcatttagtttcatattttgtgactcagatctgtgaaagatacagataagaggtgtttgttttatttcttttttccttaaagtgttttacttcttttctagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtagaaacaattctgggatttgtggggagttggtttcttggcaccttttcataagcgttacctgtgctgtttttgttatgtttagaattgggaaatatgagtaatgttatgattaattcttcagcagcgtgatcagtcactgtgctaaaatgtaaccatcttatttcagttgttcttagatctaacaagttaaaacaggtgcagtttatgtttttaattctttaaacttttgccaagtctgtacttcaaagtatactctgacagtattaaaaataaaaggataattgtaaaagagaaatcattgatttagaagcttcagttcaacccctggtgaattttctagtcatgaatgacaatgagcttggttacactgtgtttggagtacatttaagtgtctttaagttgtgatattatgaataactgtatataggaaactggaatctgttaaagttctagatagtctaattttaaaccacagattattagacaatgtgtcttcatatcctgtttgaaaataaagttagtgtttttagaattttttttttttttttgagatggcctctcgctctgttgcccaggctggagtgcagtggtgtgatcttggcttggcgtgatcttggctcaccactacctccgcctcctggattcaggtgattctcctgcctcagcctcctgagtagctgggattataggcgcatgccaccaagcctggctaatttttgtatttttagtggagatggggtttcaccatattggccaggctggtctcgaactcctgacctcttgatccgcccgcctctgcctcccaaagtgctgggattacaggcatgagccaccatgcccgggcagtgtttttcaaaatcttggaagatgatctagactattggctatgacttcagttaggtatccaccatcttcagataggtatatgacttcagatagatatttagtgtatttgctaaataatcccagatcgattcttatctatcttactttcaatgatcgaagagaaagagttgatgataccatgtggatttactgtcttaatataaatattttttaaaggttgcagtgaaatagataatttaagaatagataagtagttttgctttatagaagaaacataaagcatatgatgtagattagctttttttctttaaagaaaaataagaacataatttggtggaaaaaaggaatgaggaggaaaagaaagaataaaaacctcatagtcttagaagacaagaatcttccaataaggaagaatgaagaaggaacctaaactgtttcatgtaatatttttatctgtacaatttggggctttgttaaaaatgggagattttagctgacatgtttgtcatttttcttataacttacactttttctattttagttatgtttcattttgttatgatgtcagctccattctacctcacagagatatttgggtataaaatcatgagatgcagtagtggctaaggctttggctctagagtcatgtttactgagtttggacttccatctttaccacttactatgagtcgcgtgatcctgggaacgtattcaacttccttacacttcacttttcacgtctgtaaggtgaagagaatagtagtgcttaactcataagtttgttgttagaattaaactcgtttatttactgccagtgtctggcacatagtaaagtctttgtacattcgtcattgttatcattttataattcttctaataaaatcaactaatgcatatactgttgagatgttaagagaacatagtatttagatgatctgcattttcttacttttattaagctaaacttaggtttattcagggaattataaatatgaaatcatctagataatgttacctgcaaagttattcatttatagctttattttaaaaattttttgtgggtgcatagtaggtatatatatttatggggtatgtgagatatttaatacaggcatacaatgtgaaaataaattatggagaatggcggtatccatcccctcaatcgtgtatcctttgagttacaaacaatccaattacactctttaagttattttaaaatgtaatagctttattaatcgtttttcacttcagtagcttgagtgcatgcaatacagcaaaagggtcagaagagggtgccagtgttctagaggtcagccgcacttccaagtttgctactgtaatagctttggatggaggtggcaggtgtacaaaccagagaaccaagcagttggttaatgataatgcaaacatttaaaagcttgtcacagtctaataaatgacttttcccccttggcaatccatgcttctctttgtacccccctcaaataatattcttattagccaggtctcacccagatgggcttgtgattggtttcttgtaccatagagaatagattgtatttattgtcattcatgaatggtttttagtttttagccattgcaggagtagctgagtctcagtgattatttctgtaagttactagggccactgcgcaaatagaaccatctcatcataaaagataaaagaatgaaagctaactttctttggaatttgggatgattttaagaatgtaatatgtctatttattagcattgcttaaaaaattactctggtggcacttgacaagagtcaccttttccaatgtaacttgccagtgttagagcccagtaaaaggcagtttataccagctctttgaaagttttcatgtgtttctataatttgctcttagttgatttcatcttttctgcagctatcccagacttcgatctaacactcggattactaaattaagtatatatgaaaaaagaacatggagcatggagtttttctttcatttttatttttagagatagaatcttactctgtcacccaagctggagtgcagtggcatgattatattaatagctcattgcagcctggaactcctgggatcaaacgcttctcctgcctcagcctcctgagtagccaagacttataggcatgtgccaccacacctggctaatttttaaaactttttgcagagacagagtctcactgtgttgcctaggctggtctgggactcctgagctcaagcaatcctcctgcctctgcctcccaaagtgctcggattacaggcgtgagccactgtgcctagcctggagtttaaaaaattttaaaaatcctttaaggaaaacagttacatgtgaaaagatctgtttgttttttgttttgttttgttttttttgttttttttttccctattcagggtacatggactaaggccctctggtgttatacaaggtacagtatatatggaatcgctcccgttttgtaaccatctcttttaatctgatgactttcacagaggtggtctggatttagtaatatagtggttaaaagcatggtctttggtgtcagacataggcttgaaaaccagccctctacctttactagttgtgtgaccttagaggagttactttacttcttctttgtgtgtgtgtgtgtgtgtgtgtgtgtgtgtgtgtgtgtgtgtgtgtgtgtgtgtgtgagatggagttttgctcttgttgcccaggctggagtgcaatagcacaatcttggctcaccacaacctcgcctcctgggttcaagcgattctcctgccacagcctcccgagtagctgggattataggcatgtgccaccacacctggctaattctgtatttttagtagagatggggtttctccctgttggtcaggctggtctcgaactcccgacctcaggtgatctgtcctcctcagccacccaaagtgctgggattacaggtgtgagccaccgcatccattcaggagttactttacttctttaagcctccatttcctcatctataaaatgaggataatgataataacaacttcctaaggtttttatgactaggtgtttaattctgttctcatctgaatatggagggacatttttttattaatttattattttttttttgcgacaaggtttcactttgtcattcaggctgtagtgcagtgccttgatcatagctcactgtaaccttgaacttctgggctcaggtgatcctcccacttcagcatcttgagtagctaggactacagatgcaggccacctctcctggctgattttttaatttgtattttttgtagagacagggtctcactatgttgcccaggatgttcttgaactcctggcttcaagcagtcctcctgcctcagcccccaaagcacaagaattataggcaggagccactgtgtccagccatggagggaaatttaaattcagtgggttaaaaaatttcgaaacaccttacagtttatagcactttgatttgatttgatctttattgttttatttgctcttcatagtaatggcatgggttagacaagataattattgttgttttgcttttataattgagaattttgtgaactgcttattagcataccacttttgactggcacttgaggctactctcactagtaacactgggacttttgatatatcatttacagtattctcaagaattaaagttcttttcttgttccaaaattgtgatgctatactagggacctaccattaaatgtattttcaggatgaattctcaatgtgcagagcagagctgattgtatcaataagccaaaataatgtacaccttactgcttcaaagtagtacaggtttttccccttctccaggaaattgtgttttggaattctgtttattataggtaaggaatataatctatatcttagtaatagtaagaggaagtggttctttttttcggaggtgctcaggagatcagcatctagcacaaggtgaggacctgcccttgctctaggatgttttggcactaggcactagagctaggatgctgttgtttgacgtgcaccctctgcttgcagtcccagcccagttctgacttcttcagcatactaagagttagtaatacattcttagaactagagggcatttttagagatcatccagtctttccgtaatttaaagaatatgtatgataatatctaacctgagtcttgtaccatggagggtttgtatactttcattttcccagttaattcttagagtaaccttctaagaaataagaattgttgtaacattttacagatggggagttaaaacttagagagactgaggttacatgacctagtgcccgatcgattcaaacccgcaaacttgcgttcttgatcataacgctgcaattcctccctgtgcagagagaatatagtgacatgctgaaggcctatacaactacttggtattagttttgggactggaattcatcatttctgacttcgctaattatgatgtgcatagacgaccatgactcttgtttgattggtaggttgaggactagccacaaagaaagatggggagaagaagaaacaattcatgttggtagagaggagaaaaggatttaggttgatggaattacatagcctcagaaagagataggcatcttttgtgacgagattgtgaaagaagagaaagatgtattgattgatctcttcattcaacacggttttgggagtacctgctgagaacccttctgagcactggggatacagtggcaaatgaaacaaaggctgatgatctctatctctatctctatctctatctctatctctatctatctctatctctatctctatctctatctgtgtctctatctctatctctatctctatctctatctatctctatctctatctctatctatctctatctctatctatctctatctctatctctatctctatctctatctctatctgtgtctctatctctatctatctctatctctatctctatctctatctctatctctatctgtgtctctatctctatctctatctctatctctatctctatctctatctgtgtctctatctatctctatctctatctctatctctatctctatctgtgtctctatctctatctctatctctatctctatctatctctatctctatctctatctatctctatctctatctatctatctctatctctatctctatatctctatctctatctgtgtctctatctctatctctatctctatctctatctgtgtctctatctctatctctatctctatctctatctctatctgtgtctctatctctatctctatctctatctctatctgtgtctctatctctatctctatctctatctctatctgtgtctctatctctatctctatctctatctctatctgtgtctctatctctatctctatctctatctgtgtctctatctctatctctatctctatctctatctgtgtctctatctctatctctatctctatctgtgtctctatctctatctctatctctatctctatctgtgtctctatctctatctctatctctatctgtgtctctatctctatctctatctctatctctatctgtgtctctatctctatctctatctctatctctatctctatctgtgtctctatctctatctctatctctatctgtgtctctatctctatctctatctgtgtctctatctctatctctatctctatctgtgtctctatctctatctctatctgtgtctctatctctatctctatctctatctctatctctatctctgcctattgatatatctgtatatatctatctaaatctctgaaacagctgctcagagtaaaagaggactgggtgctatgaaaagagatagggcttagaatctttttcagatgagtgtgtttctctcactgttgtatgtgggttgttgagttatggggtaggggttgggggtgggtgctgcagggtgacactggtatgatattcaagtctgcttgtgaaggtagactggctttggagtgctccttcccctttcagcatcctctctatacctggggcagagcatttgttctagcagcggtacagatgatcatgccagaggcgttctgatctgggaggcttgcttcctgccacaaccactcccccagctccagctggtgagatggcactgcttacggtggtgatggggtaatgtcttgtttgtgggaagatgtagatactgataagcttaagaagttacattaagttacttaagaagataatgataagcttaagaaaatacagttacttaagaagataatgataagcttaagaaaatacaagcataagtatggctcttaatacgctagaaaaatcaaaatggaatgtataagtttcaaaccgtcagagtaaaacccagtttacccagtggagaatagagaagaatggggaggggagagaaagaaatgtgatagcatgtggacaccatgaaaaagaaggctgagataagtacaaatcatgggaaagtcaataaatacaaataagtacttagatcaaaatgaaaatataaatctcagttgggctaaaaagatacagaaagatactgtcaacaagagttaaacagacaaaaagtaacagcaaagttaaaaatacagagatagaaaaaaatttaaaaataaaagttatatcaggaaaataggccttcccaaatatgatttattttaatattgattaaattatcttttaaggcacacagagcaatgttatatgctgataaaagaaacagtagatcaagaaaatataaccgtgccgatcgatgcacctaacagcatggcatttaaatacataaagcgggccgggcgcggcagcccacgcctgtaatcccagcactttgggaggctgaggcgggtggatcacctgagttcaggagttcgagaccagcctggccaacatagtgaaaccctgtctctactgaaaatacaaaaatgagctgggcgtggtggcacgcacctgtagttttcagctacttgagagcctgaggcaggagaattgcttgaacccaggaggtagaggttgcagtgagctaagatcatacccctgggtgacagcgcaagattctgtctataagtaaacaaataaatgtatatatagcagcaatgaggtgaaacagataaatcaacaattgtagttggtcatttggatgtgctcctgtcagaatttgatcaaataaagaagcatcaacataaagttttaataacattaacaagctcaagttcatagatgtgtatatagaattttgtcctaacatagagaataaacaatattttcaagaacttactgaacagtcgtaaaaactaaccatgtactgggtcataaaggaaactttaaaattcccaagagtcaaagtcacatgactttgcactcctaatgcagcaaaattagaaatcaggagtaaagatagtaaagtagtaataaaggtagtaaagaacagcagcagaaaaccaaaataagtatataatcttgaaacatactaccaaaatgacctgtgggttaaaggaaaaatataaacatttaaaaatgagtggcagtgaaagctctctatataaaaatttgtggaacataattagaaaaaaatctgtggggtgtaactaaagcagtatttagagggaaatagctagtttttaacatatttatcagaaaataagaaagaaaagcaagtaatctaggtgttcaaatcaggaaacttagaaaaaacagttaatccaaaaacaataaagaataataaatataaggtgagaaattaatagagaataaaacaacaccaagaggtagttatttgaaaaaggttaataggacaggaacagctcttacagatgataaaggagaagtaactactagtactacagagtttaaaaataatataagacaactctaaacaattatattcgaataagcttgaaaaacaagaagaaataagtttctggaaaaatataaaatgacagaagaagttcaagagataagagaaaacatgaacaacagtcgttatagaaattgaaatggtaatcaacctcatccctttttccctcccaaatcctaaggcccagatggctttcgaggagaaaatatttgatattttctttctttttttttttggagacagattcttgctctttcgcctaggccggagtgcagtggcacaatcttggctcactgcaacctccacctctcaagttcatgtgattctcctgtcccagcctcccaactagctgggactacaggtgcatgccaccacgcccagctaattttttgtatttttagtagaaatggggtttcactgtgttagccaggctggtctcaatctcctgaccttatgatctgcccaccttggcctcccagagtgctgggattacaggcatgagccaccgcgcccagcccaatatttgatattttctatcaaatatttaaaaatagtcattttcatcctcaagttgttccccactccccaagaaaaaacaagaaagcctaatactctacccaaggatatgaggaaaaataaataaattaaaagatactccatgtcaatagatggtataatttaatcctgcagggatatcagttttcctgaagttaatgtatatattcttctgcatttccaattaaaacaccaagcagtcggccgggcacggtggctcacgcctataatcccagcactttgggaggctgaggcaggtggattatctgaggtcaggagttcaagaccagcctggccaacatagtgaaaacccgtctctactaaaaatacaaaattagctgggcacggtggtgcgcacctgtaatctcagctactcggaaggctgaggcaggagaatcacttgaacccaggaggcggaggttacagtgagctgagatcgcaccactgcactccagtctgggtgacaagagcgagactccgtctcaaaacaaaacaaacaaaaaaaacaaacagtattttttaggaattcattttattttaaattttgtaaggaggagttacaaaaagacaaatactacatatgattccacttgtcatacctagagtcaaattcatggagacagaaagtagaaaggtggttaccagcggctgggaaggagagaatgtggagtttaatgggtatagaattttagttttgtaaggtgaaatgagttctggagattggttgcacaacagtgtgaatatactcaacactactgaactgtagacttaaaatgattgagatagcaaattttatgtctgtatatcttacctctattaaatttttaaaaatgtatatggatgaataaagctattctaacattaaacaaaaagagaagagaagatgggagaaccctgccctgtgagacatgaaaatacagagtcataaaccaaacgaaaccaaacagtgcacctcagaacagtgcggtaactagcacaggaaggagcagatatgaaaagaacagggagtgtgaaatcagaaacatttatgtggagagatagtcagtcataaactagtgcaaaattaagcaagtatgagaaaactgacataccatatggagaataaagttggccacctacttcatgctagatgaaacagtgaactctagatggattaaagacctcagtgttaaagagaaactataaagctaatcaataaaaatgtttagtaggaatatattgggtaagataacttaaatgtctccatcaaatttaagcatttctgttcaagaaagaaaaccattggcaaagctaacagatgagattgggagaagagtttttttagagcctcttaaaatagtaaggattcagataaagaataaaaaagagatgcttgaggctaggtgtggtggctcacgcctgtaatcccagccctttgggaggctgaagcgggcggatcatgaggtcaagagatcgacaccattctggccaacatggtgaaaccccgtctctactaaaaataaaaaaattagctgggcgtggtggcacgtgcctgtagtcccagctactcaggaggctgaggcaggagaattgcttgaacccaggaggcggaggttgcagtgagctgagatcatgccactgcactccagcctggcgacagagtgagattctgtctcaaaaaaaaaaaaaaaaaaaaaaaaaaacctcaaaaatcaatagagactatagggagagggaaggatttgaatagacaattaacagataaagaaacctaagtggttaacaactatgccatgatatcatcaatcttactagtaaataaagaaatgcaaatttcaaagatgatgaaatactatattttgttcatcaaattgataaaaattagaatgtgagataacattcagtgcttgtgaggatttgggcaaacagtaacacaaatgacgtaggtggtttcagtaatcccattccttggtatatttcccagaaaaactttcctgctggtccacaaaaggacatgtataaggatgttcaccacagtattatttgtgggaagaaggaattaaaagcagcataagtgtttattactagggggttggataaataaagtattgtggatatgtaccatggaatactgtacaaaagtcaaaagcagtgatgcagaagcagggatagatataagtactatctatgtttacttttttttttttttgagacggagttttactcttgttgcccaggcttgagtgcgatggcgcagtctcggctcactttacagtacttgttacaagtagtgtgttgtttaaaaaacagcatccatcccgttttttaaaagtaaaaaacaggttgaggtatgtaacattaatataaattgaaaacatgtatgaatataaaaatcaccctctgtgtttctaagatacatattcaggaacatattaaaacatattagaatagctgcatattgaaggagggatgggtattggacataaatggaaaaagaggaaaacaaaacaagagtagaacttcacatgaatcaacgataacacttggacagcggatagaccttggtcctaagtgagatagggatctgaagccaagacctccgcataaatctagtactatcctgagaaaggtcggacgagaaaaaaattcctcctaccagtattaatggcaatatgagagactgacttattctccttggctttgattttgtggagaaaggtctctcatcatgcaggtttgagtttgaatagacataactgctctgaagggacattctctcaacctagtacgtgtagattcccacaggtaaaagcattgcttagaatgaatttacaattccacattagttaatcacttgtggattgtaatctcccctgaaccaataatgggagtaagaacaaatggagtgatcagacccttaggaacgctggataatagaacgagagtataaactaaatgattaaaggacggactgagaggcatgggcacactctccagaatggatgatcagatatgacttgttaggatgttgtttcatgactattgagagcaaaagctgaagtagcactaggtttttaatttttattttcttaatttttaatttttatagagacagaacctccttatgttgcccatgctggtcttcagctcctggactcaagtgatcctcccaactcagcctctcgtagtgttaggattacaggcgtgaggcaccgtgcccagctagcactagctgtttagtacagtgtgtttgaatcttgggtctgccacttgctgtatgagtgtatacttttttgcctcagttttctcatctgtgagaagaataatagccttaccccataatgttgtgagaattaaatgttaattatctatgtagtaacactcagtaaatattagctattataattaataaatgcataaagaaatgatttaaaacgcgaggaaaaaaacaaaggtactgtaaataaaaccaaccgggttataaaagatcaaaacaggattttagacatgaaatatatagtaactaaaatggaaaactcagtatattagtgtagttgcagattatagagagctgcaggaacagttagtgaattggaacatagatctgatgagctattacccagcaagcaataggaaagataggaagatagaaattattaaaaagaactctatgtaaattgagcccaacttatatgtaggagtttcaggagtggataaagagaatgggaggcaatcttaagagagaattgctgagaatttttctgattttgatgataggaatggattcttcaattcaggaacaaattattcttgagcaggaaaatatctacacctacatacagcatagtggaaccatagataaactaatcttaaatactgccaggtagactgggcatgatggctcacgcctgtaatcctagtggaggtcaaggtaggaggatcacttgagaccaggagtttgagaccagccggggcaacagtgagactgcgtctccacaaacaacaacaacaacaaaactaacaacaacaacaaaaaactaaccaggcaacaacaagaaaaaaaacttaccaggtgtggtgtgtacatgtagtcctggctactcagaagtcgaaggcgagagtatcccttgaccttagctaagggcttcagggcagtagtgagctatgattgtgccactgcactccagcttgggcaatagagcgagaccctgtctctaaaaaagaaaacaacctgctggggagaaaaaatacattacgtgtaaaggattaacaattaggccaacatcagacttttcagttgccacaacagtagtgagaatatggtagcgtaaaatcttcaaagtttagtgaaaaacattggcaactcagaattctgtaccaagctgaactctcatcattcttcagtaaagatagaagaaagacttttactttcagattaatacaaatgagagtttactacccaggatccctatggaaacaactgttaaaagatgtatgttagaaagaagaaaagaatgagatgcaagaaaaaaaaacaggagatgaaaaggcattaatgtaacaggagaaactaatctaatatcaatataatagtatggcatagaccttacagtaatagtgccgttacagccaaaactcgcaaatcaattgaggtttattcagtaaaggtgaggaatttcagagaaagatcacaaaaggaagagcttgtctgttgcttctccttgttggtataatgttgctaaataatacagcaggtggaattctgcatctagattgtttctatcttccctgtcaagagcataggaatgaaataaatggaatatatatttctacagtggcaaaatgaaaatgaagctcaaggtgtgtgaagacagaaattgtaagaaagcgtaaagacctctgcaatggccaggcagagtgactcatgcctataattccagcactttggaaggccgagacaggaggatcacttgagcccaggagggttttcacatagagaaagctataaggaattctccctttctgtgagggttttcacatagagttataaggctttgttgatcttagttctgataccagaacgaggaagtgttatgttatgtgttggcttaaggggtcaaagtaggttggctgactgccatgctttatcaggtttgcagaggccaagagttccttggggctgcatacctgaatagcacttattgcagtatactttgtgtagccaatactgtgtcttctttgtctgctatgagttttcaagggaaaatgagtgaaggtatcaacattaatttttcagaatataaatttgcgaaacgtatagtctttttttttttttaaactatgtactgtggaatgactcatttctaccttgactattttgatatctgagcttttcatctttttgtcaagtatggggtatcaaacagagcacaattgcagtttgttgaaacagtactctaaaacagtttacttccgtgtggtctgtaatgctgtcagtcccatggctcagtgcccttcacgtagcattcagcctcccatctaggtgggaacaatgggaaatgcagtcataggatatatcatttagagtggacttgagcaagttacttaattagtttgggccttgatttttctcagctttaaagttgggagtttaaattcagttatttaactgttaaaaaaatttatgaagtactgtggaatacaggaaaattgtagaaaatataatagataccagtcagatttaacatacattaaaataaagaattcttaaaaatgtctcattctaaactaatcaatggaagatgtggtttaaataaaagttattagaattttaggtttttagaactagttggggccaggaataaagatttggaagctgtggaggtggtggtgaaagccttagaattggattagtttctccagaggaggttccatgcagtgagatgtgaggaggaggaaatgacagaggatggagaacactgaaaaggtgtgatcacagagttagaaaggaaaagtgtcatgttggcaaagccaagaggggaatgataggaaacaagccacatatccatgcaactaattattactactaatttgcctttagatagatctgtttattgatttaaaacaaaggaaagttaaggtacgttgagagaattggttttttttaattgaggcagagtctctctctgtcacccaggctggagtgcagtggcacaatcttggcacactgcaagctccacctcccgggttcgcaccattctcctgccttagcctcccgagtagctgggattacaggtgcccaccaccacacccagctaatttttttgtattttttttagtagagatggggtttcaccctgttagccaggatggtctcgatctcctgaccttgtgatccgcccccttggcctcccaaagtgctgggattacaggtgtgagccaccgcgcccagccagaattaattgttttttgatcagaagtgagaggccaaaacagtagggtagccattttctgttcacttccattggtagagaaaaccttgtagacaaaagccttctgtttttattgaagttggcatgacctgtttgctacagacaaacttggcaagttgggcgaatgctgttcctgcagctctgctggtgtgaataaacaaggttttattcctcctgccaggactggtgtcagggcaatgactgtgtgtgtcctgctggtctttgaggggttttcctgaatatgttttttgtggtttgtaaaatatggacctcacgcaaaattatactacaaatttagttcactccaaaccaaaagatcagtgtagaattcagagcaattaatctggtagtagcaaagtggtttttgtggtggtttttatctcaaatctccagactagcatatttgaattctgtactgcacaaaaaagcagactaagacaaagtgtacacaggtgatgtgaattgaatacttagtcaataaaagatcatttaataattaggggtatggacgggcagtttctgttcctaatatttattatatgaaatattttttgtatcaaagcctgtgtttccagccacacttatactaaaggtttgtatgtttataacaagagttcttattctttcccttttcagtcacctttttcggtcaccaattcatacttgacactctctcagtgccgtgcgggtatttatgtccggtcagcattgacatgtttccaggtcacttaactgaatcatggatccaatataaagtgcagcttgggcatctgggtgcctttcataaagaggcagcaatgtggggtctcacaaatgttgtcctgtgtgatggtggtgccatcagaatgaaaaacacttagaagtgatgagggatgtgttcctacatacagatccatgtcccgcagatggaaaggcttttttctgaaattaatgcttagaagaactgagagacaagaaaattaggcagttgagacttcaggtttgaatgcctaagctttttgcctttgtagtaagaatttgtgtatttaggacatacaggataaaataatgtgggtttttttttttttaattgagacggagtttcgctcttgtcacccaggctggagtgcagtggcacaatcttggctcactgcaacctccgcctcctaggttcaagtgattctcctgcttcagcctcccgagtagctgggattacaggcatgcaccaccacgcctgactaatttttctgtatttttagtagagacgggatttcacattgttggccaggctggtcttgaactcctcacctcaagtgatccacccacctcggcctcccaaagtgctgggattacaggtgtgagccaccacacctggccggtttttttttgtttgtttgtttttaatgaggtgctttgttttttgcttttggttagaggtagtggtagattaatatatagtatacaaaatacagattagcatgtagtaattagatgcaaatgattatgtgatttatttatttttcaaatttctgacatgtatacttttctaaggctttgacctccttaactgtgtagaagggtcaccagattcagtaagcaccttcgccatgactgatgccttgtaatgggttcagctaataggaaccaaacctgacactgtcaaataggattagtagcaacactggctggcttgagctgtgcctgaatgccagtggataagggtcagtgggttctttggcatcttgagcagcctggttgttgaatttcatattccactaaggtctttactctgtggttgcaatccttttcttttaactgaatcaatattcagtctgttctgacacttcccttttggacctttttttgtttgcatggcggagtgttgtgatttttactctcttggcaaatttcaggtatataatacagcattattaattacacgctgctgtatattagatccccagaacttactcgttttataactgagggtttgtaccctttgatcagcatctccccatgcctctccctgttcctatccccagcccctggtaaccaccattctcttctctgtttctttgagttcaactttattcagattccatatgtaagtgagatcataccgtaatctgtgttatttctgatctcagttttcactgaatgctttttgtccttgtattatgagttgtgtttttctgcttctttgcttgtctggtgagtttgggttggatgccaagcattgtgagttttaccttgttgggtgctaggcattttgtattcctgtaaatattactgaactttgttttgtgatgctggtaaaatacttggaaatagtttcattcttttgggtctttcatttaagctttgttagatggtaccaaaattgcatttattctaaagctagtctcctcgtgcaccccctcccccttgattatattaaagagatttgcaaaaatttaaaacaattatattcttcttactattttagggggaaaatacaggtttttgaaattaaaatgttactttgattaacataatgggtttattgttatttaaaagctgttctaattttttttttttttttaaagatacagtgtcttgctttgctaccaaggctggagtacagtggtgtgatcatagctcactgcagccttgaactcctgggctcaagcgatcttcctgcttcagccccctgagtagctagaactataggtgtgtgccaccacacttggctaattaaaaaaaatttttttttgtagagatagtgtcttgctatgttgcccagggaggtcttgaacttttggcctcaagtgatccttctgcctcagcctcccaaagtgttgggattacaggtgtgagccaccgcacctggccctaattttgagtgtagcaaatattgatagatataactcacataaataaaaactcaataattgggggtcctcagtaactttttttttttttttttgagacatagttttgctcttgttgcccaggctggagtgcaatggcgtgatctcagctcactgcaacctccgcctcccgggttcaagtgattctcctgcctcagcctcctgagtagctgggattacaggcatgcgctaccatgcctgactaattttgtatttttagtagagacaaggtttctccctgttggtcaggctggtcttgaactcccgacctctggtgatctggccaccttggtcttccaaagtgctgggattacaggcctaagccactgtgccctgccggtcctcagtaatctttaagagtgctgaggagtcctgagaccaaagggtctgagaatggtaatggaagggaacattcagaacatttgggtgcctgaggcttctctagagcagggtacttgcccaaagggggcttgggattttgcttcctgttccaacctaacctttgtgttgccctgatatcttattttctgttactggaggcatcttccaaactcagttctccaggtcacggaaacaagtcaatgaaaaagcaggacaggtgtcacttctgttataagcttaccacttcgggcttctagtctctgttttcaacattttagtgatgttgtctctttctctatgtgtacacttctgtatatgcttatatgcatgctgatctatgaatttgaaaagaagtttgttgtgctttacctagcatttctgggtgttttgtagcagtaggtgtggtgggctgaatagtatcctccataaatctgtgtctacctggtactcagaatgtgaccatatttggaaatagggtctttgaagctattattagttaaggtttgagataagatcatgatggagtgggctctaaatgcaatgactggagtccttatagaagagagaggacatataaagatacaaagaagagggtgaagtgaaggtggaaacagagattggagtgatgcatcgtctacaagacgaggagccaggagacagcaagaggcaaggaaggctctttctcagagccctcatagagagcaaggtcctgctacacctttatgtcagacttctaaactccagaacttggagagaggaaaataaatctattgtttaaagccacctggtttgtggtcctttgttagggcagtcctaagagagtaaaacagttaggtttttctggatttctagctcatattcaggtcattatcaggtattttcaggtttttatcaaagcatttcaggtattatcagggagactgttaagatataatgtcatgtcagaaataacacaccaaaaataaggttcttattctctctcgaagctaaaacccatttagtcttcttcatcagaaacctgggaacccatgtttgacttatctctcttttatcccttatatacaaccaataaaagtcaagctcctagacatgacactgatgctttccgtggctaaggccttgtcttctgctgcacctcacataacttaccacctattctatgctttagcaattctctattcatagctctctgagaagttaacatcctttctaatcttcattatttgtggtatctctgctcaaaggttcttccattatcttcctcaccagccatcttctgctcatctttacatgctttgaggtatctccaagcaatctgagtgcttcttttctgtacttttagaaaatattctctacacttctgttgcagcactttctataatatatttatgtgatctattttggcaacattcttctccattaggttgtaacttcagcagaagacaggaaatatcttagttatctttgtgtctccagtaaccagcccagtgtaacttttccgatatacaaataccatgactttctcctgcttaaaaatcttcactgacttccatttgcaagtaggataaaatttaagcctcttattttagcaggcaaggatttatgatctactatcttttcaggcttgtctcttgtccttcttctgttactttatgccaagcaataccaaatgaatttacaagtatatcatgctgtttcatgtttctagattttaaagtattctatttcctcttcctagatatccatgcatttctctctgccttcccttttgtatctagtgatgttctcttcattattcaaaaaccaattcagacatttattcttttagaaaacttttctgactcttctgacatactgttcataggagagatttccctgcctgcctgtgttcacctgtgttcctttatgctggtattctttggtatgtgataacagattataatctttgatgtcatatctagtctttgagttccagtccttctactcaccagttcttttttctttttctttttctttctttttttcttttctttttttttttttttttgagacagagtctcactctgttggcaggctggagtgcagtggcaccatctcggctcgctgcaacctccgaatccctggttcaagcaattctcctgcctcagcctcccgagtagctgggattataggcaagcgccaccacgccaagctaatttttgtatttttagtagagatggggtttcaccatgttggccaggatggtctctatctcctgaccttgtgatctgcccatcctggcctcccaaagtgctgggattacaggtgtgagccaccacgcccggccatagtccttctacttaccagttctttaatataatatgaggtaaactatttaactacgctgagtcacagttttatcatcttttaaaatagggagataatgttagctactttacagtgctaaatgttttaagtgagataggattactgaggataaaagggtgggcaaaataggggccaggagcggtggctcacgcctgtaaccccagcactttgggaggccgaggcaggcagatcacctgaggtcaggagttcgagaccagcctggccaacatggcgaaaccccgtctctactaaaaatacaaaaaaaattagctgggcatggtggcatgcacctgtaatcccagctaccagggaggctgaggcaggagaatctcttgaacccaggaggcagaggttacagtgagccgagattgcgccactgcactccagcctgggcgacagagcaagactgtctcaaaaaaacaaaaaatatatataatttataatatgttacatattatgtatattatttatatgtattatataatacatattatataatatataatatatttatataaattagatataatattatcatatatagtatatataatatatattaatatataaatgtgtaaatgtatatattatataattatatataaaatacaattatatataattatatattgttttatattatatataatatataatccatattataatataattatatttaatacatattatatataatataattatatttatttacataatatatataattgtatataatatatatcatatataattatatatgatatatattatataatatatatcatgtataatataattacaatatatgatatatattatataatataattacaatatatgatatatattatataatatatgttgtatataatacatatgttgtatataatatatgttatataatatataatatatgttatatgtaagttgtatataatatgtaatacataatatatgttatatataatatatatagaaatattggtaagttctgtataatgatgttattaagttctataagtagaaaaaaaagtgttaaattctattacaaaataccctgagaaaggatgagggagatagtatttgtctgttgggggtttggaaaatatttattaaaatggtggcataggaaaaggaccttgaaagatgtgttcagtaggcagattttttttaagtggtagagggttaaggatattacaggcataggacaaaatgtgaacaatgacaagaaagaaggaaagtatagtatttattcagagaatggcagtactgctgcaatggagagccactggaagtggggcaaggaggcatatggcaaaggttaggcagtgctggtacattgggaccgtctgaccatggaggaccttgaattccctgctgtgatcctgtgggttagggtggtgttagagaattagtggttaagagtgtggggtctggaggcaagaccacgtaatcttagatctctgcttatttgtagctgtgagatcttgggcctgctatctcctctgaggcccagtttcccacattgccgtgagagagtgtgaagtttcctgcagggagaatgcaagggaagaaaatacgatacctgagaacagaagtgtgaggattttaatgtatatacagtagtcctcccttaactgcttttttgctttccttggtttctgttacctgtggtcacctgtggtctgaaaatattaaatggaaaattccagaaaagaacagctcccagattttaagttaagcttttttttaggtagtgtgatgaaatcttatgccattctgctgtattccaccctggaggtgaatcttccttctgtccagtgtatccacgtacccacactacctgccccttagtcactagtagctgtctcgttattagatcgactgttgcagtgtcagtgcttgtgttcacataacccttattttatttaataatggccccaaagcataagagtaatgatgctggcatattgttacaattgttctattttgttactagttattgttgttaatctcttactgtgactaatttgtaaattaaatgttattatgtaataggtatgtatatagaggaaaagcatagtgtgtatagggtttgatactgtctgtggtttcaggcatccactgggggtcttggattatattcttcgacgacaaggggggattactgtatatggtgacaaaaatatacatgaacacatgcaggaaggcccagaaaactgtttaattcagaaataaagtagtaaagtaaaacaggtatgatttttttttttttgaggagttgatatgagactgaaatcattgcttaagctgggaggaaaacaaaacaaaacaaaaaccagaatagagacgaatgataaaaaaagaaggacgatagatcagaggtcatgctatggacaaagggtagatttagtaggtgtaggaggaagaaaagaacagtatttgtgattcagaaaaaaaaatttagagtttgaaagttctcaggtagatctttccagattataattaggttaactatgtatattaaagtagaatagaggtaaattacagatgaaagactcttgaaggagcatggtagaacttgtggtgaataatgacaaatgggagctcaaatgattattccctactttctggcttggtgagactggtcgcgtagaagtagttggtagaaatgtagtttagcagagtgaactatggtttatctacatgtttttcctttccagtatggtccaacataatttgtaagtacttacagtagtagcaagtacttattatagcagtctccaatgagactagtcttgttaagaaattttccatactacttaactgagcaggaagtaccaccgcacacacagtattgcttctcagataccttgtagtttagatacactacacattggatatcccttacctaaaatgcacgggactagaagtgtttcagagtttgagtttgggaatatttgcattatacttatgcttactggttgagcattcctaatccgaaaatccaaaatgttccattgagcatttcctttaagtgtcgtgtcagtgctcaaaaagttctggagtttggagcattttggattttggattttcagatttggggatggtcaacctgtattagatcttcctgagtgctttgatgtaccctaaatgtgaaacattattcatattttctttgtggtttaatccacgttcagataggaaaaataagacaagttaaagatgagagaccatagaaccatacttgatttcttagatttgcactgttcagtctggtagccaccagccatttgtggctattaagtacttgcaatgtggctagcccaaattgagatgtgatataaaggtgaaatatacattagatatcaaagagttagtatgaaaaaatataaaatagctcattaatagttttttatatgggttatatgtttgaaatgacaatgaaaaaagaatgtaaaaaagcttattaacaattttcggcttgaaaatatgacttattattttcctgttgaacagcactgaatctatgtgtggggtgctaaaagcttaataaaattttctctgaatggattttaaaataagtatcattagatttcttgttattttaaagttatatctaatgaaaggcattaaacttcagggataaaggtaactagttaccaaactttttagctggttagtcttgctgtctaaaaagtagacctttgcttttgctttgtatggatatctaagtgcattatggggttgtttttcataaaagcctcatagcctatgactagactgtattatctgatatagccagtgttatgcttggtgatgctttttttcccttttcctcattttagattttctaaagcaatgtagcttcacttggaaacttgttagaaatactgattttgaaccccaaccctgttgaatcagagactaagggcttgatttagccctccagatgattctgatgtgcatgaagtttgagaaacatagttgtagagattccattgtgtaacggtgagcacactggactctgaatccagagaaacatagatgtagataatactacttttatagaataacaaaactcaacctctttataacctttataacatatctatttgaaaggaattacattcttttctttttaattcatcacttgtaaaactcctacattcttaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaaggtaaggtacaggtgtttcgagttcagtggcccattcctcatacatcttcactcctaccactaagttatttctaaatgctgtcagagtttcttgctcatttttcagtttatatttttgtgattagtaatttggaactcttgttgcggtaggtagattgttaagactgctctatatattcagtttttaaaaatttaaacactgttagtatcttccagtagtgcttttcatgctgtttctcaaaagtgccttgtaaattgccaaagtgtttgaactgacattcttttgccccttctgtcttttattgaaactgtaccaaattggtttagtacatggacttgggatggtacaacttcatttatgtgtttaataagatgacaattttaagccgagaccagtagcatccagaccaacacataattcatatatgagcaaaaaaaatgtgtgtgtgtctatttcaatacaaatcttactgttccttagtgcttgttatttccccttttttcagttaatatattttggtattctttccaagggtttcttcattgttgttactaacagcattgtatggatatactatagcaaaatttctactgatggacattaattttgctaaaaatttcttcctttacataaaatgattaatagtaaaaaatgttgtacatgtttagtttatacatatgtcaagtcaagtatatttctaggataaagtccttaaagttgaactgctgagtgaaaggatgtgcatttataattttgatggattttgccaagtaaccttaaagagactgtaccaagtttcatttctactatccgtgatgaaagtgttatattcccacatacttgtctgcagagtgtgttaataggctttttcactttttggcaatctgataggtgagcaaacaatgtcagtgtagttggagttctttcattgtaagtaaagtcgaacagacttttatatttaacatcctttgtattttctattatttgtttatatgctttacccatttttgttttgagttctttcctgcttttttaaaagttgatttgtagaaatctcttcccaatttaaaaattagttcttttgtccgatgtgagttctaaacatttcttcttgtttggcttatttattgagatggagtctcactttgtcgcccagactggagtgcagaggcacgatctcggctcagtgcaacctctgcctcctgggttcgagtgattcccctgtctcagcctcccaagtagctgggactacaggtgcctgcccccacatctggttaattttttgtatttttagtagaaacggggttttaccaccatgttggccaggccggttttgaagtccatggcctcaagcgagccacccacctgggcctcccgaagtactgggattacaggcgtgagccactgcaccagcccaccttttttaaaaaataaaaataaaaaagatgttgtccaggctggtctcaaactcctggccctaagccatcttcccatctcagcctcccaaggccactgctcctagctctgtttggcttttgactcgtgtgtgtgtgtgtgtgtgtgtgtgtgtgtgtgtgtgtgtgtgtgtgtgtgttcagacttcttaaataaagtgaatgttttaaggcttctggattttgtgacatattacaaaagttgtattttagaatatttcttattttctagtgatattgatctgtctgtatccagtaacattgtttaaatttttgtgtttttgtgatatatgttaatagctaattccttctaaggtacgtttctttttcagaagtgccctagcttttttttttttcttggctatttttccatttgaaatttagaatcagcttttatcatctcctgcctttaattctttctgttgcattttttattgggagtacataaaatttgtagttattaatttatagagaattgacaagaatggggtatatctttccatgaattcattttttgtttctcagaaatgttttaatgtttccttcataatagattttatacatttattaagcttcttcctaggttttctttttgttataaagtgttatatttttcattacatcttctaactgcttgttttttttgtgcacatgaaggcttgtgatttctctatatcagttttgtacttagtcatcatactgaattctcttaaaggtttggatttttttttagtttattcttttggcttttccaaatatgtagtgttatcatttctaaataataattatcttcctgtgttcagttttaatgtatgtgccccatttccttctccttctacttctgtgtaccacactacatgatactggacatctccacattatacctgatctgaatgagaatgcttttagctctctcccactaaagtacagtgcttgcttttgtgttagaattgatagctacattaagaaagtatccatctaaataaagtgaattaaaacttaaacttttttttattattttttgtttcagtagtttttggagaacaggtggtgtttggtgacatggataagttcttgagaggtggtttttgagatgttggtgcacccatcacctgaacagtggacactgtacccaatgtgtagtctttttatccctcacccattcccacttccccttgactccccaaagttcactgtatctttcttatgcctttgcatcctcatagcttagctcccacttgtaagtgagaacatgcaatgtttggttttccattcctgagttacttcacttagaataatggtctccaactccatccagcttgttgcgaatgccattatttcgttcctttttatggctgagtagaattttgtggtatatatatatatatatatacgtgtatatatatacgtatatatatatatacacaccacattttctttatccacttgttgattggtgggcatttgggctggttccatattttttggaattgcgaatgtgctattataaacatgcctgtgcaagtgtctttttcgtataatgccttcctttcctctgggtagataccagtagtgggattgctggatcaaatggtaggtccacttttagttaaggaatctctatactgttttccacagtggttgtgctagtttgcattcccaccagcagtgtaaaaatgttcccttttcaccacatccatgcaaatatctatttttttatttttaaattatatcgcattgtggttttgatttgcatttcactgataattagtgatgcagagctttttttttttgagatggaatcttgttctgccgcccaggctggagtgaagtggtgcaatctcggctcactgcaacctccgtctcccgggttcaagcaattctcctacctcagcctcctgagtagctgggattacgggtgctcgccaccacgccccactaatttttgcatttttagtcgagacggggtttcaccatgttggccaggctggtcttgaactcctgatctcaggtgatccacccgcctcggcctcccaaagtgctgggattacaggtgtgagccaccgcacccagcccttgttgagctttagtatgtttgttggccatttgtatatcttcttttgagaactgtctattcttttgagaattgtctattcatgtccttagcccactttttgatgggattatttgttttttacttgatgatttgaattctttgtagattctggatattagtcctttgtcagttgcatagtttgtgaatattttctccaattctgtaggttgtctgtttactcttctgactatttcttttgctgtgcagaaactttttagtttaattaagtctcatctatttatctttttgttgcatttgcttttgggttcttgttcatgaagtctttgcctaagctgacatctagaagagtttttccagtgttatcttctagaatttttatggtttcaagtcttagatttaagtctttgagccatcttgagttgatttttgtataaggtgagagatgaagatccggtttcatttttcacatgtggcttgccagttatcccagcaccatttgttgaatagggtgtcatttccctgctttatgtttttgtttactttgtcaaagatcagttggcagtaagtgtctggcttcatttctgggttctctattctgttccattggtctgtgtgcctgtttttataccagtaccatgattggttttggcgactatagccttgtatagtttgaagttgagtaatgtgatgcctccacatttgttcttattgcttagtcttgccttggctatgcaggctcttttttggttccatatgaattttaggattgttttttctagttctgtgaagaatgatgatggtattttgatggcaatttcattgagtgtgtagattgcttttggcagtgtggtaattttcacaatattgattctacccatccatgagcatgggatgtgtttccatttgtttgtgtcatctgtgatttctttcagcagttttgtagttttccttgtagaggtctttcatttccttgtttaggtattttactggtttttttttttttttttttttttttgcagttattgtaaaaggggttgagttcttgatttgattctcagcttggtaactattgatgtgtagtagtgctgctgatttgtgtacattaattttgtatcctgaaactttactgaattcatttatcagatctaggagcttttggatgagtctttagggctttgtagttatatgaccttatcatcagcaaacaatgatagtttgacttcctctttactgatttggatgtccgtgatttctttctcctgtttgattgctctgacaaggacttccagtactgttttttttttttttaaattttattattatactgtaagttctagggtacatgtgcacaatgtgcaggtttgttacatacgtatgcatgtgccatgttggtgtgctgcacccattaactcgtcatttagcattaggtatatctcctaatgctatccctcccccaacccccaccccacaacagtccccggagtgtgatgttccccttcctgtgtccatatgttctcattgttgaattcccacctatgagtgagaacatgcagtgtttggttttttgtccttgtgatagtttgctgacaatgatggtttccagtttcatccatgtccttacaaaggacacaaactcatcattttttatggctgcatagtattccatggtgtatatgtgccacattttcttaatccagtctatcgttgttggacatttgggttgattccaagtctttgctattgtgaatagtgccgcaataaacatacgtgtgcatgtgtctttacagcagcatgatttataatgctttgggtatatacccagtaatgggatggctgggtctgttgaatagaagtggtgaaagtgggcatccttatcttgttccagttctcaggggaaatgctttcaactttcccccgttcagcataatgttggctgtggctttgtcatagatggcttaaggtatgtcccttgtatgccaattttgctgagggttttaatcataaagggatgctggattttgttaactgcttttttggggtctattgagatgatcatctgatttttattttattttattggtattagttttgatctttcaatagtaatattttcaagtaatagacttaatagtttcaaaacatttttcacttctcatgcacttgatcattgtatatttttctcccattgtgcttctcatacatttacttcttattaggcacaataacatgttggtaagaaatatgaccagacaacttttagtggattagaagttacttgtaatttttactatgattaataatgcgtaagccttttgattccatttcctattaaacttttctttaagtgtaggatattattagtaaaatacgaatttttaaaatttcgctggttattgcagttgtggagtttgtgaggaggggagtgatttaattatttgatttcatacagtgcaagtttctgaaggcatctggatgcacaaagactcgattcaccactgtgccagcagcctgtttgttgctctaggctgattatacccaaaatgttggtgacatgatggattatcactttcattaggtcataagtgttaggggcatatattttacttttataacatttgtttttcagctcctattttctttgctctcattctataaggattacttcatttaaaaccaaagtgttgaaagattgcgtgggtcttcagtcattaaactttgcctttcagatcatgagaacatgacagcaagctactaaaaaagccttagatgattaatgttactggaagaaaagatatactggttagaattcaaaggttgtttggaagtaacgcattgcttatttttaactaggtaaaaatttttagaaaagtttttgtattagtccattttcacactgctataaagatactacctgagactaagtaatttatgaagaaaagaggtttaattgactcacatttccatatctgagtcgctagggaggctttgggaatcttataatcatggcagaaggtgaaggggaagcaaggcacgtcttacatggcaacaggagagagacagacacacacacacacatatcatgcaaatcttgtatattttttctttgtccttcctcttcatccttcacagaaggcagcagaggatcagtaattgtgctgtcttagtacaccacactgccccagtaattcatcatgttacaaacttttatgtgtcttaaaacttaccagatagtacaactgttttcaaaattggtttatgttattagtgcttcttttttattttatttaattaattattttttgagactgagtctcactctgttacccaggccggagtgcagtggcgtgatattggctccctgcaacctccgcctcccgggttcaagtgattctcctgcctcagcctcctgagcagctgggattacaggcacctgccacctcgcccagctaatttttgtatttttagtagagacgggatttcgccatgttggtcaggctggtctcaaacttctgacctcagatgatcctcccgcctcggcctcccaaagtgcagggatcacaggcatgagccaccaagtttggcctagtactgctttgtagacaattacctttatgcctgttattttcagtgcttagatccttcccattctgtgtactttttttgttgacgttactgtattaaggtggtcagaatcaacatttgtgatgtatttccagcaccattgttggctgataaaatagagatagctttaaatttagtatccataaaaaataaaatgaataccgtaggtttagagaagtttaaagttctcaagggatctatgtattttttaaaaattatataaaaataactttaaagtaatctttttttcttggtaaaacgtgcagttttatgtatttttaggcaggagtaacaactttttccacatttccatccagagaacaaaggtcaaaacagcatttattattctagctatagttttactgtttaaacttttgaaattttgtgtagcaccattgagagaagattagtgcttacagctgaaacttagttttaatacagtatcatatatacatatatattggttgatttgtttttgagacagggtctcactgtgttgcccaggctggaatgcagtggtgcaattatggctcactgcaacccttgtgtctggagctcaagcagtcctcctacctcacttcttgagtagctgggactacagacacatgccaccatgcccagctaattttttgtattttttgtagagatggggtttcaccatgttggccaggctggtctcgaactcctggactgaagtgatctgcccacctcggcctcccaaagtgctacgattacaggcatgagccaccatgccagacatctttttttcattttttgttatcatttatttctgaaactcagccaatatgatgtatagagacaaatacatagatattgactggcaaaaagtcatggagataaagtgtattacttgaacaagacttcagattgaatattattattctttagttttcattcatttgcccgctttgtgaggtattaggaatgacatgggtggtggtggatacaacatagaaaaatttcacttgcttaatattacttgaactaatctctgggaccatagtcccttggccatcaccaagactgagaagaatcgaatcaagattttgctttaggggaaggttgttttgaatatcttagggggatttacagtgcactctcctgtagcttacattgcaaagcattctggcatgggataagatgttcataactctgtgtgttgtctttaaacagagtctttgaagcagttccctcagacagcacaggacattttcctactgaaggaactcagatgcagtttaggcatacttatatgtggaaactatccatctcatagtttactactgaaccctgaattagctggtagcaacaaccccctaccctctctcccgcagtcagaggcttctcctgatagccatggcagtaaaaatagaacagtagaactaaaatattttccagaagcagaacatattcatagggaaaggatgaattcaaagttatttacaactcttttatcttcaaaccattacatataaattgatcaaataaaaatagctagtctaatgtgttttgagcaggtattaccatttttatttattatttatattgcttatttttgaatcatgatatttcaggctttttatttgatgagtcaacatcttaagattcctaatgagaatggaatatgaaaaataattgggtcattgttaacaatgataagtcattttgacagtatgtgtacttgatatgatcaatgatacttcagctctgtggttctcttccccaaaatgcacaaccccagtccaattatgaacaaaacagtagacaaatcctagttaagaaacattccaccaaacaactgactagtagtattcaaaactgccaagcctccaaaaactaggaaagtccaagaaactgtcacagccaagaagagccaaggagacatgccatccaaacgtaatgacatatcccaggcaatatcttggaacagaaaaatggcagcagacagaaactaaggaaatgcgaataaagcacggactcttgttaagaataatgtatccgtgttgattaattatgacaaatgtgtcatactaatgtaagatgttaacagtgtgaaatctggcctctgggttcccaggaactctctgtatcaccttctctgtaccatcctcacctctctgcaaatccaaaactattctaaacaaaaagtgcatttaaaaaatcaattcaaatttggcagtgtattagggttaagaataataaagtaacagtgattttgagagagctcaaaaataaaaaatttggaatggcattcttttcaaagcttggtggacccaaaacctataaatacttcagtgggggagatcagggattttaccttcggaacattaaggttgtatgaatttattggggaagagggaaggctacaaagtagtcaacctaattctatttgtcttctttgcccctggcttccagatctctctccaagtcaccatagaccatgtgcaccccaatattgaatatctcatgaacaaccaggacagatttgatctaagaaagactcaatgcaagaaatccctgttatattccagtggagagtgttatgtggaatggacccctccatttgaactcttaaattctgtttcaattcaggtcattattctcctctgctttccttggaggtttatacaaatcttaggtacaccaggaaaccatcctttgagccagggttctttctcagtgccaggcacttttctatgtgaattatatcaacaggtaaccctgtgaaccatgtttctacctaacgctgttgacaaatttcagtcctgtttcatttcacacaactgcccaacttggtggatcagaagacaacaggtaaagataaccaagtagccaccaagtaagactaggaggctttccgcaaaaaagacaactttctgaaatgcttggtgaaactgttcattagacagaatgtacatcactggattgatgatggagtttaaaaatagctcagcaaggctgggcgcggtggcccacgcctgtaatcccagcactttgggagaccgaggcaggtggatcacgtgaggtcaggagttcgagaccagcgtggccaacatggtgaaaccctgtctctactgaaaatacaaaaaattagctgggagtagtggcaggtgcctgtaatcccagctactcgggaggctgaggcaggagaattgcttgaacctgggaggcggaggttgcagtgagctgagattgtaccattgcattctagcctgggagacaagagtgagacttggtatcaaaaagaaaaaaaaaaaaaagctcagcaagatgaagatgtcttaatatggtggtatcttggctggcagagaaacaataaagagaggcagccagcagatgataaaagcccctaaaatgatccccagggtttctgtggctttccttgtttgaaagtaaatttcctgttgtactaggacactataagcatgcttgattttcatgtgattaacaagcagaggagagccagttaagcgcctttgcctctcatggaggctggggttgaggaagaagagtgagctgtgatgacctgggcagtggtgctgtgatgatggcttctggatgttcttgttgggcaatgtgtgaagatgatgaacaacacaaccaaaatgtagaaggtcttacatgtggagtaggtggtgcaagaggtctaggagaagagcactgggatagagatacaatttgagatggcccatttactatactacagggcattggtgatggcccagtacctggtcagagcaacagacagaaatatcggttggaggccatgtagcacgtgatgctagaagacagccagatgttgcacaggagttggccaaatttccaggtgtgtgtgatggtctatgtgatgctcatggatatgaacaaggagccagtgagatagttggctggtgtatatagcttcctggtgaggaagatggtggtaagcagaaaggtgttggagagagctgttgtcagtgcgatgatggaaaggaccacagcaagagatctctagcccctggaagttcccagctcctaagcctccggtatttttgtagtatcgagggatccgttggaggcctcctggaggatgtcttccattggatggttttgtgaggacattctagggagctttctcttccacagtcatagcttctcttttcacagttgtctgtaaaaggtcatctttccatttcctacttctgggaaccgtacatcagaagagcaaaccacaacagaaaatctccaaggcttgattacatgaagaacactgaggtgactcctagctacagttaaaggcttttcccaaatcagattaatcccaagatgtctctctgttctagaactctgataggcacatgctgaatatgttagacaattgcaggttatcacagcactgtgggcaaagctccacaatttcttgcctttggtattttgactctttttaaggcttgagacttatacgtgtttaactgtgccttcagaatatttcccatcctattccaaagagattgtggatttcaggttgctgcctgggagcttttaaaattagagacaaaagggaataccagcttattcagagaagcagtccagtcaacagctcacagttttcctaggtgaatcctgacatatgattggtacttaattttggttccttttctactgactgtttttgagcctgaaaagacaaacattccagttaccaaagcttgaagaatgcatgaactcggagaagggaaaacaaacggatcactgtgagtttgccaagcggggcaggtgttcgaagcccctccctggccgtgcgtgtggaatgctgggcttgccctcctgggccctcctttcttcacatggtcggattttggcctacataatcacaggccccagccctgcgccttcccctggccctttcccttcctgcacttttgggatactccatttctttttttgttaattaataactttattcgtttggagtagtttgggaagttcccaagtgtacctgaataatgtacattgtattcaataggtaatttttcatttctcccctgcctgcctccccctgctctgagtctctagtgtccgttataccactctgtatgcctttgggtactcagcactgcctccctcttatgagtgagaacatgcagtatttggttttccattcctgagttacttcacttaggatgatggcctccagttccatccaggttgctgcaaaagacatgatttcattctttttttcatggccgagtagtattccatggtgtgtgtgtgtatgtatatgtatatgtatatgtatatgtatatgtatatgtatatgtgtatatatacacatatacatgtatatatacacacacacgtgcatatatatgtgtgtgtgtatatatatatacacacatacccatgtgtgtttatacacacacacacacacacacacacacactttctgtctcttgccatatacaaaaattaacctaggtggattaaagacttaatctaagacccgaaaccataaaaattctggaagataacacagggaaaactcctctgaacattggctcaggcgaaggatttatgacaaggatctcaaaagcacaacaaaataaaaatgaataaatgggacttaatggacttaattaaactaaaaagcttctgtacagcaaaataaataatcaaaagagtaaatagaccacctacagaatgggagaaaatatttgcatcatattcaacaaaatattaatatccacagtctacaaggaacttaaatcaacaagaaaaaaaaataatcccataaaaaatgggcaaatagcatgaatagacatttctcaaaagaagatatacaaatgcccaaaaatgtatgaaaaaatgctcagcatcactaatcatcagggaaatgcaaattaaaatgacagtgagataccaccctaccccatccagaagggctattattaaaaagttaaaaaataatagctggtatcatggatgtggtgaaaagagaactcttacacactgttggagcaaacgtaaattagtacaacctttatggaaaactgtatggatatttttcaaagaactaaaagtacatttatcatttcaggctgggcgtagtggctcacacctgtagtcccagcacttagggaggccgaggcagatggatcacctgtggtcaggagttcaagacaaacctggcaacatggccaacgtggcgaaaccccatatctactaaaaataaaaaaatctgatgggcatattggtacgtgcctgtagtctcagctacttgggaggctgagacacgagaattgcttggacctgggaggcagaggttgcagtgagcctggatcgtgccactgcactcacagggcgagacttcatctcaaaaaaaaaaaaaaaaaaaaaaaagatttatcatttcatccagcagtcccactactaggagtctacccaaaggaaaagaagtcattctgaaaaaaaagacatctatgatatggaatcaacctaagtgcccatcaaccaatgaatggataaagaaaattaaactttccttttttttttttgagacggagtctcgctctgtcgcccaggctggattgcagtggcgccatctcggctcactgcaagctccacctccctgggttcacaccattctcctgcctcagcttcctgagtagctgggaccacaggcacgtgccaccacgcccggctaattttttgtatttttagtagagacggggtttcaccatgttaggtggtctcgatttcctgacctcgtgatctgcctgcctcagcctcccaaagtgctgggattacaggcgtgagccaccgcgccctgctgataagtatttttttaaaagccctgagaaatgacaatgtaggatttaaaaaatgacttgtattaacagtatgagagtaatatgtgttcaaggtaaaaaaaaaataaataaataaaaataaaaattaccaaaacatatggagtgaaattaaagttccttctcccatcctttgctcctctcagtgcagttctttagggttattaactgttgttaacagttctttgtgtgccgtttcataaagtttctatgcatatcaagcatttatgtgttatataccttttaaaaaacaactggaatcatactttttattaatttaaaaataaacattttaatatcatcttatatacagctttatctcatcttaaaaaatatctacatggttttctgaatcatacttctaccataatttaactaaatttaacctaagatttacaggtagatgaagataggggtttttcttattttattttatttattttatttttttgagacagagtctcactctgtcgcccaggctggagtgcagtggtgcaatcttagctcactacggcctctgcctcccaggttcaaacagttctctcctgcctcagccccctgagtagctgggattacaggcgcgcaccaccacacctggctaatttttgtattattagtagagaggattttaccatgttggccagcctggtctcgaactcctgacctcatgatctgttcacctcagcctcccaaagtgcagggattacatttgtgagccaccacgcctgacctcttgttgattatagtagtataacgcataatgacataaccgtctcattcatgagttgatattgtatgcgtgtaaaatgtcgatagctgtttaattatccaccaagagttttccactgatttacacggagaatgtttttttgcacagtttcattaaacatttgttatcaaacctttttaaatttccactgacttggtaggcaattctgaagtgtctcttttcttgcttagtatttatttaaagttgagttctcattgagcattttttcataggtttttgttttgttttaattgggaggtatatgttaatttcttttccatatttttctgtttgatgatgtattttttcttgttgatttataggaagtttttcctctagtaaatacattggtctatttccttttatgttttacaaatacattttcctgttttttgttttttgtttttaacttcatttatgtatttatttgggggtttatgtcaccaaatttaatagtacttttctttatgtcctctcagttttaggtcacactttgaaagtccttatacatgccaaagtcattttcatttttatatttttttgagaaaggctctcactcactctgtcacccaggctggagtgcagtgtctcagtctcagcccactgcaacctctacctcccaggctccaagccaaccttccacctcagactctcgagtagctgggctacagccgcacacaccaccatgtccagctaattttttagctttctgtagagacagggttttgccatgtggcccaggctggccttgaactgccgggctcaagcagtctgcccttgccaaggttattaaataattcatacatgcttttctctggtacttttaaagtttctttttatacatctaaaaattggtttataaaatttatatattgccgtaatgattcagttttatgtttttacatgtggctggccagttgtcattatagtatttgttaaataatccaccccttctcttctgatttgaaatgccacaaataaattatcagattagtagattgttttgctatattaattttatttttgcaggaatttctcactcttctcactcatttactttttcagatgaactttagtatgattttgtcaaattttcctcttccaaaaaatgaacttgttactttttttattgaatgtggtatctcagaagtcaagtgaagaaagggtttcaaagaggagaggatgatcagatttttcaaatactgctgatgagttacaaaaaatgaaaattgaccattggctttaataaagtgaagatccaaatatctaaaaaaccatcatgcagaagaaagattagacttgttcaatatggccccacattaactcaatcagcagatactctaaggagtcaattctaaagagagtcaaactgtccaaaactgataacacactacctgggaggaaatcaattcattcattataagtggacatatagcaaaattaaagtgtaatccgtcactttatctaattttgctatatgtccagtagagtgggcagagtttatagtttgtgcctagtttctcctgtgattatctgttactttaaacaatattttaaaactttctgtgtcttgatttaacacgtttaaaaatgaagccatgtttattgactactttttattaaaaatagtttatttatattaccaatcccccttcttgattttagttggtaaacttttgttatattttgctgagttcatagtacttttcagttttatattgtgttgttttttgtaaaggagaaacattgcttactgtaattatgattcatatttagcttttatttctgaatttcagtatatttaatgctcataactagtcgttaaaaacagcttaactgttcccagtttttttgttttatttattttttttttgagaaggagttttgctcttgttgcccaggctggagtgcagtggcatgatctcggctcaccgcaacctcgcctcctgggttcaagcgattctcctgcctcagcctcccaggtagctgggattacaggcatgcgccaccatgcccagctaatttttcttttctttttttttttttttttatagttttagtagagatggggtttctccatgttggtcaggctggtctcgaactcccgtcctcaggtgatttgcctgccttggcctcccaatgtcctgggattacaggtgtgagccaccgcgcctggctgttcccaagttttaaactttaatttttggttgcccaggaacttctttgaattgttttgtatgaagggttatgggtgctatcccaattccttgtttgttgaccatgtgtttatgttatctttttatattttaaaaaccatttcagagatacaaaaatgtatagagaataatatactgagtataatcactcaagttaagtaaacatttcaaatattgttgaagttcattggcatatctctccttgatagtactcctttttattctatcccagagattaatacttgattttagtatttatacatgttcaataagaggaagtacatatggcaaataaatatgagaaaaatgttcaactataatgaatgaattgatttcctctcaggtagcatgtatcagttttggacagttttgaccctattttgtttaaccagaattgattccttagagcctttggcaccagggaccaattttgtggaatacaatttttccacaggccatgctgcaggggacagttttgggatgaaactgtcccacgtcagatcatcaggcattaggatctcataagaaacatgccacctagatccctcgaatgcacacttgacagtaggattcacgctcttgtgagaatctaatgctgccactgatctgacaggaggtggagctcaggtggtcacgctcacttgtctcaccgcttacttcctgctgtgcggcccagttcctaacaggccacagaccggcactggtccatggcccaggagttggggacccctgccttagagtatttgctgattgagattaacttggggccatagtgaataagtcagatcttttttctgcatgatatttagatatttggagcttactctttggcagcccccaaatctcaatatcctacgtgaagtatttttattcccctcattgttcttatttgctttggttattttttctgatgacttttatgtgtctaaactgatttttcttccatcttgacttgtttagttaggattttggatctaattgcaagagagatgattaaaatgggattcatgttccgttcacggcccttagctgaaatgtgggctactcagtgaaactcactaacgttcagtttcttcatctgtagagtggatataatagctacttaaggatgttcttgtttaacgatgtaatgtgtatgaaatcatgcaccttggaacctgtaaagtggtatatactcaggatatgaggtatcaacataatttattctcattaaatttcattcagccaattactctgaatttagaatcatggagaatcttttgactcttgatttgattgtttagtctaacagtaatttagtctgacaagtcttgatttgactaacaaatcgtttagactaacaaattgtttagccttgatttgattgaaggattgtcaatccttcaatttcatgccttctacccatttataaacgtgctctgtatactttcgtatagacaataaaatgttgaacaagcccccaaaagatttaggtgatacattgtaagaaactgctgatcagattgatatatccatcacaacaattctaaaagctttttttgttgcctgtagaatttttttttgtaagctcactttgtttgcaggtccagacttttataaatctatattcctatttgtccttcatgtatgttcttcaataagacccttaaaaatctaagatcaaggtgagcatggtggcttacacctgtaatcccagcgttttgggaggctgaggagggtggatcacctgaggtcaggagcttgaccctgtctctactaaaaatacaaaaaattagctgggcgtggtggtgcccacctgtaatcccagctactggggaggctgaggctgtagaatttctggaacccaggaggtggaggttgcagttagctgagatcacaccactgcactccagcctgggcgaaagaacaagactctgccaaaaaaaaaatcaaatctaagatcagcctgtaaaattccttcttctttaaattttctttttctttttgtagagacaaggtctcactgtgttgcccaggctggtatccaaactcctggtcttaagcaatgctcctgccttggcctcccaaagtgctgagattacaggcatgagccactgtgcccagcctgaaattccttctaatgatgataccttgatagtgaaccacctcaggaccaccacctacacatattttcctagcgttctaagcaatgtatgcactggaatagtctttgctgtttcttcttctttttccttaatgagtacatttgtagttgtacagtcaaaattatgttcttgtgggtctcccagtcttcccagtctttctaaaccgtcctcattccgcatagtgttttccactatgtgctaggcaaagacatatagatgtggtctctgctctcaggagtcccagaattatgggaggttagaaggttatgatacgaatggtatacggtggggcaaaaaaacgaggaattttagatttagccctgtatgaaaggagtctgaggaagtcttaggagctgagtcttgaaagtttgcaaggtagatggagaagggggcatctaagcctggagagtggtgtcaataaaaacgaggaggggtgttcctttccaccgtgtcatgccctggcatttcacttctgcttttaaacattcgtaatatacgctcttaaaaatttctggtagagctctgcatatgaatgccgtttctgtctcattacgaactctgaaatcacttgctccctggcaaaattatacccaatttttacctaatgagaaaaattacagtgaatgtagtcatctttattgacctgttaatttaggaagcagttgagttgagtttttttctcctctgtcccagaagattttcaatcaaaaactgtagaaatttatcttcagtgggatattgtggtataacttttaaggtagaactttaggtatccctgtagagatgccttaattctgtacaaaaaagccttaaattctgtactttgcttcttgattcagacacttgttccctaaggaagaagaatatggtaacactacatttatccttttcttgttctttggtgtctacattctctaatcatttctttcatgaatattataactgtatatttaagtaatatttaaatattgtaatatttagggagcagtactgagaaactatgttattttggcatttatctagatatacttaaaagaaattttttcttctgagcacaatggcagttatggtaatcgctgggttataagttagtcacatactgtggactgtctctggttctgtctgggccaccactgtccacccatagtcttccttgctttctaagtagtatacatatttgtatgcactagggtaacccagtgcttagagaatgaaacgagacaatagcagatggccaagcgtgctgtacaatgggattagtattgggctcctccttcccagggttctcccctatggtttaaagtagttctgtgttacagtaaatttcttatctttataataaatcactgacctggaaaatgtaattgagcatttgaatctgagctgcattcaaaatctgtgttaaaattgtacagcttcttgcttgattgattataaatgataatgtagcttggagtttaatttgcttacacagatgctatcaacattcccttccatgcttctgtaacttctgtttatttcgttttgcttgcatctccagtttcctaggtttgttttttttttttgtcctagttggttctttaagtctcttctattttgttttgggtaggaggtcagaaagaataggtcctttgtatgttccgtttgttttctgtgaagtcttggataagacagttgttagtttgttcactttttccatatcataaaatcggacaggagagtaaggttgttgtttttttaattaaagacaatatttactaatatattctgagaaaatattttatttttaaaattgtgcctttttatttttaataaggatcaattcctgtattttctgaatgttattattttaaatcttaacccagctgtgaagcaagctaagtttagagaagactgtgtcaggcctaattgaactttacgtctgaaacataatttagttagatattagaattttttcgttttctttcctttacttataattgtctaatagaactcactttgcagttctttgttgatggagaatatgtatagttaaactcttgaaatatcattttattgcaaaaacaatgcgcagtaaatgaagtttgatttgatgattatatttttactggtagctaaggaaatatactctgtgtaaatttatttgcttcatacaactttttttcccctccctttttaaaagtaaaccttaaggaagtggagagtttaacttgcaaagtattatttaacttctgtatgtcaacaggtttctggttttaaatgatgctgatcctatacaagtgatattttataattattgaagaattattctcttagaaagggaggttattttttttaccttgttatagtgtaaatcttttaattatgatatgttccttagcagtattccttccacttccagaacactcctctccaaaaaatactacaaaataacaaaataccccctcatccctacattgtgataatctagaaataataaacttcagatataagtgattaaaacaacaataaaatggatgtattgtgatagatctagcaaactctattgctgcatgataactgccctaaaacgcagtggcataaacaaccattttattttgcttatttatttgtgaatcaggaattccagaagggctcacataggtagtttgttcttgatttgtgtattttcacctggaagtgtctatgattggatgatctcctaccaagatggcttattcacttgcatatattctctttgctccttagcctctgtctacatggtggtttttatttttattttctttatttttattttttgagatagagtctcactctgtcacccaggctggagtgcagtggcacagtctcagctcactgcaacctctacctcctgggttcaagcaattctcatgcctcagcctccctagtagctgggattacaggcatgcagcaccacacctggctaatttttttatttttagtagagacggggttttgccatgttggccaggctagtctcaaactcctggcttcaagtgatccgcctgtcatggcctcctgaagtgctggattacgggcctcagccaccatgtctgacctacatggtgtcttttgccccagcttctgcaggtgccttgggttcctcgtggcatggggaaagtagtcacacttctaatgtggaagctgcttccagatttatagatgttagaagcagaagctgcttggtcagttaagggttattcttgaaagtggcttggaagtggcaggtcacttctgttgtattctgttggtcatagtagtcacagaacctgccctttttattttattttattttattttattttattttatgttgttattttatgttattttattttgttattttattttatgttattttattttgttattttattttatgttattttatgttattttatttttgagacggagtctcgctctgttgcccagcctggagtgcagtggcgctatctcagctcactgcaagctctgcctcccgggttcacaccattctcctgcctcagcctcccaagtagcttgactacaggcgcccgccaccgcacccagataattttttgtatttttagtagagaagggtttcaccgtgttagccaggatggtctcgatctcctgacctcgtgatccgcccacctcagcctcccaaagtgctgggattacaggcgtgagccactgtgcctggccagaacctgtccttattaaagcagggtggtggtggtgtcaagaatggggctccaccttcttcctgagaaggggtagagttcatggcagaagagtatgtgagatggaagacattgttgtgaccatttttggaaaatatctacttcagtagaataaaacattggataaggggttggaaatcaaagagtgagttttttttgtgcggtatggcaataaaattcttactcccttttctgttgtcttatgatattgcagccttattaaccagaatggaagtggaatgtttctatttccatgttctgctcagtgttttaatctgttatttttagggtttctactgttatctgttgctttcaaacaagctactccaaaccagaaagaattctgaacaacttaagagttgttttacctaattcaggaattaccacagagtataaatgtaattcataggaagaaagtacagaagaataaggtatgtggaaaggaagaggactaacagaaggtgaattaatgctacttactgattttggcaattcaccttgggtgagaagcacgactgtctagatggaaactcttgtgtattagtgatctaacaagaaccagtgtgcttgctacaagactgccttttagaagatagaggtgtgtatagatgatacacagaatgcaggagaatttttttttttttttgagatggagtctcgctctgttgccccggctggagtgcagtggcgcgatcttggctcactgcaagttccgcctcccgggttcacgccattctcctgcctcagcctcccgagtagctgggactacaggcgcctgccaccatgcccggcgaatttttttgtatttttagtagagacggggtttcaccgtgttagccaagatggtcttgatctcctgacctcatgatccacccgcctcggcctcccaaagtgctgggattacctcggcctcccaaagtgctgggattacaggtatgagccaccgcgcctggcgagaatttttaagaacattaagaagaaataaacatggctaaactgttttgtgttatttgagggggataaagcaagatacatctcagaacttagagtgttttcacaattcgttgatggatattgctttgacctagcactgaggggttaatttggatggaattttttttccaatcgagctagaattcacagatcataaaatttaccattttaaactatatgattcagtggttttcagaatatttacaatgttgtgcaaccatcatcactgtccaattttcatcacttcagaaagaaactcacacctgctggcaattacaacccctcatcctctgacaaccagtaacctcctttttgtctctatggatttgcctatactggatgagaccttcgactgtgaacttttgagctaatgctgaaatgagttaaggctttgggggatattggttttgaaatgtgaagacatgagatttgggaggggctgggtcgaaatgatgtggtttggctgtgtccccacccatatctcatcttgaattgtaataaccacagttcccatgtattgtgcgagggacccagtgggaggcaattgcatcatgggatgggtctttctcgtgctgttcttgcaatagtgaataagtctcacgagatctgatggttttataaagagaagctcccctgcacaagctctctctgtctttgccttgtgccttccaagcaagtcacatggtggcttgccttccaacatgattgtgaggcctccctattcatgtgcaactgtaagtccattaaacctctttttcttcccagtctcagatatgtctttatcagcagcatgaaaatggacaaatacagaaggctttcagtcttcaccttgaagtatgatgttgactgtgggtttttcatagatgctgtttatcaggttgagaattcccttccattcctagcttgttgcatgtttttatcataaaaagatgttggattttataaaattctttttctgtatctattgagatgatcatttggtttttctcctgtattctgttaatgtggtacattatattgattgatttttgtattttgaaactaaccttgcattcctgggtaaagatagatttgtttttaaatagctttgtgtttttcagctggatgaatgtagaaacttgttctatcagcattattatggagacaatagaagtggacctgagagaatatagcctttggataaatgcttaattttcaagtgctaaggtgtaatataaatggacatatgcaaaggcttatattgtaatatttttacatcatggaaataattttgactcattaaacattatttctttgggcttttaagtaacttagtgaataatttgaggatctgtgcttatctgtgtcgtttctcatctgttgttaatacgccacattaatgttctcagagtcttgcaagttctagttgagtgttttgaccgagcacacattttaaacttgaaaattgataattatcaagtcaataaggaagggtcagatccctcttctgacaaagattgttcttagttgtttctcaggagatcctgtagcaggaacttgtcagagtagtaaatacacagacacatatctagaaaaagacaaaagatttagggaaaagtgcctggtcgcagttttaaagcagagtcaatattttcttctgcttaaaaactgcttataacttgacataaattctcttacattgcattctcatctgtgggaatggctgtttggttagatgcccaggtatctgtcaactctagttgagaaattgaagtaactaaccacgtgaagaagttattaaatcagactctgatgaagcagccttttatgctcttcctttttcctgctacaccagtatgtatatcctaaccagaaaatagcttcaagaatcagacatctattttgttctttatctgttttatcttcctgtaattgtcagacttcctcaattttttctcctaatgatttttttttcctaaaggagtttttcagattagaaaaatcatgtaattttacagagaaaaatttgcaaaattctataagatctttgggcttcttttttcttttctttttttttttttttccgagatggagtctcgctctgttgcccaggctggagtgcagtggcgtgatctcagctcactgcaacctccgcctcctgggttccagcagttcccctgcctcagcctccttagtactcgggactacaggcgcgcgccaccacaccctgctaattttttatttttactgcagacggggtttcagcatgttggccaggatgctctcgatctcctgaccttgtgatccacccaccttggcctccccaagtgctgggattgcaggcgtgagtcaccgcgccccgtcagcctttgggcttcttatatacagtgcatataggtaagaaactgacatttggatttgtttcattgcatcccattcaggctgaactctgccttatacacagcaaatttggtatttttattttttttgagacagggtctcattctgtcacccaggctgccgtgtagtggtgcgatcgtggctcactgcagcctcaacttcctgggctcaggtgatcctcctacctcagtgctgcaaggaactaagactacagttgtacagcaccatgcctggctgactgttaatagtttttgtagtagagatgggtttcgccatgttgcttaggctagtctcaaactcctgggatcaagtgatctacccgcgtcagccttatgaagtgctgggattacaggtgtgagccactgcactggccaaatttggcacttctataaagcagctaagcaaacaactttaaatgaagtgactggtctttttttttttttttttttttggaggaggagtcttgcttttgtcgcctaggctggagtgcaatggcgcaatcttagctcactgcaaccatcgcctcccaggttcaagcaattctcctgcctcagcctcccgagtagctgggattacaggtgcccaccaccacacccggctaatttttttgtatttttagtagagatggggttttgccatgttggtcaggctggtcttgaactcctaacctcagatgatctgcccgcctcggcctcccaaagtgctgagattataggcgtgagccatcgtgccggctgtgacgggtcattttaaacaacattctggattcttgaaaagaatgccaccgattaataatttgtaacttctcttatgcttttgacagtctgatgaaagctatgggctttctccaggtaaaagtgtgcatagttcatttgtgtgaactgagatataatatacaccttaaagtttatccatgaacttctgattaaaaacacccacctttcaccatgacatggtgaagaaaaaaataatcagaaacactcaccatctatggaacaaccaagttggtgatatacactggtttctaggttttacaaaatcataaaatatgtgtatggttcaaatacaacagaaattcatggcaactacaatttcatgttaattataatttaactagaaagagtgtagctgttgggtatggtggatgctgcgatgatcgatgcaacctaggtctctcctgattgttgaaggacttatttccccagatcgctggaagtgttatcaacagaaagccctccactttccctagagattgtcttagctaaagacaccaccttgcccgagggcaagccccctcccatggacatccagtgattgatccttatgaggtgccatggtttgaattccttccccctacttgggacaacagcttcagagctcctcgtggggttgtcagaatcctttgggacttcgtggcagctgaatcgctccctctgtacaatcctcatttttctcctcctatctactgactccgatcccaaagagcaccgtctaataaacttcttgcataataatgtctgtctcagggtctgctttccgggaaacccagtcttgggtagaatacagggtaggatatgagtgcaagtcagcatctttcaacccataaaagtagacctggcgaaaataaaaattcaatgagatgaacttgaatttaaattaaaaataagtgaaacatctcatcatatttccttcacaccttatattcaagtagtttttcagagtcttggtttctttgaatttatttgtgtctctcagtctttctttgaagaaagactccccaaatctctgaaagcttggtttgtttggttacacattatgaacttgtgaaaggtgtgggttaaataatacagttgcttacatgccccaaagaaacccctagaggttttctatgttggcaggtgaatatgataagagaatctccttttgctaagatttcttggactgtatttagaaaatatttggttttggcattatcattaaaattgtagatgtccattctaaatatatgaaaagtatggaaaagctataaaaagaaaaaaatctgtgtaaaaataaacttctcctcacttgaaattggtataatattacacttactttttggtgacctgtcttattcatgtaatagtgtataataaacaagtttttgtatccttaattctcaagaatatgaattgtaatggtataatattctttccatccagtggatagaccatatttaatttggctagccttttattgttaagtgtttaattattcccaatttttaaattattacaatacaatggatttttttaaaaaattaagcctcttgtgcctgctttagtttttaaaaaaatattggatctctcatcactaaaatgtagtgaactgagactaggctacctagacagccactgtaactgaacaacttcaagggaagccattcacatcgatgatgtgaattgagggcctcagtgaaatctcatcattgctactgccacagaaggattgccgttgtggatttatgtgccctctttgtcttttgagcaattttagcacagggaggtctgtcaattttttatatatgctgactagatagaaaaagaagggtttgagctattttccataattatctaccaggcagatcttgactggcagtgacctttggtcttaccagcttttgtgtcattgtatccagttgttctaatgcgagaggcccctagttccatgatctgtaccatgagcaaatctgtcaaggaactttctttcctaccagcaattaataaaatctacctggagcagtggactctgaaaatatattttcttaagggctataccattcctgtataattaaatttgaacagttttaaagataaaatatagtagtattctggtgaagtttattactttttaaatgttctcatcttccttagaagaatattgttatattttataattgaaagagatgttactagtcttttgttttacagttaaagtgatgagaaagattaagcaatttgctcaatgccacgtaactagtcattcattgcaataattcactccatgatctgtactatgagagaacaacacaactgacagggaaacccaaccaaggaagtgttacttgctacccgacatctttgctgggcttattgaggaccataagcagtaattgagaatactgatatgaaaacttttaaaaacccaaattgaatttaaaacattgcttagagtttcttatggttttgtcagtcttgcagcttctcatcgctggaaacaagtggagaagcaaaatttagatgtcagcaatagtctgggcaaaacattctttttttttttttttttttttttggtaaattatagttttgccttgtttgtacattttgtccgagtgtctgatggtggacaaactgttgaccagaaatcaggggacttagaacctgaaaaggaaaaattcactattaattactatagatccctctttgccaactgattatgaccagttcatccagactgtatttctgccatcaatactgaaaggtattattaaccaagaaagtaaaggtcagagcctttttgaataactgatttcatacaataaatttgatgctgatggctatttaaaagagctgtggaggcaccctcaaaaatgttcctttcccttaaatgatatttaaagtgagccaggggactgcaagaagtgttttgagctgtcttgtcctcagaactgtgtcctagaggaagtctcttctgcgtttgcccagtgatttgggcctcaaaggcagagtaatcagttccacttgactggaaataaatcacccagactgaaacatgatagctcctgacaactgggcagggctgataaaagccaaaacaaaagatgtcaataaatctgtgccaatgtggaattagtatgcagatttgatgaattcactctgtagctttgcagtcagcattagacttcctctgattttatcagtttttctttcttgttgaaataaaaattgtatgaggacaagaaagcctctatataaaataaccattttatttctgtttctttccaccctagtaaacagaactgtaccatgattacagaggtcattttaaggaataacgtcgtctttctccaaacagttaatttaaaaatgtttcttccttgggctgggtacagtgactcacatctgtaatcccaatgctttgagaggccaaggtgggaggatcacttgaggccaggagtttgagaccagcctgggcaatgttgcagtacttcatctctacaaaaattaaaaatcggctgggtgtggtggcatgcatttgtagtctcagctactccggaggctgaggctggaggattactcgtgctcaggagttcaaggatgcagtgagcagtgattacactgtcacacttcagccttggtgacagagcaagaccctgtctcaaaaacagaacaaacaaatatgtatttcttgagtttactactcaataatgataattatatatgatagtaaactgtatatataaacctgttgggtatcaccccccttctattatcattgacggcacagatgtgtagaataaatgccagttcctttgatcactacaaaattttgcttgtacagaaattgaatatatgctaataggtagtgatttctttctatgtcagggagagtttatacaaaaaaaaaacccatgggattataaaatgtatccttttctgtaacaattattttattaattttcaattttaaaactaatttatgtaacagaagaaaaaccttttaaatgttttattgtcaggtcctccttggtccgtctgtctgtaaataaactagcttcctttaaccttgaaagttaggctaaacagattatttgaataacgtcgtggtcctgaaatccttaacgtcaagcatctttggctctgcccagcagctttagtgtatggtgattagatgtatgtttcatccatgaaggatgtacttttccatttgcagtggtttggtacctcattctttgggggttcgttttattctttgcttcagtagggggtacattttaagtacatgatcgtagcaatggtatactatattaataaacactataatcataagaaatcatttatggaaagatgctttatgtgattactttttcagtttttcaccatagaacatattatttatagggtggtaattaagagtagattctggagctacactacctagtgattttcccataggcctgtagtgatgcttaaatcattgttccatataaagtccttgcatcagtacctggcatgtttttaagtgttggctgcttctgtaatctacctccccaccaccactgttagaatcgtcgttcttgttattttattttaggggttctgtggtttatagtcctaaacaatggagagtttttaaaaactggatattccgagcatatttaaaagggtatttttctgctaaacgtgattctgaacaatcatttttatctttatgttctagtatgtgcataatggatccagtttttctcttggctgttcaaagcttcttataaatcttatatttcagatcctatgggtacttgaattagtatagaatagactctctgctgaatattttataaaaatggcataatacatactgaaataatatgatatgggactatcagagtaaacagcatttataacctcaacattagcttggtgaaaaagaagagaataatgacaagaataatgtggtaacattcattcttcagctggtcagtgacacatataaactgaggtccttgatcacaacgaaagtgaggatatgtcatgggagccttcagtggggctcagctgttacccatcatgatgctgaattcagtgagtgagggctcagctgttatccatcgtgatgctgcagtcagtggggctcagctgttacccatcatgatgctggattcagtgggactcacctgttatccattgtgatgctgcattcagtggggctcagctgttacccatcatgatgctggattcagtgggggctcagctgttatccattgtgatgctgcattcagtggggctcagctgttagccatcatgatgctggataaacggaaagagaagtatttttatgggcacacatttcacccgacacacccacctcccaccccctgcgtgtttcgggtttgttcagtgcttacacagctggtttgcacctatctgtgtctatttcaggtcttcctcactgatggcagcttgcccagaggaggtaatcttagtgtccactgttctttttttattttgtgagatcctttcactatgaaatgtttgtttctcctcttttagaagtaaataagagtctgagaatagccatcccttttcactccgactcaacagtcagtctctctagagtgggtaattgaaaaagaaagtaacttgccaagaacttgctgacggcattttacctgtttcagcagcttctgcacctgagtatatcagcagaagtgtttactagcaaagaataatggattcctttaatagtttaactacatatcaggtataaaagtgaaattgttaacattttaattcctgaatttctccctagatgcagatgatggagtagaaagaagggtattatccttattatgcatgtaaggggtgtttgtatattaggtaggctcataaaacaaatctgtcttcttgtatgtaaaacttggttggttctgtgaaatttcattttaaataatgtttcttgtattgccctttcttgacaggaaagtctaatcaacagcatgaccatagcttttctttgtataagacctatatgttagcaactggaatgacctgcacagctggttaaacatgtaaacaccaaggcattgtgttctgtatatacaggtatacctcggagatattgcagattcagttccagaccaccacagtaaaacgagtcacacaaattttttggcttcccagagcatataaaaagttatgtttatactatattgtagtttattaagtatgcaatagcattatatctaaaaatgtacataatttaatttaaaaatactttattgcaaaatatgctaatgattttctgagccttcagcaactcgtaatattcttgctagtggagtgtcttgcctctgtgttggtggctgctgactgatcagggtggtagttgctgaaggttggggtggctgtggcagtttcttaaagtaagacatcagtgaagtttgctgcatcaattgactcgtcgtttcaaaaaagatttctctgaatcctgcagtgctatttgatagcattttacccacagtagaatttctttcaaaattagagtcaatcctctcaacccgtggcactgcttcatcaactaagtttattaatattctacatattttgttgtcatttcagcaatgttcacatcatcttcaccaagagtagattctgtctcaaaaaaaaaaagcaacaacaaaaaacactcttattactcattcagaagaagcagctccacatctgttcaatttttttttttttttgagacggagttttgctattgttgcccgggctggagtgcaatggcgtgatcttggttcactgcaacctctgcctcctgggttcaagtgattcttctgcctgagcctcccgagtagctggggttacaggtgcccaccaccacgcctggctaactttttgtattttcagtagagacagcgtttctccatgttggccaggctggtcttgaactcctgacctcaagtgatctgcctgcctcggcctcccaaagtgctgcgattacaggtgtgagccactgcgcctggcccatctgttcagattttatcatgaagttgcagcagttcagtcacagcgtcaggctccacttctaattctgtttctcttgctatttccacatctttagtgactacttctgctgaagtcttgagcctgtcaaagttatccgtgaggattggaatcaacttctcccaatctcctgttaatgttgatattttgacctcctattgtgaatcacaaatgtttttaatgacatcaggaatggtgaatcctttccaaaaagttttcaatttactttgcccagatccatcagaggaatcaccaactatggccttacaagatgtatttcttaactagtaagactagaaatcaaaatgactccttgatccatgaggtgcagaatggatgttatattagcaggcataagaaaaacatgaatctccttgtacctctctatcagagctctagggtgaccagatgcattgtcagtgagcagtaatattttgaaaggaatctttttttctgagcagtaggtctccacagtgggtttaatacaccaagtacaccatgttgtaaacagatgggctgtgatagaggcttcattgttccatttataaagcataggcagagtagatttaccataattccacaggccctaggattttcagaatgataaatgaacactggcctcaactttcagtcaccagctgcattatcccctaacaagagagtcatcctcttctttgaagctttgttttctttgttttttttttcttttctttttttttcctttttgagacagagtctcgcttcgttgcccaggctggagtgcagtgacatgaacttggctcactgcaacctctgccttttgggttcaagcagttctcccatctcagcctcgtgaataactgggattacaggcatggaccaccacacctggctaatgtttgaagctttgaagccagacattgacttatcctctctagctatgaaagtactagatggcatcttttgccaataaaaggctgtttcatctattaggttggtgtagaagtaacttcaatggcaaaactgccattacttttgcaccaaccaaatacattgaaaattcattgtttgttgtagccatcttcattgattgtcttagctagacctggataacatgctgcagcttctccgtcagcacttgctgctttactttacacttttatattatggagacggcttctttccttaaacctcatgaccaacctctgctagcttgaaacttttctcctttagcttcttcacctctctcaatcttcattgaaatgaagagagttagggccttgttctggattaggctttggcttgaggcatgctgtggctggtttgatcctgtatccaaaccagcaaactttttccatatcagcaataaggttgatttcttttttgtgtgttcatcggagtggcacttttgatttccttcagtaacttgactgtttggttccagaggcctagctttcagcctgtcttggcttttgacatgccttcctcactaagcttaatcttttttacttttcaaactctgcatgtagcatttgacttaatcatttctaaattttgactaaaagtgagagatgtgcaacttttccttctccctgactatttagaggccattgttgggttatgaattggcctaatttcaatgtagttgtgtttcaaggaataggaaggctgacacagagggagagagaagagggaatgattgatcagtggaacagtcagaacacatgcaacatttcttaagttcaccatctcatacgggcagagttcatggcaccccagataaattacaatagtatcatcagagatcactgatcacggatcactgtaactgatacaataatagtgaaaaagaaatgttgcaggaattaccaaaatgtgacagagacaccaagttagaaagctcttggaaagtagtgccgatagacttgctcgacgcagggttcccacaaaccttcagttagtaaaaaacccgtatctgtgaagagcaataaagcaaagcgtaagaaatccaggtatacccgtatatggagtactgaatttttgagtggcaaaattctctttactggttatgagttgacctaagtgttgatccgtatgagatttcaatagtagtgtctgattaaatcaagggaagactaatgctttccatctcggatgaactcagttcttacaataggctttggtctcttactgggcaattcagtggttcacccatacgattatctctttgttaacaagtgaaaatgtaagcttcagcatattcacataccctattctaaacttaccaaatctctttcttagcttttttgttctgcctgtcgagttcttcttgactctagagaggtaccttaaagagcttgtactaaatttattaatgtaagaaactacctgacaattggatccaggattgttttgtaattccgttattggcaggagtttttgtgaatccctgaatatagtttatggaagtccaaacttatattttattcatttattgattaatgtttactatgatctgagatgtactgtataggaaggtacaaaacagctggaggggcaggatccatgtctacttgagacatgtataaaacaaagattacatatggtttcatacactaatcagtgctataatgattgatagatagaggaatggagatatgtgatcaatatatagatacatggaagaatggaggagtgtgtatttatacataatatatacatgtatatgtatcattactggggtacagacaatgatcaggtttttctcttgggggtgagggcaacagactgttcctagaggagataatgtttatcttgcattttgaaaaccacgtagaaaaatcaggtagttctagtatcagctcaagaggagatggtgattatattctcctgcttcatttctctccatagaacttatctctgccctacactatgttgattcattcatttgttcagtcactcattccctccctccatcattcatttgtctaccttactagaatgtaagctccatgaaggcagggatttggtctgttttcattactctgtttcctcagcaactggaaaagtgcctgatctatggtgggaatttgaactcctgtgtatatagtgaatgaataaactttgtgagtagttggtttatttataattttcctttagcttattaaggatagctccttagaatttcctcatagtttgcttgattttttaattatacttgaataataatttttattgtacttgagtctccttgtacttgagtgataacatgccgcttgctgtacttgagtgataacatgctatttccacagtgttatctcatagtatgttgagtccccatcatcttacctgaactgatacaaactctaatggttttccatgtctatatgcgagtcctcttaagttttcattgaaagatcagatccttgcatgctgacactgccaacactggtactgttatttatttaaagtacagaactggccagaccacttctgtgcttaaaaatctctaagggcttccatctctctataataaaatctgtgctccttaggttggcacacaaactgttttatagcttggcttcagctgtataatgatgcattttcttaccatctcatggtagaataaaaatgagtctattcatttttctttttttttttttttttttttttttgagacggagtctcgctctgtcgcccaggctggagtgcagtggcgggatctcggctcactgcaggctccgcctcccgggttcacgccattctcctgcctcagcctcccaagtagctgggactacaggcgcccgccactacgcccggctaattttttgtatttttagtagagacggggtttcaccgttttagctgggatggtcttgatctcctgacctcgtgatctgcccgcctcggcctcccaaagtgctgggattacaggcgtgagccaccgcgcccggcctcatttttcttcatatccatagtgtctggcatgtaatacagaattcaacaaacgttttttgagtaaatgaatgcatgtaagtgtatatgaatgaatggccacaaaaatgtttgctgcttagataaaagatgatataagtaaatgaatgcatataagtatgtatgaatgaatggctaagaaaatgtttgctgcttagataaaagatggtgtaaaactaacctaacactagcctttaagaacacagtcttttctttatatagctgatttgtctttttcactgtttagctgctctatcctctgtcctccctttattctttgtgaagaaatccctcttggcatttacaatgtcattttagaagtaatcctagtcctcatggctttcctctctacatggccatctctatactggatcttttctgctagctacttttcttattttgttagggatgtgtgtgtgtgtgtgtgtgtgtgtgtgtgcgcgcacgcgtgtgcgcgcgcgcatacacatgtgtacttttttttgttttgcctacaagttcctacaaatttaatttgcctacaaatttaaggttttgcatgtaattctgaaactcttaggattaaatgatttctacagaatgcacacacacagacaaccctgagctatctgttttcaaattgaaatgattttgattgtgctattgtttttttatacatgtcctctcttttcccttaaatatttatgtacatttagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagtgagtggctggccccaactctccacacacgttttctgctttctcattaatctaagactggatatagaatacaaaagaaatccctgtgggcacaagggaaaagagctgctgtgtgctattgctgacatacgtagtgtgaagggaaacattttttttagatggagtctcactctgtgcccaggctggagtgcagtggcgtgatcttgtctcactaaattccacctcccaggttcaagcgattctcctgcctcagcctcccgagtagctgagattacaagcatgagccaccatgcccaagtaattttttgtattttttgtagagacggggttttgccatgttggccagactggttttgaactcctgacctcaagtgatccacccacctcggcctcccaaagtgttgggattacaggcatgagcccctgcacctggccaaattgctctgattttcaaacttcttgagtatctgttgacagaaagttttgatgatttctcttttctttaccttcctttatattttaagctcaatatatcaaaatctttcccattccccccttttttggtgtgtgagttgtgagttgtttccattgccttgtgggcaacatgtgaataatatatagagaagaaatatttgttagttattgtccttagggtgtatatataagcttttagttacctggaaattgaataaatggaaatattgcaaaagaatactttagtgatatcaaatactagttgagattataagaaaagaaaccttgggattcaaatgaataaacctacatccttgttatggcaagatgaataagaaggatgaattatttaaaaaatgtattctggccaggcacaatgactcacacctgtagtcttagcactttgggaggccgaggcgggtggatcatctgaggtcaggagttcaagaccagcctgaccaacgtggagaaaccctgtctctactaaaaatacaaaattagccaggcgtggtggcatgctacttgggaggctgaggcaggagaatcgcttgaacccgagaggcagaggttatggtgagccgagatcacgccattacactcgagcctaggcaacaagagcgaaactctgtctcaaaaaaaaaaaaaaagtggattctttaaaaacttaccattgtcttttgaatatagaagtttgaaattctgctaaaagcagaattacagtcatataagtgcaaaagggaatttcttcacatgttgatatattctctcatcaggagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggttaagctccccaaaatggaattagtttgtttgcttaatcattgcatgtgtctgtatgttggtgtttacataatgcatataaaaaagtattcgatggaaaattttcttaatattcttttagcaggcttttgttgaataccttaaggaatatttcagaaagctttgcagagacatagcggattggttcattcattttctaagtattactcactttgttttatgttggttttttacttactaatatttttatagacctaaagtaactgaagctcagatacatttggagaaatagtgtgctaaagataagaaagttgacagataaaaggaatatgcaaaaggaggaaattttatgtatagcaactatcaaagaacacaacagctattaaattaggtgacttaatatactttggtcttgtttttggagaatcctgttaatatgacctaaatagcaaagatgcctcatgctatgtaatcagatgatgataatgcatgagctttagcatctttctgtggattttctttctaatatctttaggcaatgttatggaagtttaaattcctaatagaatttttcttttaatagggaaaaatgtgattttttttttttcttttaagagactgtgtctcactctgttgcccaggctggagtgcagtggcattatcatagctcactgcagtcttgaactcctgggcccaagggatcttcctatttcagtcttccatgtagctaggactatacgtgtgcactaccatgcccagctaagttaaaaaaatttttttttgtgaagacagggtcttgctatgttgcccaggctggtcttgaactcctggcctcaagtgatccccctgtctcagcctcccaaaatgctgggtttacaggtatctggccgaaaaatgttttctgtttaagttaacgtagctactgaggtttgactacttacattcacaaagcttgatctactttggtttattttgtattgacagaactctttacatcactgttcaatgggtatttcttgagaatccatcttatttgttaagagttgaaagctagagctaatattgttttatatttcatgaatgagtttccttgtaatgggagtatgtcagcatttggtaatagaaaggaaattacagctaccatgataaatttaaaaatttaaacctctattttttttaaaattatttattctagatgtgtgttccttcttttaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggttaaagaaaaaatttcacatttttttgctttgccttaaataagaacatagtagataaccttagcatgtttatatggaataatttaccaatggaataataatccgccaaactttaaaataccatgtatatctgaattaattatcttagcattcttatcctactttattttattcaagataatccccaaatctttaaaaattgacagttcagagaaagattaaaatatgcaactctcttgtgggtaaaatatgagaccagagtgtaaaaatctctgttacctgatatttttctcccattagaatcagacttctgccaggtgtggtaactcatgcctgtaattccagctccttgggaggttgaggtgggaggattacttgatcaggagttggacaccagcctgtgccacagagtgagaccccatctcttaaaaaaagaaaaaacggtggctcatgcctgtaatcccagcactttgggaggccgaggcgggcagatgacgaggtcaggagttcgagaccagcttgaccaacatggcgaaaccccatctctactaaaaacacaaaaaaattagccaggcttggtggcgcaggcctgtaatcctagctactcaggaggctgaggcaggagaatcacttgaacccaggaggcagaggttgcattgagccaagatcgtgccactgcactccagcctgggcgacagagcaagactccatctcacaaaaaaaaaaaaaaagaaaaaaaaaagaataagtgggagcatattttctaatttaacatatgtagtaaggtctgagactcagaataattgttaaatatcctgtttcagattttatctcattttggagaatgttaatttcctagctttttttttaaagacagggcacatattgtcagaaagttttttttatttgttatatttttaatttctcttagcaacttattgggcctagaattttattatcttcaccttctacattagggtctattttttggtttatagcttatgtgtagatttacatgaaggactatttggcgtattttcttcttggaaactattactgtattattagtgttctaatttacattttttcaaaagcctgtgcttatcattgaaattttaaaagtagatttcttctctgttttgtttggagtaggaaatgactggtcttgaggtaatgataattggagtcatttttgacctatttatagcttaagaatgtatatcctgtatctgaatattggcattccatgtcttcagcatgagataatatcctcagaatttattgaggaaaggattgaaactcaacttttgagatatcagatttttttgtctttttttctttgttttttagagacagggtcttgctctgtcgtccaggctggagtgcagtggcgtaatcatagtttactgtgacttcaaacttctaggtataagtgatcttcctgcctcatcctcttgaagagctgggactacagacccatgccacaacacctggctaagttaattttgagacagagtctcactctgtcgcccaggttggagtgcagtggcacaacctcggctcactgcaacctccgcctcccggtctcaggtgattctcctgcctcagcctccagagtagctgggtttataggcgcatgccgctgtgcccggctaatttttgtatttttagtagagatggggtttcactattttgaccaggctggtctcaaactcctgacctcatgatccacccgcctcagcctcccaaagtgctgggattacaggcatgagccaccacacctggccttttgtttttttttaaatagaggggtcttgccatgttgcctaggctggtctcaaacccctgcctcaagagatccttctgccatggcctcccaaactgctgggagcaaggccactatgctcagccttgagttatcagaattttaaaaatgcttaatgcttttttttttcccttgtagagtgaaatatttatttctatactctgatttttttattgaaggtttttttttcaccatttttttaaaccgttaattttgtttcccttgattatcttactcttaaaaccattttctgtacttttctttctttcttttctccctgatgcttcttactgtctttggcatcctggaatagtgtggagccactcatccaagccagtgagtgacctagccaagtgttgccagaaagtcccagttgatagtttcttttctgacttttgtgtgaatgacatttttatcaccctatagataaatgaatatacttaaccttctcacctctcccttcccgaaataggaactctaggttgtttttttttttttttaatttatattgaggtgactacaaaatagaaaggcttctctaagaccaaaatttttcctgagactttggaaactgtttgcatttctgctgcttttaccttgttttgttcctagtgagttaattcattcaggactgcttctctttgcttttatttccaccatgttgtggcttttagccacaccagtttagggtacagtttcgctaacacattaaaatatgtttctgccaatagagtcttttgtaaaggccatgcttagtaactgaattttgacaactgatgaaacctgaaacaaaagaaattggtagaggacttaatctcgaaagtacctctattgcttccacaaagcatttaacaaaatttacataaatgtttctcttttgctcaaagtactttgaatcagagctttcctaagtatgtgtgttttcccctttaatattttttgaaaccattttaagggactaaatatgttttgttgcttattgaataaggaaaaaaacgtgtgttagtctttactctctcattaaataggttatgtggtgaaaatgttgatttctatgggaatatgattatctgcatggttttgtaatcttacgtgttttactatgacatgtatgaaatacaaaggaacaaaatctttgcctccagtgtatgagtactgaggttttaataatgttaaaggtaggtgtttttcagtagaacaaggcctgtggatggagagcttaacctttaactcagtattttaaggaggattattcactgttacgtcagcctctcttgtccaaaggtgatattttatacaaatactgttatttcactaaagtttgcagcttttgcttctgaatgttcttgaccttttcacattctaaaagcaaggtgtatggagtatctgcatttttaaagcataggttaacgtatagttagaacttaatgggtaagaaaggggagaagaaaatgaaggcatgaaattaaacaccttcatccagaaaatacctttcatattgataccatgataagtgactatggacagaagaaatgcttacatcttgaattaaatgtcatattccacaatttagaaatccattttatcttcatttatttttttgtgacagagtctcactctgttgcccaggctggagtgcagtggcacaatctcgactcactgcagcctctacctcccaggttcaagcaattcttgtgccacagcctcccaagtagctgggattacaggtgtgcaccaccacccctggctaatttttgtactcttagtggagatggggttttgccatgttggccaggctggtcttaaactccttgcctcaggtgatccacccacctcggcctcccaaagtgatggggtgacaggcgtgagccagtcactgcacctggcttagaaatcccttttaaagggatgtttataacactgatttgaaaaatatgcctttttttgagtttgtattataatttataaagttgtaaaggtctttaaggggtttaaaattcttggaattttattttaaagtacaaattaactcagcaagaatttagatgtaaactactctgatacagaatttgttgtcataagggaagggaaggtttatagtatctttgattttttttttcctagcttgatttattttgtctttaaagattgtcatttagtattcttttattatctttatcattattattttatttttttttgtagaggcgaggtcccattgtgtttccctggcaggtcttgaactcctgggctcaaggaattctcccagcttagcctcccaaagtgctgggattagagacgtgaaccactgcacctggcctcatttgatattcttaataatattccagctacatttaatcttgcacttatatttaattactgattaatttctcttcttcccaatcatttttcttttcctaccgtttaggcctatgggctgttttaaatcaaatggaaactagcacactgcttttgcatattcattttttctacaaataattgagtttttactctgtcagttaccacactgtgcactgaggatatatagtggtggacaagacagacctgtcccttgacttatataatttatagcctctattaagaagatagacacttaaaaaggtaattgtagtaaatcacatggtgtgagggaagcttatatcaaggagaactaacttaggtcaaggtcatggagaacctcctaacaaaagcgacactttctaagctgagacctcaaagtaaggactcaccagcgtgtatgaaggcccagaatgctgatatgcagtagttatatttatatttgtggagttataataaataatttataataaattattagaaatcagaattatctcagtgacgttaaatgccagctggccttcacttttgtttacacaatcatcttttgtgcccctacatcaagctgcctcctattgcctatttcgtcaccttctttcttcgtagatactaagaattttctcagttacttctgcttttgtttgcatcttcaatctcttcgcctttgttgtcccctctctttatgtgtaatatgatcagctttctattgaaatatctcctgatcttggtactccttatggtcttcttccctctctccttttctattagatatatttatagccttctcctgcccatgaaggattgactgctacaggaatttccctcctacaattaacaactcaaaaactgggaaaccacgtgaaacaactgattttagacattggacaacattcagtgcagaacagtgctctcatcttaccttccaaacttatatgatttttgtttcttaaaatatacttcatatgtgtatcaaggttaagggttagggaagcctatatttaagacataaaagatttttttctacacatgtgaagccttaaacaaatgaacttgggaaaggacttatcttaaaagtatagctgttactttcaccaagcgtttaatacaattatataaacatttctcatttactcaaggtactttgcttcagagctttctgaaatatttcctaagaatatatattttctcctttaatattttttcaaaccattttaagggactaaatatattctgttgtctattgaataagaaaaaataaaacgtctaagcttttgtcttctcattaaacacattatacatacatggctttagagattccagaagacagctagggacttgaaaattagtttttaattattgaaactgttttgtattccaaaatgcattaacaatattagttgacttttgtaggatcctgaataaaaatttttttctcagatcttagtgtggttctttcaaaaaaatttttcttaaacaatttttttttccaatagagatggggccttgctgtgttgcccaggctggtcttcaacttatggctgcaagcagtccccctgcttgggcctcctatagtgctgggattacaggctcaagccactgagcccatccttaagtgtggttctcgatttctgaattcatttgtttgtcccatattattttgtaaattctctaatccttgcatgagggaggtacctgtgtgatggtagcagctgttttcttaacctgactcacatttttatggcatcacactcccagtatctgtttgattctagatgcccaaggccatgtgagtcacacgtgttaggtaaagcagcatataggaaatggaaatggaagttagggtctagtgggagttaggtctctgcactggtccggctatacgatcagcagtgagtccctggtgttgccttttgatattctcttggagagatcaataacaacagttcaatgactgttagtttgtctcactaaactctgaagcatcttttgccttatgatggtgtttgatttaataatattcagagatgtgttatttaaaacaactaatctacttggaacctaagataattctccatttattactaatatttgtctatataatacttaagcagataaaaaccttataaattacaaactaactggtagatatttgataattctgtacttaaattggaatataaatcattgtttgggacatggtttgcccattgccacctgtgtgtatctgataggattgaaatgcttttctttgtaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaaggtaagaaagtgaagctgattggggcttatgaggttaaagtatggttttaaaagtatgcttttggggacatactttttcagtgtatctaactctgaatttaggttctcgaattcttgctattactgtattagctgccttttttctaggtcagttgtacgttctttgttgaggtgtctgaaaggcaacatagaatgggaataaattgggaagctatgggctgtaacataattgattggcaaaaaagagagtattcattaatttaaaattaaagttttttttactggcaaatcaagagaggacaaatgtctactttttaatttctctatataatgatcaaatgatcctcaagcaaaggagttaatcttttatcactagtttagacctttgttgttgagctaatgctctgttgggctataaatttttagacttttcacagtttttattgttgaaaagcacgctgttacttcagtgcattagatcaaaattaggaggagagacactttgaggacaatttaggagccacggatatgtttttttatgaagctgtctctgacttggaattcttcaaaatattctgtgtttgaacagatctaggcagacaggtctcctataatttttttggtgtgttttcttattattttatgctaaaggtcaagcatgtgcctcttgacctcttcttttacaccacatatttaacataaatgtaaaactgtgcagaaacaactctgccggtagaactttgttaattacctgtattctgaacagccagaaagactgacagtgacagaaaggggtcactaatctacttggccttttgaggactgatccttaagaataatttttttttttttatgatcttgaaggctgagaagtattagagtacttccataaattttttactaagttttaaagttttggggttagtggtagacttgatactgtcctctgaaggtattattttttcctattctatagtcatagaattttaattttcaagaaaccaaaactataaagtctaaccttcacagttctccttcactgtactgaaagtgtaaataacacgggctgattacctgctcacttatttcctcttattttggtattaactctactcattttgttcagttctgaataagatatatggataaaattctttaagtcagaattttaaaattaccatagcctcaagattagattatgtacattttttatgtcttcatttttgcactgcacccttccccacaacacacacatgtacacatgtgtatataccccctcacccattacgtgcttacgtgaatacatgcctctctttgcttttggaaaggcttgaaatctgcaacagtactgcatagatacaaaaatgcggtgcttttgattgattagtgacttcccactaaatatatttcagaaaagaaattccttgaataagttttattttatggtttgatttcttattagaaatctacatttgaaattattgcttgctatttcaggcagcttgcttgaaaatgtttttgactcatttttgtcaccaatattgattttgggagatggatgtgaactgaaggagagtaagaaataggactaagtctgtacttgatatccaaagcacaccaaatagcagcttttattagccactgtatttctcacattttgagaaagagttgtaaatgatctactctttccacagaatgtaactcttataaaagttggaaaaagcactgtagagttctgtcctctggccctattgcattataatttcgttttaggattcagcacagtttcttggctactggaaaaaaaaaaaaaaggaacagctttcataactcagcttttgctaccaggtttgtagtttgctacttggtaacatagtttaagatgctgaataaacagtagaatcatggaatttgtgaaagtgatcgagcatggcattttatggaagaggaaactgaggcccagagaagtcattgctgaagtgacgtggtggttgagccagagctagtagaatgtggtttgtaaattccagatcaattttctttctgttctgccaaggctagttatgttccttttggacttcctggcaactgttatttgaagactccttacccttaggtgatttattcttttaccccatttggacccaatgtcttaagtagaagtggttatatttagtattatgacttgcttacaaactaaggtagattttagtttcacttatgcccttgaatgccatttttataaactgagctctgcttattttaggagataatcagtgcattctttgtcaaagacagttgggattatgttatacctcttgttcccagatttagtactcgtttgcatatgtgtggctgctgtgtttcttactaatcatttgcttcctatgttgccattccactatttcctatgcctgtgtctgtctccctatagtttatcatttgagattcttcatttttctttttgtcttaccatggtcctgttccattggggtttttggcgtctgtgtgtttatatgtatatgctccttctgccccttggccatggctgtttctcagaaagccagtctcgtgcaaattgtacccttcatgccaggtttctgtccctgtaccatcagggggttttgtttgggacttcctgggaaagtgagcattaagtaaggttacagtcttatactagagtgaattgctactgctgcttttgctactgctggggcttgtttggaattttgcttgatcagagttaaagaacagctgattatatgtcaagttgaactgtacctctttaggtaccctactttttgatataatcagtctgtgttcgttctggtaaacttctgatattgctagttgtgattgctttagtctttgttttactctttaaatagttcctcaactaatgtaactgtagtgccacactgtagattcagcatgtagaattaatttcttaagggtgttcagcaacccactaagtgcaaaaatgaaaggagactgttacaataattgaactcaagaaaatccttagtattctttgcattttatagtgcttcttataaaaggatctccaatattaaatggttcagattgtattatgaaggattcccaggcctgttctttgtgatctaaagaaataaataaataggtccttcccatgttggctgttacagaaaataagagttcttgtcagaagatgatttagtgttgtcctactctcttgacccactgcaattttaaaaagaagattggataagcccattaatacatctataaatataaaatattttccccaattaaatcttaagaagtagtacttctaaattcatgttccatactgtggtgcatattagttggaattcagtgagaagcagaattagtaggatacacacacacacacacacacacacatagagatagataaatacatatatacacacatatataaacacacacaagcatacatatattatgagatttatacgtatatttatatatattaatatatgcctacatatattaagagatttattacagagaatagtcttgtaaaatcgtggggctggctaagcaagactgaaatccctgtggcaggctatcaggaagagaagatcgtgagcaggatggaacctgttgcaggcacaagccaaagctgtggtccacaggcagaattccttttctctcctgggaaacctcagccctgttttaaaatctttccaaaggattcatttatgtccattgggattatctaggttagtcttttttacttaatttgattagaggctttaattatgtcagcaaactaccttcacaagcaccatctagattaatatttgatggaataactgggcactgtaacatagacaagttaatatttcaaaaaagtcatcatctgatggttctggatagtatacaaataaacaaacaaaccagagcttgaaaagtcgttagataagtaaataaatttagagtagcctcaggaaccctgaatgtaactgcaaatttctctcctaaaatgagcatattagagtttctatttagattaatagtgagtaggcttttctttgctatcatgtttaaaatacttagagtggctgggtgcagtggctcacgcctgtaatcccagcactttgagaggcctgaggcaggcggatcacctgaggtcaggagtttgagaccagcctggccaacatggtgaaaccccgtctctactaaaaacacaaaaattagccaggcatgatggcacatgcctgtagtcccagctactcaggaggctgaggcaggagaatcgcttgaactcaggaggtggaggttgcagtgagccaagatcatgccatcgccctccagcctgggtgacagagcgagactctgtctcaaaaaatgaataaaataaaataaaataaattaaataaagtacttagaagcgtactggaggctgatacaggattgcttgctgtctgctttttcactcacgctgtccatcttagctgaatgttcccatgttatagcaccaccctgggaacattgtcccctgtgccgtatattgtattgtgccttataattttgctttttaatgtgctttgttaccttttttctaataccatgactaatggattcacagagtttagtgtttgcagcagaaatactcaattttactctagtatgagattgttagattcaatatgccattcaaaacttgtattcagagaatgacaaccatctgattttcatataatttagataacagaggttgcctttggtttatcaaagttagaaattttcagtgatccaaagaataatagagtctattattgtgtgatctaaagattaataggaattgtggatttactatatttcctgatttgagggaatataagaaccgggattttaatggatatagattttttgggggcggggggcagggtgtgttttgaaattcagccaagtgattatttatgggatagtcgagaaagacctgtctgataaagttattgatatatgagcagcgatttgaaggaggggctctataagaagtccgcagaagcccctaaaaaaaccacaacaactttgaggcataatttacatacaataaaatgcacccattttaagctgattgtttgagctttgacaaatctatacacttatgtgactaccaccatgatcaagatatatagaacatttcctcatccccaaaagttcccttttgcccctttacagcaaatctcttcccaaccctagtcccagcctctgcagatctgagacctacttttaaaattaattttatacattaaacttcagtttctcccttttgccttaacatttaattttctactttcccattctaacacaaccacaagtatgtgtaattccctatttcctcagctccagaagtagattcagattttttaaagccaatcaggataatagcattctctttcttagtgactagtttcgcattgagcacatatgcattagtgattggaaggaaaaaccacagggaggcttctgggaatgattttcttataagacagacttgcaagaagaaagatgacccctttctcctgaacattatcttgtcgggatgtgatacccataattgctgcagctacttctgccaacctaagatgaagccagcgtccagagagtgacagttaacaaaacctcagcaaagcagagttggaactgaaatggactattcctgaaactgcctctgtgctgcttgttatgtgagataggacaatttctgattgtttaagccagtttgaatgaggattctccgttacttccaacccagtgcattcaaatggatataattatgtacttatttccgcccccccccccctttttttgtaatggaagcaatcattttgaaaagagttaaagttttttggtaagtcaaataaggatcaatgctgctgaaagctgggacaacacacgggccctgaccaaattggggtttctttgtctacctcataccttccaaatcaaaaaataatttccctagtattttaattactcccccaaatcaggaataacttcctcactgtgctgattttggttcttttaaaataaggtggtaatttgaaggtaatagttaaaccagtcatagattattctatgccattcttttcaaatcagcccactcaggtgtcagtcctacttttcttttgttgtagtcctctttattctcctttgtttctgcctccacctcatcccccacccaaatgcctggaacagatctcaccctttcgtcttttgagaggaatacatatagcagatttttgcctccgactaggcagctactttaaagggggatgtattttgaatctaaggaagatacccaaaaattttaatgcagtttgtttagttatatttgttcattttagctgccctgtctacatcatgactttttgggttgggggggtatgtgttggaaaggtttcttatgtaggttttttttttttttttgacagaatctcactctgttgctcaggctggagtgtagtggcgtgatgacagctcactatagcctagacctcccagcctcaagcgatcctcccacctccgtgtcttgagtaggtgggaccacaggcacacaccaccatgcccagctaactgcttaatttttttgtagggctggtgcctcactatgctgtctaggctggtcttgaactcctgggctcaagtgatccccttggcctcccaaagtgctgggattacaggcatgagccaccacacctggtgcatgtgcgcacgctatttctctctctctctctctctctctctgtctgtctctctgtctgtctctctctcactctctctctctctctctctgtctgtctgtctctctctgtctctctacacacacacacacacacacacacacacacacacacacacacacacacacacacacatatatatatatatattttttttttttttttttttttaagacagattttccctctgtcacccaggctggagtgcaatggtatgatctcagctcactgcaacctccacctcccgggctcaagcgattcttgtgcgtcagccttccgagtagctgggaatacaggcatacaccaccatgcccagctaatttttgtattttcagtagagatggggtttcaccatcttaaccaggatggtctcgaactcctggcctcaagtgatccgcctgccttggcctcccaaagtgctggggttacagggatgaaccattgtgcctggcctagatttttgttatacagatgtttgaggttaaacaactggtcctgcattacataagtaggtagcagagtcatgcctaacaattccagtgtctgtctctccttcctgaaaagaaatccttttcaggtgttcagttttcattaatgacctcacctcctagaagaggaggctgtagacagctagatgattcagagtctgttcacttgaggatcttactgaggccagagtctttcccacatgctggaatgcccacttacaggacaggtactgcataactggcatgtgggttgttttgctgctaggggccagtttttctacacatgtgctttttaatgcttctctcagtctggactcagttaagggatacgtctggctcaaagagactaagactccatcaatacagaagctattgtcatttcatttatagattatgctagcattggcgtttatctatagcttgtctaatagctagaaattccagtgatgaaattttagttccttaaggtctggttgagctctactggaaggtatcacttaacataccacagaggctggtcatcccagttatcatgtgcccagaatgtagtagtatcagaaagaaaggacttgttgaactttggactattttttttgttttgttttgttttgtttttgttgctttttttttttgaggcagggtctctctcatccagggtggagtgcagtggcactatcacggctcactgcagccttaacctcttgggctcaggtgatccgcccacctcaacctcctgggtagctgagactagaggtgcatgccaccatgcccaactaatttttgtattttttttgtagagatgggtttttgccagatagcctaggctggtctcgaactcctgggctcaagtgatccatctgcctctgcatcccaaagtgatacgattacagaggtgagccactgcagccagccctgaaatttggactcttaagtctttggtctttccatgttcgaagccaatattaaatgatagtagcttgggaggttatttggttggaaggctaataagtaattttggatcctaaactattaatactaatttcaggtcctccaactctagtagagagatacagaatacagagggaaaaccaaaatattgcactgctacaattattctgagaaagatagaactggagatcagttttgttgttcgtatatacataaaattcttagggctagccttgtgagtagttatgatggaggtaactttgtttttctattttgtggtggttaattttatcttctttgctaaccatcttttccatacctcattgtattagttcgttctcatgctgctataaagacatacttgagactgggtaatttataaagaaaatagttttaattggctcatgtttctgcgggctgtacaggcttctgcttctggagtagcctcaggaaacttacagtcatagcagaaggtgaaggggaagcaggcacatttacatggccggcaggagagagagagccagcaaagggggaggtgccacacactttcaaacaaccagatcttgtgagaactctgtcacaagacagcactagggggatggtgctaaaccatgacaaaccaccgtcatgatccagtcacttcccaccaggccccacctccaacactggggatcacagttcaacatgagatttgggtggggacaaaccaccgtcatgacccagtcacttcccaccaggccctacctccaacactggggatcacagttcaacatgagatttgggtggggacaaaccaccgtcatgacccagtcacttcccaccaggccccacctccaacactggggatcacaattcaacatgagatttgggtggggacaaaccaccgtcatgatccagtcacttcccaccaggccccacctccaacactggggatcacaattcaacatgagagttgggtggggacaaaccaccgtcatgatccagtcacttcccaccaggccccacctccaacactggggatcacagttcaacatgagatttgggtggggacatagagccaaaccatgtcactcatctggaactattagctcttggcttttacatcatgattaaactttaattttgtggactaccaagacaacctagtgtgtatttatagtattgtttttaagggagttatattttgatttataaacaactgactttgttaaaaaaaaaatgttatggccaggcacggtggttcacgcctgtaatcccagcactttgggaggctgaggcgggtggatcacctgaggtcaggagttcgagaccagcctgaccaacatggtgaaaccctgtctctactaaaaaataggaaaaaaaaaattagccgggcatggtggcaggcacctgtaatcccagctatttggtaggctgaggcacaagaattgcttgaacctgggaggcagaggttgcagtgagctgatactgtgccattgcacttcagcctgggcaacaagagtgaaactcccatctcagaaaagaaaaaaaaaaaaagttatgtgatctgttcataggatttgggctaaattctgagcatactaagaacacccttgattaaaaacaaaaatcaacaagattagcccaaatcctatgaacagattacataactttttttttttttggaacacaaagaatgaatgaggtcattttcctatcatgccagtagtgatttttaatctgggagtgttatttgcacatgtgtatgtgtaagagaaagagaacttttctgatggcatttgggaaaatagctgccaggcttcaacttaatgcctaaagattattgccttttgagtttttaaattttcttttaaagatttcacaactagtttctaaaatttttatacaatgaaaatggaggtttttatttttcataaatcttctaaaatgtgttggcaaacttgaactagtttataggatgatattaccaatttttggcttgatagcagtcaaattttgaagatgaatgctttttttcttatctgtcttttcttattcttttctctttgactgaaagttttgttccctttatttgtttgtgggaatctgacctattttaaatgttactttttttgaaaaagaaaactttactgacctcctttcgctagtaatctctctttcctttacttgtgcttttccagtagtaactatcacattctgtcctgtgactgtacattagagagaccaatgtatatatgttataaaagagaagtagcactcttttctcattctgctatctaatcatctcacatttccttttctttttttttttctgaggcggagtctctctctgtcgcccaggctggagtgcagtggcacgatctcggctcactgcaagctccgcctcccgggttcacaccattctcctgcctcaccctcctgagtagctgggactacaggcgcccgccaccacagccggctagttttttgtatttttagtagagatggggtttcaccgtgttagccaggatggtctcgatctcctgacctcgtgatccgcccgcctcggcctcccaaagtgctgggatttcaggcgtgagccactgcacccggcccacatttccttttcttaccattgcccataatattcagaccctttaggagttaaaaagagagattcagtagtctcccataccttgatattatattgaaaatatttttatatttcttttatatgtacatagtatgtttacacatgtacatgtttatatatgcatacatatatatttgcacgtttttccttctgtaaaaatgtaagtacattcatctgcctatattcttatacaatttaatataattcagttgaattacttttagatttgtagattaaacaaaagtgtagataactttccctttctcctttttgtcacaatgaaatgccatttctgaccttgtttttgtattttaacatctctgaaattgggatacacgtacaagtaaatggcatggtataatctaattggtataactttttttctttctcagtaatataaaatactttttactatgatgtgtcttctatccttggtgaattgatgttaagaatgcattcaaagagtgaataaaattgttttgttgaatgtgggagtaggagaaagtagtatttctaaattaatattattttgtcatatatttcattttaaatgtacgtgtagtaaccaagtgaatgtatttactagtataaattgtaaattagatatttgacgggtttacctatatgctgagtttgtttatttaggttgaccaaaaacggtttcttttggaccatctccttggcaaaatgggctttatgatattactttatgttagtatcccattatattcaggcatctgttgcatagtgtaacccggaaatgtaaacctaggtatttagtctttattctggtaaatatttttccttaaattttgaattgatagtcatttactgtgtcttcaaagatctaccatatagaaattaagccgtatgcaagattgacataaactgctatataattcatgaggaaagtgtctctttagagaaaaatattcttacttttaaatttatggatatgcatcttcaatccatgaagtatagtgtcagagaatatgctcttaatgtggttagagtggaagagagatgactggggctgcggatggtggctcagagtaattatataatatgtgttcttgcttgagggagaatggtctgtgtttaaaaaatgaaaaaactgaaaaggaaaagaaagataccagcatattacaactgaagatgactggttctttatctgatcctgcttgcttcagcttgctttctggggaagctgcttgtttctttcttcttcctccttgatgaatatcatagacttcctttaaaaggagagtaagttacaaagctttttgtagtcagttctgttaggttatcttcccaaagtttcctgtgggcacagcaccttatagtttgttactgtggtcttacaggaatctgtgtttaatggctactgtagtgtttcacctaaaagtataaagattaggattacatataattcgatgtacagattttttctcctgaagttatttcccaagagttacagtttagccggacgtggtggctcatgcttgtaatcctagcactttgggaggtgaaagtgggtggattgcttgagtccaggagttcgagaccagcttaggcaagtggcgaaacctcgtctctacaaaaaatacaaatattagccagttgtggtggtgtttgtctatagtcccagctatttgggaggctgaggtgggaggatcacttgagtctgggaagtagagtttgcagtgagccaagattgcgccactgcactctagcctaggtgacaggtgaaaccctgtctcaaaaaggaaaaaaaaagagttgtaatttgatgctaaagtgaaatatgattcatgaataataaagtaggtaaaaattaaattaataattaaagttgctctctggcaggaatgcattccattttttcccatggatttacccgtgtgttatgtaaaaacttgcatacaaagaagactcagttaatgtccttgttcatctaaaattattttgacttcctgtgtcacaaccaatgagatagaaggatcattgggaacaatcatttagagatcggcttctttctgcctttgaacattgtctgcattttacacagcgttatagatgctaaacgttcatggagttttatagactcctaaggaagcatcataaaacagataaattatgcccaggtgagatgtcagcagacctacattcttactctttttgagacggagtcttgctctgttgcccaggctggagtgcagtggcacaatctcggctcactgcagcctccacctccctggttcaaccgattcttgtgcctcagcctcctgagtacctgggactacaggcgtgtgccaccacgcctggctaatttttgtatttttagtagagatggggtttcaccgtgttggctaggctggtctcaaactcctgacctcaggtgatctgcttgcctcggcctcccaaagtgctgggattacaggcgtgagccactgcgcctgcccggctgctacattcttattctgtatctgccactcaggcaccatgtgattgccagcaagtcgttttgtttctgtttttcatctcttcatgttacaaggtaacaaatcttgtccttcttatctgtttttattctcacaatgactttttaaaacttgtaagtactgaattatacttttgcaagacatcactaagtcttagaaaacattaaagtataaatggaaatggtgcttgcattcaagaaatagatattttgtttcagattcttaaggtacaatttagaccatgaagctaatccagatgatactggtcgttagaagccctaactatttggaggatcatactaattacagtgaaactgattactttttgaaaagagaaaaactgcttgttgttgtaaaagacagtaatgaactgtaagggctacatgctgtgcaggaatattaagcatgactgctttatatctcctactgctaagcagcattggaactgaattgatgtaaacaagcctgtgtattcttgttcattattgcttttagattgcaccatttgaggattgtggtagatttggagtgagaagtactagttgttattaggagaaaattatgttttaacatttgagaaaattatttcaagtacattaaagttctgtattctacagaagctgtgtttttctgcttttgcttttagataacttggattctcttaatggaatggggtggttaaggcgtagttagttataaggtgggtgtctataaaactaagcagactaaaattgtgcagttacttaaagccaactctgactacttaaatgagaatgagatggctaaccttctctatttttcttagtgtttaagaaattgttttttttttcctgccccaggaaatggtaaattttagacaacttttttttttttgagaaactttcattaaaatacaatggtgtaatctaataagaaagtaaatttgttgagagttgaaaatctgaaataattcttttttagtgactgtatagaatttgtgactccttcccttctctaatcctgcattttatgatgtccatgaataatatttctgaatattgtccttattaattctttctaactttctttttcacattttcttcctggatttcctgtttccttcagtctcacctcaaggtcagtatgcttgcactaaaacaaagatgatgtgattgagcgttgtttgcgaatattgtcttgaattcttacagggaactgaacatatttcaggagagggatatctagaaatctagctgtgaggataaaatgtcaagggtattgggtttatcagaagagtgtgttcagatttttgtgctttgaaaaggtagtgtgagtagtcagagagcaagaaccagatggccaggttttgactgagagagaagtggagatgaaaagagcattacgaggaaagaggaggggaaaaagaattgtgttaatgtaattgaacattcagtggagacattctggctattaaacggggtaaagtgccgcaaaaatgatggagggaaagtcacaactgcctatagctttatagaagaaaccttgaattatttactgagacgaactttcagacacacacacacccacatcctttaaattttggtttcattttgtgactctgctgggtggtagaactagtgataacaaaaacagcaacgattactgctatttatatgtgccagaggcactgtagcggaacatattttgtttcagttgatcttagcaactatgaagagagatttattattttgattttttagttgaaaaagcacaagtgcagagaccattaagtaacttgcccatcttcattagtaagtaaatagtgagagaagcggcacaaaacaaaaatctgcatttaaaaagttacttattttgcatatgagccatgacaatataaagtgtgaggatttctgataggattcagaaatgagcctgttaatatcatatgtgttttacctagcagctgcctaataataatagcgattatatatatgtgtgtgtgtgtatatatatatatatatctgtgtgtgtgtgtgtgtatatatatatatatagatatatatttgctgtttataaaagcacctctttgactcaacagctagcatatgggttacactgggataagtgttaaaagagttagcccgccaaaaaagaaaataaattgaaaaaaatttatgccccctgcccattttgagtaagctgtattcattacagaaggaatcttaaagtgtttgtaataaaaatagcaaacacaaatactgcatttaaaaaatagattttcccgtttctaatctaaacattttctccacatattgtagtagaacagtatgggtaccacttaagtaattccaattaggtggcaaaatctgaaagcagttgagttttagtataaaaatttcatgaagtgttttgccttgtgtttagagaactttcatctctaacttaagcttcaagctgactcattttagtgggaagttttatcatttgtcccatagttagtcctttgcacgactggttttgctctcagtctctctaaatgaaaccctgggaaaagcttcagaagaatttgaccgtgaagccattggtatatacataattcactgagttacaggttatattaattgtaatattgttagctggtttattttagttaacttttacccagcagcaaatgccattaaatcatacttatttctaaataagtttattttccaaggaatacaaaataaaatagtcattgttttttcagtggcaaagatcatcttagctgtagtatgcaaaagtttaaagtctctcttcattccagattatgatttagtgcagtattttttttctagatagaaacattttaccattttaattgtggttttgccaagtccagttgaataggtcataaagagagtataatttattactgctttgatactggattgtttgggtgacttcattatatgaccttgggcaagatacttaacctttccatgtttattttaaccacttgttttgtgttaatagtgatgcttagctgtagtatttgtattttagtgtctccactaaacatttctattttgcagaggtttatttttattcctctcttctcccttgtcttcttcccctgccctgctctcctctgtcttcctttgcattcagtacagagtagtgagattttatttagagtgatactgactgaagactcacattttctatcttcagacatacacatctttttatttcctgttcaatgacattagcaccagagagtgaatacaaagaaattattccatgtatagatgaaaatatatgatttggttcagaattcttcttttggctaacggtcattcagagatgagagctataaatgtcatctctattctcattaacacttaggtctaaaattgagctcaatattattaatatctatgttttaattatcagttaccactgtagacttgtttttaaaacaaatgtttagaatatgtgtgatagttcctaacaacttcattaacccatttataccagaggttgcacattttttgtgtgtgaagaatcagagcttcgtgatgaccttgagcagtaggatataaataactaccacaagcttagcattccagtaatagaacactaggcataaaagggttaagaccagagtccctatgttgttaaaagttaaaatacttttatactttgccccccaaaaaatcccattgttatagtctcttttatatagtttgatggaaacatttcacattaatttctaaaatctaattcaaatagttatttctctgattacacactttaaaaagattttttacattattgtctgatttcattaagaaaaggcactatactagttgctaaaacctcatcataagatatatcactcacaaaaatagatgtaattgtatttttgaaagggttagtttcttatttttttagctaaagcttttttttataggccctagaaaatttctgaccccataaaatctatttacaaggagtttgacttatgggcaagagtttataacccaggagaatgatcgttattatttgcatttttagcttccacttttcattcctttcgcttttttaagcaactctattgttcaagagcgtatttcttattatttttctttcaaataatagtgcctagtgtttttgtaatagtctgcacaagcaagtgtaacatcttctctgttaaataacatctgctggtgtagtagtgtactcttttgaataactcattggtgggaaaaaaaatacgtgaatgcagacttgtgctgatcttcctaactcttctactgaaaatgatagttttatgctatcatgcattgataaatggtaaatgtttttttagatagcaattgtagatcaccacggttgtagatcaccacaaattctgtaaatcagctgaagatggcaaattcaacagagaagggaagaaagaataattttaaagttggccaaaatttgagtttttatagagttgccagatttagcaaataaaaatatggatgcccagttaaatttcatataaaccacaaatcatcttttagtatgtcttataataactattgggccatacttactctggcacccacccccccatctcagtaaaacgacagaaacacgtctgatttctgattacagtttgacactgttaaaaatgctatcaccttctttatctcacttcacctcataacaactatatgaattggatgacattttcccgtttcacagatcagaaaattgactttacagagatgagatgatttacttcgggtcatagctactaagtggcagaatctagggtacaaatctagtttgtctcatttcaagtttacttcacactttcctttcctctgtatcaagcttgtccaacccatggcccacagcccatggcctgcatgcagctcaggtcagctttgaatatggcccaacacaaatttgtaaacttacttaaaacattatcagctttttttcatgtttttaagctcatcaactattattagtgttagtgtattttatgtgtaggccgataattcttactcttccagtgtggcccagggaagtaaaaagattagacacccctgctctatatcttgttctgttatgtgtttgtgacatctagagatgacatgcaggttgtaatacctttttaaatttatgctttttagatccttggagcatgggggtgaagggttggattacttgtattatttggtttgcacagtgtccagagaagcagaatgtgtggtcttggagtggaaactgcatgcagctctatctcttatttggcagctgttggcgtgttccagttgtgtcttcttttgattatactaagcctgtcttgtatgggaaattgattaattctgaataaaataatgatattgcaatcagcaattaaattgtttttttgttttgttttgagatgagtctttctcttgttacccaggctggagtgcagtggcgcaatctcagctcactgctttcaagcaacctccgcctctcgggttcaagtgattctcctgccttagcctcccgagtagctgggattacaggcacttgccaccacgcccagctgatttttttttttttttttttttttttttttgaggtggagtcttgccctgtctcccaggctggagtgcagtgatgtgatctcagctcactgcaacctctacctcccaggttcaggcaattcccctgtctcagccttctgagtagctgggattacaggggtgtgccaccatgcccagctaatttttgtatttttagtagagacagggtttcgccacgttgctcaggctggtcttgaactcctgacctcagatgatccacccgcctcggcctcccaaagtgctgggattacaggcgtgataaactgtttttaaagcagtctcatgatggctttatttgcaagggggctattggtatgtattgttccctatgattatcaatacatttggaattcacatagttaaacaaacttatggtttcatgtagcaatgtttgggatttcttcatagcatttttttttttttttgctctaattcttaggtgagattggctagtctgtcaccatttgtagcctgttgtatgagatgttcctatagtatggactagttcattcatttgtgttgtcctatttatcaacattttctgccttgctcaagaaatgctctataacgcaacttgtatttcagatattgggtaatttgattattttataagatcctttagaacagtgcttctcaaacttaagtgtcatacaaattggatgggagcttgttaaaatagagttcttatttgatggatttggttggggcctgaatttttctacctttcgaaaagctcccagttggtactgatactgttggtctgttgagcgtgctttgactcacaagattttagtgagttaacgtttttcaaatagatttttctccttttttaaaaaattcacaaacatttaacaatatctctgttgatttatttatactagctcatatttgaacttgttataaaaatcgacctttccttgggtttaggatatcaaggtgaccgttttgcctttgttaaaggacgtctgaggttttctattggcatgggtacaagagtcaggttaagatttcaggatgttagagcaaaagcactgttttcactggcacctgttgccttgttgctttaaatgtataaaagcatattgaacagtggaacaaagtgacaagaaatttagggtgaggcaactggagaaaagagtcacaaacttcagaactattgagttggcttcttgggtatggcttatgctttcacagaaaccttccttccaacctctagtttctgttgtccatgtatgtggctttgaggtctcagaatttgagattgtgctttgggagaaacagacaaggaaatcagtggccttcactggcagctggcagacctgtaagtgatgtggtttaattgtgtgtacgtcaggattgctctgtctttaagacggtctttttaagctgcagtgtttatccactgttggcattttctttgttggtgaagttgtattcttttgttttaatcttccagctcttgtctgggttgtcaaatgtttgagcatgatagcaaagatctcaaaactagttctttttgcaagcagatctcatctttaaggtgtagtgtaatgggattcagaaacttgactcctgtcataggcaggagggaaatgtgtgtttaatttttctttacttcgctttccttcattaatatgggattgttattattattttctggtgtgtttgggatagttgctgtcaatggctacaaaagacagttttaagattctttagctagggctgggcatggtggctcacgcctgtaatcccagcattttgggaggccgaggcagatggatcacgaggtcaagaggtaaagaccagcctggccaacatggtgaaaccccgtctctactaaaaaatacaaaaattagttgggtgtggtggcatgcgcctgtagtcccagctactcaggaggctgaggcaggagagtctcttgaacccgggaggtagaggttgcagtgagctgagattgtgccatgcctagcaacagagtgagactgtgtctcaaaaaaaaaaaaaaatgtagctagctgtttggcctaggtattacaaatttcaatgtttgttattgtaagtttctatattcaaaaatcacttaagtatgttacacaactattttgaaactgttagtgaaaaataatccccttcaaatgcaatcttttaaattgatatatatatatatattttgagacagagtttcgctcttattgcccagactggagtgcaatggcacaatctcggcttaccgcaacctccgcctcctgttttcaagcgattctcctgcctcagcctctggagtagctaggattacaggcgtgcacccccatgcccggctaattttgtatttttaggagagacagggtttctccattgttggtcaggctggtctcgaattcccatctcaggtgatccacccgcctcggcctcccaaagtgctgggattacaggcgtgagccaccgtgcccggcctaagttgagatgttaaaaggaaagtactttgcagatgactttccaagaaaactagaaggaacaattggcttggggaagtgatcataatgatataacttggatataatcagaactttttgtcttttttctgagatggagtttcgcttttgtcacccaggctggagtgcaatggcgcaatcttggctcactgcaacctctgcctccagggttcaagtgattcttttgcctcagcctctctagtagctgggattacaggcactcaccaccacgcccagctaatttttttttttttttgtattttcagtagagacatggtttcgtcatgttggccaggctggtcttaaactcctgatctgaggtgatccaccatccttggcctcccaaagtgctgggattacaggtgtgagcctctgtgtccggccataatcagttctatacaatgtgttgtgagaggaaaattcaccacaggctctttaccttatttaaggaggtcaattaaatataaaccatagtagcttgcttattgtcattattagtttattgatgcaacagtagagtaagttgattctttcctacattactgcaaaagctatctaatgcttcctcctgtccactctcattatgtttccctttcagcttgttccaaattttgggaaatctgattatatcacttccttatataagtcctatatactttgggtaagctacgcattccttgcttagcatataattgtttggctttgcttacctttagctttctttttctctactctctcctccaactttaagctatagtcattctgaaccatgaggttttccccaagataacacattctccttttcctcaggtttttgttcgtagttcttctctgcctagtactggatcacctgcctagtaacttggacttaatcccttaggaaagttcagatactgtttttccaggaagcctttcctgatcatcaccaccacctccacctccagactagcttagggctctttcctgtccactctaatagcacttgttatatactgtatttccttagatgcctgggaagtatttgagagcacgaacaatttttattcatgaaattgttgcaggaatttttcttagttcagctaaagacggggtccttgtcacacagccacgaaaatttaggcttgtgtacgattcgaacgttgagtaggacagggttttattgggtgaaaaggaaaagggggaaacagggcctctctgcaggccagattccttgctagagtgcttcccgccttgcagattgactcccaggttacacccgtgaaaaggaggggccaggctcctccctgctgcacaaggtgcagatttctgtagctccatcccagtgtgctctcctcccagggcaccgctggctggagtttctctggggaccccttcctacctggctttctcaaaattgtatcctcagtgtttgatatataatggtagtatttaatgaaatatttgtctatttaatgagtagtgaatatgtaaaaaacttagcaggctgtcaaagcttagataaatgtgatcctcttacatcccagagcctattttctcctgggcaatgcctaaagcttattttttagttgtctagtaatcccgattctgccctttgtgaggttagtcttcttcacctttacctgtaacctagcatttagtctagttttctgacctaccggtattttttttctagatgtaaaattatttcctgactctttctgcctaaatcttttggcttccattttgactattcacataaagagggaaaaaccccatagtgtcttacatttatttagtacctagtagcttaaagtgcactttcacattcaccatctaatgtgagtgaagagacagattctgtggaagaactaaactcatctggtcatactcatcatttcaagtgggaagaaagtggtagctttgaaaaggaagagtgcgtagaaatactgttgtagagtcgaaacttgctttcagaggagttgagttttaagaccgggtgcggtggctcatgcctgtaatgccagcactttgggaggtcgaggtgggcggatcactcaagcttaggagtttgagactagcagggccaacatggtgaaaccccatctctactaaaaatacagaaactgcctggttgtggtggtgggcacctgtggtcttagctacttgggaggctgaggcaggagaatctcatgaacccaggaggcagaggttgcagtgagccgagatcactgccactgcactccaccctaggcgacatagcaagactccatctcaaaaaaaaaaaaaaaaaattgccacgcatggtggtgcatgcctataatcccagctactcgggaggcagaggcacaagagtcacttgaacccaggaggcggaggttgcagtgagccgagatcacgccactgcactcagccttggtgacagaatgagactctgtctccaaaaaaaaagaaaaaaaataaggaaaagttgagtttttaaaaaaggaaatgaatccatatgagaatgccagggtacttacatcattggatatgctgcacttttggaaagaaaaaagacactgaaagatgaaatttcctaagaacagaggaatacatgctgttaaccatggtaatagaatcctggtaaggtaacaactctgtagagcagtgggtttctgccttctgatttatgtactatgtacaccatcttcatttcatatttggtatcagagatctcccaggtaaacagtatttgcttataatttctatagtagagaggttaaaagtatcgtagttacagtcagacagacctgagtttgagtactagttctaggatgtttaaaactgattttgggtaatgatttaattttattgaaggtttgctcttttcatttttagtgtggagttaataaaacctcataaaacattttgaataagatgataaatatgctgtgataaacattaaggtccttggtatataataagtacttgtaagggttattatggtattatatttagcatagcgctagagttagatataaacatataacacataacttcaatagtatcctccttccctccactccccgcctcccggcctcccctcaaagagtgaagaagaagcatattccatgtttgtttggatcttaatgaaagggcaaatttagatatttaaatttatatattaacatataaaacataaatatgcgtgtgtgtatacatacacacacacacacacacacacacacacacacacacatatgtttggggtgaggagaaaaaggatatgttagtaacctcttgcagtgtgccaaatcttacgctaagcattttccatgcattattttatttacttctcacagttctataagagatgggcattattcccatgtcataaataaaaaagataagaacactctgaagcttagagaggctaaagatcatatagataatgaatagtgaaccagcatttaacctagagctctttagcccttaaaacttttgcttttaaccactctaccatttgtattcctgttaggagtctcctcacatcccttgggagaccttgaacatattctgagatttacaagttaccatgttaattttatgattttgtattttcatttcaatgacaataaaaaagtttatatacatattctggatcacctgggtgactgtcttacaatgaaataccctatgtagtttcatttatatttatggatatcatctcattgtcttcaggtattactgttataattgtcatgggccaatgagaaaagaacagtggtgggcctaatccatactgttgctttttatccaagcagagttcaaatgatgtcataatgtactataagcagcaaactttttttaaaaagtaatttgacaaaatttctgagacagttggatcatcttacagctcaaaacaaaacaacttggacaatagtaataagtaccatgagtgcactgtgagcagcaatttaacagcatattcaattaatactggtactttgcactatgtcttttggtttgaattgcattcaatttgggaactctagatctaatatttgcattttttacagtattacaatttatcagtggatctagaaaatattttcttttataattatactatattatactatcatctagatacagaccctttagctcatggagatgaaggaatcagttctgtttaggggagtgctggaaagctttgccaagatactgccatttaagcttcttcttgcagaatgagtgcatgtatgctcttatgctcggcaaagacagggtaagggaaagggcagggacatgaagacatctgaaaaggcaaaaaaacaaaagaatcttttcctcatgcttactgcatgagggaatattaaaaatataggttattgttaaagacctttagtgctaattaagggaatatggattttattacgtaattagtgtgaatccaaaaaaagcaaaaagtgtgggaatataaacaacttttataattcaattgtgtgcatatggaatctttgtaaattaagtcatgttttacataaaaccagaatcttattggttaaagactatttggaaatggaatgtaaatgtttttgtatgaaaataaattgtccccaaattttcagatttacaagttaccttttttttggtctccccctctccttccttctttccgttcttttcctctaggcgcatcctttaataatgaaatcagaaactcgtaactttattcttctctcccatctcactgggatattttagcgattaatagtattctacccatttgatttaatgatttttattttattttaactaacatttattgagaaaactacatatgagattttctgatcactaatatttatttgcacagaaaaaggtgttactatcatttacttaatagatctgcttttattaatgattttatgccttgatttcccacagttagcctccagctgttacttctgtattatgcatgttagagtgaaatgtccaaattaaattagtttttaagctgagccctgtgaaatcaccaggtggagaaatacggatggcatattattcctgcatatgcattttcatatgctattggtgcagtgtaattcaactgtagcattcacaactttcatcattgacatagccttggtggggtcggggaggagggatggggggtggggggcggggggagtaaatggaatgatatgtacaaaaacacttttcagctgggaagagtgaaacaagttaataggaaataaaaggccatattgtctattcagactagtacgttacttttccagagtcatggggctagcaaccactatatgtctgacttctaccaagaagggttgaatccctggttgatcctgtgaggcctgaggcatataaacaagaaacatgaaagggagaggaaaattaaatgaagtgggagtgttgcagaataataatacaattaagggagaaaataatagaggtagaggaagaggttatatacacttatttctcttactatgaacattttacttagaagtgtaaggttgtatgtcttgtttgatacagtgataaaaattatgataatgcttaacagaaatgggtgctttgctccataaaagtgctccgtgctttcctctgtcattatgaattaatcagcaagaaatccagaagtgaacaacataaaagtattccctctcctcctttttttaaacagtgaaaaaagttgacaatatatttattctgtcatagatccaaaaagccaagcctgcgttttaaggcagggttttctttggttttctatttctcagccacaccttcagatttcttggcacagtacagtcatagcattgtgtcatatccttggtctgttttatcagactttataaattgattctgactgtaccagcagtactagattcttatctttacacagtttgggaaatggacaatgactcttttggaaaaacagctctataaattgtgctgtggtatgtgagaatgggttctctgctttgcttttcctctagcctgctgccattcctagacagtgtcatttctctgatttagggcattgtgtagctgttctgggtagagtaaacctgcctctaaatgtggaacagattgttacccgtcagaattctccaccttggaatggtgacactgaaagatacaattcagctctggccaacacctcctgtcttcccagttcacttactctcgtctccactccaattattgcatctaattaggaccttgaaacaacaacctactacttttttttgtttgttttgaacctcgtatggcctcacacttccttccttacccgggtcagatttcatggtccagcagtataattactcccttctaaatccccttgacttacttgcttttctcttttgtcacacttgcttgcaaaacctcaatcctgatttaaagcaagtgtcttcctacactgcctctgccctgagcagctttatgttaccgggcaagaagagtcacaaagctttgcagactggtctcacattgaatttatggccacagatctcaaattgctcctaattctgcaggcagtcctaattaagaggactattagatttgatttcccatcctcagaggtgactgtatcattctgttctcttatcaaatctgcaaatccttcgcctccactcaaagtttctggcttcacttgatatttctttgagaaaattaaaataattggatgctacccagtttgtctcctcatcaaatctaccagcctacttgcatctatacctggagcctttgcctgaatagtgccactattcctgaattcacctctgctgccttttctgttaatcctatcccagttgcccaacctaaagatgcttctccctcattatccttctccctcctttcaaatttttgctttctccttgttcacaagtgtactaacctgcctttagagttccacttaatgtcttaaaaaaaatcgttctcttgatgtgatgtcttattctagttgccaccctgtttctctcttcccttctcagcaaatcttatttaaaaaattgactgtagttgctatctgcctttccttacctttcttcaagtttgtttaatcaggctcctatttttagtagtcttacgaaactgctcttgtcaagttatcataaatatccatgttaccaaatacagaaatcacttccatggccccatcttaactttacctttcagcatcattctacacatttccttccttgaaacactgttttcttctggtatctctgataccagtgtctccttattttctccctctttcacctgtcattccttttgtggtgtttctgattctgccactttcctctagacctctaaaaggctccactctcagtcctattctcatatatatatatatacacacacacacacacacacacatatatatatatattctcagacttttcttttttttgagatggagtctcactctgtcgcccaggctggagggtaatggtgccatctcagctcactgcaacctctgcctcccaggttcaagcaattctcctgcctcagcctcctgagtagctgggattacaggcatgcaccaccacgcctggctaatttttatatttttagtggagacaggatttcaccatattggccaggctggtcttgaactactgacctcaggtgatccacccgccttggcctcccaaagtgctggaattacaggcatgagccaccatgcctggcctcagacttcttcaagtctaaggcattcattatcaaaaacacagcaatagctaccaaattaataatatacaaggtgctccagaatactctacttattacctacacaatgtctttagttaaatatcaaatttagttttactcagaacagatctcttgatctggcccacctttttcaaaacctcttcttccccagtttcccaccctcaataaatggtactaccattcactcattgtgcaggcaataaatcaccaagcaatccttgatttttcttactccctacgttaaatctattagtaagcccgatcacacctcaaaaatgtatctttaattcaatgattccattcgattctctctatgaaccattatccgttgctcaaattactgcagctgttttccaatggctatctgcttctatatcacttctgtactagtcccatctctgtagcaatcagactgaactctctttttttttttttcttttttgagacagggtctcactgttacccgggctagagtagcctggcgtaatctcggctcactgcaacctctgcctcccaggctcaagccatcctcccacctcagcctcccaagtagctgggactacaggtgcacaccaaccatgcctggctaatttttgtgttttttgtagagacagggttttgccaaagagcagggagtacaggcatgagccaccgcacctggcctgaactgaactcttagacattgtcaccccttgggttaaaaccttcctgtgttctcccatcatacacagtgaaacccaagctccttccacagcttaggctctgtatcctatggcttcttgccacccctgtaaccccaccacaacctccccttccatatactccacctatcagcttttttgttgttgttaaaacaagctaagcattttctatcctcaaagcctttgtagttatgattctctgtgcctcttctcctagatcattatatgtctcttccctgaccattgtagctgaaatacactgtttgtcacatccagtgtctccattacattgcttgttttaatttttttcttagcacatgtcactgtgctatgacatacttttttgttagtttatgttcccgcctcccccttttaaaaataagttcaatatgtttgttgagggtggggacattgtattcttttttcttccttagctgtatttaactcttggcaggcattcagtaaatatttgctgaatagatgtgcgagggctggctcttttctgaaaaagttgacagttgagaatgcatgctagttttaaattatggacaaatatgtggctttacatcagttgagagaaacttgaatgtttattaggttactgttatttttatttgtgtttttgagcaattcttttgtactttgtgataacaagtaattgcttccaaatgaaaaagacttttccagtgacctgcaaagctcttcagcagggattggcaaactacagctcatctggcacctatttttgtaaaacctgcaagctaagaatgggttttacatttttcaagggtaacaaaaaagaaaaatatatgagacagattttacatgattcacaaaatgtgaaatatttgctctctgatcctttacaagggaagtttgctaacccttgctggaggcggtggccctcattacctgccttcctcattagtggcctgctgcatctgtctgcttcacctgggcctcgtgcccattcgcatttgctgtttccttcgtgaggaacactcaggctcactcccttacttccttcacatctttgcttagctgttgcctttgcagtggagcctttcctgagcacttaatttaaattccaatcccgccacccattcctacacaccttatctcctttcttcttttatttttcccattggacttatcactgtctgacataccatgtatttttcttatgttctctttctttccagtggacagtaaactcagtgagggctgagatttttgtccgttttgttcacggccatattttcgaagatagcacctggcccatagaagcttttattaaatatttgttgaattaatggtcatagattaaagttatcttgagaaccagcattaaaaaaagtcaaaacacttcagtaaacattgattaattgccataaaacagtcctcatctcagatctatggagttgtataaaatcgggtccttgtcttcaaagaaattagtgtagtagtgagaataagcatagaaataaaagacactaaatgtaagatgagactaattatcctgcagtttccttgctgattaaaaaaatgttgaattgatcatttaaagtatttttgcagaagttaaaagtgtttatgtaaaactccaagtaattaacacttttacgttctgtattgatatcttttctccttttcatcatgacttgttttctttagacagttaggaatatggttccgtgaaaataaaacccatatttaaaatggcttttaaatagtcaaaagcattttaattagataaataacaagtgaaactattagcattttatttttagttttttggttactctttgggcaggtattttttaaagcacaattagatatttaagtagtattataaaattttatgtcttaatttttatgttaactgtgagtggagctctttggaagaaggtaaaatgagagagagtgtgtgtatgtgtgtgcacgtgtgcaatatatatagtcatgagtcattgaataattgggatgataggttctgagaaacatcactatgtggtatcattgtacaaatatcatagcgtatactaacacaaacatagatggtctagcctactgcacagccaggctgtaaggtatagactgttgctcctaggctataatcctgtacagcatgttaccgtactgaatactgtaggcagcattacacagtggcatttgtgtacctaaacatgtaaacatcagtaacaatccagtattataatcttatatgcatctgcatacaagatgcagtctattattgaccaaagcattatcatcatgtgctgtaggactattatgagtgtacatattctctttttttttttttcttttttgaggagacagggtctcgctctgtcacccagactggagagcagtggcgcgatcttggctcactgcaacctccgtttcctgggttcaagcaattcttgtgcctcagactcctgagtagctgggattacaggtgccaccatgcccagctaatttttgtatttttggcagatacggggttttgaggctggtctcaaactcctgatctcaagtgatccacccatcttgtccccccaaagtgctgggattacaggcgtgagccaccacacctggcccatattctctatatgtaacattttataaatattatagatgtttatatgtaatatacacagtgctttagcaatgtcattttatttttaattattgtctatttaagccctagcttaagcttctcttcttgagtgaaaacacaaataccttagtgaaatttgattgataatattttttttaatttgacaatagaagcatcctattttttcttaaatttgtgtgggagattttatggtatagtaacgtataacactaactatatgtaacttcctttttggtaaagcaaaacagccagtagaattgtagcctctggcaaatgttgttagtttcttaataggaaggagtaagttaaagacagataataaaaattcctttaccaattaattttgctaggtgtttaagatacaaggaagatatttattttttagtaattccattgttttagagcttcaaacaaactgtattttccctcagagttttgttttgggtggatttgtcagtagggtatgattagtttcctttttacgcatttgttcaacaaatgtttaatgagcacctataaaccacaaggaactgtactaggaattgtggattttgaaaatatatcagaggaggactttaacctctaggaaggcatgttcataaagtacagtaaaacaggtatgtagactccctccctaatgtggagaacaagtcaacatgtcataagatagattcagttaaagtggtatgggagttaggagcatccataatagttgtgatctaatagatttacctaaatttgagtttggattttaagagacagaggcttagagcagcaataacaaagtaaatatgggcaaagcctgcctggcatagtctgcattgactgttgtttcttaacattgtgcatttagtgtgtattcatatcccctgggaacctcgttaaagtgcagattctgatttaataggtctggcgtcaacctgagattgggtgtttctaccaaacactaaggtgatattcatgatataagttcatggatcacactttagatagcaagatggtggaccacattttgtaaaacttctggtggcagagacaagtaaaaattcaactactattttctttcccatcttcgtttttctgtcttcttacacttttgtttgcttacatctgtgtgctggtggagagagttaaatcttttattcatcatttcactgtttattataatagttgggagcttagcaattgtgaatctaattttaaagcattaatttatttatgaattgctctaatttgtcctcttcctgcttgaagaatggtaaaacatctatgttcactatgaattaaattcagattagttcaggcaaaacagcagttgagagagttttaataaatttactaaaccattaaatccatggcacctcacgataggaatttactaacatctgggttttcttgagaatttagattcaaatcaaactagatgttaatctacttataaggaaaaagaaggaaattcctcatttcacaagttctgttatgtctcagaatgttttttcctaaatatacattccagaaataccctccttttactcttttaacttatatttagatgatactccctcttatatctcttcccagagaaacagtattgaaaaggataataatgaggcaagaaaatcattgtgtgttttcatcttttccagttaattcatgaattcagaactatgcatacattcataaaaccatgtgcatgcacacacacacgtacacagacagacacgcatacacaggacgagaaggtgggggtaggcaagagattgatttaattgtctcacaattttctatacttttcttggttgcctatcatagataaaaccattttatcttgatagtcatcctttagcctatagagtgaaggtgaagaaataatagtggtgaaactaaagataggagatttaaaatatgaaaagaaaatggattaagaaaatcaaagaccaaaaacttaaaagaatcaaagaccaaaaaaatgtgccatactgtactactttgtatatctagtctgatataggcaaacaacctattttgagatacaaccatatctctttttagaaacaacttttaaagaaaattttaaaatattttatgtctgaagtagaaaatttagaaactgtaaaaaaatgataaaaaagaaaaaaaaataggctgggcgctgtagctcactcctgtgatcccagcactttgggaggctgaggctggaggattgcttaagcccaggagtttgagaccagcctgggcaacatagtgagacctcatctctacaaaaaataaacagcaataacaaaattagccaggcatggtggcatacgtctatagtcccggctacttgggaggctgacataggacgatcatttgagcctgggaaatgagctatgattgtgccactgcagtttagcctaggtgagtaagtgagaccttgtctaaaaagaaagaaagaaagaaaagaaaagaaaatgaattttcaaaaaacaaaaagaaaaaaacatgcttaatttgtccatcttaatattcttcattatatgtgtgtatatacatacatttgggatcatgctctgtattccttagttagcattttattatgtctttttggagttgatggaggtagtcattagtatgtctgtgagccaggtggaatgctcacacctgtaatctcagcaactcaggagtctgagacgagaggatcacttggggccaggagttcaagaccagcctgggcaacatagcaaggtgctgtctctacaaaaattagctgagcatggtgatgtgtgcctatagtcccagctacttgggaggctgaggcaggaggatcaattgagcccaggagttcaaggctgtagtgagctatgatcacgccactctactacagccaggacaacaaaatgaggctgtctcttacacacacacacacacacacacacacacacacacacacacacacggagtggttgattggataggatgagggtaatgaatttcttgaattgttttttctgaaacacgactaaaaacaccataacctagttttatgatttgtaggtaaagtaggatttttaaaatcacttactcttcgatataattgtgatggaaagtgctgaggaatgaaattggctttgattggattaaatatctaccttctaaccaaaacatagtctagtagttttaattcagttatttattccacatgtcataatgccccaaataaccaggctactgctattggcattaaaggttgccagcaccatctggaataattcacaaatgcaaggtgaaaggaatttctgcaccatttaaatttttttctctctcttaaaacagagcaaaatttttgcatctagtaaatgaatgttaggaggaacttaattttgagaaaaagcaatttgattcataaaaacagaatttttctccatttgtttgtcttctctaatgccaggagccagtctgctttttccattagttaatataattgatatcagattgttaaaatgagaaataaaaaattatagagtaaggagaataaatataaacattatttttctttttatttcctctagtgataactgattttattatattgtctgtggctgaattcttctgtagatattgaagatggccaaaaatggagatctaaaatgtaacttcttagtgtgcattttcaatggagaatgaattatctcatcatctgtgtcattaattcatgattttatcttgaataatttttcccagctttattgagctataaattgataaaatagcatgcatttaagtacggtgtaccacatgatctgatacatgtatacattgtgaaggattagcacaatcaagctaattaacacctttatcacctcacatagttaccacttgttgtgtgtgttgttagaacccttaagatctgctcttagcaaatttcaagtgcgccgaacagtattattaattatagtctaccatgctgtacactggatcttcagaacttactcatcttctgtaactgaaagtttatgccctttgacaaacatcttccacgatctccccctttcccaaccctctagaaaccaccgttctactttctctgagttctgtgaatttgatgtttttaggttcattcatatcacaagtggcagtatttcccttttgttcttgtttcgaaacagtctcactctgtcacccaggctggagtgcagtggcgtagtctcggctcactgcagcctccacctcctgagctcaagcaatttttctgcctcagcctcttgagtagctgggattacaggtgtgtaccaccaggcctggctaatttttctgtttttagtagagatggggttgcgccatgttggccaggctggcctcaaacttctggcctcaagtgatccacctgcctcggcctcccaaagtgttgggattacaggcgtgagccactgtgcctggcctcctttttgttttatggctgataaatattccatttgattatatatgccacattttctttatccattcatctgatgcacacttatgttgtttcacattttggctatcgtgactaatactgcagtgatatgggagtgcagatcctgatttcagttgtttttgatgtgtagcagaagtgacattgctgagtcatatggtagttctgtttctaatgtttagaggaaccttcttaccgttttccataatggctgtgccagtttacactcccaccaacagtgtaccaggattctcttttctccacatccttgccaatacttgttatcttttgtctttttcatagtatccattctaactggtatgaggtgatatctcattgtggttttgatttgcatcttcctgtgatgttgagcgtattttcacatttagctatcctttggcctgttgagcatttttccatatacctggtgaccatttggccatttaaagtcttctttcgagaaatgtctattcagatcctttgcccattttaaaatcaggttgttttcttgctattgagttatctagacattttgaatattaactccttatcagataggtttgcaagcattttttcccattctttaagttgtctctttactctgttgattgcttgcattgctgtgcagaagccttttagtttgacgcagtcccatttgtctattcttgcttttgttgcctgtgcttttggggtcatgtccaaaaaatcattgtgcagacccacatcaggaagttttctttccccagtgttttcttctactagttttaaagttttaggtcttatgtttaagtctaatccattttgagtcaatttctgtgtatggtcagggataagggtccaatttcattctcctgcatgtagatatccagtttccccaacaccatttattgaagagattatactttccccaatgtgtgttcttggcatctttatcaaagaccaattaactgtaaatgcatgcatttatttctgggttttctattctgttccattggtatagatgtctgttttcatgctggtaccatagtgtttagatttgtaacatagtttgaaatccgaaagtgtgatgactccagctttgttcttcttactcacaattggctattcacggtcttttatggttccatacgaagtttaggattcttttttctgtttttgtgaaacaatgccattggtattttgatagaggctgcattgaatccatagattgctttgagtagtatggacattttaacaacattaattgtttcaattcatgaacagattatctttccatttgtatgtatctttttcaattcctttgtcttctagtttttagtgtacaaatctttcagccagttgtatacaaaaatatacaactaatttttgtatattttatattctgcaactttactgaacttactataatagtttttaacaatttttttatgcaggctttagggttttctatgtatgaggtcatgtcatttgcaaatagagacagtttatcttgtattttccagtttgtgtgccatttagttctttttcttgcctaattgactaggacttcgaatattctgttgaagaggtggtgagagtggactcccttttcttgttcctgatgttaggggaaaagctttcaacttttcaccgttagatttatcggctgtgggctaatcatatatggcctttattgttgtgttgaggtacattccttctttacctaatttattgagagtctttatcatgaaaggatatttaattttgtcaaatactttttcagatgattgtgtgatttttatcgttcattctgttagtgtggtgtatgacgtttattaatttgtgtattttgaactatccttgcaaataaccacttgattatagtgaatggtccttttaatgtgctgttgaattcagtttcctagtattttgttgaaagttttgcgtctagtttcatcagtactattgacctgtaattttcttttcttatagtatccttatctggccttggtataagggcaatactggccttttaaaatgagtttggaagtgttcctgcctctttaattctttggatgaatttgagaagaattggtactagcttgtgcttaagtgtttggtggaaatcagctatgaagccatctggtcctcagcttttctttgttgggaggtttttgactactgctttagtcttctttcttgttattggtctgttcagctattaatatgtcttcacttgtccaggtacagtgtgtaatcccagcattttgggaggccaaggtgggaggatcacttgagaccaggagttggagaccaaactgggtaacatagcaagactggtctctacaaaaaaataaaaaattaactagttgcagcggtgcatgcctgtggttgcagcaacttgagaggctgaggcaggaggatcctttgaccccagaattttgatgaactatgatggtgtcactgtgccccagcctggacaacaaagcaagaatgaatctcttttaaaaaaaaagtcttcaattttgttgttgttgttgttttaatgattcagtctttagggtatatgtttctagaaatttattcatttcttctaggttatccaagttgttggtgtattaattttcataatattctccttgtactcctgtggatcagttgtaatgtcttctctttcatgtctgattttctttatttgaattctctttctcagttattctagctcaaagcttgtcaattttgattatcttttgacaaacaactattatgttgattttttagaattttctttctggtctcccatttatttctttattatttccttactttagctaactttgggcttaggttgttcttttttctatttttttgaggtgtaaggttaagttgtttgagatctttattttcttaaagtttattgccataaacttgtctctttgaactgctttgctgtattctgtaggttttagaatgctgtgttttcattttatttgcctgaagatactttttgactcttttttttttttttttttttgagttggagtctcactgtgtcacccaggctagagtgcaatggcacaatcttggctcactgcaaccaccgcctcccgggttcaagcgattctcctgcctcagcctcctgagtagctgggattacaggcatgtgccaccacgcctggctaattcttaatacagatggggtttcaccatgttggccaggctagtctcaaacccctgacctcaagtgatccgcccacctcagtctcccaaagtgctgggattaaaggcgtgagccaccgcgcttggcctgactttttgactctccttttgatttcttctttgacccattggttttgtcaggagtatattgtttactttccatgtatttgtgaatttttaaatttccctcctattattgatttctaattttataccattgtagttgaaaaacatgcttgatatgattttaacatagttggatttaacacttaattttgtggcctaacatatgttatattctggggaatgctctatgtgtacttgagaaggatatgttttctgctgctgttggatggatgtttcatatagtctgttatttgctctatactcttattcaggtctaatgttttcttattgacagactgtttgacctatccattgttaaaagtggggtagtaaagtcctctcttgttattgtattgctgtctgtttctcccttcagttctgttagtatttgctttatatttttaggtgctctaaggttggatgcatatatattaatacatttacaattgtaatattctcttgatgaattgacccatttattgttgtataataaccttgtctcttgtgactgaaagtctattgtgtctgatataagtaagcccatttctattcttttttggttaccatttccatggaatatctttttctatccttttgttttcagcctgtgtgtgtccttacagctaaagtgagtctcttgtagccaacatattgttggatacttaaaaaagtctgttagccactctgtatcttttgattggagaatttaatccatttaaagtaattattgatagttaaggccattttgttgttctctgttttgtaggtcctttgttcctttctctcttgctgccttcctttctgatttgatttttttttttgtaattgtatgcttaattcctttctatcttttatatgttactggaggttagttttctttgtggttactatgagggttacataagatatcttaggctgttttaaggttgtaataactaaactttaattacctacaaaaattctgcaattttatgtctccctccttcacagtttatgctattgatgtcacactttacatctttttatatttgtgtacccattgacaaattattgtagctatagttatttttatacttttgtcttttaacttttatgctagttaaaattgatttatgtaccacgattacagcattgcagtattctgaatttgactgtatatttatttttaccagtgagttttatactttaatgtgttttcatgtttttatttagtgtcctttagtttcaactcagctccctttagcatttcttataaggcaggtctagtgcgatgaactctgtcagcttttgtttgtctggaaatgtctttatctcatctttatttctgaagaacaactttttttttttttccctctgatggcacctctgactccttgatattgtattatttgtttctcagagaagtaaagcaattttttttttgagacggagtctcgctctgttgcccaggcaggagtgcagtggcatgttcttggctcactgcaatctctgcctcccgggttctagcgattctcctgcctccgcctcccaagtagctgggactacaggcgcccgccaccacgcccagctaatttttgtatttttagtagagatggggtttcactgtgttagccaggatagtcttcgatctcctgacctcatgatccacccacctcagcctcctaaagtgctgggattacaggcatgaaccactgtgcccagcaacaactttcttatgtataatattcttggctggcagtttttgtctattagcactttgactatatcatctcattccctcctgatctgcaaggtttctgctgagaaatccactgattgccttggtggtggtggtaatggtggtgtgtatgtgtgttgcgggtttccttgtattataggttgcttttctcctgctgctttcaaaatttcctctttgcctttgatttttcagaattcaattataatgtgtttcagtgtaattttctttgacttgagcttttgagcttcatgaatctagatgtctgtatttctttcaagatttgagagattctcaggcaacagacattcatttacgtgagctaggtatttcttctattctcctgttgggaccttggtaatgcacatgctcattcatttaatgctgcatcggagcttctgtatgcttttgtcgtttttaattcacttttctctttagtttctctaactggataattttaaacgatgtgtgtttgagttccctgatgctttcttctgcataactgagtttcctattgaagctattaattttttttttcagttgtcagtgtattcttcagtttcaagatttctgtttggttctttagagtttctattcctttattaaactgtttgttttgttcatgtattgttttcctaatttttgttgagtttcctgatttttgtttctgggttctcttgagtctcattgagcttctttaggatgattatctttaatgccatcagtcatttcatgtatctccattcctttgtgatcagtcataagggctttattggtttacttcggtgatgtgttatataactgtaaaccgaatacatggaaaaataaaaaaaaaacaatagaaaaataattagaattagcaagagcgtttaacaggttttctagatagaatacccatataggggaatcatgttcctgtttatatgccagcaaatagccactagaaaatgtaattttaaaaagttactaaaataatttattcaggaaaagttcattagtgcatggagccattaggtgaaaggttgataaaaggtgaactctacacacagaagagaccaggctgtcactgccttgatgcactagttaatcttagcctctttaagagtgagaaaaccaaggaccaggcacagtggctcatgcctgtaatcccagcactttgggaggctgaggcgggtgggtcacttgaggccaggagtttgagaccagcttggcccacatggtgaaaccccttctctactaaaaatacaaaaattagccaggtgtggtgttgcatgcctgtaatcctagctacttgggaggctgagacaccagaatggcttgaacccaagaggtggaggttgcagtcagccaacattgcgccactgcactccagcctgggcaacagagtgagaccctgtctcaaaaaaaaaaaaaaaaaaaaaaagagtaagaaaaccagacattatattatatgctgtcagatgtgaggcaatgtcagttatacaacaccattaattattatttttacctaaaaatgaaaattgaatatattcaagtctttaaagctaatattcagtatcaaaacaaacaaaaagcaagagatatagagaaacaagttgaatttcatcatgaagaagcaaacatacaatccagaatgtgagtcgttgtatggaataattgatttcctttttaaaaaaatcactggcattcaaaaagggtacattggaggaggtaagagacttttctctagattagtagggatttgaaggatctgacaataagcacaatgtatgggcgttttttgtattttgattcaaataaagtagccgtaagaaataaactttgattcaaatggggaaatttgaatatggactatatattatactgatattgaggaattgttaattttgttacaatttacgttgttaaacatgctcttttttggagatgcatcaggaagcatgtataagggtataatgacatgatatctggaattttaaatgatggcaaaacgtataatgtacatagaaataaaatatatacacattttttatggaggaaaatataatgctttgttagccttttaaggagacctaaacaaatagataaacacactgaccagttttcaacctaacgatagtgcaaaagtgatacacgttcagtaaaaccacactttgaattttgatcttttcctgtgctattggtatgtaatatgatactctcttgtgatgctggacagtggcagtgagccacagatcccagttagccacacaaccaggagagtaaacaactgctactttccagattaggtgttttaaatgcattttggacttaggatattttcaacttatggtgggtttattgggatatagcccaatggtaagttgaggagcatctgtagtatgttaatgaattgaaagatccaaaagcatgaagtttttcccaaactgacattgcttcaatgtgattggaatcaaaatcccagaggctgctgttgggttttttgttgctgtagttggttggttggtttggtggaacttgacgggctagttctgaaatttctatgagaagcgtaaagcgccaagaacagccaagagagttttgaagaagaaaaaggtagggagccttgccttgctaattactttttgtaaaggtatagtaattaaggtggtatagatctggcacagaaatatacaaacatagccacaaaacaggtacacatgcatatagaaactttgtacacaccagaagtggcaatgcatgtaaatattcctgggaaaattcattataaatacatgtaaaaaatgaaatattattatgttataccaaaccccccaaaatggaagtatgtttttacctcataacatatgcaacctcggtttcagatggattaatgactgcaacgtgaaagacaaagttaacgtcgttttaggggaatatctttatgaactttgatggacaagattttgtggaaatgtcacaaaattgtatattataaaggagaagattgatacatttgaaacaattaaaagttttaggctggacatggtgactcatgcctgtaatcccaacactgggaggcagaggccagtggattgcttgagtccaggagttcaagaccagcataggcaacatagtgaaacctcatctctactacaaattagctgggtgtggtggcatgtgcctgtaattccagctgttcaggaggctgaggtgggagaatcacctgagcctggggggtcaaggctgcagtgagcggagattgtgccactgcacactagccttggcgactgagtgagatcccatctcggaagaaaaataaaattgaattctatcgatgaaaagatgtaaagaaatcatagactagaagaaaatacttacataacatataacggataaagtattattatctataatgtataaagaatacctataagtcattaagaaaaagatatgttaatttaaaaagtggagaaagacacaaatagctatttcacagaagtggaaacaggaatggccaaatactgtatgataagatattcagcctaggtggttagaaacatgcattgtaaaactataatgaggtactattttttttctaccctattggaaacatttagaaagtcagtaccatgtattaatggatgtggagaggtataatggccaacagttgtgcacagctagcaagagtataaattaatatagcttcttggaaaataaaataaaataaggtgtacctactgtatttcctagcaattcagttcctaggcctataccttagagatattcctgcccaggtatatcagagtgcacctagcagcattatttaaaatggcaagaagatggaaacaatgcaattgtcatcttctggggagtagattaaagtaattgccatatattatttcatacctcagtgaaagtggagaagattaaaagatacattacactctgaatggtctaagtctcgaaacctattgaaagggaataatattgaatatcattctgtactaaaaagaaaaatgaataattatttatctttataaagctcaaaaacatgtaaactataaatgaacagttcatatatatatatgtagcaaaacaataataaaagcaaagggattttaaacataaattttgagatataggttgttcttattaatggaggatagaccaatagtagagagagacacaatagggagcttcagaagtaaatatgatgttccatttcttaagctaggtttatggatttttatgtcattattttcatatacatctacattatatacagtgtattgaatgtttgaaatatttaataatggtaaaattagagttgttttacaaagctttctttttctatcagccattctaatatttcagtgcgtcgatgtcaaaaatactgcttccgtatttccaaaatctctgacttggtttctttttagtcatttcaaatgatcccgtgcctttcttttgttttatgatttcattgttcttcgtagaatacatgctgaaatacatgttctttatgggaaaacttatttttgtaaacgaatgtgctaccattgagaggaacgaatttggaattgttgaaaaatttcgcagcatgtatttattcgttggttttcagccattccttattgtcactggtgtaagtctctagataaacatatttgtttctatacatacatatgcaaagcttgatttttctccttctgtcattaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggttagaacacaaggagaatctgaaaggatcgggtgaagacatttgatccgtaatcgcatgttgtttttctcttcatctttatcctcctcttttttctctttctaaccctgcttgctgccttcctctcagaccaactgtttagcaatgaaggaatggctttaagtagaaaatgcaagttttattccacagctttatgaggacacctcagcataggagaaagttcatcttgcttcaagttgatcacacttaattggtaagttcaatgacagtttaatgagtgggttatattaggcttcagggttgtcagtatacctctttgccagttccattcattaaaatggattgctaatcttggtttgtgtctttcttccttttttctattcttcctttctcttttccttctacctctctaacctccctctatctttccttcctttcctctttttaaatattcagtttagtaagaatattttacagtcatacagaatgtgacatataaactgtattttttcacttcagtggagtgataattgatgcctaaacctaattattcacagattaattaaaccaggctcaacaacagcagtagcagctaccatattataagtgccagttaggtcctcagtatttgaaactaggctctggtcattcattttgttctaaccttcacagtaatccaagtggagcaggtggtattgtatacattttgcaccgggggaaatagattcagagacattgtgttacttacgtaaatgcacacagcttctaaatggctcagccatgattttaactgggacttcctgaatctgtagactgtcctctttgtcttgatcataatgcttcagaatgaaggtgtagattatagggaagaataccataaatgtgctggagtctctgaaagccatgctaagactaagccactgccagattgtttttctctagttaacaatttctaattgggtctgatactgtgtatatgccgcaattacaatctttactggagagatttggagggtttactatgtagaagccattctgaggctttacaacaaattcttttaacatatgaagaagactctactttttacttctttttctcattcctcttttatgtaacttttactgattatgtttatagaaaaagtataaatttcctcaaatgcaccaaattttgcaaaaagcagcatgcccgtttttcctcatccttgccaataacagttaatattggcagttttctcatctttctgttcttcctccttttttttttttttaacaaaatacaaatctgatgagtggtaaatatttcattctgtgttaatttatatttctctgattaccaatgacattgttttttcaagtcttgaattttcttttgcttgttaatgtaatttaaatctctcttccattgttaggttttcctcccatggattttttgcttagtttatccacattttgagagtatatatttacacataaatacttttaagttgttctgtgctttcatatttttgcctttactttttaattcattttgtggtatttgtgtggtgaggatattttttctttattgctaacaacttcacaagaatgtttatagggaattatttcattgctcacaaacttgaattgatgtctttatatttcatgaaattaatgatgagtctgtttctaggatttcagtttaacctcccttcttgaactatggccacattgttgtttaattctagaaagtatttattttatgataaggcaagcctctctttatgttagcactttaactgtttcatttgtctttcttaccctgctcatcatttaatgttttctattagcagtctctctctataaaccaaagatactcttctaatcttctctcagttgttataacaccaaaagtgctttcatatgtaatctcttatttcctttttatataaactaaaagataaataagatagattatattatttatattttacctatagggaaaactaatttagagtggatgactggcttccccaaggtgtctaagtaaatgatagataccaaagttatgaaaaagatagctgatggccatgtgcaaattacacagagatgtaattcattcaaataccgtgaaaagagcactggactacaagttaggatacttaggatctgatctcagttcttttactaactactcagttacttaagtatatttctgtttgtttatttatttatttacttatttgacagacagtcttactctgtcacctaggccggagtgcagttgtgtgatcctcctgtctcagcctcccaagtagctgggactgcaggcttgtaattttttaattttttgtagagacaaagtctcactatgttgccttaggctgttctcgaactcctggctccacacgaacctcctgcatcagcctcccaaagtgctaggactataggcgtgagccactgtgcctggccctatggatcatatttagagattgcaatctgggtgttaggggtactccccaccactgcgttgtcatttacaacaacataatgaagaaatacagccggccatcgtggcttatgctaatcctagcgactcgggaggtgagatgaaggatcacttgagaccagagttcaagaccagcctgagcaacatagaccctgcctctaaaaaaatttaagaaattagcctggcaggatggtgtacacgtacggtcccagctactgtagaggctgagactggagaattgctttatcccaggagttcagggttgcagtgagctgtgattgtgccactatactccagcgtatgtgacagggcaaggccctgtctctaaaataaattaaatgaaaataaaagaagttaggaattcttggagaagttactcattccaggattagagcaagaaatgtacaagacaaacctaaattagtggttctcaaacttgtgtgcgttggagttacatggagggctattagaaaagtagattgctgtctcctgtccctaggggttttgattcagtaagtttggggaaagccccatgaatttgcattctaataagttcctgggtgatgataaaattcctggaccaggaaccacattttgaaaaatcactgcgctatagcatcatgcgatatgaaaaattaagaacctatcaaagactactggggtcatataaggatggacagaggagcaagaatgaaggggctatcactggcctaggatagacagtttgagcataagaaagactaatgagcacagttgtttaaaacaaagtatttttaaatccggaaacttcattgtgagactataaaaataatttggagattgctgggacaccagtgccctaacactgggatttactttttaaaattccaatggtagtaggggaaacattggccattttttgatagtttattgaagctgagtggtggtgacatggggtgtatgatattatctttcctatacttttgcatgtttgaaattgtccctaataaaatgctggaaaagaaagatatcacttaaccacttgaaactttcgtatctgtaaaatgagtcttaagacagataagacttcactcttagactttagtgtgtctttcagttctaaactagctttttaaccatatttgcgtagccctggagtggagcctgtgactctgggttcatttcttagccaagctccttatttgtgttttccctttacttgagaaatattttccgtattttccaagtaactcttttttcatatctttgcttgaatttcatggagttggtttcttctgtttttaaactgaaggtcatatagctttggtcgtatacctttgcttttgtctaaaaattataaattttaattaacatactagaaaaattaatccataatatatatttgtttatatccctctacattttcttttaaactttaattttacttatttgtaatactaatatatatacactcttccgtattttgctttttaaaaactttatatcatttaaacatttccatgagttatgtgtttcataatgatgcttgtacttactattttcagttgaatccagagttcagtagctttatacacgttcctctttttctggacatttcttaattttcaattttcacagagcaaatttgtacagataaattgtacccaatttggtgatttcctttggctattcctcagagcaaacttactcaaagtatatgaagtgttgtagcttttcttaaatttttgttaccaaagatgaactaatttatagtacttccagcagtttgcaggcattctgttttccctatagccactttggttctatttaattttttgctcattttacatataatggcgtcttcaagttgttatatttcatttcttcagtgacactgtccgtttttcacatgtaatgatctattatctgaaatttccgtgtcaaattttaattacatttgctacctatcatgaaaatcttttcatatcacctcctttgaattgatatgttatgaattacattgaggaatgatgattgttacatattttttctttttcagtcatttttcttttgaaatttattagattttgttgtttaaacatcttttcaaaaaaatcttttaaattgcttatcttgtcctttcaaggcaattttttcacttaatatccatttgcaacagagtcaagcatactagtttcttttagttctttagctgtgtgtatgtgtttgtttcttgtaaatgttcattgctttaatgcatgtggaatttatttaacttaacttacaaaacatagatttaaagtactctttctttaccctgatacccagttctcctggtagcacttagtaaataggtattctttaaaaaaattttaaatctacctaatcatatgctacataatcacacagaagtttccatttcattctagattcattgttttgtctttaatccaattttttgcatttcttcttcttctttttttttttttttttttttttttttgtgatggagtctcttgccctgtccccaaggctggagtgcagtggtgtgatctcggtttgctgcaaccttcacctcctgggttcaagtgattctcctgcctcagcctcccgagaagctgggattacacacctggctaatttttttgaatttttagtagagtcggggtttcaccattttggccaggctggtctggaactcctgacctcaggtgattcagccacctcggcctcccaaagtgctgggattataggcgtaagcccagcctttttgcatttcttttgccctttgtttacaaagtcagtaggtcatcttcaacgtcattaactttatctcaaaactttttttctaggtaaatttatcagttttttcaacaacctttgaaacatcatttgagtgtctttagtttgttaaattatactaataacttaaagaatattatcacttgtaatttatttagtcatctccagccaggaactaaattcattcctctttattcctatttatgtttattatttatcatgttaaaaaagatttaaggaatataaaatattttctaaagaaagctaatatccagattacaaccaaattattaaagatttgtggtagataatagagaagaaaaaggcaaatgaaacttcaagccataaaaagatgaaaaaagtattagcaaatgctctttattgtattcacctataaaataacctttcttcttatgaaaacggagtcaaattccttacagagctcctgtctctaaaggttgtgagcattaatgagatgatacatgtaaaagcttctataagagcaaatgttaacaggattggactaggtagtagtaacataacaggtacagtgggtcctccatatccataggttctgcatttttggattcagccaacggtggattgacaatattatggaaaaaaacaccaataaaacagaataatacaacaataaaaaataaatagaaaataatatagtgtaacagctatttacatagtgtttacattgtattgggtattagaagaaatcgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccaggcgcggtggcgggcgcctgtagtcccagctactcgggaggctgaggcaggagaatggcgtgaacccgggaagcggagcttgcagtgagctgagattgcgccactgcagtccgcagtccggcctgggcgacagagcgagactccgtctcaaaaaaaaaaaaagaaaaaaaaaaaagaaatcgagagatgatttaaaatatatgcgaagatgtgcatagattatctgcaaatacgacagcattttatatcagggacttgcgcatctgtggattttcatattccaggggagtgttagaaccaatccccagaagatactgaggtgctatgtagggatgtaatgaaacgtgagagatactgaggtgctatgtagggatgtaatgaaacgtgagagatactgaggtgctatgtagggatgtaatgaaacgtgagagatactgaggtcctactgtagggatgtaatgaaacgtgagagatgctataattttcttgtaaaaggaggcactcacttcattaggagagaacttttaatttttccggtaggattttgtgagaaatttgcctcgtgttacttcatttagagcagtggttctcaagtaaggctcagttttggcgctaaggaatctttggcactgtctggggacatttgcaacttgaggggtgctaccggcatctagtgagtagagtgctgggtgctgctaaacgtcctgtagttctccggatagcccccacggcaaagaatttctcggcccacactgcaaatagtgctgaagtttgaaaccacgtttagaaacactttgaatgccagttctttatccgaagtgttactgtggatgaagttttcatgaatagctttggaaacctaatacgtatggccatatttatatttttttctatgtagagctaagaccaaagctgttaagttaaaactctgtagtggcagtgccacagtacccagtaatatcgcctaggtacatagttttctggtaccgtactctaatttgatgtgaaataatgctaggagagttgtggtgagtgagtaatttacataacatacacaataaccatcattctcgggcacataattccagattgaagttaatataccacgtgattgaagtattctgtattattgttaatgaagacttggtactctagaagtatttaataattgtcacacaatcgtaatcgaatgactggttatatttttggtgtgtcatagaatagtagaatagcaattaattatgtcttcttattttaatcatttttatcacaatgttttgtgttttaaatttctggctatttaggtgatctcttgatgttttcatgaaataggagaagtaaagggaaacactactaccttatttctgttttttgaaggaattattttagtatttctacgttaagtataataattctagtattaaaatattcattaagtgttttgtacttaatggtttgtttgtttgtttgtttgtttgtttgtttgtttgtttttaagacagggtcttgctctatgacccaggcaggagtgcagtggtgtgatctcagctcactgcagcctccttctaccggattcaagtgattctcatgcctcagccacccgagtagctgggattccaggcgtgtgccaccatgcctggctaattttgtgtgtctgtttttattagagacggggtttcaccatgttggccaggctggtcctagcatcatgtgatctgcctgcctcggcctctacaagtgctgggattacaggtgtgaaccagcacacctggccttatacttaatgttttgaatagtttatgtttaatctttatcagatgccgttttgatattcaaaggtcagttttgctagttacgttaaaaagcacgtagtaaatttattttatttgtgaagattaacacttgacctgcagggttcattttcactttttgttattcagcgactgccacttgtgatgttaagttcatcactggcttcactgttccaggtagaagttacagtttgccagagagcagtagtactacttttctattttttctcttttttaactctgaaaaataaaatacatttttaaagtatgcacatgcacatgtagatgtgccgtgtaaagaatacttataacatgatcatctcgagaaattggagtattgttggcatcccagaaatcatatgtgtatttctttgctatcatttttctcttctgttcctctagagattactattctgacttttcttcttctttgcttttctttatgacctgcacatatatcaaaaagtataatttagttttgtatattttgtacttcaataaatggaattactgtatttattcttttgtcacttcttttgttgatcattatttgtgagattcatttgtattagttatatgtagcatccattcctttattgtccttgtactgtgtttatttaattcagaattccacatttatattgaaagtgctctgaaaagatgattcatttcttttcaattttccattctttgaatacttcagatagtaccaaaagtaattccttttggcagaaagtgagtttagaagtaagtggttactttgctttttgtttttggttcaacacattaaaaatgttctgattggattaaacactgtcttacatgtgaaatgaaaatgatacctgaaaaactaagagaatctgaggatcccagagattctaaacacttttttgtcatttatcatggccttagatatgaatactcttccttacgatgtcatggtgccactcagttgtatcctatttctacctttgtgttttggacagttaattactgtgatttatagtaacttatctcatactttttggtctcagaagcctctttgcatttaaacattattaaagttcccaaagtgatttttttttctttttttaaatagagactgagtcttaactatgttgcccaggctggtctcgaactcctggcctcaagtgatgctctcaccttggcctcccagggtgctgggattataggcgtgagccactgcaccaggcctcaaagtgatttttttatatgggttatatatgatatacatgtgcagatcttttgacccagctatcccatgtcgtagatttatatgcatatacatgtccaaaaatataaaaatacatatgtacaaggtgacttataacattattcgtaattgcaaaattttgaaaacctaattgcctataggtgggagagtgcttaaattcaccatggtgaatctacacaaaggagactggcagttttaaaaaagaaatgaaacgtgagcaaaagaaaaaaaaaagatagtattttaatcgtgaatgaaatacatatccatgagtttatgctgatataaataagtaatcaaatacataaataaatggcatatggacagacggctctttctcatagaagaatttcagttaataagtatagatggaaatagaccaaaagaaaatcaccatgagacaaactgatggttgtgaaagttagtgtgtgaaagtttgaggttaaacatggctttcatagtctcaaaatgttttctctaaggtgtttatttattttaacagaagactaacttttcagtgaagaaacctaccaggacaccttaacaaagtgtttagagttaacattaccagtaataaagagacattgacctcatgaaccccttgatacaaggcactgagagggacacaatatcatttctgtgttattctttccaaaaatgtgtagcctcattccagtaatgagaaaatgccagacaaatgcaaattctgggacattttacgacataactgagcagtacactttaaatatgtcaagatgatgaaagacaaggaaagactgagcagttacagatgtattcgaggggaaatgtcagctaaatgaattgtgggatcttggattaaagcagatttcaggaaaaggaacagaaaattagctgggtatagtggtgcatacctatagtcccagctacttgggaggctgaagagggaggatcacttgagcccaggagtttgaggttgcagtgagcccaggagtttgaggttgcagtgagcccaggagtttgaggttgcagtgagcccaggagtttgaggttgcagtgagcccaggagtttgaggttgcagtaagccctgtttgcgccactgcgcttcagcctgcaagacagagtgagaccctgtctcaaaaaaagaaaaaaaaaatccggaaagaaaggacattggtggaaaaacaatgaaaggacattggtggaaaaacaatgaaagtaaggttctcaggttggtaaatagcattgtaccagtgttaatttcccagttttgatcatcttactatggttatgtaaaccataaacattacaggagcctgtataaggagcagatgggcactgttctgtttttgcagcttttctgtatgttcataattaattcagaataaaagttttatttaacaaatgtattgacactatatttctcagcacttttaatcacccagttcactttgccatctctttgaaataagtatgctttggaatttaaaaatgtcttactaccaaaattaacataacaggttagttagctcaggcatttttcctgaatttaggaatgcagatattatgttctcatattgttgacttcgtaaacccgtagtttaattaggaatgtagctgatcaggccgggcacggtggctcatgcctgtaatcccagtactttgggaggctgaggtgggtggatcacctgaggtcaggagttcaagaccagcatgaccaacatggagaaaccccatctccactaaaaatagaaaagtagccgggtgtggtggcacatgcctgtaatcccagctactcaggaggctgaggcaggagaatcgcttgaacctgggaggtggaggttgcggtgagccgagatcatgcaactgcactctagcctgggcaacaacagcaaaactgcatctcaaaaaaataaaaataaaaaggatgtagctaatcaagttgatcgttctaaagattagactcaaatcctcaagccatgatgatgtaatatggctattatcagtagagttatacctagacctagagatgaaccttgacctgtctgtatccttcaagtatagaaggtttaattttactcatttttaaacatacttgagatgtctttcattttttcaatataaatttatcgaatgctttctaagtgtcaggcactgttgctaatctttggttatacagcagtgaaaagacatgttctccgcccttctggaacattgtctcatggaaaaacaataaaactaaacaaataagtaaatatcaatcagggtaagtactacaaagaaataaacaggacactgtgatagatgatgggggagggaaatattttgggcaacaaatttaggtagtgacatcagaggagtcctcccaaaggatattgagatctgaaaaagccttataaaaagtggagaagacaaaaaattgaggttacccatatggcagtgaaaagcttggcattttcaaagtagagaataggtaagggtcaggtcaaaagggaccttataggccatgaaaagaagtttagattttacaagtagtgaaacagtctacgtgaaaagttgacaggatctgattcgcattttcaggatactgttttttgcaatatctggaggatgattggagtgggacaagagtcatacaaaagtgtttgctcactgtttcatacctttgtgtgctgtgcagttttctatgctagaaacagtaatgttgcacgagacaaacaagcttctttctcttaagaagctcacattctggtaagggctctgtgagaattgaggagagaggtttttatttatatttaaaaaaaaatttttggagacagactcgctctgtcactcaggctgcagtgcagtggcatgatcatagttcactgcagcctcaaactcctggacttaagcgattctcctgcctcagcctctggagtatctgggactataggggtgtgccaccacacctggctaattttttttttcttcttattttaagtagagactgagtcttgctgtgttgcccagtctggacttgaactcctggcctcaagcagtccttctgccttagcctccaaaatgcatggattatactttacattacttattataactttttatttctgctggctgtcaaaagatgtgttataatacaagtacaataatttcaattatagtaattgctatacgcagaactgaaattaggtaaattccagcaacagcaagaacctttcaaataaaacatatagaagcatagtcttagctgatttggctgttggtgaattggggattaaaaaaagctttctcttgaaagcctacccatcttttaagggtcagatgctttttcttgcgaagctgcctaaatcctcgcagttggaattaatcataccttctgttgtaatttcattagtttgtttctgcattgatttggggattattttatattactttgtattatatgctaattgtgtgctggttcttctgcatacttgagcttggggaccatgtcttggtattttacatatagttggtacttcataaatgcttattgattttaattgtatctatagatgtcaagaacgttctgtcacatgcatcttagcctggtctcttagtctatttgggctgctatagcgaaatactgtaaactggctagcttataaacaacagaaatttatttctcacagttctgtgcctggaaagtccaagatcaaggaaccagcagatttggtgtctggtacaggtccactttctggttcataggtagcaccttcttgttgtgtcctcacatggtggaaggggcaaggcagctctctgcagcctcttttataagggcatttaatgccattcatgagggctctgctctcatgacctaatgacctcccaaaagctccacctcctaataccatcacattggtgattagatttcaacgtttgaattttgggagcacacaaaattcagattctgattctgatctgatctgattcagatcattgcacctggcatttggagcctcctattaaagcaagctctgttttaacctcatcttgaggtcagatgcttggcttctctgttttacacaagctgacagtgttggtttctttgaatataacacgttgttttcctaatgtatgctcttctacttctgcagaatctttttcctgtggatttccagttttactacataaagattctgccttcaaattaacttttgttgatgaactctgcctggacttgttattgccttatccattgttccttagcctgaatgtttaatcatgctttattgtttacatacttttcaatacattgttttataattgcccctgtgtgatttaacccatttaattttcccttctcagctagtttatatctgccataagtgaagaattactttaaaatttctttttagtttttcttaaacactgttttgcataggttcattaattatagctgtacttattgagttataaataataaaatttaatttagttataatttttttggaactgaatgatattccattcagcatcctaataaatattctctaaaattctgtaggctatcctttaagagccttgtatgttttaacacaggaaatgccatcttcccttagttgagaatattaattctttgagcagtgacactcagatacacctttcagcaaggctgtaagttttagtcacgtcctaataatgcaaagtagagtggactgaaaggaggctcctatcaatagtggtttggggctttgttttcctttataacaaagataagtatctgaatttaaccttgaaagaggttgttgtgagagagattaatggaatgctgtggtgctgtgagacagctctcccgaaaccaatgaatattaagaataaagttcaaagaaagtgaaaacaatggaaatagagccggggaaaatcagctttacatatatttaagcatattctcttcttagatatatagtcaatgaaacatttgtgtttttctctgtaatttgatttaactctgtctacaaaaacagtttcttcattttgataagagattttttttcctttctgagaatgaacactacttatccttcatttttagatttgccagggggataattatttaagaaagccttttataaacattaagattgacatctttttaggaatactatttctagaaatagtatgtgatttgtcacatgctggatacatctaatatattaatgttcctgtttttgcaaaaataaattttgatttcctgtttctagaacttttccttcacctatttaaatgtttaatcctgtatcatttcttcctttttaataaaaattttttcttagtaaaacagggctttttctatatagaatattgtcgtaggtgagtttttatggtgttcttaatgaatattagagtaacggatcacaatggaaaagtgtgcatataaatcagcatctgtttttacatccctgtggatagttgctgaaattacgcatgaaaattctcttttactgcaggtgaagcacctacacaaattgttggttatgtgtgcagcttttaaaaactcctatctcaaactgggccactttttaccatttagaaagaaagcaaaaacacggcttaacattactttttaaaattctgcagtgtttgaaatggactctgtagtacttttccctctggccacatgtcagttcaatttaatagcagtgaaatttattgaaagactttattgataggactaatgtgctctccataaaatgatgaataaaattacattaggcactaaaattattaaaaactggactactaagttctcactttagtgaaatgaatggtttactcctttcctttgtgttgtgtgagctcttcttggtttgcatttggaaggaaaagtctccaatgagattcttttttttcttaaattttatttttaattataatggatacataatagttatacatatttacgaggtacacatgatgttttgatacaagcatgtaatgtgtaatgatcagatctgggtaattagggtactcatcccctcaagcatttatcatttctctgtgttaggaacgttataattctattcttttaggtattttaacatgtacaacaaagtgttgttagttatagttgccttattatgccactgaatgctaatcctgttattttttaagagaacagaagcaggtatgcaaatagtccattttctaagacctcagaagcaaaggtcagcctcttatgggccacatcagttgtctgttattttaaggaaaagatatttttgggattttttggtaaagactttgaaaaggtatgcttgttctttttataagcattacagatcaaagatttatagtgtcctaggattaggtaaactccatgtccttgcccaagtttctcatactcagctaccatgattttcaagatgagacccttcccagtctgtatgggatatttgtactctatgctctgtaaaatttattgatataaagcatcatttttatatgtgtacttttctgtttatttaatgaaatacatctgcttttgttttgactttggtttttaacaattggggttataacagagcaccactcttaactgaggggagacatttgaggtgttttaaggagaaggagggagagaatatttttaaattttaacccacagtattgccttaaagtagttggtgtgtaaccaaattctgtctctgtgttgtgctagctttcacttcatcagtgcatctggcttcaatttttttccccacaaagcatctgagaagttggtaaatgaattctgacatgttgaatgattttaatgaaatcttctggatgtgtatatatgcttaggggatggggaagagggaggcagaataagcagtggggttgaaggtaacaaagaattactgtctctttacgttaaggataatggataacagttaacattaatatctttcagaacaggttaaagtctgtctggtaagtggtgtttacttccaaggaagcagctcttattattaattcaaataaatgacttccattaccgtgtcagaatgagagctgggagagggaggagagaatgtgggagattgttactttggataatctttgtgaaatctgaattggccttctttctgctgcagaaaaaggcaaaagcttagggagatctaccatcatcaagtagctcttttttatgtgactatactgtagggccttgttaacaatttttgagggagatgtttgagggaacaacaaattaaattttaattgcagtttctcctctgcctttgcttttctgattgaatgtttgattggaaagaaaggcagctagctgggtgtggtggctcacacctgtaatcccagcactttgggaagccgaggcgggcagatcacctgaggtcaggagttcgagactagcctgaccaacatgtagaaaccttatctctatgaaaaatacaaaattcgccaggcgtggtggtgcatgcctgtaatcccagctactctggaggccgaggcaggagaattgcttgaacccaggaggtggaggttgtggtgagccgagatcacgccattgcactccagcctgggcaacaagagggaaactgcatctcaaagaaaaaaaaaggcagtggagggtagagtcttacagctcagtgatgtgtagcttggtgttgacagagctgacatcaagaagtaaagttctgagagatgtattgggagtggtatcatgggagttgctatagagtccagtctctccctgttaatctgcctgagtgaagctatagttaggctgtcccaacttctgccctagtctctttgaatataggagtcttcttctttaaggagatgagggattctttgaaaggtcttccttcttctccctctaccagacccctcaaagtagtcacacaaacctcctgccgtgaaccctgtactctgtgagtgaagtattcgtatttgatttcagcaaatatgtgaggctggcaaaagtaggcttcagttacataatccaatggtaggaaaaatggtctgggttcgttttggtgagtgcaaatgtggttaatagcagttgaagtaaaactctaaagatactgctttcattttaggtgatatgaactatttaaaatgataaagcatgttcctttgctatctctagatagctattaagtgagatgtctgtgacacacagtacatttctaaattttgggttgcctgaattgtttaagcagagtaaaatagccaagttagggcaggtgcatggaataaaactctctctctacttagtcttattcccctaggctgccaatttaatgcttttttctaattagtgagtgctataaaatggcttatctccaaacagtacctgtgttaatggcaaaaaccacaattactttggcaccaacctaataattcccctttgtaatttttttaaattttatttttattttattttatatatttttttgagccaaagtcttactccctctcccaggctggagtgtggtggcatagtcttggctcactgcaaccaccgcctccccggttcaggcaattctccctgcctcagcctcccgagtggctgggattaccggtgtgcatcaccacccaggataatttttgtatttttagtagagatgtggtttcaccatgttggccaggctggtcttgaactcctgacctcaggtgatccacccaccttggcttcccaaagtgctgggattacaagcttaatttttaattgacaaataataatcgtacgtatgtatggtgatgtttgaatacatgtatacattgtggaatgatcaaatcaggctaattaacatatccatcacctcacatacttgtcatttctttgtggtgagaacatctcaaatccactttttttttttttttaatactttaagttctgggtttcatgtgcagaatgtgcagttttgttacataggtatacatgtgccatggtgagttgctgcacccatcaacctgtcacctacattagctattttctcctaatgttatccctcccccagccccaaacccccccaacaggccccagtgtgtgatgttctcctccctgtgtccatgtgttctgattgttcaactcccacttatgagtgagaacatgcggtgtttggttttctgttcttgtgttagtttgctgagaattagggtttccagcttcatccatgtccctgcaaaggacatgagcttatccttctttatggctgcatagtattccatggtatatatgtgccacatttgcttaatccagtctatcgctgatggacatttaggttggttccaagtcgttgctattgtgaaccgtgccacaataaacattcgtgtgcatgtatctttattatagaatgatttataatcctttggggtatatacccagtaatgggattgccgggtcaaatggtatttctagttctagatccttgaggaatcaccacactgtcttccacaatggttgaactaatttacactcccaccaacagtataaaagcattcctgtttttccacaacctcttcagcatctgttgcttcctggcctttttttttttttttttttttttttttttgagacggagtctcattctgttgcccaggctggagtgcagtggcgtgatctcggctcactgcaagttctgcctcccgggttcacgccattctcctgcctcagcctcccgagtagctgggactacaggcacccaccaccactcctggctaatttttttttgtatttttttttagtagagacggggtttcaccatgttagccaggatggtctcaatctcctgacctcgtgatccgcccacctcaacctcccaaagtgctgggattacaggcgtgagtttaatgatcgccattctaacaggtgtgagatggtatctcattgtggttttgatttgcatttctctaatgaccagtgatgatgagcatttttcaagtctgttggctacataaatgtctccttttgagaagtgtctgttcatatcctttgcccattttttgatggggtttgcttttttcttgtaaatttgtttaagttctttgtagattctggatattagccctttgtcagatggatagattgcaaaaattttctcccattctgtaggttgcctgttcactctgatgaaatctacttctttaaaaacaattttgaaatacacagttgtaatttaaaattagactctgtttttgcctttttttttttttataactttttcccttgtctactttaagactagaagcagttataatgaaaattcatgaggaaacaggagtttaaagagggtctttattcagtgggggccaatagactctgagtatttcgttctcagactaaaaaaaaaaaaaaaaagttgattccccaaacagtcaaatgtgaggattcactcaaatgtgatgactaagcttattgataaacctccattgtatatctcttaaaacatttgcccaattttttttcagctgaactttgatgattggcctatcactgagtattcttggtgttgaactatttatgaatacgttggattactctaatttataatcatagtcacaagaaaatattttattagagttcaaatcacttgcagagtttattctgaataattcctgacataatgcatatcttgctggtttcacattcagtgaaatgctgagccatatctcaattctgtagtctccataatatctgcctttatattttaggtatgtttgggttccattttaatatagtctcataccaacagctgtgtttttataattgaggtcctgttagcctaaaaggcatttttcttggagaagaaattttgtcttcattgataatccagttttgttatactggagctacatcctcaggttctataatacccatccttcagtttgactccaagtcatccttacctcctggcgttcatgcccttgtgtagtcctctcccgcaccctgtcaggattggtctgtatgaaccgtacaagaaggcagaagtgatggcgccggcttctgaagctacatcacaaaagatactgatgcaactgccttgcactcctgaatcacttgccctggtgagagccagcctccgtgttgtaatgacactcaagcagcccggtggagaggaacagaggcctcttgccactagctgcaccaccttgccagccatgtaagtggaagcaaaggactgaatcctggttgacatcttgactaccacctcataagagaccctggcaccagaactgtttagctaagctgcttttgagttcttgacccacacaaactgtgtgagataatcagtattcactgttttcttaagctgctaagtttcgaagtaactcattaatacaacaatgaacaatgattacagatattttatatttttagtattaaggtgatctaccatagtctgatttttcccctctaaatccacagtttggttttctctgttagagtaataaatgctattttaaattgttttattcatattatcaccatggtaattatcagggttgggtaacattggagcttttgttggtgtttattacctatataactcatatttgtctgctgacagcctgtaagctgggaaaagagttacaaatgtatgtaaaacatgatgtgtcatatagccttttatagatttatttcctatgtaaaaaactgctctaactagtgccacattctccagtagaaatacaatgtgagccacacgtataattttgaattttctaatagtctcattaaaaaaactaaaaggaaacattaattttaataatgttttctttaatcaaatatatccaaaatattatttcaacatataatcaatatgaaaattattaaagaagtgttgtacctcctttttttaagactaagtttttgaaatttaggtgtgtttatagcacatctcagtttggactagccacgtttaatcacccagtagctagttgttgctagtggcttctgcattggacagtacaaatagtatattagctaaagaagaatattttcttctaagctagcggcagattaagaatgcctataaacaacaggtatgattttctcaaattaagtgtggcatgtcctatcttaatctctagctacatttagttccagtaagtcaacttcctaatttccagatgcttcagatccttcaaacctaaggaatatagggataggaggaattagggatagtacatagtatatgtagatttcttcagcattacagactcagaatggctcttactgtctcatagtttatcatgaaggttggtgaatatggactttttgaaggagaaaatgtactttagcatgtaaagcatgtattccaagcctcaggctacacatggtagaatcactcttacacttgggccaccaggaagcactttccaggggttttagcacatccccttacttcatcgatgtggtcctcagagcagaagtatgtgaagtctgttgcatttcatgattctcaagtctaatatgacatcttattggctcactcactttcaaggaagctggtgacaactgtcacttcttcaactcaaagtctggcattgacagattagagatttttaaatcttcagaatcttcaggatttatggaagaacttactgtgataatattgtcccttttaaaaaatgttgttatttagaacatcccatggttatcaaaagacttgaaaggaatttcttatcataattctgacccacttctgtaaaatattgccgtgaagaaattcataggacttttgaataaaaagctgaagagcacaatgatgtataatccatacatgttttgttctctttacctttcttttttctgatcatgagcactgcctgaagatgtgtttgcctggtctgcttttctcttttcacagtaaacagttaacttacatatttagatatcagttatctaaacaatgacacttgtaactatttccagaaggtctttagatccctattgatttcttcatagtgcaagatactcttttaacatatttttcaattttcttttgattttatatcagaactatgtattttatattatttacacaaataatacttacatgtcttagaataatagtcacttctcttattcttttctaactctgattcctcttcctctgagatgaccactttcatctcttttggttgtttctactgttgtttatttttatctttccaaatgacattcttatattattgttgtattatttttcttatttgggcgttgtctgttgacatcttatcatagatgatgaggaattagtgtttttacacaaaccaacacacacacttacttctttctgtccttccaatataattatatctaggtctacatttttaaaactgaggcacgtagtatattatgatttacattttggtctttcctagggtaccttagttttcctttttgtttttcctgtcttgggtatctctttctttctttctttttttttttttttttttttgagacggagtctcactctgttacccaggctggagtgcaatggcatgatcttggctcactgcaacctccacctcctggttcaagtgattctcctgcctcaacctcctgagtagctgggattacaggcgcccgccacaacgcccagctaatttttttgtattttcagtagagacggggtttcaccatgttggtcaggctggtctcaaactcctgacctcgtgatccacccgccttggcctcccaaagtgctgggattgcaggcgtgagccaccacgccctgctttcttgggtatctattcccagattcctttctacacccataaaattcctcctgatatcattgctactataaaaacacatcatcccttactaattgcccttggataatccatacatctgctgtttttcttggaaacattcatttcctttctctgctgtagtgtgtagttagtctctaggttgtgtcatgcttgtggttcccttcaccactcacctatggtagagctcttttttctggatcccacatcttctttccaggtttacctcttcattttcatagagtataccgtagtagcttcctgagagagtcgttgagtgagatacttttttggggggattttgcattcaactcccatatttgattggtagtttagatacagaattctagattggtaatcatttgttttcccttagagttttgaaaccattactcaaattgtcttctactttcctgtgttgcctttaaaaactccagtgtcttctgatttgttgatctgacaagtgatcatttttggcctttctaaaagttttcaagatgttttctttcctctagtgttctaaactttacagaaagagtattcatattatcatctaagcaccaaatgatggatttaatctttttgcaagagcgaggacaagaaagagtgattataaatattacctagcagtgctgttgatactctggtatttgtaggactcaagggctttcctgtttatttcttacagtggctcaacattttattaaattaaataggagattcaagctgtggttcaacacaagagaaacttcttggtttattttagcagagctctcaaaattccaaaactaaaactagtgccagattttacccactcgatagattaagtaattctggactttgtaaatgaaggtgagagagatatttgccgtcttctttctcttgtattttactatcctagtttgatacagttgcgttagagcaaatgcttccatacttagctttacatcgaaatgttatgtgacttataatatcacgtaaatattacttatcagccatttccttttatttgtagtttcacttggcttttgtttttcatccttattatcgagaaagattttgaaccaggctttgtcattaattccagaaatcttttttaaataaggctgtgaacactgagctcatggagtacactctggtttcactgccggcttcaggtaaagtcatgacatgagttttataatgaaacactatgaaacttgattctctgcattgtgacagattactaatcattttctccctaaaagttttttattgatacagccacaaagctatttttgccccacgcagatgtacaagtgaagttgtttgcttgaaatagattcctgggaagttatttggaattaactgtttgagcctcaattttagataatagaagcctctcaggagacttgcaaaaaacagtttaagagtgggataggatagaccgcacaaagacataatactgagttttccgtaagttgctaatgagaaacgttatcaactttatgtattaataatgtttctttatgcttctttatacttacagcaatctgtattttagaatcccacattactccaaaatagtcattctcattcattagagggtttgagaagactgaactaatcattgcatccatctcttagttcgtaatccttcttttatgtttagttttctttgattctgaagaaaccaccttggcctttgttttgacgggcatcgttccttgtctctgcgcgcggcgtccctttaaaaccctccactgtactgtgctgctcatggcaagtcaacagagggaaggaagagctcaacaaacaacgtttgttttcttttgttttgttttgttttgttttgtttgatacagataaactgccctacataaaacagaacctcacttatgggaatagatcacagtattttataactgtggagaaacacagttctctgagaagaatgaaaacttgtaacatgaacatcacgtacagcaccaaaatgtgaatttttttctaaatctcattttttaaaatttagaaaaacgagagaggaaaagatttatcaactgttcattaagaagaatgttaaataatagatgctgttcttccaaagtggggagaaaaatctgacttaactttgacagatttcaagttctagatttttgaaggtacagttgtcaaaaaggacttacaaaagtgggctgtggtataattgagtttcttagataaaataaaaaattcttggatatcttttcctgatatgagtactctgaaaattggagaatggtttagcaaatcttgctcttttgttttatgtatttttaaaaggaagcactttattcttaatcctctagtttcataagaagttaaagaaggaagtgcctataataacctgatgactgcagttctccatcccacttgaactcttcttcatgttgtcttcttaagatctctcctatcttacatgaactcagcgttctgtagggttttgtttgactttctgatagatcaacattcacctctccggaagctgtgttttaaacttgtgtagaacatcagggctgggaattgcttagttggctgataaaattgctcattcttagccagaccggtcacttatatccagttgtcatttttggttttctcctatgagattatgagaaaaccatacattcttgaaatactaggatgcatcacttgcttttcaatgtcttttaagaaatcgtttgctgacaattgtctatgaagaatatcatctgaaagatgatgctgcttactgcactttttcatgtaggcttaactgcagggaaagagtgttttgatattcggtcgaattactatctcatcaaagctggctttatgcttagagagtagttcaaaaacaactttgtgcttttaagtaatcaagcccttgccacctctgctgtctaacacagttttgttctctctgttacagagagcaaatttctcacatttgtcttgcttaactaacttgagcctttgctgttaatgatatacttcttcagcctccttctttcctttccttgctttctttattgtgtcctctgtgacgatatcttgttgacctggatttgcttctgatggaaagaacatttaataagcaaacagccctttcttaataaataggctctccctgggttaagtaattaatccacttcacctagtcttccatcattttctaggacagtctccgtaagaaggatgacaggattgaagagctggaagaagcactaagagaaagtgtacagataactgcagagcgggaaatggtgctagcacaagaggaatcagccaggaccaatgctgaaaaacaggtctgctattttatacagttccaagcaatgctgctggttaaccaaaaggtaacacacaaccagtatagtttaggtaaactatacatattgtatgtttatagggtttcaaaaacacttcatagaggagaagtcccaaggagttccttcatagcggtattagatacaaggatgtggtttcttttgtgtcaagtatagaaagaaagaccaactttattagcaaagctgagagagaattgatgaacattttgcagaatgagtgcctttcagtgccctgttcctagataaatgccttgtctactctttcttaaataagaattgaaataaagttgtatgagaattgactcatgttaacacagaagtccctgcattaataacttaggtctgatcccatatatatttatgtagcatgtgctaatgtattggacgagatgaaatggagcttgtctgtctgctacaagactgggcacaaccctggcttttaaacggaaagaaaaaacatgaacgtttctcttttttttcttttattattattaatttttttgagacaaaatcttgctcttgtcccccaggctggagtgcgatggtgtgatctcagctcactgcaacctctgcctcccgggttcaagtgattctcctgcctcaacctcccgagtagctgggattacaggtgcctgccagcacgcccagctaatttttgtatttttagtaaagttggggtttcaccatgttggccaggctggtctcgaactcctgacctcaggtgatccacctgccccggcttcccaaagtgctgggattacaggcgtgagccactgtgcccggccaaaaaaaaaaagatacaaacatttctgactgaaaaacgttaatttcaaatagctaatattttattcatttcataccctgcctcattgaagagaagagttaaggttgtaacaagttaaggttaacagtgagtatgaaggacatagaaaccatgcacttgagtcccagataagcagcctcggagggacttgctgaagagttctgctgtggcagtttgtgatgcttgttttacatatatcctgcatcttttaagatctccagactcttgcttttgacttttcattaggaagaataactacagatgggaaaagtgaatggaagaaatagttttaacaagtgaaggttataatcccagctcccattatgagaatgtgatttaagatttcaaacctaggccgagcgcggtggttcacgcctgtaatcccagcactttgggaggccgaggcgggcggatcacttgaggtcaggagatcgagaccatcctggctaacacggtgaaaccccgtctctactaaaaatacaaaaaattagctgggcgtggtggcgggcgcctgtagtcccagctactcgggaggctgaggcaggagaatggcgtgaacctgggaggcggagcttgcagtgagccgagatcgcaccactgcactccagcctgggcgacagagcgagactctgtctcaaacaaaaaaaaaaagatttcaaatctatctgacacagaggttcataacacttaattttgcagtagttgtttcctttccatttctttgtgggagaaatataaatgttaaacaggaaaaaaatactcaatgagagggtggcaggaatctttctaggaaccccttggtcagaccaaggtgttattttgagttaaggtagctatagtaaagaagggtatgtttccaaggcagacatagtatgtgccccagggagtcccttcatagctgtgtgagatagaaagatatggtttcttttgtgtcaagtatagaaaaaaagaccaacctcattggcaaagctgagagagaatgaactttttgcagaatgagtgcctttcagtgccctgttcctagataaataccttgtctactctttcttcaaatacattcctaatgcacagtcacatagagcttggttagtggagagcttcagagaagggatggtgacagccattgtgtcacccaagggtggagagtaatttcctttaatcttgattttaccctttttatattctctcctttatttttcaaagaaagatttttcttctgctttggcctcattatttattgacaagtattaaacatcagagatcatgcagagattttggcaattaataatcatgtcattatgggatacagacttctgttatgtattttcctttttgaggctattgtgtgaactgattataatatgctttaggggtatgttttatttatggttaatagacttcgcagtttttaggtttgcagaaaaattgagcagaaagtgcaaagagcttccatttacgcctttctctgcctcagtttcccctattattaacatgttgcgccagtgtagtatttgttaaaattaatgaaccagttttaatacattgttattaactgtgtggtccatagttgagggttcacttttcgtgacgcacagtcccgtgagttttgccaaatgtataatgacatgcatctgccattacagtattatacagagtagttgcactgcccttaaagtatcatgccccaccgatttattccttccccgtctccccagtccgtgatctttttactgcctctgtagttttgccgttttctttattggtagttggagtcatatagtatgtagcatgttcagattggcttctttcactcagcatctgcatttaaggttcttctttttgtggcttgatagctcatttctctttatctctgaatgatattccattgtatggatatgccgcagtttgttcattccttcagctgttgaaggacgtcttggtaccattcagtttttggcacttaggaacaaagctgctgtaaacattcacatgcagactttggtgtggatataagttttcagctcatttgggtaaataactgtgagtgtgattgctggattctgtggtaagatcatatggtaggagttttggaaaaagctgccaaacagtctcccaaagtggctgtatgtattttgcttttaattgtatgcttttttccttttctgttttcttgtccacctttctgctactcactgcctatctgaagctgttgcgtgaaatattgcatgagaccagttatttgaactttaagtggttcaaggtatgaagaaattgcttttatgtttatacttctgaagccttacaaccttcatctactgtcctctcctctcccattttttattattatttttatcgtttcctgtctttttttttttttttttttttttttttttttgagatggagtcttgctctgtcgcccgggctggagtgtaatggcatgatctcagctcactgcaacctctgcctccagggttcaagccattctcctgcctcagcctcccaagtagctggggctacaagcatgtgccaccacgcccagctaatttttgtatttttagtagagacggggtttcaccatgttggccaggctggtctcgaactcctgacctcaagtgatccgcccgcctcggcctctgaaagtgctgggattacaggtgtaagtcaccgtgcctggcccatcttttcctgtcttttagctctactattaattttacttatgtacgttaattatatgtactgagataatctacaaatgttcttttgaaatgccttaaatgaggcttttttgtttaggaacattatctttctcagattcaaaagttacctgtttctcacttaaatttagcttctgggaaagaatgactttttctgataaaggtaggatatctacatctcttaattcctccaagagcaaagtaaaattgtatgggagccatagctcttattaaaataagatgtagaaccttccaaagttcgagcaaggaagaactcccataagaaaacatctcttgatgccttttctttattctcacgggatccccttacagtttatttattcctaatacatgctgccccacgctgagcccatgctagaaatttagagaagttgtgtaatgacctaatgaaggaaggtgccccctaacctgtgtgagcaaattggaagatggaagtgaatgatccccacaggggagaacccaacagctcctttacttttgctttgtccctttccacgtggggattctatttctggaagctttctctgtttaacttttggtgggttttgtgctttattgaatgtgagtgtcacttttcttaaacaaggtctcctaaacaagtctcagaattgccaggggctaaggagcagtatgcttagttcagctatgatgttatgaaatttaaatttttgaattttaacattttaaaagagtgatttaaatatcttcactgggccgggatacagtggctcatgcctgtgatcccagcactttgggaggcagacgctggaggattgcttgaagccaagagttagagaccaacctgtacgacaatgcgaggcctcgtctctacaagaaaataaaaattaattagccgggcatgagggggtatgcctatattcccagctacttgagggactgaggtgagaggatcacctgagcctaggagtttgaggctgcagtgagccatgattgtaccactgcatcccagtctgggcaacagagtgagaccctgtctttaaaaataataataataacaacatatttgcacatatgaatttggttgttcttttaaaagccccatttttaacagtgatattcagtgataaacagtaatattttttcaaattgccattttgacattatttggcttataaagtataaattcttgatgttcaaggttataggattatatctgtggtttgctaggtaatgatacattaatgagcatttttaaggattacatatttttttgttgttgttaatgtataaagttcttcattggctgaaaatctcctctgtcatttatgcaacagttatcaccagaatacccaagttcattttcagaatgaacagttgccactacagaagcaaaactggtagaggggtatgtctgtagaagataatgtacactaatagaactataattgtattccttcgtctttcttattgccttttttacttttagcaatttattctttacttttataaacataattctttactggtctgaatattaagttatatttccctcattgtttattaaatggcagtgttgctctgaaaataaaattatactttcacttgtacctttttccctgctaacatttaaaaaaatcttgtgcttttccaaatgccacattaagcactgaaaatgaaaaggtaatagatacagcctctgtcttcaagaagcttgtagtttattgggaaagactgaaggatgaacttacaattatggttctgtttgacaactaccatggtagaggtcttaatacagagctttaggaacagaggaagaggggcaagcctgaaatccagatttgggaggtctgcagaaggcttcccggaggagattctatgtgtgaattaaaaaattagccaggtgtggtggcgggtacctgtagtcacagctactcgggaggctgaggcaggagaatggcgtgaatctgggaggcagagtttgcagtgagctgagatcgtgccactgcactccagcctgggcgacagagcgagactccatataaaaaagaaagaaagaaagaactaggcaaagaaatggaagatgttcaacatgttccatgtagagggagcagaagtgaaagctagaagcgtctaggaaaccaagttgtggttagtagctacagttgagtgtaaataggaatggcaagaactatgtaaagaagagaaaaagatgagagagtaagggagatcctttgtacaggtgtgcacagtcagatcatgctgaatgaagcatgttcaagcttatgttcaaggaagtagagaacctttgaacaaagaacaatagttattattagtttacttgctcatttattcattcaacagatctttataacttattcagtgggtgctgttgtagtcctggacaatacatactgataaacaaagtagctgtaatttcatgcctgagaccttacagttcagatagggacacagacactaacccaacagataacatttaattgctagttatgacaaaggaacaggttttcagaaatacacaataatttcttgaaagttggagggttagcagctattttagattaagtgctcagagagggtcctctgtgaaagcggctttgtcctgggccttgaaggctaagaagcttaccatgtgacaagtgggacagaagcagcaatcataatggtaataaggtggagaagagctgaacgtgtctaaggaagactaatatgactggcgggcaagaacagtgcaagctatgcagggccttttatataaggccattccataagaggaatggaagccattaaagagttttaaagagggcgtgacatcatctgattgatgtttttaaaagatcattctgggtgttgggtggaggatgaattagaggggggtaagattgaaagcgggaggatcagatggactattaaagtagcctaggctggatgtcttctaactgaggtatgcacacacctgaaagtgcatgaacactttcccaaaaggcacatgggcacaggctctcagcctctaaacatacgtatccctgaaattgatctgctcaaaaggcacctaaggtgtgcagattctcctttttcattttccccttcacggttctgcacccctcacttgacaactctcctgactcttactatcctctattcctcagaggtgaaaaaactttggaatgttaacaaagggacaattcagcatattggtgttaagataatggatgagtccgtcaggttgttttcaacagaattgaaataaaacctaattaagttgccagttggtagattatgataaataattttcgatgacacgttactatctggtttggggtatgtaattctgaaggaatgcaaagagttgagttatattgctacaacaaaactccttccattcctatccatttatatgatgaaggtttcttagtgcttacatctatagaagtgaaacataccgatagaattgatgctgaacccttatcttcctttttttttgagatggagtctcacttcttcacccacactggagtgcagcggtgggatcttggctcactgcaacctccacctcccgggttcaagcgattcttgggcctcagcctcccaagtagctgggactaaaggtgcccaccaccacgcctggctaatttttttgcatttttattagagacgaggtttcgtcatgttggccaggctggtctcaatcctgacctcaggtgacccacccgcctctgcctcccaaagtgctgggattacaggcgtgagccactgtgcccggtctgaacctttatctttctattaatagtaatattaacaaggggtatctaaactaataaaagtataaaagtcccattaatctcattaagataatatgtttaataagatacattttaattaaaatgtattcatgtttaataataattttcttataatatttaatatatctattggttttgattgatactatataactagtgattctaatcataactcagtgcacaagaattcttaagggttatgaccacaggaaaatattaaaatatcaaatttaaatttatataaatatttttattgagaaaagtacaagacaggatctgtgcaagccatctagcacaaagtaaattacattagtataaaattctaaggagaagtagaatggaaacaaggtcaaagagaaaaaggaaaatgtaaataataatttgtccttaacggtttttgaatagatgatgatggatatcaagtatggtatttgtattttattggatacttccttttctttaaaaaagtgatgcttttttaaaaaacagtctttaatacccaagaaattagatctttgcaactctttaaattttcgacgtaaaacatttatatatcaagttaaaatcattctgtctcagtatgtttgtgagcagaaaaaaagaagtataaaaagatacattttaaaaatcatagttgtataaactcttttaggaggtatagaagcaaaaatgtgtagagagacttttggtctatgcaagaggttgggcagatcaggcaatagctgaagagattccacagtgacagtggagataaagagaaatagatagatttaaaacgtcttttggaaatagagctaaaaggatttggtgaattacatgtatggataaaggatagaagagaaaacaaagatggccattggatttctggttggccaactgggagaatagtggtataattttttgagatgagaaagcctgagggaaaaatttgaggataagaagcaagacatggtattaaagaaatgttagctacattatcgtcagttttagaattgttatcagatatttttattattgatttagagatgagttctcgatatgttgttcaggctggactgtagtagctatttacaggcatgattatagcacactatggcctcgaactcctgggctcaagctacctttccacatagctggcactgtatgcgtgcacaatttatatttttagccaagttttctcttctgagatccaaagttatgaaatagacaacaacccatttcatatctttacaccaatatttccttgatatctcaaccagaaactaagttcaatcttttgattctcaccttccaaccagtttttcccccaggcttgctcatctcatctgagaggacttctttgtaatcttacaaagctgaaagtaggcttactgaatgtgagggaagtcgagtctgagagaggcagaagtgataggttaggtacagaaatttttacactgtggctttccagttcaaaaggtcgttccagaaccttagggaagctgtattccataatggcgaagaaggtggactctggagttagaaaccttggttggaattaggctcccatcacttagaaattatgaccttgggcaagttacttgtgggtcagttccccgagctgtaaaagaaatagttactacatctgccacattaaagagatggtatctgtataaagcacctttaacagattctgacacgtggtaaagccatagtaaacatctaccactattggtacttctgttgtcaccaccactgccctctgtggttccaaggggaggcactgctctcactggttggctgaaggccccagagaaatgtcgtatttatagaccctgtctggttgattcagcaccagcagtgacaaacttactgttaaattctaatttacatatgtcaagtgttaatactgtgactcaaggaaattcttgtcctctccccaatctggtctcatattctagaagttgtagatttgcatcaactgagaataacacagtcacctaatatgttgatcagatggacattattcttatcaccagattatttattctctgagagtctgtcttagatcaatacaggttcttaatctgtacattatttcctattttacatccatggtcttctcataaaaagagtttgagtaggccgggcgctgtggcttatacctgtaatcccagcactttgggaggctgaggcaggtggatgacgaggtcaagagttcaagaccagcctggccaagatggtgaagccccatctctactaaaaatacaaaaattagctgggcgcagtgctaggtgcccataatcccagctacttgggaggctgaagcaggagaattgcttgaacccgggcagcagaggttgcagtgagctgagatcatgccactgcactctagcctcagtgatagagtgagactccgtctaaaaaaaaaaaaaaaaaaaaaaaaaaccttgagtagctttagtaaactgctagaaatatatgctataaaatccagttctaatgctgtctttcagttttactaagccagatgttctatagtttccagaaggaagggagggaggggaaaaatactttcttagcattatttgaaactaagcattggttttagaacgttatccttagatgttattcctagaagcaggaagatacggaaattttaaaaccgtaaaaatattttaagggtttagtctttgtaatcttaaattggaatttgaaacatttgtttaaatttatgacttttttctcttaaacagtcacacatgcatttcctatgtactgcaaatacctagaaaacaaatcatcttcttagtagcaatgctcactcgtagtggtcagatacggtttctaaatactattcaatattagaaggacttgaaatctaaacaaaagttacttttttggcataaagtgaatattataagtatacatttttcttcacaagtgcttattggcttctgaaacctctgtagtctttatagcagcactgtcaaatagaacttgctaaaacagtggtaatgttttatgtctgttctaccaagatggtagcctctagccacgtttctgttgaacacttaaaatttggctagagcacctgaaaaactgatattttgcttttatttaattttaagtaaattttaatggccatatctgcctagtggctactatattggacagttcaactctatagtatgttggacagatgggtgggtggatggatggatggatggtcggtcagtcagatggacagacagatagatacatggatatctatctatctacatatacatagttagtagatactagttagtttttcctcctaagcctgacagagttgtgacactaggatattcaaatacaagcattttctgatatagttggtcattttttaaatttttgtttttggaaaaacatttgtgacataaaaccatgtttgtcaaaagtaatttttcctttaagaaataatggtggaagactagatcactttcaagggatattataattgcatgtgagtgttttcttccacattcgtgtggtagcatcatgtagatgcttaaagttatgacgtgagtgatggaattagtggaggaaaaaggagtggaatagttacagaaatgagagtcatctacattagatgtccatagtgagaacatgccaccccagcattgttaaaagtttatgtatcatccattcatttcgctgttcattcattgtttatctagatcctcctatgtgctagaaactgagaatactttactgaaccaaatgagtatggtccttttcctcatggagcttatatgttagtaggggagattgatcacagaaataaacatatactttaaaatttgatccatgcaaataaaaaaagtatagtattttataaaagtgtgtaacaggggaccttatttagagtgaatggtcagggaaagcatctcgtctattttattttattttattttatttatttatttatttatttatttattgagacagagtcttgctctgttgcccaggctggagtgcagtggtgcggtcttggcttgctgcaacctccatctcccaggttcaagcaattcttctgcttcagcctcccaggtagctgggattacaggcatgcatcaccacacccggctaatgtttgtatttttagtagagatgggattccagcatgtttttcaggctggtctcgaacttctgaacttgtgatccgcacaccttgacctcccaaggtgctaggattacaggcatgagccaccgtgcctagctggagggcatctcttaacacattgatacttaaattgagaaatgaaaatgaaaagtaagtaggaattagtgaaattaagaatggcaggtagtttacttcagcaggaaccacgtgtgtggagaccctaatgatggaaatagtttggcatagttcggaaatcaaaagaaaaccagagttcgtggagtgtactaagtcaaagtgagccggtagctctatggatagtaggtgagtgattgaataaatgagtgaatgaatggatggtgtggcatgaaactggagaggtaggcagaaaccagaatatataggatagtcatgttaatgattttaggttttatctcaaccacagtggttatcttttaagtaattttaagcagaagagcggtaagacttatttcctgttttaaaaagagtattccaggctgggcacagtggctcatacctgtaatgccagcactttgggaggctgaggcaggtcgatcacctgaggtcaggagtttgagaccagcctggccaacatggtgaaaccttgtctctactaaaaataccaaatttagctgggcgtggtggtgcacgcctgtagtcccagctactcaggaggctgaggcaggagaatcacttgagcccaggaggcagaggttgcagtgagtccagattgcgccatctcaaaaatagagtattccagcaattatatgaagaataaataggagagtaagggtagaaagggctgaggacatgttaggaaaacatataatccaaggacatgtagggtgatggcaaaggagatggagaggtctatttggagataaactcagcaagatttgctggtcaattgcatgttgatgatgagggagaggagagggaagtggcaaggttgatttctacgcttcttatcacgaggatctttaagtggatggttgtcttattccatttagtgttgctataaaggaattacctaaggctgggtaatttataaagaaaaggagtttatttggccatggttctacaaactgtacaaggagcatgatgcccgcatctgcttctggtgagggtctcaggcttccacttgtgtcagaaggcagagtaccttttattcttaatacaaactacaattcttgtagatttactgacacttactgattacctactgtctgccagtcactctggtacattctttctttataatattattcagttgttaaacaacagattctcagatatatgtaatgttttctaggtcgaaaacaagtgccagttcttgttgggtcctttttcagaagagtaaagaagggcttacatgtcttaaactacatgttccttctgagtgaagcaatctcttcaaccttaccttattcccttgtctggaaaaatcctacttcttccataaaaccttttctgaccttccaagtctgagttacatgtctctctcatgtttttgtttttctttttctttttctttttttttttttgagatggagtctctctctgttgcccaggctggagtgcagtggcgtgatctcggctcactgcaacctccgcctcccaggttcaagcaattatccctgcctcagcctcccaagtagctgggattacaggcgcccgccaccatgcccagctaattttttgttatttttagtagagacggggtttcgctatgttgaccaggctggtctcgaactcctgacctcaggtgatctgcccacctcagcctcccaaatgctgggattactggcgtgagccactgtgcccagcctctcatgtttttcaactgcacttgtacttagtcctgttttttttttttaataacactgcattattattacgtatttactacctattgctttaagagactgtctccattttgtctcctagaatgaaagctccttgagggcaggagctgtgtcttatttactgttgtatcctcagcgtctaccattgcacctggtacacaatggcattcaatgaatatttactaagtaattaaattatgagcgaataaatgaaattttgtcctgacttaatgtttgcagcatcactgtacttactaaacaatttaggatttaatggtaattttatcatatttttatacttatctaaacagtgttttgaaatgttttctttgttgcaattgcgtttccactggatttgataaactactttttcatctgaacagaagaacttaaaggtgtcagaattgtagatttaaagaattagaatagatatttatgtgaaagttatttacatttttgtgcttgattttaaagaatggtagccagagtggaaaaatacaatttagaaatcattattatccctgacctgtccttcagtggcaaaacagagggcttatatgtctcaaaaagtgaatgtgcaaaattgtaggcccactgttgttgacctcttagctagtgggaactagctgaaagtcttatgtagcagtgagccttccactcggaagtaccaggccaccatgtttatgaaaacatgtaataattcaaaacattctgcagagcaggtataaactgattagaatcatttgaaaatctttttgatcctactttatttccttttagtgggactgatgcttctgatcatcactggtaaatttgacattaggtttttcaagatttgcctcatctttcccggacttggaaataggttcataatattattaagactgattcatttcatatagtgctgtaatgggttacatttaatagtttacagaaatctcttcttaacatatcctaaattcattttctttgcttgctcttataagtcttaactgatttctgtgagacattcttgaaatgagtagctaagcagtccaaaagtgttacagatacaaacgttattcagaactatgtagaatcattctgtcttacaaaaaaaatagagtgttacgttggtaacataaacggtgcttgtaaagcagtttactggtttctgcagaagttcatcatgtttggtcaatgcacagattgtagatactgttgttcaaagatacttcatttttaaaatgtaagatgttattatggaacatgatattgataagcatatagaaagtatatttttaatgtttcaggtacctaagagatatgacagttcacgatcatcttctctttgccgttgtgtaatcagttcagtctttcaatcaaattctgtcaagaggaacctcgtaggtttcactgtagactctcgctctgctgtcaaggagtttgaatcccctttgttatggtggctggttatgaaatcagtcacttgacagaccctgaagtgagactgctggaaatacgtcatgtctgccttcatggtgacagctggttacaaaacaaaccccaccacagccattctgcaattgacaagggacttcaaaagccaacagggctgccacttcaaagagaattctgccatctctggcttgttgaaagaagttgttaaatggctgtaccctgccctaccagaaatctccatgtttagacttctccttcttttgatctttgaaagatgtatgaaatgacttaagttagaggaatgataaagtctctagtaatggcaacccagcactctgcattttgatccatttattaatggaaattacccagatatgttctaatgacaggaggtttaaaaactcaatgtctcagagaatgaatgtccaaaaaaagagttgaaatttcatagtattgttgtagccaccttaaaaaatctggaaatagtagggaagaaaatgaaactcagtgtgtttttaaaaccttccatttcttcgtgtaatttttagcccttttaatggaatcagattctgaatattgatagattagaaaacaacacaaatctttaatcataagattaaatttcatggttaaaacggacatttctccacttttagtaactctgtacttaaagtttgaagctaccttgtactatatttaaagttatattcatccctttctgctgaatacaattttaaaataattaccttgtgtttatcttaaacaataaaaaaagccttagagttttaatagaacccttaataaaaggtcagagtgctaacaatcaagggaaaaggcagcaacatgaactctttcttttagaatacggatagccctaaaagatggagtaatgtttagtatacttgaaaaagaaagcagaaaactttataaataatataacagtaaaaaaaaagtggagattttatactcaacatgaacttggagtgtaaattagttggaatttaaaatccttctaagtgaatggcatgaccttttcctaattgtatgttttctctctcatcctatgtgtataggaagataaagctaaagatctttagattcatttgccctgatctcctattttcttatttctcttaaaatatctctttacataaaatttttagaaatcgagttgacagaagctttaacgactgtaacttcctctataattttaccagatggggtcagtagataactactaaagaaattctgaagcagaactgaagcccccaggaaataaccccatgacatagtatgaccaaaaaattctctagaaacatgagtagtcgctcttcaagtaatgcatttggatttgtctttttttgttgttgttatcttagtttcttcctctagaaaaacctccagaaaatttttttgacaaagtagtacatgatattactgtcctggaagtccaggaaatatctatgcctttaaatttaggctcgagttttcattttattcagcaaaaggactgtatctgtgttttcaaaagttagagcgatgtgaaaaaattaagtccagtggaaacaaacctttggcacatccaaaattaaaccccagaaatgactgccagaagtctatggatactggttttcaaagcagacttttttttttttttaattttattttattttatttatttatttttttttgagacggagtctcgctctgtcgcccaggccggactgcggactgcagtggtgcaatctcggctcactgcaacctccgcgtcccgggttcaagcaattcttctgcctcagcttcccaagtagctgggactacaggcgtgcgccaccatgcccagctaatttttgtatttttagtaaagacgaggtttcaccatgttggccaggctggtctcgaactcctgacctcatgatccaccctcctcagcctcccaaagtcctgggatgacagatgtgagccaccgtgcccgaccagacatgtttttataccctatactctatctaaactgcagagcaacttctgtagcaggaagcactcttggagtctatgtggtggatctataccaagggatatatcgttcgcttgtaatgagttcttggggtgtttggctcttatttcttttctcctactgagaagtttgataaaccaagttattgatcatagaagcagtcatccaagatacggctgaaagtaaagccttgggagccagatggcttcccgctgatttttatatgcagtttatattctccttggctgtgtcttcctggatgtttcaatgaaagatatttttttctggagaaatgtgcacggtgggatttatcctattcaacagatagtttttgtgtgtgtcatgtcccaagccctatttggacattcaattgtcccttcctcttgtctctaccctctttaataaatgaataaagatgcattaaaattaatgtaaagtgcttcggattagaagtcaagtgacgtggattctaatccttgttctgtgtactaacagtgatttggcataagttttgtaatctctccaagtatctgtaatctcacctagatggaagaaattattatccccacaagtatccactcaccacctcacattgagataagtatttgcaagggttttagtcgcttacaaaggcagcatacaagtgttgagccttattatggccaaaatcacacacacacaccagacatgcgcaaacatacacgtatcatatatgcacatacatacacatattatacacgcacttacgtgatgtttatgagtttccctcttggtgtcctagggttaccagacataaaatcccatccttttacttttctcccttggctaatagtatacttttgataaggtcaagtaagtgtcattttatttgccaacattgtgtttctaacaactgtccagggttgtgttgaaataaattttctccacaaaatgtgtgtctaattaatgaaatgtcaactttatttatttctaggtggcagtttggtttttttcaccattgcaaatgagaagaattaaaatttccagttaaaatggcagtgaacttttatttttgttaaaaacttaaggaaagtgtttgagtctgttttactcacattatttcatttgatcttagaagaagggctgaatccctacatggtctgttttgtttgctgttttccgaataaaatgcaataaatattttctccatttgagatgatcagattatttaaactaagaaggaaatttctttccaaaacctggacaaattatatagccattcaacacttgctttattctattgtgttaactccctagcaaagcaaaaaaaaaatgccttttcagaagagaaattatcagagctcagagttctagggatggtctttgtcattccacctctattcatatttcatttcctaaattagacatttgtcacaaaccctaatgaaatattaagagctctcagacccagatgcagaagaaagcataaaatggtggttgccacatcttctttgttactactgctggaggaagaaaatgcaatctattacttagattatttctgtcctcccttcttccaggagcttatgtgtacccagtagatcattaattttttgtgttaattgattccattacaatctgttgctgaaataagcaaatcttgggagataaataatattttgctgtcaaagcatgatgtaggctgacttaaaaatagaaaaaatgaaataatattctgctgaaaagatagtttgttttcagggcattaattcaggtatttattttttagttttgatgctgtgctgtcaaagtcacctaaatagaattggcagtgatgaaacactggcccgtcttagcctctttctaacatcagtgacgcaagatactgagggtcatagcagcagggggatgtttgctttgaaaatgtgcatccacattttattgtgtcttatttttcaaaccctacttaggagtgatgagtgcttattacgggatttatcttcctaagccttctgagttgattttttttttaaataaaaggaaaattgagatggcttgaaaaagaagcatttctttcacactgatacgtttccactctcttttaaaaagagtgggaatgggaacactccccagagtgactcatgagataccattgtgggtgattttggtaaacactgatacatggtagcaaagcagcgctcagtgtgtacagcaggatggagtcggactactcagcttggaatcctagctttgctttctctgtatgacctcggacaaggcacttaaacccactaaccctgtttcttttgccataaaaatgaggataataatactttatacccaccatataggatcattttgaggctttaatgagacaatacatctaaagcacttagaacagtgtacttcaaagtagacaaataatgtaagtaattattattgcaataactatagttattccatagttataaaatactgtactgccggtatatatcttgtcaaagaattaccatgagttggcaaaaagaacgtattggaaaaaagagatttctagtgtaaatgatagcctaaagctctcttgggaaatgtaaattcaaattttcattagcaatagttgtgagatcctctaaaggaatttcctaggaaaggatgatagaatttatgtatgtaggtatatgtgtatatatgttttcactaatacttcaaaaatgctcctccactcaagagcttgttacctttttttcttcataattataaaacagtaggttttaatctggaactttgttctagtcagggaaaccagtggacttctcaagtgacaatctggcttgcatggtgactgctgaacctctggataatctttttgtaccactccctttttcttctaattgttttcttcttgtggagacttacgccttttactctcccaagagagtataacaagattttccatacgcatcttggaaactacaaaaagtgtttttctcctggttgtggaacagaagaaggtgggaaacttgaagaagcgggctttgccagcctctgaagccccctgttgtgctgctttcttaaggaaaataggtctgtggtaaagtcataatttgttcccttcttattctgagcaaaagtttattagcttgtgatttaagcaaaccatctggtcctgctggcactgcacactgtcaggccccgtgctttctgcttattatgttactgaaggcagttacatatttgagtcccagctctggcctgagcttttctgtgttttaaaacgtctgcttttgaaaattgtgctgtgacctggagtatatttttaaagtgtggataaattcttcattgtttagtataggatttatctcttcttttcttctactcatcggtctttaccctcgtttctctggctgtacccaatactgtacaactgctcagtggtaggcatgaaatggaaccaagtgattctagctggaagtgttctcctggattgtggaaacatagcagaaaatgaagtaattaaatttgactttgaaactgtttccctggcttagagccagagagcaaatcagatgattgattggaaataccaggaatgtatggtaccattcttgccttgaatactaaaatgctttagaacttacttggatatatgtataatctgaggcagaaatactttgagggtctcacactcaaatggatgggaaaattaagcaatctttaagaaaatgattttactaacagataaaaatctgaaaggtagagatttttaaattttttaacaatatgtaatagttgtacgtatttatggggtacatgtgatattttgatatatgtgtacaatgtgtaatgatcaaatctgggtaactggggtatccatcacttctaacatctattatttccttgtgttgcaacattccaaatcttctagctattttgaaattcacaataaatgatttaactatagtctccctactgtgctattgaacactacaacttactccttctatctaactgtatttttgtacccattaaccaacctcccttcatccccctctccctcctacccttcccagcctctggtaaccaccattctgttcactatctccatgaaatcaaatttcttctagctcccacgtgtgagtgagaacaagcaacatctgtctttccgtgcctggcttgtttcacttaacataatgttctccagttccattcatgttgctgcaaatgacaggatttcattctttttatggctgaatagtattcgtgtgtgtgtgtgtgtgtgtgtgtgtgtgtgtgtgtgtgtgtgtatacataccacattttatccattcatccactgatggacacttaggttgattccgtattttggctattgtgaacagtgccacagtaaacatgggagtgcaaatatctatttgatatactgatttcctttcttttggatatatacctagtagtgggattgctggatcatgagagagttctatttttagttgtttaaggaaacaccatactattttccatagttgctgtactaatttacattctcactaacagtgtatgagtgctctcccttctctgcatccttgccagcatttgttattttctgctttcttggtaatagccattttaactgggatgagatagtatctcattgtggggtttttttaggagtggtttgagggagagacagtgtcttgttctgttacccaggctggagcgcagtggtgtgatcatagctcactgcagctgcaaactcctgggctcaagcaaccctccagaatggccgagactacaggtgtgcactatcgtgcctggctaattttttgtagagatgaagtctcactctgtggcctaggctggcctcaaaccccttcctcctgccttggcctcctggaattacaggcatgagccaccactcccagcttcactgtggttttggtttgcgtttctttgatgattagtgatgtcaaacatttttcatataacttttggctttatttttatgtcttcttttgagaaatgtctatagagatcttttgctcatattttaatcgaatttttttttgtttgctttggaagtaagagttttgaatgaagggtaaaatgtgtccttaaacatgacagacttgatgctggggaagtaactttcacagaaacaattgaagatagtcaataaaattgcatttatatcttggcaaaaaggtaagaaattctcaggtcaggggatgaacaggtagggaattcaaaaataagtacttgataattattgaacattgggttttatatcttcataggataaaagaaaagatcaaggcagcccaagatagtcaagtgggaaaccaaatccctgtcactcttttataaaacaaatccacaaagcccaaaattcattctttgaaaacaccaagaaagtcagctggtctttggtgagactaaaagaaaaaagaaaaatggcacaatgaacaatatttattttagaatgatagagggttcacaactactagtcttgtaggtgctagaaagatataaagatatctttgccagcacatttgaaaatttagactaaatgaccaaatgccaggaaaaattgaacttagcaaagccagctaaatatgaaaaagaaaacctgagaaaaatgaggcagtaataaaaatttttcctacaaatttcaagcccagagatttatattggtaacttttggcaaatatacaaggagcaaataatttcaatcttacagacacaatttggaaatataaaagagagggaacaatcactcaacaacatatttaataaggttcacataactttatatcaaaactttacaagttaatacaggaaaagaaaagcttaggcctgtctcaatcctgaacatgtagaaaaattcctaaacataatcagaccaatccaaaattagtgtacacaaaaaagaaaaatgtgcatgagcaagttttattccaagagttcaaggttggcttaacagtagaaaactactgtaatcctggctaggcgtggttaattttttgtagagatggagtcccagcactttgggaggccaaggcaggtggatcacttgaagtcaggagttcaagaccagcctggccaacgtggcaaaaccccgtctctactaaaaacacaaaaattaaccagacgtggtggtgcatacctgtaatctcagctacttgggaagctgaggcaggagaattgcttgaactggggagatggaggttgcagtgagctgagatcactccactgcactccagcctgggcaacagggcaagactccatctcaaaaaaaaaaaaaaaaaagaaaactaattactataatccatcacagtaaaagatgatagaagaaaagttaagtgttcatctcaagaaatgcagaaaatttaacattcatttataattttcaaaaattcttaactacctagcaatacaagggaatttccttaacttaataaagggtatctattaaaaattacactacttgtagataaaacttataaaggattctttttaaagataggaataaaatagaatgcatgctatcaccatgtctgtacagcgttgtagtagtcattctagattatgcagcatggcaagtgaaagaagtgaatattataagaattacaagaaaagaaagaaaactaccatatttgtctatatagtaaacttcaaaatctgtcagtaagagcatttaagaagactgctagatacagattcaatttccgtaatctgcactgaacagaaaatttacattttttgtaaaaacgatactgtttactagaaaattaagcatataaagtacctaggaataaatattattaggatgtttaacattttaatgagaaaaattattaaactttatgaaagatattaaagttctaaaaatatatctagttcattacgtgttctagaacagtacctggcatatgataaaatctaaatatttttgcagaagttcaagaatagctaagatgctcttgaagagaacaagctgagacttattagatatcaagccttataaagtgataataattaagataatgaatgtagtattggtacaggactaggcaaaagagtggatcataatagaaagtgcagaaatatccatgcttgtgagtatacttgatatatatcaaaggttaagatagaatagatttttaaataaatggtactgcacattggctatccatatggggaaaaatgaaatcagacccctgcctcataccatatacaaaaatgaattccagatggattaaggactaaacatgaaaagcaatactttaaaactcttacaaagtttatcaatcagatattgtataacgaacaaccacaaaatatcagtagcatattgtgatggttaactttatatgttgacttgactggctacggggtgcccggatacttgctccgacagtattctgggtgtttctgtgagggtatttggggatgagactaacatttaagtcagcaaaattgagtatagtggattgccctccctgatgtgggtgggccttatccagtcagttaaaggcctgagtagaacaaaactctgatctttcccaagtgagagagaattccctctgcctgactgccttcgaactgggacattagcttttccttgcattcattcagactcagactgaaaccctggctcttcctgggtctggagcctgctcgccttcagactggagctataccattggctctcctggcttttcaagcctttggatttgggttggaactatgccactggctttcctgggtctccagcttgccagttcaccctatagatcttgtgattcatgagccagtttcttataataagtctttatttacacatatacactctgtttctctggagaattctgactaaggtacagacaataccaagcatttatttctcgttcacatacatggagggtgagcatggttggctctgagtttttttgcagaaattgacaagctgattctcaaattcacatggaaataaaaaggagccagaatagccaaaaacatcttgaaaaagacaacagctcagattttcatagagattatgttgaacctgtagatcagtatagattatggttcttatccattactgattttatgttataaaaacatagcttggtgtattatttgtacccagttttagataaaattttacatgaattaaactgataaaatggaatcaatggtatatgttcatgtaaagcttgcagatatgcaaatacatatcccagtatattacatagcaatatattctcttttttgtttgtttgtttgtttagtagagacagggttttgccatgttggccaggctagtctcgaactcctgacctcaggtgatccaccggccttggcctcccaaagtgctgagattacaggcacgagccacagcgcccggccgtaacaatatattcttatggcaactgggactgtgaggatgctgttagctgaagacatttaacttgctcacttctggaaggataaaaaaattcaggtgccaaaaaaactaaatgcatttgcttactatcattgtttaacagctgttaccaatcaacgtggaaactttgtttaggtaggaagcactaatttccaagggtcagtgaaacaactttgatttgtcatgctgatttttgactctaggtttctctgttttagtatcacacaaatggggtttatgtaggagtcaatgaatggcaaatgccccacctctacctgccctaccttctacttctgaaaagactggttattaccaagattatttcttggcaattaacaacctaacataaagtcttgtaattgatgcagttggctgtttgattacatttgcttctgaattaaaatgaacaagtttatttaaataattctgatttggtagccacctggaataagtggaaattactgataaagtacttaccttgctctcttagtttcttttccttatgttttagcattttgtctgtcttctctggtggctttttgtttgttgtttttcaggtctgttgctgtcaaggctttttttttttccccatgtcatttttaaagcattctgtctcctttctatctggtatgtacacacacacacacacacacacacacacacacacacacacacacacataactatataggtatatagggatatatttccttcctgcctatataatatatagtatatatataatatatatatatacactgcctatgtagtatataggtatatatatgcctgtatagttatataggtatatagggttatatttccttcctgccttccttaaaaaagaaaccctacctacctggatttagagcaagaaattgtctgattgaattctagcagtttctttaaaaagaaattcttcttaatgatgtaaataggaaaattttagtttagaggactaaaaattattcgtctatgtatacaggaaatctgttatttgccaagtttatgtcttttatttcctaaaatcgttctgtatatttttttatatttgtattgtattatttccatggaaatttctgggtcatttccaaagaacttccttaaaaggtattgtctgtggcagcgtgcgacttcttaaactgataacttgtatgcccttgcatgtattaagttctttctgacctaagctgaaaagaattatactgtagggatgttattatctgctatattgattcttgatatatacacacacataactgatccagaaagagtacagaattttcaatgtgttcctgcgtctcttcaattttctggacccaggagttgcgtgttacccaggtcctctgactctgattgatcaagacactctgttgttctctttcccatatttatgataggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagtaagtgtttgtagtcttattcttcaagcatatgcttagtggaaatactttttctccctgcattcatcttctggctctgtgttttaccccaatacacttacttaattttagtgctaacttgtatttctcactctctagaataaatttggtcaaaggtggaacaaatcctgatcaaatagaaatatttttggttcctctttaatgatttttaaatcctctggcttatacatatctgtgtgtaattacctctctgaaattcctaaaatcttctggaaagttcaggcaaaatggcgagcttactggggaagagggctgttggttctgaggttgtatgaagactaggcaatttttaaacacattttttattgtaaacatttccaaaggtacacacaggtagagagaatgaacccccatatacctgtctccaagattcagtagttaccattttgccacactggaagccaatttttagaaaattgtcacttttagcagagctttgctatacacattttcctgcttcccccacattttgtaggttgctgagaccataatctgttgtgaagcatgtatacatctgctaatacatagtagatgtttcttttacttctcagtgaccttctgtttaaaacaaacatgtgtcttttgaaaatccagttgtaccctctcatttaccattcctaatccttccccttacctaaagaccctactgctattttactgaaaccaggtctatcctgggatccctcagttaccctcagttaccctcgttctgtgagcagttatctttatttttgttgtcttcttttctgtctcagagaataggtttttttctccttcataaggccagattcttctttctgtcacagatttcaagtccccgcctcagcagcctttcactgtcagttctttctcacgtgacccttgctcacttcttctctgcataaatgcacagtctgtctttggcctaaaataaaattttttcactccaactagtgctttaaactgacatcagtttacttttctgctactttgaactatcagtaaactttgaatacctgaataatagagctgtacagaatcttgccataataccttagcatgaattctcatgggacatgatgattgtgatattgtgactgcaacccaagaatgttgaggtgtcctctgtgctttcacgttcttgggctatagtgcaaggctacgagattctgtccttttagaaaagcattatgagtgatatgtcttggaagtaatgtgtaagtgaagccggaagtggattggcatagggggagaattaagagaggttagagttccgagtagcatcatcagaaaaaagcttgcaggtttaagtagagaaaggaaagtcctccctgtgactgttggcaatgacactagattcttcactctgtagtcactgcaggacccaccatattttaaaggtttaaattattcaattattgatcattgaacaagtgaaaagatttagtctacctagagaacttgagaggcagaaatatgaggggaatgaagtgtgcagggagactgaaacatgcgtatgtgtgactctggagctagaataagacagagtcttccctcaggaaaaggtagttggcccatttgcatagaaaattcttcagcaaagcactagaatagctttgttttctggaataatcctgacttcatcaagccaagagaaatgatttaatagctattttccattcctagcatatattaatgtaatttttgagcgtctgttacagataaatggtgaccgtaagtttggggagacgtaaaacggttcacttggtagcctgccagtggtgcattggaaacatttgcgttggttatagccagccctggagaggaggaacgttttaattggcagatcccacaatgggtcttctcttccttatgctgtggttttgttaaccattacttttttattccacttttatgttagcgtttttcccttaagaaagaaaggataaaagggagcaggggaaaaataataaaataacaactgtaataactgtaataaattttaagtatcagttgaggtcatgaggttcactgttaagaattctagatgaactagttcattcgacactgccctgcattcaaactcctcctgcaggcccaccctacattagcattcagaataaattttacaagtccattttttatttttaataaaatttttattaagctgtgaatttgactgccctgacaactggtttgttcagggaaggggtggcagagctctttggtttcattgagagtttagagctattcaataggtagcctcctatatgcaggcagttagttgtaagtcattcaaagaatgaaaccaacgagtagaagttaaatcactatactcattgggagcttaaaaaataaataaatatgatttaaaagatgatgtcaacacaggtgaaaaaggaaaaatattagaatctcctgaactgactagacagacatgtttagaagactggtcttctctggaaacaagtaaagctggcagagaaatccaaatatctctgtgttaaattatatactcatgagatgctttctggccaaaaaaaggtctcccacaaacagagaataaattttcatatgtacctaagaagagtccagtactaaattctgacatttaaaaaattattgactgttaggagagaaaagtagagtacaattgtgattaagagagctgttaacaggccgggcacggtggttcacacctgtaatcccaacactttgggaggccgaggcgggtggatcacctgaggtcaggagttctagaccagcctggccaacatggtgaaaccccgtctctactgaaaatataaaaaattggctggacgtggtggctcacgcctgtaatcccagcactttgggaggccgaggctggtggatcacaaggtcaggagtttgagaccatcctggccaacatggtgaaccctcgtctctactaaaagtacaaaaattagctgggtgtggtggcgcacactgtaatcccagctactctggaggctgaggcaggagaatcacttgaacctggaaggcggaggttgcagtgagctgagattgcaccattgcactccagcctgggtgacagagcaagactccatctcaaaaaaaaaaaaaaaaattaaccaggcatggctgggcacggtggctcatgcctataatcccagcactttgggaggctgaggcgggcagatcacgaggtcagaagattgagaccatcctggctaacacggtgaaccccgtctctactaaaaatacaaaacattagccaggcgtggtggcgggcgcctgtagtcccagctactcgggaggctgaggcgggagaatagcatcaacccaggaggcggagcttgcagtgagctgagatcgtgccactgcactccagcctgggcgacagagcaaaactccatctcaaacaacaacaacaacaacaacaacaattagccaggcgtggtggcgtgcgcctgtaatcccagctactcaggaggccgaggcaggagaatcacttgaacccaggaggcggaggttgcagtgagccgagatcgtgccattgcactcccgcctgggcaacaagagtgaaactctgtctcaaaaaaaaaaaaaaaattgtggggttgttcacattctaaaaaaatctcattagggatttatgacatggtgttccaaattaaccacaaaattgtaaatagttaaccaaattatatcctagtaacaatttaggggggaaaataaaaatgaaaatgcattctgagttacataagagcatgtttactcttcacaaagccatatttatttatacttccaccaaaagccattttttttaagtctgtagacatatgataaaggacttttagtggacttggaagcatttttcacaatgggctagaatactgaggttgaatgttatgtaggaaacccacataatataaaattattttacacttgaaaaagaaaacaatatgttgtacagtatagctataaacaaatagcattggtgggtctgggactagttaaaattatgaagcaaagtttatatctacaatcaactatcccttgggactcctcctcagttttgcttaactctctcattctgcttcccttttttctgccctgatattcagtgcttttatacggcccaccctatagacatttctttactttcttgtgacatgaattggaataaattacaaataaccctaaatgttctttgcctttctccttctttaaattttaaacttattccacattttagctttttaagatcagacataacttccaaatagaagaaaccatgtttaaaaaaaaatccatgctttttaatcattttcttatgtaaaaagcctcaagtggctggaataaggtctaagtaacaaataaagaactaaacttttcagataaaggctccgaaagtccctcttgttttcagctttcaaaattctttctctctctctatcaatatatggttcacgtgtaaaaatgtgcttacctgtgtagggatgaaattaagactgtctgtcatctactcctcacaaaaggaaggaagtgagattattgtcctactttttccttatcttttctttttttctctgttggaggtataggatcaaccctcatcccttttgttaaatataaatgaatcatttaaaaggttaattattgtaggtaggtaacctgatgcgttaacctaattgcaatacccagttgaagaaaatctgatatataatttaccagtatggcaggtttttttggttttgtttggatttttgatgttttttgttttttaattttcctttcaggaccatctttttcattgttctccagagtgtaccttataggtagctactcactctccaaataggtaaaactcccctcaagctatggatgtcaaagatagtaatctatccatttaatcataagcttttcttccagaagttactgaatgaaagaggattagaagatggtctgtgtagcaaaggatttgcttacattttgggccagtttgcttacccgtgaagcaggcatagtaagacttagacccacctcatgaagttgttgtacggatcaaatgagattttaaaaaagcacgttgaagttggtaaagctgaatgtgcttgcaaagcatgacatttacaactgaaaatccaatttgtgcttttgtgttcgtacctggagaaatcacttagcttttcaggtctgcagttttctcactcagattcgaaaggtcccccatcgatttaaaaattgtggactttggccagatgacctcctgaggtcccctgattctgtagttgtaaatgtcctgtgtaaatcagggaagtaattcatatacaagcacagtatactgaggagaagttggaagccaggtatcatgattcctggctgaggactaggctacgtgttcactgaatgagactgcccaaggcttaccagagattagatgctacagaatgagagtggaattgtaatattagagatagagccgtggggaatctggagttccaacccagtcaacatggagaaatccttgttaacttcagttatctagctgagataacacaaaagataggtttgaggaacaaggaccatgctctaatataaggcctactctagacccaggctaagactagtaaaagaaggccccaattaattcttacagggtagaccaaatttggacaatgagtctcaccgagatagagaagcctgggaaatatcctgagctttcagcagatcagcataccaaaggttaaatccaaacctatacaagttcaaggagtcaactattaactgacttatatgtactagaataaaaatcactgctcctcagaagaaattaacagaaccatatttgcaatatatcccatgttgaacttttaattaccagacatgcaaagaatcaggaacatatgatctatagagcagaaaagagcatgcagtagaaatcacctctgaggagtcctatttggtttaacagaaaaaaaaaaaaaaaacaactaaattcacccttatacattaaagaattaaagaaaaatgtcatgttgatgatggaatagataggaaatctcaacagagaaaggaaaagtattttaaaatggaaatttgacatagtgagaacctgtctctacaaaaatgtttttaaataccagccaggtgtggtggtgcacacctatagtcccaactacttgggagggtgaggtgagaggattgcttgagcctgggagattgaggctgcagtgaactttgattgtgccagcatactccggcctgggcaacaaaatgagaccctatctcaaaaaagtaataatcataaaatgaaaatggaaatttgataattgaaatagaaatgaaacatttattggatagtctttttttttttttttttttttttttttttgagatggagtgtcgctcttgtcccccaggctggagtgcagtggcgccatctcggctcactgcaacctccgcctcctgggttcaggcgatcctcctgcctcagcctcccgagtagctgggattacaggcatgcgccatcacagccagctaattttgtatttttagtagaggcgaggtttttccatgttggtcaggctggtctcaaactcccaacctcaggttggcctcccaaagtgctgggattacaggcgtcagccaccgtgcccagcctattggatagtcttaatggaaaattagagctgtcaaaagaaagagtcagtgaacttcaaaatagatcaattgaaattattcaatctgtagaacagggagtgaaaggatttttaccgaatgaacagagcctcagtgacatgtaggacaatttcaaatgggttaacatacatgtggaacactagaaggataaaagagtgagaatgaagcagatgaaagacagtttttaaaaatggccaacatatttctataatttaatttgaaaccatgaatctttgatttacaaatcccagaaactaagtgaaaccaagcaggataaatacaaaaaataaaaaaatcacaactagaaataccatagtccagttgctggaaacaaaatatgcagagaaaaataaaagcagcctaagaaaaaaggcacagtgcataaagggaaactatgatagctgagtccttatcagaaacagtgaggacctgaagacaatggaacttctttcagggtactaaaaaaaaaaaaaaaaattagcctaaaattctgtaagcaaagaaaaagatcctttaaaaactaggattaaataaagacaatttcatataaacaaatatgaaaagaattcatctctagaaagcactctagaagaaatgctaatgagtgttcttcaagctgaagggaaatgaatccagatgggagcatgaatctacaggaaggaatgaagaacaccagacatgggccgggcactgtggctcatgcctgtaatctcaacgctttgagaggccaaggtgggaggatcacttgagtccaggagtctgagaccagcctagacaacatgacgaaaccctgtttctacaaaaaaaaaaaaaaaaaaaaaattagctgaggatggtggctcatactcttgttccaattacttgggaggctgagactgaggattcctgggcccaggacacggaggctgtagtaagccaagatcacaccactgcactccagcctgggtgatagagtgagactctgtccccctgccaaaaaaaaaaaaaaaaacacagacatggtaaatcagttgatacatatagaaaatgtattttttcttctcagaattcccttaaaagacaactaaccatttaaagcaaaaataacatgatgagttggcatttataatatgtgtaaaagtgaaagatgggacaacagtatcccaaaatattaggaggtagaattgtaaggttcttacgttcgtgaagtagaaaatatgaactgttggctgggcatggtgactcatgcctgtgatcccagtgctttgggaagctgagactggaggatcacttgagcccaggattttgagtttacactgagttctgtttgtgccactgcacactagcatggttgacagagtaaaacctggtctctaacaaaaaaaagaagaaaggaaagagagaaagaaagatagattacgaagtgttcgatgtgaagtagtacaatttctaatctaaatagactttgataaggtgcatgttgttagctgtagagcaactaccaaaataataacaacaaaaattttaaaaaccctgaagagcggccaggcaccatggctcaggcctgtaatcccagcactttgggagcccaaggcgcacggatcacttgaggtcaggagtttgagaccagcttggccaacgtggtgaaacccccatctctactaaaaatacaaaaactagccgggtgtggtggcgggtgtctgttatcccagctactcgggattctgaggcaggagaattgcttgaacctgggaggcagaggttgcagtgagccaagatggcgccactgcactccagcctggacgacagaacgagactctgtcacaaaaaaaaaaaaaacaaacaaacaaagaaaaagcacctgaagagctaacagaggaaataaaatgcaatgctaaaaattgtttcatttatccaaccaataaaggcagaaaaggaacaacaaataaagaacagaaacaacaaatgaatgacataaattcaaccatatcaatatttatggcaaaatgaaatatagtaaacacaccaagtaaaggacagagatactagattagaaaaaaaaaagcaaggctcaactgtatgctgtacataagacctgtactatcataaacactggctggaattaacggaaaaaggtacttcttggaaatagtaatcctaagaaacctggcatagctatattaatatcagacaaagagtattcccagagataagaaaagaccatataataaagataaaggggacaacacatccaaatgacataataatcctaataaatatatatctaatagagcttcaaaattcatgaaggacagaccgacagaactaaaggtaaaacaaatctgtggtcaccagtcattactggggattttgacctctattccttagaaactgatagaattactaaacaaacaaaagcaatcagaaatatagaagatctaaagactattaacttgacttatttaacatttatagaatactacatctaacaactgaagaaaatatatgttttttaagtgcatatggaagtttcacagatacagaccatatgctgggccttaaaagtaagtctcagtaaatttcagaagactgagatatgctaaagttgttctctaaccacagtagaattcagttagaagttaataagatacttagaaaatgtttggaaattagataacataattctaaataccatggcttagagaagaaggaatgttaggactcgttttgaactgaatgaaaattcaaatgtgaagttttgtgtttcacagttgaaaaagtggttagaatgaaatttttacccttatatacctgtattagaaaagaagaaaagttgaaattcattgatcttagtttctacactaaggtaccagaaaaagaagcagagtaaaccacagtaagtaggataacggaaatattaaagataacagaaatcaaacacatagaagacagagaatcaacagaaaattcacaaaattcataaccgggttctttaaagaattaaaaaaaaattgataggtccctaccaaatggatcaagggaaacaggaaggcacatgaattgccaatacctggaacgagagaggggttatcactccagtttctaaagacacgtaaaaagataagacaatattttgagcaaacttataccaataaatttaatagacaaagtctttgaaaaatacaatttattaaaactggctcaagaaggaatagaaaagtgagcaggcctttatctattaaagaaattgaatttgtcatatggaaccaaaaaagagcccaaatagccaaggaaatcctaagcaaaaagaacaaagctggaggcattatgctacccaacttcaaactatactacaggactacagtaaccaaaacagcatggtagtggtagtaaagcagacacacagagcaaaggaacagaatagagaacccagaaataaggctgtacacctacaactatctgctcttccaccaacctgacaaaaacaagcaatgggggaaaggattccttattcaataaatggtcctgggataactgcctagccatatgcagaagattaaaactggactctttccttacaccatatacaaaaatcaactcaaaatggattaaagacttaaatgtaaaacccaaaactataaaaaccctggaagacaacctaggcaataccatgggcgcgggcaaggatttcatgacaaagacgccaaaagctgttgcaacaaaaacaaacaatgacaaatgggatctaattaaactatagagattctggacagcaaaagaaactaccaagagagtaaacagacaccctacagaatgggagataatttttccaaattgtgtgacaaaggtttaatatccagcatctgtagggaatttaaacaaatttacaagaaaaaaacaaccccattaaaaaatgggcaaagggcgtgaacagacacttctcaaaagaagacatacatgtggctaatgagcatatgaataaaagctcaaagtcactgattattagataaaatgcaaatcaaaaccacaatgagataccatctcatgctagttggaatggctgttattacaaagtcaaataacagatgctggtgaggttgcagagaaaaaggaactcttacacactgtcggtgggagtataaattagttcaaccattgtggaagatgatgtggcgattcctcaaagacctaaaaacaaatacagtttgatccagcaatcccatcactaggtatgtacccaaaggaatatcaattgttctatcatatatacatcatgaaatattactcagccgttaaaagtaacgaaataatgttttttgcagcaacttggatggagctggaggccattattctaagtgaagtaacacaggagttaaaaaccaaaagccttatgttctcacttataagtgggagctaagctatgagtatgtaaaggcatacagagtgatataatcgactttagagactccgagggggtgggggagggaagatatggataaaaatctatatattaggtaccacgtgtatatagtactcagttgatgggtgcactaaaatcttagaattcaccactgtataactcagtcttgtaacaaaaaaacacttaaaccccaaaagctatttgaaataaaacaagacacatgtacacatatgttcattgcagcactgttctcaataacaaagacatggaatcaacctaaatgctcatcagtggtggactggataaagaaaatgtagtgcccatacaccatggaatattgtgcagccataaaaacgaacaggatcatgtcttttataggaacatggatggagctagaggtcattatccttagcaaactaacgcaggaacagaaaaccaaataccacatgttcttacaaggggagctaaatgatggcaacacatggacccatagaggggaacaacagactctgaggtctattggagggtggagagtggagggtgggagaagggagaggatcaggaaaaatgactaatgagtactagacctaatacctgagcgatgaaatagtctgtacaacaagacttcgtgacacaagtttacctatttaacaaaccttcacatgtgcccctgaacttaaaaattaagaaaaagaaagaaaaagaaatagaatttataatcaaaaacattcctacaaagaaaactccaggccccaatggctttactgttgaattctaccaaatgtttaagcaagatgtaataccagtcttagagaaactcattcacaaaataaagaaggtattatagaaatacttaccaagtcagcttagaattgtgaccctcctgcctaaacttgacaaagacattgcaaaagaataaattacacatcagtgtcactcatgaacattgacataaaagtccctaacaaaaccttagcaatttgaattcaatataaataagaaagctaatatatcacaaccaggttggccttatttctagaatgtaaggtttgttcagtattcaaaaatgaattaattaaactcactacctgaacaaaatacagaaaaaaatcatttagtcacctgagaacattcagaaaggcttttaataaaaggcaacacccatttatgataaaatatcttagctgactagagatagaaggtaattcagcttagtaaagagcatcatgaaaaatttacagctgacatcatacctaatgatgtaagctgaaccctgagattgcaaaagagataacaatgtctatatccccctattcaatactatattggagatcctagtaatgcaagaaaagaaggagggaaaaagcataaaattcaaaagaaaattctaaaacgtatgtattcataaacatggttgtttagggcattttaggcatagtttggggatactgcaagttttgttccagactactgaaataaagtgcatattgtaataaggcgagtcacgcaaatttattggtttcccagtgcttataaaagttatatgtaagcagggtggaatgggtcacgcctgtaatcccagcactttggggccatggaaggtggattgcttgagcccaggagttcaggaccagcctgggcaacatagaacctgtcgctacaaaaaaagaaaataaatagcggggcatggtggcacacaccagtggtcccagctactcgggaggctgaggcaggaggattgcttgagcccagaaagtcaaggctgcagtgagctgtaatcgcatcactgcactccagcctgggtgataaagtgagatcttgtctcgaaaagaaaaagttatatgtacactatgctatagtctgttaaatgtgcagtagcgttgtgtcttaaaaaatgtgcatactttaaaaatgctttatttaaaaaaaattctcctgatcatcttgagccttcagggagtcatgatctttttgctggtggagggtcctgcctctatcttgatggctgctgactgagcagagtggtggttgctgaaggttcgggtagctgtagcaatttcttaaaataagacagtaataaagttgccacatcaatggactcttcctttcacaaaagatttttctgaagcatgggatgctgtttgataagcattttacccacagtagaacttctttcaaaattggagtcaatcctctcaatcttgatgctgctttaccggccgggcgccgtggctcacgcctgtaatcccagcactttgggaggccgaggcaggcggatcacaaggtcaggagatcgagaccatcctggctaacatggtgaaaccccgtctctactaaaaatacaaaaaaaaattagctgggtgtggcggcgtgcacctgtagtcccagctgctggggagactgaggcaggagaatggcatgaacccaggaggcggagcgtgcagtgagctgagatctcgccactgcactccagcctgcatgacagagcaagagtccatctcaaaaaaaaaaataaataaataaaaataattctatcggccaggcgtggtggctcacgtctgtaatcccagcactttgggaggccaaggcggggcatcacctgaggtcgggagtttgagaccagcctgaccaacatggagaaaccttgtctctactaaaaatacaaaattagctgggtgtggtggcgcatgcctgtaatcccagctactcaagaggctgaggcaggagaattgctggaacccgggggcagaggttatggtgagccaagatcacgccattgcactccagcctgggcaacaagagcaaaactccatctcagaaaaaaaaaaaaaaagaattccattagctatatccaaggtttgatatatatctagatttttttttctcatgtatgatgaagtctctggattcctgagtgtttctttttaacctatttagggtgtggtggtttcatttcataaaattgggagttgggagagaggtatttgttgtggagttcacagtattattgtattgtggtgaaaaaacatagtctataaaaggaaaacacaggaggtgtaaataccactacagtcaagattttaaaactatccactgaccagatgtactggcattgaactgttgatttttgtcctcaggctggtgtcaagtgatgccatccttttgagtgttcctaggtctcttccttagatatatgaaaatgtttctcagaagtcctgatatccagcctcccccaacagtagacttttactcacatctgttaggctagacagagtcccgtgccaagtcattgaggagggaaagtgggattatcgttcttggcctaatctaatcagcacctacctctgaggtttagagatagtctttaaggcactctgcgaaggcaagatacatgaaaaacagttggaagcacaactggttaagcagccaaaagagtcttcggttgtctctgagttgctatctttcaatatgcctgggtgtcagccaatttattggaagggagaaagaatattggttgatctggagagtctgataattggcattctgttaggagaacctctgttatgcttatttaaaggccctttaacacagttctattatttcgagtttttacaatgtgaagtcttctgtttgttgtaactcttttttttttttttttttttttttttttgagacggagtctcgctctgctgcccgggctggagtacagtggcgtgatctcggctcactgcaagctccgcctcccgggttgacgccattctcctacctcagcctcccgagtagctgggactacaggcgcccgcccccacgcccggctaattttttgtatttttagtagagacgggtttcaccgtgttggccaggatggtctcgatctccggatccacccaccttggcctcccaaagtgctgggattacaggcgtgagccactgctcccggcctgtttgttgtaactcttaaacgaggacttgttttctaatctttggtagctgtgcttctgtggagctactttccttgggagtcctgttccttcagagcagcgtccaggttctctctctggggacttagtacactcactctttctggaccagtttttatgttaatttctgtgcttgggattctgtgtgtctctcatgcatcagtgatttctaatgagtaattcttttcctacccatagcctaagagtctttgttgcttcattgggctagtaagtaaagtttttctaaaggtctctatttttacagggatagtcaacctttgtgactttctttaactttatgcagaaaggttagttccatctcctcctgagccccagtcctgggatctcctccctaaggcttataacccagtttttaacctaccgctccctcgccccacccccgtaagttatttccacttaaactcatcagctataactgaattctttgttattagcacttctcctgctttggctaaagctcaatacctaattattattttctttttatgcactatttttatgagtttggagcaagaggggagggtcatgttgggttccttcacaatatttatcacaagtacaagttccaatttaagctaatttattttcagtctgttaggatttttttctccttctctcctaatttttgtcaactgttatttttgtaatcattctttttcttcctgaagtcttcaaaatccatcagatggatttgattgttgctttttagatatatatctgttgcaaagtttttgccattgcttatgggatgggatgaattacagctctcttaaacaacagttttctgtggaaaggcagcagaaggcaatgatgaaagatgtacttcctgctcttcatctctatttctgaaatcttattttgtttcctgagtttctgtaagagttacttctgcttaaaacttctgcctttacccaaactttatggtgtcttctggaatagtttatttttccagtatactttaaagaaaaaaaaaccttcggttctcagcctgctcatgacatccagctcctgttgctttggctcagagttccattctacctcatgataaacaccttcgtatctcattatatcttaaattctctaagctctaggagcagacttacagagggagcatactgtactatttaaatgagccatgacaggcctgggagtggaacttactgctgggaagtagaccaggtggtattaaaggggcttgttccatgtggcaattgctccacccgttaatactgaagtagaaaattggaggagtaaaccacgttcagttgctaatttcctgtggagataagacagacacactgtgcttgtgtatttccatctctccatgtaaaactgtattggaaaacatttctttttatttctaggtctgatttttttgttgtagttttattttattggcagagttcatgtagctaaacccctcagtgcttcaatttaagacatcgggagatgaatgaaattgttatgttattaagtagatgctgcagctctgcttgctagggatgaaatcctattttatgaaataatatagtgtgaagctgtcagtaatttccaattgtagaagaggcctaatcagaaagttgggttttttttgttttttgttttttgttttttttagacaggcccagacagttttttgaccagacatctatacatgtttcagtgagttaattactcattttattgtaatttcatctgttagaaagtacccaaataattgcaaagtttatgtatataaacttttatggatatatcacaggcaaacaataggtgatctttggcatggttgtagttgggaggtttcagatggagatactgtgggcacatgccctcttcttcccagctggcatcctgggaagtgctgacgggctccggagcaagtgaggccctagagactgtttatgacacgtcagtgttcatttgtgtctcatctctttgatcgctaagaagatacctgttttactaaagctcagctgttgtcagtttctttggattgattgtcttaaagggaaagataaatcaactttgtttttttcctgaagatagctaatcaggtcatttaattttggaccaataagtaaaagaataactgagtttaatgagtattgcgtaaaataagttcttggtgatttgaccctgggttgacttggcatgaattttctttcttttcaactccctgctgcccactttgtggtgttgtatgaataatgagtccacaggccctgtaaacatgttaggtgaggtgtttgttgtttattagtagttgggattaaatagaagttgcacactgaaattgagtgaagtgacttttctgcagttaacttggatgtcattggtttgaaggagtttttctgttgcagctgcttgtcctactacttttagctgtgggtgcatcctttctgcgtcctgctaaaaattatattcttgttttcacttttaaaacctaagacggttccagagctgtgtttggtttttgctttaaactaatgcccgagcgcccctttagttagtcaccaatcactgtttaggtaagttgatgattcctttttgctacccaagatttttttatttaaaattgagcatttttaacttgctttttaggtcagaggatcaatgtcctctgtggtattcctcctccatctaagcttcttaaagcagtattataaatagaggctttcaacctaaaaagtactgtgtatttcattgactagaactgaactgaactgtaggctaataaaaagtaccaaatgaaaatattatggtatctcattgcactccattgtagatgtaatgtagtgtgaccagcagtagctttgattcattgtaaatcccatctgaatactgacaacagttcaaaacatcaggagataaacctcaaaggtcacatttgtgtgaatggtcattgtgcatataagacatcattttattatttgaaaactagtagtgtagctcttaagacagggcagtgtcctaacctctgacagggatagaggcgagaggagaatcagtgggctgccaaacagtcatgtgttcataggtgaggttctgtttcttctttagctgttactattgttattattattattattattatttgcatgaatggtagcagttacttcacaggcaaatttcctatgaatcccagagtattgcaacagattagcagcaaataaagacctgagataaagaaaaaaaaaatgcttttattcagttatattaaaattaggacatttcaataaaaaactaaagcagcttatgttgttctgcatgcataaattgaaagaatacttgaaaattcttcaaacttgatggtagacattatcttacagctttcttaaaggaagtcagtttcttggcagtaggacagaggttcccaacattacttggttctagcacaatcactaaatttttcgtgacttttagaccaaaataaatacttaacagttcctaacagtttgttgtgttccaacagtttgtaatcatgtcaaaaaataatagacatattagtaataataaattgaaagaaaatattttaatttcttattacttactcatcaaatgtgtgattgttgggcatggcacagttttttaaaccttggaatcagattggccactgccaacttcatttcttgttccacgctaatttctgtgcagaactgtgctgtgcttttagtcacagtgctgcggtctgaatggttatgtccccccaaaattcatgtgttgagattctgaccccaaggtgatcatattaggaggtgtggagcctttgggagtgattaggtcttgaaggtggagttcttatgaatgggattcgtgtccttgtaggagagaccccagagaactcatttgccccttccactgtgtgagaaaagctgtgagtagatgccatctgtgaaccagaaagcggactgtcaccagatactgaatcttacagcactttgattttaggctttccagcctctggaactgtgagaagtaattttttgttgtttataagctacctagtttatgatattttgttacagcggcttgaatagactaagatacaccgcaaccatcaaaaactcaatttcgaagagatggaatatcatgaacaataattttgcatgatgtcgtattgaactgtgaaataccacaagctagtaatttgcacactgtctgacagcactgtgtttctcaaaatttaaaatgctctgcagtacccctgtgagttccctggggtgctgcagtgcacaatttgggaactgtggtagtattgtagatagtaagattatctaataataagtattgatgacatcttagtttaggaataattattagtatgtcagactataggggaagtgagtaaatcatatactaggttgttatcagaatgattatgaatttcttcacccacctgtggagagacagcatggcctatttttttactctgaccccaataagaaaagtattctgtaccttcccccttctctctccctttttgtctcttcgttatctctcactcttgctctaacagacacacacatagtgaaataagtatttaacaaaacagtattctcattatgtgcactctgactttttttttttttttttttaatgtctccttaagacctactgaactgacggaaactagttaaggtcacagactcgagagactgacgactttaaaatggccttcaccatttcctgtctgtgtgactgtaagcaagttatgtaacctctcagttactcagtttcctcgtctatagagtggtaatttgtaatagtacctagtgctgaggggatttgttttcttttgttttgttttgttttgttttgttttgttttgagacagagtctcgtgctgtcgcccaggctggaatgcaatggtgcgatcttggctcgctgcaagctctgcctcccgggttcacgccattctcctgcctcagactcctgagtagctgggactacaggcacccgccaccatgcctggctaattttttgtatttttaatagagaaggggtttcaccgtgttagtgctgaggggattttaaggaagttaatacatgtaaaacactttaaacagttcttttttattttattttattttattttattttattttgaggaacagttttgctctaatctcccagactggagtgcaatgggacgatctcggctcactgcaacctctgcctcttcctcagcctcccaagtagctgggaatacaggtgcgcgccaacaggcccatctaatttttttgtatttttagtagagatggtgttttaccatgttggccaggctcgtctcgaactcctgacctcaggtgatctgcctgccttggcctcccaaagtgctggaattacaggcaggagccacaccgcgcctggccatttaaacagttcttgatcagtaattactgctttattactagaatctcaatgaataatcagaggctaaaacatttgggaaattagggagatgcagtagttctgtgctctaaagggtactgcatacagtcaaaaggcttttctgaatttctgctcttgggcagatagattgtgtatcccttgccaaagattttccgtatttatcctcttgaatctggatccagttgagtagtaaacgggagtcaaaataagggagatgaaaatactatcgtcattactgacaaagctgattagagaacatgactttatatttgcagccaagtagcttcactagtatatcactcctgccaccagcacagctgcataactgcaggcttcttactgcgtggcagagagtagaacaggatggaccttctgcataagcagccaggtctgaagaggggagagcagaaggggctgaactgagtgtgttcacctctttcttcaaaatctgccaatgatataactcacaagggagggagacaagaaacataggcacagaaatgtgaagaatgagaatatcaccttaacaaaggaaacattttataaggatacaggaggtccataatcaagttcatgttttgtaacttttagtagttaggtatcctttctggcacaaactttaaaaacagatacaccagggtttgaattctgcctgtgtcacttaattgcactggcttaggcatcctagaatttctaagagccgtaaaacagacaaaactacttggcaagaaaaattgaccactgacttctctcccctgttctgttgatacaacattaaatttatcaatgtttgtttttgtcaaacttcagtagtgttagaggtatgagatcagccttagttgattagaggtatgagatcagccttagttgattagtaaaaaggattttatatgcctaagatagcaagagagatatgcctttgatctttcttatttataggaaaataatttattaacctaatttttattgtcacttctaacctaaatacatagttgtcctattaatggggacctttttttcccgtgagcatctgaaacagtcttttttttctatgtatgtgaagtggtaatagtttttctcgtgtatcaggcaactaccaacttattttagaccagaaattcttggaaatggtaccgatccagttggcataaaatgtgcaagcactattctattgattcctcaaaaagatgcaattgctttactcatagagttatcagttatttttctggctatttcacttgaagtagccatgctttgtctttttttctatggagatacgtggccaaaactaagtcttttcaccagctggatgataggaaatttgataaaatttgagcagtataaaaactttcccattgactttatatgattgaatttccactatgtaaaattaaactaattatttcttatgctacccaatatatagtttattatttgaaaactatgtccccatttttcctcaagaacatgattttgtcttttgcatctcagtgcaggggttggacagcataatttcttctcctagaaacacattttctgctgcttgtagctactatttctattttttcatcaacagctacaggagtaagtggagttcctgacatctctgtgtaatcagtggtatgatcacataccccatattgactttttcttttgaagtttatgctgctgtctcttcagtaccttgagcttgacctctagctttaagcagtaaaggtatcaaagaaaatcagttgccagagtcagtctgtttgcttgtgtcctcctaacccactgatggcacctctgactccttgacattgtattatttgtttctcagagaagtaaagcaattttttttttcctctgtcacccaggctggaatgcagtggcgggatctcggctcactgcaaccacctcccgggtttgagtgattctcatgcctcagtttcccgagtagttgggattataggtgcctgccaccatgcctgactaatttgtgtatttttagtagagacgaggtttcaccatgtgggtcaggctcgtctcaaactcctgacctcaagtgatctgcccagtttgccctcccaaagtgctggtatcacaggcgtgaaccaccacacccggccaaagcagttttttttacatatagacatttaatatattgactttggttgattcttacctcacttccaagataattgtttctgttaaattacatgtatttttaggcttgagtcatccactatatttatgagttggtcatttctttcatgagttgagcttgtttttaaaagttctacttttaaagtccccttctgtctctcctgcagccactttcactgtaacatttatcatgttattcctggcagccagtcttcttaactctccatcattacttttggcaggttacagcagtatcacttagggttctcttagttcatttttaatgaacatccaaaagatgctcctattgcaataaaaccataagaaaagattaatagaataagggtttattctattaataggcaatttggggctgctacagtggctccatgataccaatggttctgggctctttcttttccgctatccttagtatatggccttcttcctcctgcttgcaaaatggtggcatacagaagcctttcctacatattccagaatatgaagaaagacaagggggaaaagggacgtgccaactggttaaacaacaatcaccatatcaaagacccacccactagatttcttcttcttactggccagaactttgtagcgtgcccaccctctatacacaacaggctgcaaaggaggctggaatatcacgttttagttgggcagtgactatccagtgcaaaatccagattccgttagtaaaggatgttgatggagtggatggatattaaacagagattcaactttcctgttcagaaacgtgttataactccatatattgctttaattctatctatcctagatagacttacaaggctagaataagacctttagaggcactaaccaaccaccaaaaagaggctaatcacctcccatatgtaaatcaaattgtacaaaaaattgaaaaaaatacatgtaaagaccgaaaacattttgatttatcctatgacgtttcagtatttttctggaagtattaaatattctaaaatttttttttttgcccgggtacggtggctcatgcctgtaatcccaacactttggaggccaagctgggcggatcccctgaggtcgggagttcgagaccagcctggccaacatggtgaaaccctgtctctactataatacaaaaatcagccgggcatggtggtaggtgcctataatcccagctactcgggaggctgaggcaggagaattgcttgaacctggaaggcggagtttgctgtgagcccagatcacaccattgcacttcagcctgggcaacagagtgagactctgtctaaaaacataataataataaattaaattaaattaaagtgtgtggtagtgataatgggctggagggtatggtgagtctatgttgctgacatgctaacccacatcctgtctacttcatcagtatttcctattgtattagaaagatgagaaggttccttaaatttttaactccatagaggtgattcatttactataaagccttaagaaaaatacttaccctatctgggcctctgtttctccatccatgaaatgagaacattgatcataatagaaaagtaggcaaagaatataatcaagcaattcacaaaactatacacgcagatgactaataaaattataagaaaatattaagcctcacttatgacaaaagaagattaaatttaaataaaaagttcctttctaaaaatgtaacatagtagcagagatgtaatacccagtggcaataagaatataaagaaacaagtatttgagtgtaaagatagtctgaagtagtaaacgagggcaactaggtgtatttatcaaaggttttaaaaaatgcgcaaaaacttttgaccctgcaattctactttgaggaactttcctacctgaatttttgacaagcacacaatgattgaccctggtaaattgacataaggtatttttaactccagccagtttttttctttactgtagtaatttgtgtgaagctttctaagaagtaaatatgtaatttactgtcaaagcttttttcttttagaaaatctaagccatgaacatttaatatgttttcgttttaccttatattaggaagataatggcaatcttttaaaaataaaaattatttctttgttcatatcttaatttttgtttcaatctgtctgtccattttggtcttgtctattttacctctgggctctatctttactacaaccagtcttcctaactcttctcccaactttcagaagtagttttctaactatgtcaatgaagtatttccaaatgaaacttgccaaatggtctaatgccataaagacttctgcttctgtcttcattggattttagtcagtaaattttctttcttttttatttatttgtttatttatttattgagaatggagtctcactctctctgctcactgcaacctctgcctcccgggttcaagcaattttccttcctcagcctgccaagtagctgggactacaggtgtgcaccaccacatttggctaattgtatttttagtacaggtgggatttcaccatgttgtccaggctgatcttgaactcctgacgtcaggtgatccacccacctcggccttccaaagtgctgggattatagaagtgagccactgcgcccagcccatattcagaagttttctacagtttttttgttttgttttgttttgtttttttgagatgaagccttgctctgtcacccaggctagagtgcagtggtgtgatcttggctcactgcaacctccacctcccaggttcaagctattctcctgcctcagcctcccaagtatctgggattacaggtgcccgccacaacgcctagctaatttttgtatttttagtagagacggggtttcaccatgttggccaggctggtctcgaactcctgacctcaggggatccgcacttttggaggccgaggtgggcggatctacaggattttaaaacatgaagttgtgcctcttcccaaatttattctcagacttatttttttactagttttatttctgaatggcacattagagagagagaaagccagagagagagagagcgagagagaggaaagaagagacaaggtgggaccgatggtataattgagttcatagaaagacagtgaagtgaatcatgggtgtttcatcactttacaaaactgataacaataatatcatttctagaaacgtgaatttacagtatgaaatggtaaacattttttttttttgagacggagtctcactctgtcgcccaggctggagtgcagtggtgcagccttggctcactgcaagctccacctccagtgagccattcccctgcctcagcctcccccagcagctgggactacaggtgcatgccatcacgcccgactaattttttgtatttttagtagaaatggggtttcaccgtgttaggcagatggtcttgatctcctgacctcgtgatccacccgcctcggcctcccaaagtgctgggattactggcttgagccaccgcgcccggctggtaaacatctttttatagctaatgggcacttttaggctaactgagcagtgaacactattaaatatatgagaagctttttaaaccaccttccacttaattcataactacttgtcaggttgagactttcttttctctgttaaccatgccaatttttgctcagagcatgctgaaaaagctactagattactgtcacatataccaggcatggctctgttaacctgtttagttgtattattgctgaaaagttatttattccagctattcttgatattttaattatatatttttattattataagaaaccaatgacatactcatatgaaaaaatatctctgtgaaataaagcaaaatgttttggaaaagggatgcaggtaagtcatttcaaaattgctgttgttaatgcgggagaggatttggaaaaataggaacgcttttatactgttggtgggagtgtaaattagttcaaccattgtggaagacactgtggcgattcctcaaggatctagaaccagaaataccatttgacccagcaatcccattactggatatatacccaaaggattataaatcatgctgctataaagacacatgcacacgtatgtttattgcagcactgttcacaatagcaaagacttggaaccaaaccaaatgcccatcaatgatagactggataaagaaaatgtggcacgtggccaggcatggcggctcatgcctgtaatcccagcactttgggaggccgaggcgggtggatcacctgaggtcaggagttcaagaccagcctggccaacatggtgaaaccccatctctactaaaaataccaaaaattagctgggtgtagtggcaggcacctgtaatcccagctactcaggaggctgagacaggagaatcgcttgaatccaggaggcagaggttgcagtgagccgaggtcatgccattgcactccaccctgggcaacaagagagaaactctgtctcaaaaacgaaaaaaaaaaaaaaagaaaatgtgtaacatatacaccatggaatactatgcagccataaaaaaggatgagttcatgtcctttgcagggacatggatgaagctggaaaccatcattctcagcaaactaacacaggaacagaaaaccaaacaccgcatgttctcactcataagtgggagctgaaccgtgagaacacatggacacagggaggggaacatcacacacggcctgtcgggggatcaggggctaggaaagggatagcattaggagaaatacctaatgtagatgatgggttgatgggtgcagcaaaccaccatggcacatgtatacctatgtaacaaacctgcacgttctgcacgtgtatcccagaacttaaagtataattttaaaaaaagtaaatccaaaaaaaaattgctgctgttgaattaggttaacagttactgaatattgggagactttttgaaacctcacagtttgaaattggcattgtatttcaaatgtctgcatactgactagccccactttcacacaaccagagctgaaaaggatgtgaaaaagacaatactgaacctaagtcatcagattatatggtgatctttggatctcgtctaaatgaaaaaccagcaaagcagcttcaaagcagcaaaacactctctatatactttctttattctttaagaaatattttagttaatcacctagcagacttgagtgtcacataaaggggcttcttctatagtttctcataaataatttgctgattctgggaactctaaaaggtaaatattttatgtagcatgtgtatattgtaaattatttataaaaatgttttaaaagacctaatcctgaaatagtaaataactaaaaatttacaaatactattctcaaatagtaaataagtatatatgagctttcaagttagaactaaaatttccatgatgtgatatctattttaagatttgtttatcaaggaatattgtaatttgggaggattttttaaaagcagattttattttttctgcccttcacaaaaactaaatctgagccttgggaaatcagggcagctgcatcatgatgtgacttgcctggggtttggtattttgctgagatacctgccagttggaattagaaccctatgggtataactagggtagacttaattattggcttactgtatttaaatcaaaatgaaaagctcatacaaaattttgtacccgtactctgaaaaaatgtggaactgtttttggactaaaattttatagcttttgtggctaatgaggcatgaaataaattggcaagctcaaactgttcggagtacagtggtacagtgtgcattttctaattcccagcccttgggattccagcaaaggtcacaaattaaacaaagtcaggattaatcaagactataatcaaataaaactcaatcattaatcctcttctgacttacaatagagtgattgtgtaattgtgtgagaagcactggagagggctcttttgtagtgcgtaggaaaatcaacattaaggtgtcagacagaaaagtgaaaccctgcaggtgaagctgtctctggagccaagagaaactggcaatttatgcagagttgcaagtgaagctttggagcattgaaaggctgttggcactgagctgcagagcgtgtgggtctctcggtgaggcctccacagagatcagtttacgggctgcagcaggccgtttgctgagaagctcagtgtttgggtgcagcagctccaagcaacagtctctccaagttaactgccagaaatttactgtgtaattctcagctctttgtaattttgaagaagaggttatggaaaagcatttcctctgtgggagtaattatgtgtcagaaaatgccattcctcaataaagggggaaggttcacaaagcacagaactttgtcctatttattccatgttcctgacttctgaactgatgcttgctttctgctattttatgttctatagtgatactttcttcatttttcatcccttcatctcaagtcagcgtcagttttattgctttaaaagtcaacagtgatactatccagttctgctaagagtgaaactttaagaataaaatttgattttaattcatcccttattatatgtgagtatattttttatattcgctttaaggatagtatttacctctgtttgttagctttctgctttccttcgtataccaaatagaaaaattctcattcactcacccccaaagcatgtgcctgttatcacatgattcagtttgagtttctatattacacaatttctgtttcttacattgctttttcctatttatgtactaagctctctgtatatgcaggatactgttaggtatgatatgagatatttattattttctttcaagtaaataaacaaccattatccatgcatagctggtcagtcccataaattttagtactaaaatatcacttggattattttattagcaagactttattgtaatgatgtatttcagattttgtctttccatttaggctcatatatgttacattttggtatcattattgaaacaaattcatgaattgagttcatcattagaaaatgaaagcctcagaattttggtaattgttttggaccatcacaaaaatgtgcttggcatatttaaattctgtatttttttcccttacctgtaataacttttcaaagtacctaaagctatgatagaaatggaatagcatatagaatacttgtgtgtgtgtttgtatgcaggggggcggcttcttatttttaccttttttctgattttatatatacaatgttagatatattgttctgcaatttatatttcagtggaagaatattcatggttattttttaaagtcagcataaagatctgttgcattctgtttaacaagtgctttgtgttccagtgtatagatactgcattatttatttcatcctttcttggttgaagattgtttaggttatttccagttgtgtaatattgcagataatactgtaaagaaaatcattatacttgcatcttttcacatatgtaagcatatttttctaggatagataatggagttgctgggtcaaaacataatggcgtattttattttgaaaactgttgctcaagcactcttataaaaggctctaccccacatgtgctctcacccaaatgtgtatgaaagtgtgcatctccttaattgttaggtgtagtggatactatccatcttttacatttttgctgacttttatatttgagatatctttctacaccattactcacccttttctttccagcagagtagtattccatagtattatatttaattagtcctccattaatgaacatttaagttacttctaacagtttgccattacattcaatgctacagaattttaacaaatttgtaatgcagaattttcataagtataagaataaccttattacaaaagtcatttcacatgtatgcaagtatatctgcaggataaattccaaaatgtaacaaagggagtatgtatttgtaattctagttgatagtgtttttttggtttttgttgtttttttgagacggaatctcactctgtcgcccaggctggagtgcagtggcacgatctgggctcactgcaagctctgcctcccgggttcacgtcattctcctgcctcagcctcccgagtagctgggactacaggcgcccgccaccacgcccagctaattttttgtatttttagtagagacggggtttcaccgtgttagccaggatggtcttgatctcctgacctcgtgatccgcctgcctcagcttcccaaagtactgggattacaggcatgagccaccactcccagcctctagttgatagtgttaaatggaaaaggaagatgtaaaacagtatgctaccatttgtttacaaggggaagggtataagaatatccatgtgcaggcacacatggtaacatggcgagtgcgggggaaaatgaggtttcaagttagaactaaaattaagggtacactgtgacttaggtcacaacaggacataaacatttaatttactctgagcctcagtttccacatgtatgtaaatgaagctagtaaatgcctgtttgatagtattatgagaattaaatgcaaaattgtatgtgaaattatgtgacactgtggccagcatatgatacgtgtgtgtgtgtgtgtgtatattttgctctatattgtgccatatgtggcacagatatttcttgtaaaggtagcaattgcctgttgtattcatacaatgcggagcctacttgtcaatgatgcttttatttaatcaattatacatagagttgtcagcatggaaaatgcagcttctgttttgaattatgttttacttctgagtataatttaaaggcaaaatggcttcactcctagaaactcgagacctctaaagcttgttctcttcctgatgaatgttctctttgggcacttcaaatagagtatcttactcatggctttaggtgatatactgggaaagcatgcagttgctttagaagcctttataaataatacttgagtgttcaatataaaaccaatgtttggctttcgtaaccatttcctacatctcttctataagtttattgaattcacagtacacatctacactgtgagaagcatttatctccttttgtgctaataaaattaagcaaaagacaaagttactcccaagttcatagcatattccttgaaaggaatgattataagaacaaacggggatcaatgcattacatctttagaatacaggaaggagtttttactacttcattttaaaaataaggaaatagagatgaaaagctttccatctttccataccacgttcggcagtggtaatatgttttatacccactaatcaaggcatcctctgtgttttgatgctttgataagtagtcatctgcttttaagtttgtgatagtagattgaataagtgtcctcgtgctcacgcaggattatatacttattatatacttaggcaaatttgtctttttgaaccaagttttatcacttaaaatgagcataataataactaattcataagaatgctgtaaacataaaatgagtattactaactgagaatgtacagtagatagtaggctctcactacatgctggttttccttcttcctttccattctcttaggaaaactgatactcagaatggctaagtgatctgtgcatagtcaaaaggccaatttagtgatagaactgagactggatccatcactttgattacagctagattctttccattataccaagcagcatccatagtaatttactttcatttgtacaattttctatgagaaaaaatgagcaacaactatcagtttgtcttcaatcctgataaaatctagcacttacagaaattgctaagaagtaaacatttattacacaaacccatgccagagaggggtatgttgagttctagtctaaacatctttaataatgataattccataattctcagctgtttcttttagattgaccttttctcacctgataaaattttccaattctaagctctttattctgattgaaatctgacataacttgtctcagtcatcatttttccattctgagcttgcttatattttctaaacttttaacttggttctccagcctggcgaccttaatttgtccattttagaacagccaaaatatccttgattttgctggattaattcagttatctcaaattatctctgacttcctttttcacacctgattttccttagttttgttgattaaagattaatatgagtttgtatgccctgacagtggatgatacaaaagaaaactggtctaggaattaggaaacctactttctgtttcatctctcttcttattgccaagctgtttcctcactatgatgggaaaaattatgttgtaatcttatgtcttataaaagagggctcaaattggtatagactgtatattttgtggggaattaattatgtgactattcaacatttgacaaataattttggacgtaagtgtgcaatgtctaaagcccgaataattctaattttaatgtcaacgcacttgatgagttgaagtatggtgcttgctggtaatggggaaaaaaaaaggctacaaccaaaagtattgtgttatataaaattacatgtgatttgttgtgccttcactttgaatattagctttcctgacagccaatgtaagatattagttaacatggaaaataacttcttacatttacatattgcagtttttcagggcacttctgtacacatgtggtatctatataaattatatttcagaataaagaaatggtcactgtctataattcttacactgccacaccatttgaaacaggccacagagatttattactccatgagttttgtgaatattgagactcaaatgctatgtttgtacaaggaaatcacaaatcgtaactagaatacattcacttacatattacacctagagttcgttttctcattgttcttttaagtttttttctctgagtatgggtaggtaaagtatagcaaatttgttgcagaaaattaactgtgaccacattaaagacttgaaaccacactccaaaatagaaaaggcattaggaaaatattttgcttagaaggaatgattgttcttgtcttttcaattttttcttttaaatgtgcaacatgaaactactccttaccttgaaagctgtatggctgattgttgctgcttcccaacatcttcacccgttttaccggaatttcgcctctgctattttaccttctaagctgtgaacccttgtcatcctatttgaaccaccccctgccctcccacctccctgttattagcagtacatcaaagattggtcattggtcttgtctccctgctaattcatatcttgatgttcttgaacagtatttgaacagtgcccctttagaggaatatctaatgtcagtcatttcctattctgagttaagttaattgatctgataaattacaatgagcaagtgaatatagtgggtttaaaacgtatccgtctattctggatttgcttttgctctggagaaggcaaaaaggccaggaattagtgagtgacttagtcttctctcgtcattggcagctgacagacctactgatgaggtgataatgaactccaaagtctaccctaggagcaactgggagggaaaagaacccagacagaaggcatgtctcactttggagcctgccaagatttttgctttttcatagaattcatttcgaggaggttaacaggtagactttgctggatgcatgtcagaagtgtaacttatcattcatggacaccaaagacaaatatatattttatttctctcaacgtaacaagccagaggcctcagtctcagagacggtcactggggtaatccagtcagagagggagcatccgaaacaaggcttgaatataaagttcattttttaaaataactcttccttctttccattaaaattattatccaatacatatggtatgacagattagaccttccagaattatttgctactcctgtttatttgattcctagaatgttgcttagcggtctcaaacttaattggagataatgagtatacctaaggtaaatcttccaattttgtttccagttatgaatgttggtgaatctttccttttccaaattcagtttaggcctccactgcctgtttttcttcaggtatcatgaaagtgaatgaagtattttcaagtccattcatccccacctcacatgggcagtcgcccctcatacacatatattttgtagcccacacaggaggcaacttaatgtacaaaatgttttaagttaattactggaagtgtgttaaacatagaatattagtgagtttttaaagtctctgaactttaaaaataatcaactgtttgtagaaaaaaaatgaattattgttgatgactcagcgttccttatgtaaagacttggctttagtcttcaagaagctcttcagcttccctttttcggttttaggcagaacatggactttgagaagttttaaaaattctattattcccacccatgtttccctctgtctttaagctgtaataaaacgtatcaatgttctgggagtctgtattgctgaattgtcagggcctttcttgcttagtttcgcttgatgataaatttcaaggaacccatagtgcactatttttaaccagtttcgaggttgaaaaaatgctaagagtttgtgtccagaggtttggataacattgttaattgtgccaagtatccattgagtttggctttattctttatcctgtttaactggcattttctctgctgtaagaaaacagtccttaggagccacgacaactgattttattggtaaacatatgaatgaggcatgtttcataaaactttataaatttaatattagaaggacagaagtttgaccagacagttcaataaagacaattttatatatattttaactttctttgattccattcacttttcaaattagatatttcagattgtaattcttagaattgaccatgccatttattcctctttcttgaaagacaaatagaataaacaaaaatttgtagacatctaaagagtaatctaaggactatagttttgactcatttctttcatgagtatagtttctcttttctcttttataatataagatatgcacccgtttgtctattcattcctttttgcttctccaaacctgtttgcatctttggttgtgactcatttctttatttgatcaattgttaccattgtatacagtctctttagttggatatttgctgaagtcagataaaccttactggtttcagggatatgattgtggtatgaaactgccaatcttctactttgatgttcatgattcaaaaacttcttgttcctttggagaaaatgagcctaagttagtcgtcatcctggaaataagttttgatttctttttatgaaagaatgccaggaactttcaccagtttatctttgaatctttattttccaaaagtaaggtagaaaaatcctcaccgttttactgatttgcagactggtaaagtgaacaaggtgttagaatcaagacattttactcaaagaccactaatttaaaaaggtaagtcagaatctggcccaagaccttgacctctcaaattagatttaattatgaactgcattaagtcccattatttctcctattttgcttatcaagtgataacttctagtcagactgggataatcatgaatctacagtgccgaaggcattcatgacaaagctcaccctttgaagcagaaaagcaattcatctgtgtcaaaaaaggatgcaaactaagttttgatcctgcctgatagtaccattttccagctataccttgtccagcattctttatcaaagccagaaagactatatgcaagaagaatttagaacagactaggtactataattctttgtgtttgaaaggtgatattttagacgtagagacaaaaagtctcccttgagtttttgaaagaaattgcttgtaagggcaaatgttttaggttgaaaagttgatattttttagtttccctgtttatgaatagttcacagggtaatgttgtcagtcattttaaacttattatttctccctcttggaaaggttatagattgccaacagaaagtagaactccctgtttctgcgtgtttttctctgaaatagtgtgtgacgtagtcacattactccaggctcaattatagacagtttgtgggttttttttttaataatgccaaaaatctgtggataatgtataataagctgatgtacatcctactagaactgaggtatttcagtttgtgacaaattatgtcttaacatgttacctcgttaatagtcattggttcataaatgctggggattttaaatttaactctttttatacctaatattaaaaattaacccaatttaacattatttcatctaccacattactggccttgttttgattctaaatctcatgtcctaatttacaaattaccaaattaattcaaatgtataacctctttatgatttgaggcccactctggaaaagaaaaatactagacatttctattaaagtcatgagtgatttttatgtgtcttgtggatccatcccccagagtcttgtcttatatctttatgttctaacaatgaagtttttttaacgtacttttagcaaaatatacatatatttacacaagtattttagagttacctacagtaggatttagaggtcttttattcccatgattatataacattaaacaatatgtagcccccaaataaatttttctgtgggaacttcttcacgttgtctgcacatgacagttgatcttgggttgtttcagtactttccttggttttcctcctgtgtctttagccattccctagaagtcccctttttctctcccttacaactgatggtctctatgagtccacttttagctcccttctcttcttctatactttcttcccctatattttttccaaagtaatgttatctgttcagtggcatcagccgctattaatatatgctcatgacgtccaagtacaaataaatacacaagtggtttactctagcccatatctctgttcccaactttgggcccctatcaactgccaactgcacctgacagcttgaacattccataaacgacctcaacatacctaaaatcatctcatcattttttttttttacaaatatgctcctcagtatcttcatcatcaagaaatgtcgtttactcagttgttcaagccagaaactaattaaattgttcctaacaactttttttcccttgcctctcatagctttttcaacctttgagacatatctccacatcattttgcttctctcttcacaggaattattctattttatcactttgtttttgcaacagcatcttagctaatttgtaactaattttaccctttgccagtccttttcttctgcttcttccaggttaatacttggttgtttgtttgtgtttgtttgtttgtttttcctttggagatggtgtctcattctgtcacccaggctggagtgcattggcataatcactggtcactgtaacctcaacctcccaggctcaaggaatcctcctgcctcagcctcccaagtagctgagaccacagatgcatgccatgatgtccagcttaatttttttttgttagaagtgaagcctcacttcgttgcccaggctggtctcaaacccctgagctcaagtagttctcctaccatggcctcccaaagtgctgggattacagacatgagccactgcacctgcccttaatacttttgaaaacacgtgtatggtcatgttatttcctcttaaaattttccaaaggcttcttatcctttcaggataaaatgcagactccgaagcctgacgttgaaggttccccataatctgacttctcctgttgtacgccacgcccatgtgacctcacgtttctcctttctctctctttcgcttccccctcttgcctttttcctttctcccccctccccttttctccctcagttaagatgctacttcttccatgacaaatgatgctataggaggaagtcatttctttctctgcgtttgctttgaacctctcctattgctttgtcttttttttcttaccatggattaaaatatctgtgtacatgttttctgttgaattaggagcatctaattcagtgttagacacggttctacgtgttagcagtatcatctggaataagacagcctctgttcttggggagggagggtccttgtctttttcattcttggaactttttagaggtgatttgacaaataaataaatgtctatttaaaagttactaaaaaaaaaaaaaaaaaagccttagcgaccaggcacggtggctcacgcctgtaatcccagcactttgggaggctgaggcgggcagatcacttgaggtcaggattttgagaccaacctggccaacatagtgaaaccccatctctactaaaaaatacaaaattagccaggcgtggtggcacatgcctgtaatcccagctacttgggaggctgaggcaggagaatcacttgaaccccagaggcggaggttggagtgagccaagatcacgccactgcacttcagcttgggcgacagagcaagactctgaatcaaaaaaaaaaaaaagaaagaaaagtcttagaaaaggttttttttttctaaatttttcaatatagattcatctaataatctcaaaataattttataatagcctaaataaaatcaactacacacgtattaataatgaccttctatccctatttgggatgcaaagtgaggcaataactacaacaataataatatattgttttacgttttccatgtatatattctgaaagcctcacgagcagcctgtgagaaagctgctttcattatactcgttttatagttgaggaaagtgagtaattttcccaattatactaataaatgagaaggaacagatccgtaactttggtttccttttgctatctaatgttgctcttctagatcttacctagctggggaaggggaaaatgtgaataagataccaaaataagtggatgttaaagtaattcaggcaagaaattatgaattagggttatgtcagaggtggaccatgaagaaatattgaggaggtagaatgaacagaagatttaatgacaaagggatatgtggaatttgaaggaaagggaggagttaaagatgatttaagctaaaagctcccaggacttttgaccccacttttctagtgtgcttggtttctcctttaaaaagattctggagaatagtttaacagttcccaatggaagtaaattataaaagctgagatggcaatatttaaaccctagagccagcagcagtggattcaaccctgaagtttcaagcagtatcctttgttttatggctaagaaccagtatcatctgttatttaactaggaagtacaagttcacctttacaggaccaacattttattttcttctgtgaaatgcataaacaacataatacacgacaatgggaaaagtcagatagcacagaaaggcctataaggaaaagcaacaacacatctaccttttctgtccccctttccacatcctcgagtgagtgatcctttcagctttcttcactcaaaactttgcacttgctcttagctaaggctgagaagcaatcatcactcagaactttagactcataatgttattttttattgactccttgcaacagtcagtatttagcttacttaaattgctgcctgttttccctcactccttctcccagtttttgtattattattattattattattttatgaatcctcttcgttacctttgtaactttaaatcatacacttaaaactcttaatttctctttatcatcttcccacaggctctctgcctagtgacatgtaaaataaggttatcagtacctctactcttccttccacttttcttcccctcccttcttctctcttccccttccctaacttctgacagttgaatttttatttttattcatttacacaggacatgcagccatatcttaaagttgaagactcatcttgtccttctattttggaaaattatgaacaattctcccaaatactgttttctctaatattttgttctgcaactcctagtagacttagagtctctttgtcttttttacatgtctcttaatttatcttctcttttttatctctttatgtcttttatcctttatgttccatgttttgactaaattgctagtactgtctttcaattcactgattctgtcttcagctacattcaatgtactgtcccctgcttatttagtttttgtctgtaactttactcacatatttgttaaattttttattggagtgtatactatacctctgaaagaatatgtgtactgtcagtttagttcactatatttttgcagtctgaaaaatttatgtaacctgacacccaaatcaagaaacagaatattcccaatactccagaagccctctttgtgcttccctccagtgagtaacacctcccttgagtaatcactattctgacttctgaatgcatattttaattttacctgttttgtgttatatataaatggagttatcaaataagtactcttttgtgtctgggttctttcactctgtgttgtgagttttactcatgtttttacatgtagccaatagttctttcaatcttatcccataaggtatcatattgggtgactatacaatatttatttgtctagcagttatccatctacttacttattcactgttgatggagacagagcccatttagtttggggctctcacagatagtggtaccatgagcatttccagtgaagtagtggttcttgacccagggagatagtggggctgtcacagagacccactcacagagccggtagataccttggttctgtttctgttcttgaatccatctgcttgattcgttatgccctgatcctaacaaataattagtcattgggacaggaggtgagtacacgattgcagttcctggtgttaagcgatgagcctgtatcttctataaagtgttgttagtccccctcatccaggaggagtgagagttctagctccccgaggctgctttcggatccatattcctggcaggccatggtgtattttgcagctctgttccatttatgcaccacacatacgtttaagttgtatttgagcccagctgtagctttctagatctctccttatagtcattgctatgtattttatatctcagagcatgactttaccaaaccatcttaaccagaagtatttctttgaatctgaagactcctggatttcaggatatatttatgacttctttttttcttcctttgtttaagctcagaaaacttcttgtattacttctttggtcatttcctttccttcattttcactattctcaccttctaaaacttctagttgttggatttagatttctcttaaattttttactctgtattttttatctccttttcttcatttagttcttggttgggggaacaaaatatccttgactttatcttacagtacttttgaatttttttattttgctaaagagcattttaactttcttacaattggaatgttctttttcatagcctgctgtatctgttttgtagctttagcgtcttcttggatttctcttaagaaattgattagaccttttaaaaaaatgttcttctacttcctgaattatttgtgtttcctacagccttagttgttaaactcatgtatcttctcttttatttcagaggtttttcacgtattagtcaattcttcattgtcccttcatgtttaaggagaactagattgattgtggcacatggccaaactgaaattcctttggtggtgtttgcaggtttgcttccctgctaggcctctgctctgggtgatacagctgactagcagctttgtataaccggcagaacctgtccactggtagccgtctctttaggatggatggtgtggatccactgtcaggttggaggcaccccccaaatttaagaagaaaaaggatttattctgggcaccaactgtgatataagcagtcctggatcatttcagtagtttatttagtatcatagaaaagatcatttcaggtttctctgcttacttgttacaggtggggaaaataataaactgcatgtcctatgtaagagcatagggaggtgaggaggggaaaccattgcagctattcaaaatagacttgttttaaagcttttattttaagtacaggggtacatgtgcaggtttgttatgtaggtaaacttaggtcatggaggtttgttgtacagattatttcctcgcccgggtattaagcctggtaccctttagttactttataattcgtcctgatcctcgtcctgatcctcgtcctgatcctcgtcctgatcctcgtcctgatcctcgtcctgatcctcgtcctcctctcaccccccctcctccattaggcgccagtggctgttgttcccctctatgtgtccgcgtgttctcatcatttagctaccacttacaagtgcgaacatgtggtatttggttttctgttcctgtgttgtttgttaagggtagtggtctccagctccatccatgtgcctgcaaaggacatgatctcattctttatttatggccgcatagtattccgtggtgtatatgtaccgcatttttttttttttttttttttgagatggagtctcactctgtcgccaggctggagtgcagtggcgcgacgtcggctcactgcaatctctgcctcccaggttcaagcgattctcctgcctcagcctcccgagtagctcagattacaggcacgtgccaccatgcctggctaatttttgtatttttagtagagacggggtttcaccatgttggccacggtggtctcgatctcctgacctcatgatccacccatctcagcctcccaaagtgctgggattacaggcgtgagccaccgcacccggccccacattttctttagtctatcattgatgagcatgtaggttgattctgtatctttgctattgttaatagcactgcagtgaacatacacgtgcatgtgtctttataatagaacaatttatattccttttattatgtacacaataatgggattgctgggtcaaatggtatttctgtctttagttctttgaggaatcatcatgctgtcttccacaatggttgaactaatttacactcccgccaacaatgtataagtgttcaggttccttttcccacaacctcgccagcatctgttatttttttactttttaataatagccattctgactggtgtgagataatattgtggtttcaattttttctctaatgatccctgatgttgagcttttttcatgtgcttcttggccacgtgttatgtcttcttttgaaaagcgtctgtttatgtattttgcccactttttaatggggttgtttttttcttgtttaagctctttatggatcctggatattagacctttgtcacatgcataccttgcaaaaatttcctcccattctgtaggttgtatactgttgaaagtttcttttgctgtacagaaactctctagtttacatagatcctgttcatcaatttttgcttttgttgcagttgcttttggcatcctcattataaaatctttgcccattcctgtgtcctgattggtattgactaggttgtcttccaggttttttatagttttgggttttacatttaagtgtttaatccatcttgaattaatttttgtatagggtgtaaggaagggatccagtttcaatcttctgcatatggctagccagttaccacagcatcatttagtgaatagggagtcctttccttcattgcttgcttttgtcaggtttgttgaagatcagatagttctagatgtgcaaccttattttggggctctctcttctgttccattggtctatgtgtctttgtaccagttaccaggctgttttggttactgtagccctgtagtatagtttgaagtcaggtagcgtgatgcctccaggtttattctttttgggtaggattgccttggctgttggggatcttttttggttttcatatgaattttaagatagttttctagttctgtgaagaatgtcattggtagtttgataggaacagcattaaatctataaattgctttgttcagtgtggccattaaacgatattgattcttcctatccatgagcatggaatgtttttccatttgtttgtgtcatttctgatttctttgagcagtgttttgtagttcttcttgtagagatctttcacctgcttggttagctgtattcgtaggtattttatactttttcaggcacgtgtaaatggaattacattcctgatttggctcttggcttgactgttggtgtagaggaatgctagtgatatctgtatattgatttcgtatcctgaaagtttgctgaagtttttttatcaccttacgaagattttggaccaagacgatggggttttctagatacaggattgtgtcatctgcaaacagggatagtttaatttcctctcttcccatttggataccctttatttctttcttttgcctgattgccctgtccaggaccttcaatactatgttgaataggagtggtgagagagggcatccttgtcttacaccagtttttcaaggggaatgcctccagcttttgtttattcagtatgatattggctgtggatttgtcataggtggctcttattattttgaggtatgttccttcaatacgtagtttattgagagtttttaacatgaagcaatgttgaattttatcgaaagccctttctgcatctgttgtgataatcctgtagtttttgtctttagttctgtttatgtgctgaatcacattgatttttgcatgttgaaccaaccttgcatcgtagagacaaagcctacttgatcttggtggataagccttttcatgtgcttctggattcagtttgtcaggattttgttgaggattttgcattgacgttcctcaaggatattggtctgaagttttctttttttgttttatctctgccaggttttgatatcaggatgatgccgacctcgtagaattagttggggaggagtccctcctcctcaatttatttgaaatagtttcaggggtaatggtaccagcccttctttgtacatctggtagaatttagctgtgactctatctggtactgggcttatttatttactgtttatttatttggttggttggttggttggttggttggttggctatttgtggcttcctcaatttcagagttcattatgggcctgttcagggattcagtttcttcctggttcagtcttgggagggtgtatgtgtccaggaatttatccctttcttctagatttcctagtttacatgcataaagttgttcatatattctctagtggttgtttgtatttctgtgggttcggtaataatatcctttttgttatttctaatcgtgtttgtttggattttctctcttactagcctatttagcagtttattttattaatttttttttaaaaaataaactcctggactcattgatcctttatatgggttttcatgtctcagtgtccctcagttcacctctaatttttatttcttgtcttctgctggctttgaggttggtttgctctcggttctctagttcttttagttgtgatgtaaagttgttatattgagatctttctaactctttgatgtggacatttaatgatatgaacgtccctgttaacattgtcttagctgtgtcccagagattctggtatgttgtatctttgttctcattagtttcaaagaacttcttgatttctgccttagtttcattatttatgcaaaagtcattcaggagtaggttgatcaatttccatataatggtatggtttcgagcaaaattcttagtcttgatttctaatttgatcatgctgcggtctgagagagtgtttattatttcagttcttttgcatttactgaggagtattttctgtccaattatgtggtcagttttagagtatgtgccatgcgaaggtgagaatgtatgttctgttgcttttgggtggagaattctgtagattcctgtcaagtccctttgatcctatgctgagttcaggtcctgaatatctttattaattttttttttttttgagacagtcttgctccattgcccaggctggagtgcagtgatacagtctcggctcactgcaacctccgcctcacgggttcaagcaattctcctgcctcagcttcctcagtagctgggactacaggcatgcacgagcatgctggctattttgttctgttttgttttgtttttgtatttttggtagaaacagggttttgccatgttggccaggctgatctcaaactcctaacctcaagtgatctgcccacctcagccttccaaagtgctgggattacaggcatgagccactgctcctggccttaatctttgatctaatactgttagtggggtattgaagtctcccactgttattgtgtgggagtctaagtctctctgaaggtctctaagaacttgcttcctgaatccgggtgctcctgtgtcaggtgcatatatatttaggatagttagctcttcttgttgcattgaaccccttactatttagtaatgctcttctttttcttttttttttttaatctttgttggtttaaagtctattttttctgaaattaggatgtaatcctgcttttttctgtttgcttcgtagatttttctttatttattttgagtctgtgggtgtcattgcatacgaaatgggcctcttgaagatagcacactggtgggtcttggttctttatctagcttgttgcttggtgccttttaataggggtatttagcccatttacattcaaggtttgtactgatatgtgtggatctgaacctgtcatcatgatgttagctggttattatgcagacttgtttgtgtggttgctttatagtgtcactagtgtgtttacttaaatgcgtttttgaagtggctggtaatggtctttcctttccatatttagtgcttccttaaggagctcttgtaaggcaggtttgatagtaatgaatttcctcagcatttgctggtgtgaaaaggatctgatttttccctcacttatgaaggttattttgtccagatatgaaattctggcttggaatttctttaagaatgttgattattggtgcccaatctcttctggcttgtagggtttctgctgagaggtccgctgttagtctgatggacttgcctttgtaggtgaccttaccttaccctctagctgcctttaacatttttttctttcatcttaactttcaagaaccttatgattatgtcttgaggatgttcttctcatgaaggatctcattggggttctctgcatttcttgaatttgcatattagtctctctagctagggttgggaagctctcatggatgatatcctgaaatacgttttcagttgcttacgctctccccatctctttcagggataccagtcattcatagatttggtctctttatataataccacatttcttggaggttttgtttattcctttatactctcttttctctattattgtctgacttccttatttcaaaacgtcagtcttcaagctctgagacactatcctcaccttggtctattctgctgttaatacttgtgactgcattatgaaattcttatagtgtgtttttcagctctgtcaggttgattacatgttttttctttgctggctattttgtctgtcagctcctatattgttgtactgtgattcttcgcttccttgattttgtttcagcatactcctgcatctcaacgatctgcattcctatccatattctgccttctgtttctgtcatttctgccatctcaacccggttcagaacccttgctggagtggtggtgcagtcattttgaggaaagaaggcactctggctttttgagttgtcaagagttcttggattggttctttcttatctttctggggtaatgtttgttcaatctttgaacttgctgacctttggatagttttttttttcttcttcttcttttacactatttgatgaccttcagtgtttgattgtggtataaggtggattcagccaactgactgtttctggaagactttagggggccaacactcagctctgatcttctagactgtgtgctctaactttgggggacttatattgggcaatgactttgttctctggctcctctgaggttaggagtccactgtgctggtggggccgaagtgctccacgatcactggtcactacactctaatgggtggtgtctgccaaagtgcttcatagtgtggcggcagcaggatccgtcctcatttgcacatgccagcaacagcagcagcgcagcagagtgcacgctggacaactgtgacagggtgctagcaggtgccagggtgcctgcccccatgtaggcattcaccgcagtggcagaggcagctcagctggacgactgtgacagggtgctagcaggtaccagggtgcccgcccccatgtaggcattcactgcagtggcagaggcagctcagctggacgactgtgacagggtgctagcaggtgccagggtgcctgcccccatgtaggcattcactgcagtggcagaggcagctcagctggacgactgtgacagggtgctagcaggtgccagggtgcccgcccccatgtaggcattcactgcagtggcagaggcagctcagctggacaactgtgacggggtgctagcaggtgccagggtgcccgcccccatgtaggcattcactgcagtggcagaggcagctcagctggacaactgtgacagggtgctagcaggtgcccgggtgcccgcccccatgtaggcattcactgcagtggcagaggcagctcagctggacaactgtgacagggtgctagcaggtgccagggggtgccagggtgcctgcccccatgtaggcattcactgcagtggcagaggcagctcagcctggggggccagagagcccttgctggtgactgtgcatgtgatatcactggtggttgtgttaatacggatgtgggttactggtggggacaggtctctgtgtgccccaggcaggggtggttgctcagggttggggagggtctgctgtcctctgtgcctggtttcactcctgtggcagtgttggcacaagggcagggctggctggttctgtgctcaccaaggctccaactgcagtgacggtccagcagaaggggaacaggtggtagggtgcacacacacatgcacactggcagggcaaggaaagcaaaatctgtccacgtacacatgtgctggcaaagagatgtggaggcttgctgtaggcctgggggaagctgtaatgtgtggagaaagcaggcaggcctggtgcgtggccagcgtgtgaccgtgggggccagcctgcttgagttctctgccagtcaggcatagttccccagcacaggagctataatgacagcctccggggtacccaaggctatcctgcaagcaggcacagctaggctgtggtccctagagagtccagcagaccaagaggtgctcaggttggaccagccccatctgatgggcaagacctccagagttcaggtcttgcagaggttaggtccagttgttcccctggggctaaagtctcctatgggagcaagtcaagcctagggagatgggcttccctagccatgctccactacagactctaccacaccaaaccctctgggttccacctcagctgacgcgctgcccttgcttctctaagcagctctccctgccaaatcggtgtctgtggtagatgaggggtcatcttctgctggaattccagaggcccgtagcaagaacagattactcttcgtgagtacaactcgctcattccctcagggtcgttgggggctaggaacgagtccctgtgtgcagtagcccggtgcagcgttcccagcatcctcccctttcagcctgcttctgtgtgttccctccatccactctcactgccttccctctgaaggtctgttgtgccagtcagctcggtttctcgctggcagctgttccacctggctgcttttagtaggctttagtgcccttcccctcttttttaatatagagacagagtctctccatattgccgaggctcgtttccaattcctgggctcaagcagtcctcctcccttggcctcccaaagtgctgagattacaggcatgagccactgtgtccagcctagtactctcttttaaggatgtgttttccagttcttgttattttcattctaaggggtacattgccagtatattctaccttcttccaaaggaataaatacagattggtttaaaacatagaatattaacatttctatttttccttgaatgtccacttattcttttctttttcttttttttttttttttttttttttttttttttttttttttttgaggcagagtcttactctgtcgcccaggctggagtgcagtggcgcaatctcggctcactgcagcctccgactcctgggttcaagcagttctcctgcctcagcctcctgagtagctgggactacaggcgcacgccaccaagcccggctaatctgttttgtattttcaatagagacagggtttcgccatgttcaccaagatggtctcgatctcctgaggattataaatcatgctactataaagacatgcacacatatgtttatttcggcactattcacgatagcaaagacttggaaccaacccaaatgtccatcaacgatagactggattaagaaaatgtggcacatatacatcatggaatactatgcagccataaaaaaggatgagttcatgtcctttgcaggcacatggatgaagctggaaccatcattctcagcaaattatcacaaggacagaaaaccgaacactgcatgttctcactcataggtgggaattgaacaatgagaacacatggacacagggaggggaatatcacacactggggcctgtcatggggtggggggttgggggagggatagcattaggagaaataactaatgtaaatgaagagttgatgggtgcagcaaaccaacatggcacatgtatacctgtgtatgaaacctgcctgttgtgtacacataccctagaacttaaagtataatttttaaaaaaagaaacttgaagctttgggatcagcctggaatatttttcataaattctgttgacagtttcttgctgaatcactttgaatggatattcaaaacttcgtttgaacttaagaaaaataagaatttctttttgtatttcactgaatggtaaacagtttctactctcttctgggaattcatagatgaaaggggatggtttttacctgtccaaatctatggagaaatacacaaaacaggagattatattaataatatactataataatataaaggaagtatgaacagctttcagtgggagcttgtagagagagtttttcctgaaaaagtcaagtaaagataaaattcagtaagcaaaaagttaatgcgggccgggtgcggtggctcacgcctgtaatcccagcactttgggaggccgaggctggtggatcacctgaggtcaggagtttgagaccagcctggccaatatggtgaaaccccgtctctactaaaaaaatacaaaaattagctgggcatggtggcacacgcctgtaatcccagctacttgggaaactgaggcaggagaatcgcttgaacctgggaggcagaggttgcagtgagccaagattgcgccatcgcactccagcctgggcgacaaagagcgaaactctgtctcaaaaaaaaaaaaaacaaaaaaaagataaagcaaaaaatgcagggatagagaaaccatggcaaaaggtgctaagtgctgaatttaagtgtagaacctagactcaatctgagaggacatcatcccatgtctgcctggtattgtacagaccctcctagtcttttagctagctcttaaaggataaatcagagaagagagcgttgcgcgtattcttagttgataaaatagcagatgaaaagtcacagaggtatgaaatattaatattaatgtgtatttgaggaactataagaaatttagtattgctagagcaaagaatgtttgaggagaattttgaggaaaaggctagaagggctttctatgccatgccactaatttaaattgctattctatagcaaggaagtgatgtgatccaatccatatttcaggaagatcgtgctgaccctgtaatccattacatgaatgcagacagtaacactctcaaaatttattaaacacacttaatgaaataaataccagtatctatgttatctgccttttttgcctgtcactcatgcggtcctcacaactccttccagcccctaaactaatcagtccgggcattagagagctttgaaatgtttattaagaaaacagtcctgttttgacagacaggagttagagcacctggacttaaagcaggctttacagctctactggggatctctcatgtaggcaacatgaggccagcagagccctgtgcaaacaggcatcataagcaaatgaccatttcttttccattatagacttcatccttcaaaagggagtgccattcgtcccaactagtattttccccccttttatctgtgtcactaatgctaaattagttcatgggtcattcaaattctagcagctttggtgttagtctttatatttcagttccagtgctccgctgattattttggcatgaaactatcccatacagtcatcatgctgcttttaattcaaaagattcctatgagctgcaccaggaatatcgtatctagtacaaaaactgtatgtctgttcttccctgaagcagattctcttgtaacttgagtttagttatcttagtattgatattgagttatttttagagagttctgtggtggttagtggctcggtgttttcatcagtcgttcacttaactatcctttcggaacatctgtgccacttacgctgtctcacttctcacccaagtcttagatgctttttcattcttcatattactaggaaagattaaacacatcatataatgccagtgactgcaggactttcctttaaagcttctaaactacctgccagtatgctgaaataaggtatattctgaagcttatcgtttaaattgtagatttcatatgtaaaaacattttttttttttaagacagtcttgctctgtcacccaggctggagtgcagtggcgcgatctccgctcactgtaagctccgcctttcaggttcacaccattctcctgcctcagtgtcccgtgtagctgggactacaggcacccaccactgcacccggctaattttttgtatttttagtagagacggggtttcaccgtgttagccaggatggtctcgatctcctgacctcgtgatccccccacttcggcctcccaaagtgctgggattacaggcgtgagccaccgcgcccagcctgtaaaaacattttcatctttgtttataaataaaacatctgattatacaacaatacttttatgggactcaaagaggggagtcagggttggggtggggtctgtcatttatttacttatttttaaaagatacctggcctggttctgtggcggtggcttttcttcgctaatcatgagctgtactttgagtatgcagtagattccgtcagcatctcagtgggagaaaggggggaaagaggggttttaacacagtgttctctttgcattgagtgaagaagctgttgatctctgaaggaggaaaggagagactggaaccacatgaaggcttgtgctgtgaaaccctgaaaccctgacggtgccttttgatcactgtgttttaacaaagctgacaatcctcagccacacaaatcttgggaactaaaataagtattcatttaactcttgactaaaggttaaaagatacagttaaaaagaaatctaaaacccagagtggtaattccactttttctttctctttctgttgttggaacctgagctctctaggaaaactaacatttgttaagggcctgccatgtgccagattcctgtctgtaagagaggtataattattattttacactatctcaatcttaataacaactccgttaagtttacacatttatatttccatttgacagttaaaatcaaggaagttcaggaagctgcttgtctagggtcatacaactagtaagcggcactgtccagctccagaacacatgctttttcttgtgtattttagtgctccttcagtcacttatatgatttacttatttgttattcttttataaatttaagcagtagtacaaagtagaaagaataaagaaaaaaacagcccccaagtcaattgcctagaaaataatcattatttgtagtaggtaagcaggattcctgtcatattcctatgcacatatagaaaaaaattaacatataacatgccattttaaataaaaattgaatttaattttacttgacattagcagaataaagagaatttcagtagaatatttcttctttttttttttgagacggagtctcactctgtcgcccaggctggagtgcagtggcgtgatctgggctcactgcaagctccacctcctgggttcacgccattctcctgcctcagcctcccgagtagctgggactacaggtgcccaccaccacacccggctaatttttgttctattttttagtagaaatgggatttcaccgtgttagccaggatggtctcaatctcctgatctcgtgatctgcccgcctcggcctcccaaagtgctgggattacaggcgtgagccaccacgcctggccagaatatttctttactataaaggagaattcctaagccatccttccaagtttaagaaaagagatagagattggggttatgttttacaacagcatcttttatttttattttaatcagtattaattcatgccatgctctaaaagatgaagaaattatcacttcttctcaccagtttttaatgatatagttttatatcagctttaccaaggtttataatatttacatcttattttataactcccaggctacttagtctgggagttaaattcagcacttaacaccttttgccacattttccctatccctgaattttttgctgtatcgttttgcttatttaattttatcttcacttgactatttcaggaaagactgatgctgaattctggttttcttgttttatgtttgcatgcttgatagtgtttatttgccattctacttgaagtattacttagctagttacgaaattcttaggtgtgttcttctaatgcagagtggatgaatgttcccggatgctctcttcctgccatcactgcatctgatgttgcccctctgagttagaacagaagggccaggaattgacttcagcctgcttttctataacctgggaaatgtgaggagctaggactattctcagctggatctccactgtctttgtggaaggcctggactcaagtttttgttgtttgtttgtttgtttgtttttcctgaaattttgataaatatcctgtattcatcctggtaagcatgagaaggttcagatcgtctgtgaaattctttagagattgctagaaaacagcatatcctagtaatttttcttgcctttatgaggttgccatagttaaatgttttgtcctgactcatctcttaaaccaccagtccacccttttccatctgtttttctccacatttggggatattactgggaattctcacagttttatcacctcacttctgaattgcttctgggcttagaatagggtaaagagcaacactatttttcaccaaaatttttgttgattttattacctgcagcccaacacaaaaatactgacaaacctttcatttctaggagaacaactgattgaccctaatagaaaaaatagactctatcagtcaggtattccagtgtataggaaacagcgtgttgtgacatttgtttatttaagagatgatggttttcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggtgtgaacccgggaagcggagcttgcagtgagccgagattgcgccactgcagtccgcagtccggcctgggcgacagagcgagactccgtctcaaaaaaaaaaaaagagagagatgatggttttcaggttttttgggttttgtttgttttgatcctttgaggatggtatgttgtagtccagagaaggtatttagaattgtgacaaggtaataaaattgagacaaacacgattatttatctttgtcgagagtcactcctggcaattttcacatggaccttcgttgaaatgcatcattgaaatactagcgtacattttaggtattttactgtttcacggtatgcttattagtcagtgtaaaatgcatcctaatcaaaattaactactttgaaaagggaagttgatcgcttcttggccatttggctaagatcaactgaaaagggaagtagagataatatggtacagcaatttatttttaaaacaattagtttttttaaactgacaaataaaaattgtgtatgtccatcatgtacaacatgatgttttgaaatatgtatattttgtggaattgttaaatcaagctaattaacatatcattatctcacatgcttgtcatttttcatggtgataacacttaaaatctatactcagcaattttcaagatgtagtaatttctatatagagaaaatctgtagaactcaggattgtctattttgaaggttcttaagatgtatttccaagaaaatacagtataaattttgtgattgataccacttttcatgctagccacataaattgtcctttttgctcccaggttaagaattcaaggcttacaaaaatgaacacaaggctgggcacagttgctcaagcctgtaatcccagcacttgggagaccgagacgggcagatcacctgaggtcaggagtttaagaccagcctggccaacatggtgcaaccccgtctctactaaaaatacaaaaattagccaggggtggtggcgcatgcctatagtcccagctactcaggaggctgaagcatgagaattgcttgaagccgggaggcagaggttgcagtgagcagagatggcgccactgcactccaatctggtcaacagagttagactcggtctcaagaaaaaaaaaattataattgaaaatgaacacaggtttcttgtatgtctctccacttagttgattctctagagtgtggtacattttacaatgtgttgtctgcagtgtttatttacattgtctggcatgctacaaaggttggtagcatttgctaataaggaaccactatgtgaccagtgtaaatgatctaccagtgcctcttcctggtttcgatttctttcctagcaaaatacgggtataagaagtgaaccagacgtctttaagaaagagtatgtctgctactcttgtttccaaaagtgtttatatttattcattaaagaacttttgttactgaattctttttaggaaacttagtgaaccatacactgcctgtatggccaatgatgaagaatcagcttaaggggaaaaaatgtataatgtccagccaggcgcagtggctcacgcctgtcatctcagcactttgggaggccgaggcgggcagatcacttgaggtcaggagttcgagaccatcctggccaaaaccaacatggtgaaaccccgtctctaccaaaaatacaaaaattagctgggcgtggtggcaggcgcccatagtcccaattactcgggaggctgaggcaggagatttgcttgaacctcggaggcagagcttgcagcgagccgagattgtgccactgcactccagcccaggcaacagagtgaagactccatctaaaaaaaaaaaaaagtataatgtctcacaatataatgcaacaagatttcctactcaggacttacaaagacctgtgtctcttaaaatacacgggtcaccggaatgtaggttttttggtaagtgctgagcattcctatattcatttccttcctctgttttatgattcactggaaagcttcaagccttgaaatatttctgatttgatttttgcaatatactttttcttcccattgccatgctcgtatttctgcacacctcatgtgcttatacagtccaatcattttgatgacttggggaggtgtgaagaggctgagctagacttcatattttctcctgtcccgtgttcttattgtaaaggaatgtagtaatgcactgtgtcttttttgtgtctgttgttggctacatgtcctcaaaacatattcaacaagtagacgtctattgaaaagaaattttcctaagttgtccccaagaaaacgacgacactggagtcagttccgtgtttataacagagtcccaacacttgtttttctccagggtttctacaagaagaagcataaaacagtgttagtatgtgactgacctttggcttcaaggcttcagtaaatccgtaaagtgagattgattaggattaatagctttttgtcctagctaaaaagtgttcgagatcttggcttaaaaagagttctttttggccgggcacagtggctcacgcctgtaatcccagcactttgggaggccgaggcgggcagatcatgagatcaggagtccaagaccaccagcctgtccaatatggtgaaaccctctctactaaaaaatacaaaaattagccaggcatagtgccatacgtctgtagtcccagctactcgggaggctgaggcaggtgaatcgcttgaacccgggaggcagaggttgcagtgagccgagatcatgccactgcactccaacctggacgacagagtgagaccgtctaaaaaaaaaaaaaaaaaaaagttatttttgataccttggaatgtgttggccgttttaggtgcttccagcattttattcaaagagttgagaacataaaaggatagcttgattatacttagaccttaaaaaacttttaggagttcatcaaacacataacctttacaactggttagacttccagctttcctaaacaagagtatggcactcttgccagtgttggtttaaagtacatgtaatttacataaaatagcactgactgcagcctaggtctctaagcagagaatgctctgacaactttgtctccaggtccactctactgttccttattgaggagggaaaccaggttcacagtgttgtgctttcttcttttggcaccaaaaggggctcctcctggtttatgagttttaaaggatgagggaaaaattcatcatgggggatgttattttcctcagtgggtaagtgaagtcagggaaaaacagaaaacaatggagataagaggatgggatgcgttcagtttattctgttgttctcaccacagtaattgactcagaagggactcattctgaatttagtatctagtgttaaaagaacaggcctggggcaggcggaggccagcactgagacacagtggtgggttgagacctattgtattttttaagttgttccaaggctgtccaggtgtcctgatttaaagcctgcttcttaagtcaggaaattgtatcttgttctgaggtttactgtaataaagtacacagtcctaggggatggtacttctggctccatgaatcactttacaggctggctgtactgacccaagcctcatgatttatttatgccataccacagtaggaatggcaaatatgtaagccacacatggtctatgggatgggcctttaactgggaaactgccataaatccgtgaagtcaggtaggacagagccagcaggagctcatgtcgtgtacaagatttcttcctgttttatagggacttacagttctagagctaattaagttcatcctccttagagtgtatctgtcttagtctgttgtgtgttgttataaaagaatatctgcgcctggataatttataatgtaacaaggtttatttagctcatggttctgtgggctaagaagttcaagggcatggccctggcttctggcaagggctttcatgctgcgtcacaaaacagcagagaaggtcaaaggggaaggggacacatgcaaacaggagaacctgagggtccatcctggctttatcacaacccactctcctgggaactaatctgttccctgcaatacctaatgcagtcttgtcagagtgggaactcactcactaccacaagatcagcaccaagccattcctgaaggattcatgcccctgtgacctgaacacctcccatcaggccccacctcccaacaccatcatactgggaatcaaatttcaacatgagttttcgtggggacagacaaaccatatccacaccatagtgatatccttggactttttgtgtgctgtgtttatccagtctttgatttactgcttacaaatctaaagaatagctctgaaatatagtctagtcctattgtcactgatattttctcttcgatttatttctataaagtgttgcccatgtttttcaaataatttctatgttttgagtaaatactaaggagtgcgatggccagatcttaagagtatgtttagttgtgtacagaactgccaaactgtcttccaaagtgctgtaccattttgcgttcccaccagcggtgaatgagaattcctgttgctcagcattcttgccatcatctggtagtgtgtgttctggattttgtccattgtggtaagtgtgtagtggtatctcattgttctcatatgcatttcctgattacgtatgatgtggagcatctttttgtatgcttatgtgccatctgtatatattccttggtgaggtgtctgttaaggtctctggtgcattttcttccttttatcttgttttatttttgttttttataatattttcaatttttaattgatacaacataattgtacatatttatggggtacatagtgatgttttaatacatgcagtgtatcataaggcccattttttaatcagatcatttattttcttagtgttgaattttaagtatcttttgtattattttggataacagtcctttatcaaatgtatcttttgcaagtattttctcccattctgtgtcttattttctcattctcttaatatttgaatatttaaacacatattatttataaattaatggtacattatttataataatggttaaacggttggtaagtaaatcactgctgagtatatactgctttgaagggcccaaggatccattaggcctccagctttaacccagcacagcattctgaaatacccaattctccccagagtttcaagagtcaccaggccttaaccttcttattgcctcaaggactcttagagctcaccaggctcctcctaccacaagccttcatcatatcaccctgttcctgttgcttagggagctttctcaggatagcatttcaagattgagtacccatcctagttttctcagtgttccttgtgagccgtgtcacatagaaggcatttaataaatgtgtgctgaactgagctgaaccagcaagggcaaaagggatttaagagactgccgttttaattgaaaaggagtaaaaagacactgggaaaggcagcatgtattgggggaatatgagaaatttccaaatcactggaccatcaggctggaaaatttaggttggagccaaactgcaaatggtttgaatgtcatcatgtatagtttatgtatttatatatacttacctttctcatagaagggtgaatttttatattataatagctagaatgttcttagaatttatcttcttaattcagaaaacatcacattgagatctgtcagtaaaccccccacacacacaaataatttcttgtcctcattgaccttcggtctgagctcttaatgcagttttctctactacacttgtccatgcacatagtggtcgcagacatttgagagaatgaaaatcatgtgtttaatgagagattgttatcggagactgtagcacttgttttactttattctttctattgctttttctctttttgtttctttcaaagtacatacaaatacatattcattatatcctatgtaagggaatgtgtatttactctagaataggactactttaagtttgagatggctttttgcttttaaaaatatagatgagtgtgatttaggcatgtatattcagtcagatcttttagctctcaccttgataaaattattgggtacgagaagcaatcaagtcttcttttcttttcttttttttttttttttttctgagatggagtctcgctttatcactcaggctggagtgcagtggtgtgatctctgctcactgcaagctccgcctcccgggttcacaccattctcctgcctcagcctcccgagtagctgggactacaggcgcccgccaccacacccagctaattttttgtatttgtagtagagatggggtttcaccgtgttagccaggatggtctcgatctcctgacctcgtgatccgcctgcctcggcctcccaaagtactgggattacaggcgtgagccaccgcgcccggcctacaaataatgctttaacgctaaagagacaggagaacattttcaaatattttaaggacagttatttgaaagaatgaatttcttttatggagcttaaaggaatagaactagggttacaaagagacagctctttcagtcttaataattatgcaggataataaaaaatataaataaaacttaaaaacagagagcttttgggatcagttctataagtaatttcctaagaggttgtcaaagctggtataggcaccagctcattcaatgtgtttaaacataggctggggggccacttggcagccatgtggtgtggaacacaagcaagccgtgattttcatgaatggatctgttctgtgaggtctcttgttatgctaagagtttgtgattctggttttgttttgtgtgatcttgaaagactgatttatgatctctttccacttgtttactgctgtttactgctcagcccattgcaatatagcttctgcctccagccctgaaactaccctccaaagtagtaactttcgaaaaactaaatccgatggaaattttgtattctttatcttgacctgcctgtgaatctttaacatgttttatctcttcttatttctggaaactttctttatctttggcttccaggggaccaccttctttttgttttctttttcctctaagaccattccccctcagttcttcatagacttcttccaccagtgctgtgtgccccgcctcttatcttggtggtctcgtgtcttatcttggtggtctcatgtactcctgtgattttaattactttcagtgctgatcattcccacgtagtctttaatcgggtcctgattgcaggactgtcagtacaactgcctaccaggtatctccccagattcataaggttgatgtaaagattaaattacttagttaaggccaggtgtggtggctcatgcctgcaatcccagcactttgggaggccgaggtgggccaatcacttgaggtcaggagttcgagaccagcctagccgacacggtgaaacccctgtctactaaaattagaaaaaccagctgggcatggtggcaggcacctgtaacaccagctactcaggaggctgaggcaggagaatcatttgaacctgggaggcaggggtttcagtgagccgagattgccccgttgcattccagcctgggcgacaagagtgaaactccatcttaaaaaaaaaaaacttagttgaaggtgcctagtagaatatctggctctatagtaatcatgctggcaatgctaattatagtgagtgtttacccagttcattcatactcttgaagaatcatttatttatccttttcttgggtcagggcgcaacagagccttgctctgtcatccaggctggagtgccgaagcgcagtgtcggctcactgcaacctccgcgttctaggttcagttgattttcctgcctcagcctcccaagtagctgagactacaggagtgcgcccggctagtttttgtgtttttgtagagacggggtgtcaccaagttggccatgctggtctggaactactgacctcaggtgatccgcccacctcagcctcccaaaatcctgggattacagcagtccgcccactgatttatctttaaatcaccacttcccaaactgttttctcttgtactagtatccctcaaggtggtaagtgatgttccacccagaaaagagagaaggtggggttccatgatcagttaagtttggaaaatactttataggtagggttggaactttttcaggggccagattgtaaacttactgggctctgtgggccatttggtctctgtcacactactcaaatctcttgtagcaccagcgtagccatagaaaatatataagcaaatgagcaaggttttgttcactaaaattttatttgtggacactaaactttgaatttcatataattttcacaaaatgtaattattatatgttatatgctatattatttggggttacaaaagtattattattttcttttttttcaaccatttaaaaatggaaaagccattctttgctcatgggccatgggctggctttgaccatgagtggcagtagcttgctgattcctgctttaaaatatagccccctattaaagatatgcaacctacaccataaaaagcttttctaagttctgcagcagtgctgttatgaccagtgttcctcaaacatatttgaccgtggaaatcttttgtcatgcttatttgttactgtctcttgctgtacttctgtggaatgtgcttttgagaaatactgacctagagaatagctatgtatgccagaggtaaagtttggcctgtggagcagactgtaaataacaagagaaagcgtcttgtctttattcctcttgctctgatcgtcagctccaactggtcacagacagaatggtattttgggaaactgaattcactctacgaggtgggcaccagtgaaccactaaagctgagtcaaagattagctgaattgagggtggacatgatgaagttaattccgtcaaccagcttcagaaatgggaaaaatggctttaacgtaaggtaaaatagaggtgctctaagtgagataaaatactcggtcctggctgggtgcggtggcttacacctgtagtcctagcactttgggaggccaaggtgggtggattgcttgagctcaggaattcaagaccagcctgggcaacgtgatgaaaccctgtctctacacacacaaaaaattagccaggcctggtggcacatgcctgtggtcccagctacttgcagggctgagatgggaggatcgcttgagcctaggaggtcaaggctgcagtgagctgagatcacaccactgcactcctgcctaggtgacaaagtgagactgtcaaaaaaaaaaaaaagtgtgtgtgtgtgtgtgtgtgtgtgtgtgtgtgtttatatatttatattccgttgaggaagaagagatccagaggtcatatgcaaaatataaacagtaataggtatcaatttctatagttttgaaatctttactgctgttgttttaaaatatgcaaaagtttaaaacttaaaaaattgagtttatatataataaaattctaaaacttgctttgaaataatattttcagttgctgtttttgtgtgtgtgtgtctttgagaagtaggatgtgtgactcagtagggagtaaaggttattgctttactattttgagcatatttttccctaataaaaataatgccatagctaaggagagaaccttcaaattaaaaacaaaaacactttcattttaaaagtctacgcttcccatctttttatgtctactttaaccgtatgccccttattaaaaggaaaaattggtgtagtaagcattgtttttaaattctgtctggcatttggcaagcagctagaacctataggaggatgcagaaaagatgggaccatcccagctgatgagaatttatctacctgatgcaggcatagtcattgcccattcccacagaatttacataccaggtgtctcattccaaacctgtgtaggagaaaagggactcttatagtttttgccaacagattgatagctgatgaataataaaattgttgaatcattaatgcaagaaggtaataaattaccgggtttgttttcatccatttggccaacaaatgtttttggtgacctccaagatctcagtagccccaatgtcttcagtactctctcagcatcccagcatgcactcatatatatccctgacagctttcataagcttcctatacagctataggagtatatctcggatacttacgcattggagcagctcctactttttttgtaagtgtaccacaaatcccaaaattagatgttctatgtaacgctggctattttatgagatcaagacacagttggatcttgattttgctggaggtggagacctgagtgccctgacactgctggcattcttctagcaaacgtcatgacaaacagacgtggaatgcagcacaggctaaagaaaggcgagcaagccccctcggtagcacagtgtggacagctggtatggacatgctatccatctaaaactgggaaaggttaaataaacagtgggacagtgacaaagtgcagagattaattgccgaaagcattcaataattcttaaaacagacatctaaataagcagaagcattctggagtttgagttctgagagacaatgtaagaagactttatttacttttggagacagagacttcctaaggaaagaagacaagataaatggtgtagtccaaaagtagacatatataacaacaggtgtaccttagtttgaagggactacatcttcatatgggaagattgtattctgaaattttctgttcatattacatacactataaaacatgaagcgtaaaggacatactgttgtaaaataataaagacaaaatgagagaaaaggccaatataaatctttttatcagaccatctccagatgttactgtgaacctactacttagcttcatctcttgaggctcaagctcagcttcccctcctccaacttcatccccagatctccagcgcagatcagtgggtttaagacataattcagtagagattttgataggatttgagtaaatccctaacagaaactcccttggcttgccagctatttttaaaggcagatatgtagaaagcagaagatcctaaattcacctatctgtcttgtgatagcccttgccaggaaaataggagatttgcccaagaatatattataggatgttcttgtggtacatgcctgtagtcccagcttcttgggaggatggcttgagcccagcagtttgaggctacagtgagctgcgatcatgcctgtgaaaaaacattgcaccccaacccggacaacatagcaaggccttgtctgttcaaaaaaaaaaaaaacactaaacttttttttttttcaaataatacattagatagaaccaacccatagaagtcatctctgcataatatttctaagtccaataatgatcaacattatgagtgcctgcaatatcatgagaatttaagagtcaaaagttactttgatcattttcactatggaattgaaagattctttttatatacttattggattaggaaagtacatacaaatgctaaaaatccagtcttggcaaggatgtagggaatcagaggtatgtaataccttaatgttggtcttttaaatcagctcgtcttcctctaaaacagtggatctcaagtatagatgtccattccagaaactcagtaggtctggagtagagcacagacttccattttgaataatttctttcatgtttgagagccaccattgtaaagcaaatctgataccatgtaataagctatacaactctccacagccgctgacctatttgtgagcccttcttgggttctgcaggggaaagctgcttcccgctcatagactgaattatgtcttaaatccactgatctgtgctggagatgtggggatgaagttggaggaggggaagctgagcttgagcctcaagagatgaagctaagtagtaggttcgcactctggattgattttcatatgctaaatcatttagaatttccatatccattttcacttcaaccgttatagtttggcatgacataaatcttcttacatcgacaaagataagagtttgcttcattttttcattctggtgtttgggagtaattttctggaggaaaatgtcactgataggtctttgctctgctgccttgaagtcaggaatccaaaattgtcattagtactatattggagccctcaaaactttgaccaaggtggggaaagaaaaagcataacagcttcagggaaaagtaggctcagtcgaggctttctccctgaggatcagtaattgtagcatggtgaggggttggataatcaatcattttaggtcaaattaaacatattttctttacgagttctgtcaaaataggtagacatgaggtagaatccaggagtcacttctacactcaacagaaatagagacaactcactagaactaagactgtaaggaacagtctaagatggtcttagttcattttattgctgtaataataaagtaccacagactgagtaatttataatgaacagaaattttggcttatggttctggaagctggtaagtccaaaagcaaggaaccgacacctggcaagggtctttttgctgtgtcatcccacggtggaagggcaaagagggtaagagaaaggcggaaggcaggtaaaaggaggccacaccccgcttcctcgttaacagacctacccttacaataatggcattaatccattcatgaagacacagcggtcatggcctagcataccctaagcgttctacctattaatactgttacaaaggcagttaaatttcaacatgagtttgggagggaatagtcaaaccttggcccactcactgaattgatgttgttttcctttctgttataatgtttcaccgtaaactgtagttccctacatattatattgaaaggactattggtctgtatatatttgtgtatcacaaaagagttacgtcatctttagagtcttctaacatggagaatatatagatacattttatatacaatttgatagttaactaattctatagatgcaggcttttttttttaaagaaagatactatgtgccattattttgcaaattaatgtaaatcttaaaaatttttagtggattttattctaaacagtaaataccaaatgagcagacattgtcgtaactaggtactcccttctcctctggcatcttttttgtttgtttgtttaagaagacattctgaggcttattgtaatttcttaatttctcttctgatttttaaatttcagttatgttgtctgttttactattgacagacattgttaagtataattcaaaagtaaagaagcttagaatataaacagggatctggatgtcattcagcagaagtgctctctagtcatgaagaaaatgaagcttggctatgaagtagaagaatctttctatcaaaaaataagaacgttggaacttaggatccaatagagtcgcacaatagtcatataggtgattttacacttacttcattggggctgtcatggctcaaatatatttgtgatccttttcttggaaattgctttcagagccagtttgcaggatgcccctaaaaataaatatgcacttacacttcactgtaatccaaaacctatcactctgattcattgtgcacaagacttggtgtcaaaattaaaattcagttaataaaaagggtatttgtcataattccaaatatttaaataatgcaataaaactgtgaagcttaaagagaaatttggcagcatcactggaataaatttttgtgtaacttcccaaaattaattccctgaagaatatatctttcatttcaaatataagtacaagtatattttataaaggaagcagctagataacttttgctaaagtaacgtttaaggaaatacagggctgggtacagtggcttacacctgtaattccagcactttgggaggccaaagtgagaggatcacttgagcccaggagagcagcctgggccacatggtgaaaccccctctctaataaaaataaataaatagaatagaataagctaggtatggtgatgccagctacttggtatgtagtcccagctacttgggatgctgatgtgggagaatcaccagagtctgggaaatctaggctgcagttgttggctatgatctcaccactgcactccagcctgggtgatgggagtgaggctctgtctcaaaaaaaaaaaaaaaaaaaggtgggcatggaagatgaatggaagatactcaaagatagacccacgaaactgaggatatgctatttcagtctctggactaaaaaaaattgcctgttttcatggacacaggaaggggaacatcacacaccggggactgttgtggggtggggggagggaggagggatagcattaggagatatacctaatgctaaatgatgagttaatgggtgcagcacaccaacagggcacatgtatacatatgtaacaaacatgcacattgtgcacatgtaccctaaaacttaaagtataataattaaacataaaaaaataaaaattaaattaaaaattgcctgtttttattaaactagtaaacaatttgtagaaatgcatgatttgattaaatgagttttgggtgccaccttcataagggaagctagaactgtgcttaaataccaggagccctgctaccttcttaatcttgagcactaaaactaagacctatatctaaaaacttagcctaaattcgcattccaccgtcatgaatatggaatgaaaatctctcatgaagttggttttcatgaaagtgcctccaggaaagcaaaactctggaacattgggccacatttataagaccgtgattattcattaaaaaactgaggatgtaatatttggaaggcctttacttactatcaactcatcaacagtatgggatgaaactagcagcttgactttctgtatgaagtatgggggaaagagtggaaagaatgtcagagttcactgggaccttctttagagccatggggctgaattttatttaaaatattcattggaaaagcacctggattccaatgcttcttaaagtcattctgtttttccatgcagttcgttatttgcttttagaccttttatctccaagttgttttatttagttgctagtatttcttcaggtgtcattatcttgcatccctctagaagataagacacactattgtgtgcatgtgaaattagaattcctataaatatctcattcttgaacaaattttcagtatcaccataaatgatatttaacactaagtggccaaaaacaagtcattcacagagattctgcatcatattcagtctgacagcactgaagctgtggttgtgtatttttaactacacttaatgaaaaaggacatcaggactccagcaaagttgccagcattcaccaggtcttatgagttcttctgccctagaccttttctcatctgctctgtccatccgatcttggcactcgccagctctgccttcttagtccagcagtggctcgataagaaccgttgatcttcagagctctgtctctctctctctgtctctctctctctctctctctgtctctctctctctcgaagagctggaaaagaggactcgaggaaaaaatattcatagggtaatttgtatcttccacattatttaaatttggaagcataaaaatacattgtgcttgaatcatgctgggtgaaataagccagatacaaaaggccaaatgctgtgtgatcctacttatatgaggtacctggagtagtcagattcaaacacagaaagtagaatcgtggctgccaagggctggaaggggcagaggagggtgttagcctttcataggtgtagagtttcttttcaggaaaatgaaaaatctttggatatggatggcggtgacagttgcacagcagtatcagtgtgcttaatgccacagaaatacacactttaaaatggtttaaaatggtcaattttatgttatctgtatttgactataggttaaaaaacgtgcttatacttatcatgtttgctatatgagaacattcctcattcagaagattttatggttcttaaagtaacttgattaaggaataatataaatacaataaagtgcgaacattttagacatacattttggtgagtttgtcaagctacagtcatttccaggagcttctgtctgccctttctggtcactcgccatttcccactgcagtccctggcaacgactgatctgcctccgatccttgtggattagaatacagttcatttttatattttttaaacaaatttggaatgtacaaacttttgttttttgacaagtagagatacagatgtcgagttttttgcccatctgagaagcaggtagaggctttatagcagaggtctcaatagcacagtaaaactaagtcttctaaacttgccataatcttatgaacatgctcatttttcagaaaaggtgaaggaaaaaactgaacgcaagttttccacctacaattttgttcaatcaatgtcatttactgagctataatcaccagcagtttctgcctttataatgttaattttgatctttttcaagaacttgtgaaaaatggaagtcagtccatattgggataacttctctacccattcccttgtaagtgtatttctttccttttttttttttttttttttttttctagagacagggtcttgctctgccacctagactggaatgcaatgtggtgccatcacggctcactgcagcctcgacctcctgggctcaaaggatgctcccacctcagtcccccaggtagctgggactataggcatgcaccaccaggcccagctagttttttttattttttgcagagatgaggttccaccatgttgcgcaggctgggctcgaactcctgggctcaagtgatccacccgcctcagcctcccaaattgttgccattacaggtgtgagccaccaagcccaaccatgagtgtatttctcactgtaggtcagttcctttcccttgtttcaggagatagagaaacatgagatgagcagcaagtgagaaatcttggacattgtgctttgcacaggacttgccattgtgctgcaggagggctgtgctaggcaggaccccagcgtgcactgttggaactatgccctgaaatagtctgtatttggtgacctttgaaagtttctttgtagcatttaagcgtaaatgtgatagttattttgtgttgcatattcattgactagcatagcagtctttcatttagagtcctacctgcaattcttgaatccaagagtcagacagcagcgttttattcttcattctttaggaactgtttttgtaatataagatttttacttctaacacatctctagcagtagcatcctggcctttccccttgcagaatcttctaatctctcctcattaccttcaactcagtctttctaagaccttgctttacttctctaaaacttttggtatttctatattacgtacaaaatcaaatcacttctcattcagcatttttgtgtaccctctgcctgctgggttctggttaaaaccctcaaggatttcacattctgtttattccttaggccaccattccagaccatctctactctgatttagagctgcctcttcagcttctctgccatttcctgtccctgtagacactctctaatccagttctacgatgtgtcctcacatgtgactggtgctttcacacttgccactctgtctttcttatttctctgtcaaaatagggcccatgtcagttcccacgtccttagcctgaggtgatttctctctgctgtactacctcagcatttactgcccatacagtatatttggcacttagcatttattgtttcatctcattagttatattaaaatcttagagttgaaaaggacagtctcaccactgaaaacaaaattacttacacaatatctctgataatctgtttaaacacctagtcatgggaagatctataattttttagctttccaactctacttactaacaaatattaatacactagatgttccttttataaaccaaaatctctctcttttgcgacttcccctgctttagtaacaattgtgccctctggacaaacacagattcaatgttctgtttttgcaaaacctaccttaaaaattttggtagaaatgattgtgctatgttagtaaatctttttagattaacatagccttatataatcccactatgtcatcttcctttgataccttctacttgtgcaccccctcttaaattatgacatatagaattgaacctagtgaacctaggtgttcagttagagaaaaacacagctctttctttctttaaatgaaatgtaagttgcccaaagctcatggtttctttctagttgtggtttatgtttatcttccttacgtgctctgctcacttgcctagacgctactggcctggaaaaaaaaaaatgccttaaaagtgcagtgaaatacagcttcaggataggtgaaaacactgaacagcgggggaaccaccacaacagatagaagtgaagtcagaatcagaggtgcagttggttcaagatacattcattatgagcctactctgtgctgggaactattcttagcatttggaattcattacagaataaaacagacaaagatcctgtctttgtggagtttgtattccaactattcctaagcacaggctttgggcaaacattgaagactagcaaagtatatcagcgtattgagtatagagtatatagagtaactgcagccctaaataaaataaaacaagaaagcttaagcagtttaggctaatgcaatgcagaacatgaacaatacttgaaagcttttagttttcaagtttaggaaccaagactctcgaaggaagacattttttaaaatgtaaaaatagcagcataatacctgaaagatagacacaacccaagtgtccatgttggataaatggataaacaaaatgtggtatgtgggtgtggtggaatattactcagccttgaaaaaggagattcagccacatgctacatggatgaaccttgaaaacatcatgttaagtgaaataagccagtcacaaaaagacaaatactgtttgatttcacttatgtgaggcacctacagaagtcacattcatagagatagaaagtaaatgatgactgccagaggctgggggaggggaaaagaggagttactgttattggtatagtttcacctttgtaagatgaagagagttctggaggttggtcgcagaacaatctaaatgtactttactgaactgttcatttataaatggttatggtaaattttatgtgtgttttatcacaactaaaaaaaacctaaaagataaaagttaatgagctaataaacagaccaataaaccagaaacattaatcaattttgaagaggtaaatcataaacatactataatcagagaaacagaccctacccatgtagaagaatcaaaaaacatttacagagcaaatgcctgttaatatcatccaaactatgtaagtgctgaaaggagatgctgaatggagagaaattagcagttaagtgagtagccagattttgaaggagagaaagctacaggcatttcaggcagaggacataacataaacctaagtgaaaacacatagcagctctatgacagagagtccttggaagacagtaaggaagaaatgggttaaaaaattgtaggtgatcctgaatattaggcaaaaatatttgctatggcaagagacctaatgacgatgaccttggaaaagtaggacagtatagaatgatggagaaatcagagaagaggctttaagaataatgcaggcccaagataaaagggtgggagtgacgtgcacagacaaaacagtgggtacattaaaaactaaatgttgtcagcctgtggatccaggaatatgatggctctattaacattaaaagggtaatttgttatgttactaacatgtaaaatgttagtgttgacattttacattaaagagatatttctgggtacctaaataaacatgacctgcagaggacataagatatacagggaccaaagtttgcgagggcaggtatttcagtgaggtccacccacagaggctctcccatggactatggttttcacagagtttatttaagtagtgtatctaccatagtctctgaaacctctgcaagggaagttgaagaatctagtcattagaggatttcttcaggaaaagagatagaagagtagaagagatatattggtagtttactactcactctggatagttaattggttaaataactaggaaggtagcagaatcaaaggtttatttagtccatcagtaagttaatctagatttcagatttatcttaaaattagagtaaattaaactattcctacatgtccatgacattaaaatgtccaaagctacttatcttgttctagttttaatctggtatttttccagatgttttcagtatgatagaatgtatagaacatgattacacagtcattcaatttgacatactcagttggaggaggagcgaataataaaccttggtaacagcccttcattcatactcctctttttgtcttgcatttctgttaaacacacacacatacttaggactcattcagatttttaaccaccatatcacaacgctaattacggtctcttatttactagcaatagaagtctaatgttgtggcgttctcaaggattcaggaatgttattcaaaagcattttgagctccatttgcctttgatgtttgcctccagtttctgaaatttgcccagatgggggaaggggatagagggggtggtcttactatttcctgaagcacaaatgccgcagcagagcccttttagggacatcttgattctattagaatttgcaggtcaaagggcaggttcaactggcctggtagtttaaagcaccagggatagagtgaatagactactgtaatgacttaaagttggatttctgctgctacctactcattatgctaataatgtgcatgttggtcatgtgggcggggggattactaatactttgaaaggtttcgtgtccacattttccttttttttttttttttttttttaactctggaaaagaagggaacagaacaaggagagtaatttgacaggaaaagcattgcagttcttattttgccctgggcttgtggcatacatatattaccgttcacattttatgtgcttgtattactccctagggactcatgggaatgaagtcagaatgtgctacactagcaagcctcccctttctgtggatagtctttagttcgtaaagctcttaaagtcgatgattaattcctttgaggttcaatttctttaaaatatttatatcagtattagaataggtgatctcaaaccattgactcagattaaaagaagttataaaaaagaattacttctggtaatttttattttctttatacttttctgtatctttcagtttttcttcaatgactgtgtactacttttatcagaaaatactttttttcaaagaagcaattatattgagtagacagctattaaaataaaattttttcaatttgcttttttttccactgtgaattccattccctctgaaaagctgagtgtttttaacaacatttctgagtttagacactctcaagtgtgccatgtaaaacttaatcaggtaagtccgactataccatatggtcctttctaagagatggattagaggaacagcaattttcgtattccctaaaagtctttgctgttactgtctactagctttcacattcttccctatcctccaaatttttttcaagaggttgttctccctcatactatccacttcaaatttaccagaattgtaaccaagagaacaatactgtctttgtcccttttggaaaataaaagaaaaacctaaaagctagtatacctatcaaagatagacattactcagaattcatatgattatatgtgcaatatataatcaaaacattttattctcttgactatgaattgcccttcttaggcacctatacatgtagaaatcagtgtcaggagtatacgttgtaaatggaaagcagaaagacatgatgatctgttaggggatttttagaggatgagagccatggtcataggagagaaagtttgattctgtatagtccatagcatattatcattgcttagtaaaaaaaatagcatcaatgaaataaaatctctatttgaattgcataaaaaatacttcaaattatatatcttgttaaaaagacactattccaatggctcagactccaatgccacattcctcaaaactttgaaattagaaatctaagttgtcatctgttatttcatattgtgatttgcaaagttgacattttaccccagaggtgaactgtaccacactagctgtccaagcataccatttatgaaagagtttggaattcagtcaagaagcttcaacaatatggaattatttttactatgtcatattacaatattttccttaagcacaaaataggcctcaagtctgatcgcctttgtattttgcattcagcaaaggtgctggtatttcaatctaattaggtagagtaacttatctgtcattcacctgctgctgcttgcctgctactaaatatgtgattctgactattggtgcacagaaatgtagcacccttattgggaaagcatgctgcctcttccagcttggtcagtctttgagcttcccgaaagggaacagatgaccgcagtcaacaggaaactgcatagttagaccttcttgaactctttcacctttaagctcatttcaccacttaacatatttttttcaagtggtcagtggatatatttagactgtcattatccctttagtgttgactggatcctcgtggtataagttgcctgccatttcttagaattacgtagtgtggggacagtgcgatgagaatcttctctcctcttccagcagcaaaactagtgaaacaaatctttatttccatgatgtaaaccgagtacacatcttctatttgttagtattgctttcagagttgagtagacctacacatccagaataaaaaatatccattagaatattcagtagacagatagtcttccagtctgtggctaaactaaaactcttccatatgactgctgttgaagctcaattatcttaacaaaagacagaagcaaggttaaacttgggcaatgcattctcagattcagcatttcctcaggtcaaaagctcaggccacttatatagttcctataaatcaaatatgtcttctttcataaaagatgagctactgagaaatgcattttggattatgaaactaattgttcaccaactccattgtgattattttgtaaatttcttacatcagcttccccactaaatccacctttttttcctttggacacaaaccataaagtaattattagctaaaccacaaggaatctgtaaagtttaaattactgtttcaaagtgtgcagatcattgccagtaaagccacaactgcaaacttatttgcattcatgagatgaaaagaatgattgatgttcataatgcaccaggaatagatggctgtgtttctatatccacgttattaaagtctgcagtttgttgtacactgtatgcatgaaaatgtcttcagtgtcagtaatgcctcagatcatctggaagctacagaataattatcaaaggaataaattaaatggataaagtatgtaagttacaggattattcttaaagtaactgtttacttttcaaattcaactacaactataggaactctttttaaaatataaaatgaaatactaagttcttactaatatagttttttttaaaaggttaacaatttttatttattctttttgagatagggtctcactttgtcacccatgctggagtgcagtggcaccatctcagctcactgcaaccccacctcccaggctcaagagatcctcctaccttagtctcccgagtagtgagtagctgggaccagaagcgtgtgccaccgcacccagctaatttttgtatggttttgccatgttgcccaggctggtctcaaattcctggcctcaagtgatccacccacctcagcctcccaaagtgctgggattacaggcgcgagccaccacgcctggcctgaatattttttaaactttattttattgtagtaagaagacaacacgggatctaccctcttaatcacttaagtgtacaatgtagtatcattaattgtagagagaatgtcatacagcagatctctagaacttactcatcttacgtaacttaggctttatgcccactgatgggaactccccatttccccctctctcctctgccttgcaaccaccattctactctctgtttgcgtgagtttgactgttttagatccctcatgtaaatggaatcgtgcagtatttgtccttctgtgactggcttatttcacttagcctaatataggggaacttattaagataacaacatgataaagacaatttagagtcacattcgcctgaatgggattcctggctgtaccatttactccaggtgtgaacttgggcaagctgtgtaaactctgaaagtcttggttttattaccctcaaaatgggggtactgataatagtaacttcaaagaattgttggaaggggtgaatgatgctgttggcgtttgctttcttggttttattaccctcaaaatggcggtactgataatagtaacttcaaagaattgttggaaggggtgaatgatgctgttggcgtttgctttcttggttttattaccctcaaaatgggggtactgataatagtaacttcaaagaattgttggaaggggtgaatggcgctgttggcgtttgctttcttggttttattaccctcaaaatgggggtactggtaatagtaactccaaagaattgttggaaggggtgaatggcgctgttggcatttgctttcttttgcaggcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcaggtattattaaatgccagcaggagggtcagtggggccagctttcacaccattctccacacaggtctttgccagcttgtactttaaggtctcatgtttcatattagacatctgatcattggagctagttagtttccatcattagagactttttatctccgcaaatctgtgtctaggaaatgcagagcattcgtggtaagagggctgttttggacaatgtcacaggtcttctatgagaatgttttttaactttgtacaatggattgtagaaattattgaaattagcccatttgacatgaaaaggcttttttttttaaacatccagcaagatttctatgacagcagccactaaggatattttcatgaaaagatttccagttattcaggattgggtaagctctgaagataagaacaaaggttggcccttttcttttccagcctaaatgctctcaaaatttaatacttaatattcatgtaacaccttttgtttgtgaaaataaaagctaaaagtttcccctttgatgatggttgcacaacagtatgaatgtacctaatacacaaaaccatcaacttaaaaatcgttaaaatggtaacttttatgttagacatattttaccacaataaagaaatggagaaaaacatttcccttggaagataaggagagtgctggatgtttacatcggagccctgcttgaacggcagtgctcctcgttgagtgctcctggctgggcgcagcatccgcgtcccagcctccgtggctgtctcctgcattcccagtcacgttgtctgtacattttggctgcccaggtgtgctctttgccctcaagtaatgagaccgagaaagagcttttcaagtaaagaaatttattttcttctatttttggaggtcagtcatcaattgatggtattttggcataatgtttatattaacaagaatcaatatttaaacaacaaagttattttctctgtggatcaaattaaaactgcttagaaatagtctttatatgtatttatgttgcacactttgctgagaaaataccaaaagatgtcttttttctgcaggatggatagttgaccagcaaaaagtaacccattgcttattcacaagtgaaataaaacttttccagggtcctaaaatactttttagcaagaagaggacatcatctaatattttgactacctgttatgtaagataggaagaatgtgcttattatgaaagacatccgtccagtagttgaaaactgaaatttggctcatcaaagctgataatagcaaattggaggatattattggagaaaggagttcactgctgtgggagtttatatattcagcaatatcacttatcttaagtagttaggcttgaatacataggcctatgatttaagcagttcttgatctcttcacttaagacaccaaatagaattgaatatctagcagaccagaataccatacctcatttacagtggtttttgattagtggcctccaaagaacatatgttttcattatgtgaaaattaaggaaattggccgggcacggtggctcacgcctgtaatcccagcactttgggaggccaaggcgggtggatcatgaggtcaggaaatcgagaccatcctggccaacatggtgaaaccccgtctccactaaaaatacaaaaattagctggatgtggtggtgcacctctgtagtcccagatacttgggaggctgaggcaggagaatcacttgaatccaggaggtggagcttgcagtgagctgagatcacgccacagcactctagcctgacaagaggacgagagtccgtctcaaaagaaaaagaagaaaagaaagaaaagaaaaggaaattaattaatctctgagcttataaccttagaaggaagtagctaaacaattctcagtgtctttatatcaaaccacatgccttgaattttctgtagcgatgtgtcctgtatgaagagaaaaataataacagttctcaggagtccttcctacagtcatctcctgcctcccttttacattcctgccctttcaaagcgtatctggatgctgtgagcaagaaggaaggagtcttgccaaaggcatttgattctttaattcctccaagagtgtgtactaacttttggacaagggagaggccttttggaaagaggatatggcatcaatgttgttttaatttaaagcttctagtccatgaattgctggaatgtgcctcagtctaaaggctatttcctaacagggaagcagtcagcattgaccaggctttccagcaaatggagctgccactgcctgataggctcttggcgttcacatgtgattcctattgtcagaaagaggtgaagcaatgagggatatatagatttgggggtcaccttctaatatggtcccaatttacttaccccctctaaccaccgcccccccaccccctacagggtaacttgtctccttgactcattcatggcaaagcagcacttggagaggctgcatcagaggaaggggccagggccagtgaaaaaaataaactaaggctgtctaacaaactccagatgttctgtggtgggtgccagccagtgtgttcagaccttaagtcatgaagaagccccactgtgattgtcaggcccccgcacgagatttaatgtaaactccgatagaaccctggaaagcattaatacaatctgtttagtcacagcagttgtcacaagatggcctttctctcagcattgttttcttcttttcacctccagaattttacaacctccgtattgtgttggttgctggtgtgaaatctggctctgcccctgtgtgctctacacagatgtgttataggcaggctgggcttttcaggacaggctgggattttttttttttttttttttttctgtttttaagagtcaactataacagtataaaagtaaaggctacaaacttaaacagatttggtttgaatctagataatctcatttacaactacaattttgtaatcctgtgcattagaattaattgtcacaccatatattctttgattccagtgttttgtaggcgtgagggatacaaaagcacagtgctcgtcttaagggaactcacaggctaatgcatcaaaccctggttgttctagtcatctggcagacattctgtgtgttagtccgcttccacactgctgtaaagtactacctgagactgggtaatgtaaagacaagaggtttagctgactcacagatccacatggctggggaggcctcgggaaacttacaatcatggcggaaggtgaaggggaagcaaggcacatcttacatggtggcaggagagagagcgatcaagcgaggaactgccacacacttttcaaccatcagatcttgtgagaactcactatcttaacagcaaaggggaggtctgcccccatgatccaatcacctcccaccaggcccctcccctgacacatggggattacaattcgaggtgagatttgggtggggacgcagagccaaatcgtatcacgttctgtagaaggtaatcctggccttgccaactttttctgctgacagctttagcaggtcatccaaacattatgtaacttatttacccattcacttcagatttacctcacagagttggtgtgaaattcaataagatagcacacctgaagcgcttagagtccccccttccattccctgtcactgatagccctgttcgtggtcagaactgtgccataggtgacacacagtacattgagggaggggtagtctcagtaagcatggctcttgttccttttttttttttttttttttttgaggtggagttttgctctgttccccaggctggagtgcagtggtgcgatctcggctcactgcaacctccacctcctaggttgaagcaattctctgcctcagcctcccgagtagctgggattatgggtgcccgccaccgcgcccggctaattttttgtatttttagtagagacggggtttcaccagcttggccaggctgatcttgagctccagacctcgtgatccacctgtgtttgcctcccaaagtgctgggattacaggcgtgagccaccgtgcccggcctggctctacttcttggttgtctctagccactttatttaaatgtgcagactcacgcagtgttcagaattacacaaccagcacatggcgttccactcctctgaggaagaacgtatttctcagggcagttaggaaaaagaggtagaggtactttttatcctttcttttttccacctgttctttttaatgatatgactctcatatagaatttttaaaaaataattctaaattctaatatgtctttcttaaatcttacattttcgtcactgaagaacatttaaatgcccgtctggctgaagtcctcaacattaggaaaatgtcaactcccaagctacatcccatctcactcgccttcgagttctgtgattttccacatgttacctcccgttctgggtatccccgactagtataacttttcagaattctgtgaaaatagagcagtgacaataatggccaccacgtgccacttgactgtcgtgcgcagggcacaggggctttacatcaccgggtcttccccacagctctggagagtgtcttcattatttggggaagcgcttcagacccaaaaaggataaaactgtggctaaatttccatgaagaagactaagcggtggagctagaattagaactgattctcttctcactgtcaccatcttttgtgaagattccagatggttggtaatcagattgtattagaattagaataatacaaacaatgctattttatgtttttatgatactcatttgttccctgagacacagaaaaggggatctatttatacgccagcccttcccctctccatccgtaaagaaccagaaacaaaaaagaaacggtgcgatttgtttcccttttcactgttccaggctgagcatcacctttcggtacacgcggtctttctcccgtcatcccagcactacttccttgagatgagatgacatcaggtgatcccgttggtcttgagaatgatcccatattcttcagtcaagcattttcatacagtagttttctactgtgttatgtgtattttacttgcttaatcctccaaagaccgctttatttccctaatcactaagttcttgatgggaagagtatttcaccgttgccccaagtactttcagtaggtgtggtatgaaaaaatacctgaatcaagtgaataatattttgagtaactgtcttttattaacttccgtccactctctagtgaacagttttcagtctctcttgtggcactgcctatgatacctttgctcttgttgtttcatcggtaaagctgagtactttgacattcactgattaggttgggaaaaccagcctatgctttgaattggccgtttctgcaatctagcagacattctagcacacattcactcatctgtgaacctgcatttgtacatgctttcacacttccccatccctattagaatgccagttaccatgataacacgattcaatgctctgtccacatatcccactcagaaacaatttgtcctataatatggacttgctatctttcaattcatttatttagggttattttactcctttgttgttagcgaaaagaaaatgtatataggttaatgcctttcttattttgactttaaccttttttctcacatgatgtagagctggccattggcccacctttaaatggctgtatatcatctatcttttcctcctcgtggaaaaggctactgtctattatagaagcatggtgtactaattatgaagttgcggttgaaaagacactttatcatcactctagccacttggaactttccaaataaatcattatttggactaaaatttcccagtcttgtttatagtacaaaggtgaatacctttttgaaggttcagtaaactctctttgttaggaactgagggttatgacaacaataaaatatctgtttcagctttcagttttggtggacatgttctttgatcacagcttttatgagagaaaatgcagttttattattaattcttctctagccaaactcaaatcattttactggtttgaaatgtgtcgtctttacctatctcaaagttttgagtaaagaatataaatatattgttttgtatatgaaaaatgtgatttgttctcatttactaaaatttgggaagaactggcttaacattgatctgaagaatgtaggggtcagatacttttttaagaaaaggctcaaatttgattttcaaattcttagcccagggccctgaccgctccccgttggagcaatatttaggaccgccaagttggagacagtaaataattgattcttacatgtcagactgattgtcggctctctgcagtatacatgagttgtttttgaacgaagctaaaatcttgtgaagacgtactaataatctaatatgaacccagttagatgaaaatcaccttttgggacttattctgttctatgagaaaaaaattatacgaaaaattctcctaactagccaagaaaatagacctgtctgtagtctacttagtgatttaaagccttttccttagacatgaaatccatgatggaagcttgttgccaataagaataatggagaatcaacctttaaagccacatacatgatgtagaatttcaagttgccattattctgtattgtaatggtcagccagagagacatgtgtctagtcagttttattaactactttctacagcagtcctcccttccttttctctgtcctattttctgaaccaacagaggactaaattttcttacggagtcaggaagttaagacttaaaatttaaggaatatgagggtagagtgtaccttgttgacttacattattgcatctgaaccttcagatgacatcctgaaataaattgcatagttagggtattttatacctatgattcccattagggacttcatggttttgacaaatacactatcaaagggaagcacatcacaaagaacactacttgcaggtcaaatattgacgaatttagggaatatattgtgtgatattttggtctaatttttcactttcagtttgttgctgtaatacacatagggaatttttaaaatatatgtattttagatttatgctgtatttgtaaattcccataaatacataaaaggaccgtgctaagctgtctttggggtggccacactagtgtattttcctctcacgttttaccataagcagcaagaagaaaccaggcccccaccttcagcactttaactggaaatctacttagctagatctctgagttcattcagtacattctccactttctacacaactgtaggtgacattgttgctaaagttctggtactgcatatcaaggatcccagtaacaagttccttgcttcccttgaagatccagtggcagcctcctaaaagcccctatttcagtgaacagccaattcagggcacttgaggtttgcactagtctctcctcagaatctttccaggtcttccagtttccgcccactacccagctccaaagccacaccggcgtttgaagtttttgttacagtgttaccccattcccagttatgccaaaatctattagttatctactactgcataaaaattacccttaactgagtggcttaaagtagtaattattgtctcacacagtgactgagggtcaggaatttgcaggcagcttagcaggtggttctgacccggggtcctctgtagggttacttaggacacgagagccagcttctccagaagtgacccgagagaggaagagagcaaccaaaatggaatttgcagtgtcttccataactgaatctcagaagtgacataccatcacttctgccttattctgttcacacagaccaacccttatatagtataggaggggacagcacagtgatgcgaatacctggagacagagatccttgcaagccatcctgaaggctgactaccacagcaagtgcatgaataaacaaatttggtatgtccatgcagtgaaatgctgctcagcagtagacagaaatgaactacaaatacacacaacaggttggatgaatcgcaaagacacaccgagcaaaaatggagacacagaaaagtacatactgtatgattccaccatactatacagtgtaagaaagcagatcagacaacaaagcagaacttattcatcgtttcttcccctcgtcagctcacttgagaggcctgcagggggaaagggacaagttccattctctttcactcctctgccttcttcatcttctgatgctgcttctctggccaacattgtttcctttggggtggagcagcagccaaaagacgcaaacctgacagctttctgtaatatcacttgacccacagaaagcgcatgcatcctcgccgtgccaaacggtgagaaataggccgcctccgatacttctgtttccgtctgccatctgtctccttctcagataagcacaaggcaaatcaacaagtctgatggaatgagatgccagtctccttgacgtgtactcacactcagtctttaggagtggttctctttgagccctctctgtcttagctaaggcaaaggggactcttgtgaatgaacacgtaactctccatgtggcaagtccttccggcagtagcactacgctcacaacagtcttagacagatggatgaagggcacctgctgaggcagtggactgctgacagtagtgccttttcagccactggccactaagctgcctttatacatcttggttgcttagctcttttttgtcacctgctttgggccttggtcaccaattctataacaactggaaaagcccattcatcatactattaaaactgttttacattctaaaagaagataacaatggtaggataaaacagcagagagctcctgagttgttagtgaataaagggaaaattaaatagcaagtatcgcagcagcttaagtgctgcggaaactgtggaaagtaaaatgttgtaaacatctgttcatctcacttagtttaaatcctcgataatgaggccagcctcagagagcatttatgtacccatttgttttatatatgaatctgtcatctataatgccaggtgcctgttttatgactgagaagacattcctcaaaacacatctgtgttaggcactgccagggccccttcaccttgcccttgacggtgcctacttcatatctgctgtgcacatcagcatcagcctcccagctgtcctgcatgatgttatctccttgatggtgactgttgttttatcctagaaaatgaaaactttggttagaatattcagaatttgacagaagaatgcaattccgagaaaaacagaagattacagttcagtctataataattcaacggcccttatttttttatttactgatttatttttaataaagacagagactcactctggtgcccaggctggagtgcggtgtgcagtcatagctcctggcctcaagccatcctcccaccttgacctcccaaagtgctgagattacacacgtgagccaccacagccgtcctcaatggcctctattgactagttaagataaaaatgttaatcttttaaaaattattttacctcctttcaaccctaaatttgtgtatattaagtactcaaatatatatacttcttcctctgaaccattacaaacactaagatcaactagattgttcctactgatggtatccagattgttttgaaagaaactagatgcaaaccctttttcattcactgtcctcacttctggaattgccttgcacttcctcagctcaatctccactttaaacttctcttcaagactcatcatgataggtcggaatttcctagcctgaagtcactatttttccttatcgttagcaaagccattctgtgctttttttcattcacgtattcattttcccttggcttaagttgaacaaatgagaagaaaggagggagggagggagcagagagaaagagaaagaaacttttcacttggactagagttgttaattgtatttattctttatgttaagccaggttattcttgttggtgtgattatttgttcaaatctaagaattcccgttctataaccattcctgtcttgttttcctgtttgtatgtatagcgtggtacaatagaaatagtaactgagtgtcaggagacctgagctctagatccaactctgttgataaataagtatataatcttgaacgtaataacaccatcaacgaatatcaaacacttcacattttacaaagtactattcagatacttaatagcgcctaaccctagggctgtatgggcgaagcagatctcataaataaaaggagtgagtggtttaaagccacagcagaaaaagaactgtgagaaagtaggggccacatggtgttgtctacagaggcaggcacttctaactccagctctcgtgaccatgtcagatgcgagccctgtgttattcaggcatccatgtttccctggagaattcagatttttatacaaatctctttatgtctaagtgttggcagctaatgtgttttttatttttatataaatcagtccacaaggctgatttaattgtgtttgttttaacacaaataaggccacaggctgcctgacttgcctcttcgggctttatcttcctcacctataatattgggtggatagatcaaatgattttaaagtctaaaattcattattttctgtattttgataaatcaacatatttacctgtagctgtatcgtctgctaaaggctgacattaagagtttaaaaagaagcaaatcaaaaagcataagaaaacgtgtgtaaagattgtttaactctgtctatagaaatttgctttttttatgaaagtattattttattaaaaaatattgcattatgaagatgaaaaaatcttggtttttttgaatccttcaaagaaatagatcatattttgatgaattctgcttgattggagttactaataagtagaaagtccagaggctgggaatgtggggaaacctggactcatcccaggctcctttcatccatctgttgcatttttttgtcgtcatttccagatgtaggaaaatccctcacaacaatttgataagactcttcccttcatttccagcatcaaatctaacttgcctttcctatcgtcaaactgctgccttttatgatgccacagggaattaatttataaatcttctgtgtttcctgatccctcttgaattgtctcaacgcagataaatcaacctaggtttcctgcccatacgctggtgccctcctctccctgtttcttctgtgtccatcaggtggtgtgatttatagctgcctttcctatgctcattgaccttggtctgaggatctcattaagcatatgtaaaactagaaagattagtttgagggtcgttccctcctccgttaaacttctcttggtgggaaccagtcagaccaatatattccaaaaatctgttcctgctgcctcttttggtctcttttgaactaatgtagatactcattaaaagcaaatgtgaattagacaagtgtggtggcatgcgcctgtaatctcagctactcaggaggctgaggcaggagaatcacttgaacctgggaggcggaggttgcagtgaggcaagatcacaccactgcactccagcctgggtgacaaaacaagactctgtcacacacacacaaaaaaagcgaatgtggaattaaatgatatttgcattcaaggataataggagtggtgttaaactagaatattagctgtcactgagtgccgttttcagaagctgtaatttacatgaccaaatgtattatcacatgactttctggaaaacagtattcacgccattagtcatctcaagaaaatactgtttaacgtttaggcagctgagccctattttgagttctttatgtgaattaattcatttaatcatcactacagccctcagaagtggagttatcctcattttacagagagggaaagaggttaagtaacttgccctaagtcccgtagctcataagtggctgagccagggcaggattcagagccgatcatatcactccagagctgacactcctgatcactacaccaaaatgtgttaccatcattacagcatgtgcttttggtgagagatttcaatagccttcagccatattattaataaccccatcatactctgttgtaataaatagtactttaatctacccttataaattacagtgaaaatatatacattactgtaaaggactgcccccaattttaaaaaattaattcagaatcctgacaggtcaaactgctttctaaatcttgtattaaaaagatgtcttctaattttaacaattaccttataaatagttgactggattaatgaacagctgtacagcagaggagagggtaaaatgataagctgatttttaagcagctaagttcgaaaatctgtgtgctcataaccctaaattaccattggaaataattttgttattaaaatactattactgtcatgtatacatagacaagatgtatgcaaatctggttccaaagtattgcacagcatttattaagatagtgtttagccaccagcattttttttaattttaagaatcaattaatttgcatacttaacagctcatagagatgagtgattggaaagctgctgaaaagttcatagaaaatagtgactgttgaagaaagaacatctatcatacctgaagttcagtattttccccctatatttcaaaagttttatgaaatataagaatttaaataaataaattgttgagctttaatactaaaacagtatttgtggtagttggttttcagggtagagatgcttaaagtttatggtattgccagccttgttcctgaatggagcatttagaattggatatgatgtttttcttggtctcccagaaaattacaacctactaatggttaaatctaaaattatgggttctcagaaaataatttggaacatgtacagtctgggcctacctaacttttaacaagctgattcattagaaatatacaaagagattgaatggatattactgtgtttaaatctacatatgcactttacgagtacacccaaagtgcacacctggaaacaaacaccaaactgtctcctgagacccaggttataaaacacgcttagagaagcctggttggttctcagtcattggcctgaagccagtgaaaggacacagttgcatcatattcccctagtctacagtgtttaacatttcttaatttcaatttctgctaaatgaaagattcttataaatcaagttttcttttcctaacaagtttcctcgcaattaccttcctatcttttttttttctttttttgagacggagtctcgctctgtcgcccaggctggagtgcagtggtgtgatcacggctcactgcaagctccgcctcccgggttcacgccattctcctgcctcagcctcccgagtagctgggactacaggcgcccgccaccacgccctgctaattttcttgtatttttagtagagacgggggtttcaccgtgttagccaggatggtctcgatctcctgacctcgtgataacgcccgcctcagcctcccaaagtgctgggattccaggcgtgagccaccgcgcccggcccctatctatcttattattgagaaacaatagccaggaagaacagaaggaaacctgtttttaaggctggttctagttgagctaattgctatctagagctctctttgtatttagacatcaagacaacagtcacagcaatgttccctaagcccgcattgtcctcctgaatggtagatgaaattaccagcacctgacttgcagctcttcttatggctgtgcactgaagtaactatttctcttaatacatattttaacaatctcagatgagactaagtgggtctcttacttttgtgtcgtctagtaaggagccataactgaaatatcctcctttttattaccataatgatataactataggaaaagaaaaaacatgagccatgattgacagaaattactctccttgtcagagatcatttcctctgttgcttaaagcttcttgcaatgcagcccttttttttttttttttttttttttttgagacagagtcttgctctttcgaccaagctggagtgcagtggcacgagcttagctcactgcaacctccgcttcctgggttcaagcgattctcctgcctcagcctcccgagtagctgggactataggtgcctgccaccatgcccagctatttttgtatttttagtagagacagggtttcaccatattggccaggctggtctcgaactcctgacattgtgatctgcccacctcagcctcccaaagtgttgggattacaggcgcaaaccactgtgcccggtcacaaaaaaaattttaattgaaatgcatgcagccaggcatggtggcttatacctgtaatcccagcactttgggacgccaaggcaggcagatcacttgaggtcaagagtttgagaccagcctggccaacatggtgaaaccccgtctctactaaaaatacaaaaattagccagccatggtggtgcacacctgtaatcccagctactccagaggctgaggtgggaggatcgcttggatccaggaggcagaggttgcagtgagccaagattgcaccactgcactccatccagcctgggcaacagagcaagacttcgtctcaaaaaaaaaaaaaacattaaaaagtacacatgtctaagtatacatgtcagtgaaattttacacacttatgtaaccagcatctacatccaggaagcagatgattgccgacaccccagcaaccagttctcacactccgttttcaggtaccatcccctgcctattcctgcaggagtaactgctctactgaattctgacagtattgattaattgtatcttaaaaaatcaaaacttaaagattttctgtcaacagagcaaccagggacccagaggcagaagccaggggagccaccacaggcagagggcacagccttgagtcagaggattgttctcagaccttgaaacctaatggaattttctctgctggatttcagacttgcttggggctgatgagccctttttttcttccagtttttcccttttggaatgagaatgtctatcatatactggtcccaccgttgtattttggaacctgataacttgttttctgtttcgcatattgacagatggagaagatggatcatacttagtctccctcatacccaactcagattaattagatgaggagatttgggactttcaagtgatgctgtttagatggaattttggatttagagttgtgccatagtgggttaagatttttggggatactggaatggggtgaacctatgttgtgtatgggacagataagaatttggtgggactagaaggcaggctgtagtagatggaatgccccccaaaacatatgccctccccaaacttatagcccccaaaaaacattatgtccacgtccagtttctataacctgtaaatgaaaccatatttggataaagggtctttgcagatgggattaaattaaggatttcaagaagagatcattcttgattatccaggtggggccctaaccctaatgacaagtccttgtgagagacagagagaagacagatacagaagataaggtgatataaaggcagaggcagagattagactgggtggctatgaaccaagaaatgtccacagtcactgaagccaaaagaggcaaggaaggatgctcccttagcatctccacagggaacatggccctgccaacaccatacttttggacttggggccgctagaactgtgagagagtaaatttatgttgtgtttatgttgtttgtgatcatttcttacggcagctccaggaaactaacacatggagtaggtaacacagcttctcgagtccttcatgtatgacaagcttgttgcccctgaaggtattagggttcccctttatttgaaggagaaaggtgaatacattatctctgcttaatcactagcatttgttgatatatgcaaagaagacattcttaagacagcctcggggcagaagaggtcaaataatatttttggagaaaggagaatactaagagactaataagagttagcctcggccgggcgtggtggctcacgcttgtaatcccagcactttgggaggccgaggcgggcggatcaggaggtcagaagatcgagaccacggtgaaaccctgtctctgttaaaaatacaaaaaattagccaggcgtggtggtgggcacctgtagtcccagctactcggagaggctgaggcaggagaatggtgtgaacccgggaggcggagcttgcagtgaactgagattgcgccaccgcactccagcctgggtgacagagactctgtctcaaaaaaaaaaaaaaaaaaaaaaattagcctcatgaatgagctagaaaaggagctcttaggcagagggatcattgtggccagggttgctgaagcatgaagcatcctgagatcagggagccatagaaggcttcttattaccaagtctgcactactcctgggcagtgacgtgagactccagagccaggaggagacaggtcacggagagccctggattgacaatgctgagagtagcttggacttgctcctgtaggggatgccaagccatggagaggcttttagtctcaccgatgttttcagagttttcttttatagataaatcaatcactctggcagctaatggaggaagttaaggggagcctggagtaagaagatggtaagattaaaaacagggagactgtttaagaatctattccagttgcccaaatatgaaatgatgaggacaagaatatagggtagttgagatggagtaatgtattcactaggccattctgtgtatcaaacaccacctaatcttagtgccttaacacagtaaacgcttatttcttggttacacaaagtccaccgcagatcttgccggctctatgaggaagctgccctccatgcagcaattcagtaatccaattctactaaaaatttcctcctttagctctttcagtatgaggccttcttggtcactgtggcaaaggaacaagtaattggtggttcccgtgctgtttcttctatgcttgggtcccacggtcactacccacagaccactggccagtcagatgtctggtctggccaagtaagtggaagtggtctccctaattaaaatgagtaatcaagaagaaaggccatatatggaagagaatataacatgcttatttttagtagagttgaattcgaggttatttatacccaaatagatacatcaagaaagccgttggctggagatgctccaggtaaagatgagagctagaaatgataattttggagtcatcagaacagaaatactacttaaacccatgaaaatggaatagcttgcttaagagagaatataggcaagttatacttactttttactgttttctgacacatactaaaatattaacacaggccattcttttcatccttacagattatagttcaatgagcatatgccctctgtaagcctgttggtaatggatttcagaattggctctactggatatgcattgctaggagtttttatgcagttctagggtttttaagacctttttttcatgtcttacatgtgttgaaaatgctttaagcatttatggcacaatatatcacaggtgattgtgatcttatataccccatagccattttgctgatttgatatataaattaataaagctctgttcctggaaatgaggataatgctacatgaatactccaaagagttaacataaatgtagtcttgaaaagcactccctcaagaaaagaattctgtccaaatcctattaattcccgggtattttgcctattttccttaaaagcaccttacattaaaaaatctgttttgcattcagtctctaagcaaaaatatgtagtgcctttaaagaaacaacaacaaaaaaacccttgagtaggttaatctctccattttaagttacacacttatttcatgaactaatcaaacttgtcgttaaggcttcattaatttcctctccactcatggggtgggatggttgaatcatagcggggctgtgtgtgtctggaagtgacctttgtatatttgggtggtaaattatacttcaaaataccagtagacattttattaaaatttttattttctttggtagattatttccttctaattatagtagtaaacactggtatgttatgattagtgattagcttataacaaacatctaaacagggataagtcagcctgtttagcgataaacctgtctcttgatatatttagaactgatcactagccagtatggctccatatatttctaggacagtgtaacccacagtgacataaattaaaattttaaaaaaatcaaggatacagtaaataccaactgtctattaatattgattaataaatcaatacatttaaaaaataataaagtttaatttttcaaattgataaaagtaaaaattactaaattgatacattactgagttaataaaattaacatttactactattaatctaaatgggaaggtgaaacatgggacaaagaatgaatttttctgaacctaaaaactggaaggaaagtcaaaagtacttaccagagcatgcttaggatgcccaaaggtactgtcagttcatctcccggaggtggggttagtttagtcaccaccaaaataaaactgtggtcaaaccatgaattttggagtattaaatgaacccagttgtggattcactatggtcaaattactacaagaactgggactggaataggttgccctgccctagaagtttcctagttgattgagttgaggtctgattaagttgaggtcacttccagacacacacagtcgcactctgattcaaccatcccactccaggaatggagaggaaattaatgaagccttactgacaagtttgatgagggagggagcagctatgttggcatgtcttctaagagctgtttctgacttctggtgcccagcagtagtccagctatggtagctgatcagttgctgcctaattacctaatcctattggcaagatgaatgtttcagttcgctgctgtgcctttaatcataattgtcttttattcattcagtttgaggtcttcctggttcttgggatgttgagtgattctcagttgaaacctggacatgttggatgttatgcgatatgactctgggtcttacttagacttctgttttagctggttttctttgacaccactccagcaggggaagaatggggtgctgcctcagtattgcccagtggaggtagaagtccagtttctcccacttggaccctgctgacactcaaggggtggaggcttcttgttactcctaggtggagatgggtattcatgtccccactaggcttcactggtgtatccctgcctggttagggtaggaaggcctccactaacacagtgggggtgaaggaaggggggcctggttactgctgtgcggtagtgaaggtccgactccaccaggagacacggctgttactgctccatggaggtggaattctagaatcctcacctagtctctagtgacactgtggaggggagacttcattgctgatggttggagattatagccctgcctccctcggctttccctgacaccttccagtggagcaaggagaggctgaagcacctcctcacaacctggtgagcatggggcccgccgcttggtctttactgacatgagtgacagtgggaccacatggtctttggaatagagtgattgttgtcccacaggtttctatgttgctaggctgtccctttcctttggaggcttctttggctagagagagtgggctcctgttgaagcttttttggtctgtgcctgttggcatttcctggttgttggcttcttcagctctacctctggatatataaggcagaaagatccagggagctgcaggtcacagcactcctgactggtctgccttctctctgcctttttagtgtttgtctgtgtgtatagttcttgttgtacttttatacttagtgtgctggagaaaaaaaaatattcctgatacttcttaaagacagtaaggcagactattcaggggaccactgagatgaggatttgtgttagagggcagagattgggctcaactcagaatacacaaggaccaatggagatgtgtagcgaaggagcagggtgggggtcagtgatggaaaattactaagaagaaacgtcatggctgggggattcttgccagacctactcaacaggagttgctgaagacaagccagagagatgacatattgatagtgggagatgaggaatttgatcagatctcatgagtgatcaggcctcaagggtggggatttatttttgaaggaagacttaagcaaactaccttttctctttaggaaaataaaatgtatgttctgggcttagatatctaagtaatcagtaggttgaattttaatgcttacatgcagataaccgatttttttaagttataattttcattactacctcatcccttagcccaagtcacatatttacctgttttggaaaaccatacctctggcagcagttgagctttgatgtctagtatcattactttattcagcttccaattcattttaagtggtccttaatgggtattcatttcttatcagaatcaatctatacctgatacttgtatatttctggaaatcaaagtttttcaaatatttggatttataaaattataagtggaaatatttcaacaactatgaagagatagataatttaagatacttttctataattaacaactttttttagaaaagcctgattttaataaatggtggttttctgtttttttcttctacagaaaagactgaaagccatttagctcagttgtacaaaaaagaaactttagagaatagagaaaatcaagagtgcaatagtagctgtgggaaaattttaacaatgtaaccacgtatgtttgtacagatacatatatacagagaaatccttttataatgaatagtcagagtataggagaaaaaaatggtattggagagtttggccttatatcatttgctttcaatctgaatggttcagtaagaatctaaaaatgcctttatatcctctgggtttatttaaagatacttcactgtatgtacacacaggtgtatagttggtttatgttttgactcagttatattcttttcttaccatgtatggaccatgattttgtaaaaagaaaagataaaattccctcagaacatctagctttaagaactttggctgggtgtggtggcttacgcctgtaatcccaacactttgggaaactgaaaggcaagaggatcacttgagcccaggagttagtgacgagcctgagcaacgtggggaaacctcatctctacacaacaaaaattttaaaaattagctgggcgtggtggtgcacatctgtagtcccaggccttaggaagctgagatgggaagatcgcttgagcccaggtggtcaaggctgcagtgagctatgattgtgctactgcactccagcctgggcgacagaggagaccctgtctcaatttaaatatcaaaaagaacttttattcttgtgatctaaagttcttttttttttttcctttagagagaacacacgtgtgtgtgtgtgtgtgtgtgtgtgtgtgtgtgtgtgtgtgtaaagtgcttggattcttgaagatcactttctctgcttgcttagctgttcttcaagcaggagaaaatatgctgtatttatgtgattataaaaagcattgccaggcatggtggctcatgcctgtaatcccagcactttgggaggccggggcgggcagatcacgaggtcaggagattgagaccacggtgaaaccccgtctctactaaaacgacaaaaaaattagccaagtgtggtggcgggcgcctgtagtcccagctactccggaggctgaggcaggagaatggcgtgaacccgggaggcggaggttgcagtgagctgagatttcgccactgcactccagcctgggtgacagagtgagactccgtctcaaaaaaaaaaaaaaaaaacaaaaaaaaaaccacaaagcattaagcaatttaatttctgtatatttagtaaggaagtgatcatactttaaaaaaaaactttttaggccgggcacagtggctcacacctgtaatcccagcactttgggaggccaaggcgggcagatcacgaggtcaggagatcgagaccatcctggctaacacggtgaaaccccatctctactaaaaatacaaaaaattagccaggcgtggtggcgggctcctgtagtcccagctactggggaggctgaggcaggagaatggtgtgaacctgggaggcggagcttgcagtgagccgagattgcgccactgcactctagcctgggtgacagagcaagactcctctaaaaacaaaaaaagaaaaaagaaatttagtattacttcttgttttcgtggcctctgtatctgtaaaatacaactgtacactcagtgatatggtttggctttgtgtccccaaccaaatctcatgttgattgttattcacagtgttgaagaaggggcctgatgagaggtgattggatgggggcagcattcctccctgttgttctcatgatagtgagtgagttctcttgagatctgatggtttaaaagtgtgcgatacttcccccctcacctgtgctctcactctctcctgccaccatgtagaaaaggtgcttgcttccctttcaccttccgccatgattgtaagtttcctgaggccttccagtcatgtttcctgtgaagcctgagggactgagtcaattgaaccaattttcttcataaatttacccagtctcgggtagttctttacagcagtgtgagagcagactaatacactcagccactcagataacctaaattacagacaaactgtggtaaatgttcttggatcctggccattgttcactgatttttagaataacagaatgcacttgcctgcattttcttcttttctttagatatggtgttgagtctcactgaatccagctaataattccctttaaacattctgttctttgagaacagatacagctgggagaaatgatcctatgacattaaaactagaattggattgcattaggtttattgcaaggatgtgagatctgtactccaaagtggggcagtgaccaggagcaaaggctcaaccactctttgtttttgaacagtttcattttaggtactgcactgggccattataggcaaattggcccaaaaggtatttcactcctggaacttaagttcatgaccaacttttaggaatggctttttagatctgactgttactttttcaccagaatgtaccataattatataccatggccttgccagaaaacaggaaatctttcaaaaattaggagtggaatagaaattttgtagtttttttttttttttcagttttaaaatgttgaatgtgtttttatccttgtgttaatatatgtttgaagagagaaaatataggctgctcttctccagagttcgaagttaaagtctgcacagcatatgggaaagtgctaaatatacatggtaattggaattaaccattaagatgaacatactcattctggcagctaagaagggatatcttcagctcagggaaaactataagctatgtttgtaagtccacccagctgggttatgtgtctgggttatagaagccaggaatcccatgcaagcgtttctaaggattacaaaaacggtcatgatgagatggaagagaacagtttcttaagaacgagcagatagaccaaaaaaaattttttttatttgctttctaccaagagggggaaaaaagtagttttcatgggaaatatgttgaaagaacagatgtcttgtgagcttaattccataaatggtgatgtgcccaagaataccctgagataagaagaaaaactacatggagtcttaaaaaaaaaaatcactgagtcctaaagtaaataagtgaatatccataatcaacaattttccttttcatattaaatctatttgcgtggaaggaaatgaaggagaaaactttataaatatgtgtaaactggagtccctggattctagagttcttttgtgaaactagtgtaaggaacagaaattgtctttttatctgagaaaaaactgtgctagttgagatgtctattttctttgcttttgactgagataactcactgtggtaacactgggttttaaattctgattggtaactatatatctatttttgtttaatacaaagaggaaaatgaattatttaataaaggaatttttatagaaaaagcattcaaaatgttagactcattgccaaaaaatatatgtcgtccttaatcgtaggaaaggtgggagctacaaacctatcatttttttgcaccaatcatggaaaattgattcttgaattcaacaaacatataaaggattttatctaagctggcaattttactaggtactgagttgatagaaagatgaatgagactctgtcgcagccctcataaactcaaatctattggaagaaaagatatgtaaacagatgattagaatctgtttcagatagcgcggaaagccttttgttccaaacctcaagaagctgcataagcttttaccacctctaaaaatttgtcatgtgtggttgagctcatgtgagagaatggtgtcagaatcaaagagggggctgaaagataaagatgaggtgtgtgagcctatgcagcagctgcccaggggctagcagacgtagttatgactagaaggacttgggtttacaaaatgcctatacagagaatggaggtgaggcattgagctcacaagaggtggggagttggaaccgaacctctgctgaagatgggtccattagaggctcgctgtgcagaaaagcaagactcgttcagtcaaacgcctaccagtgacagatgacaaagaagcttttctctgccctgactctgggaaggagcccagagtcagctctaagaaaccaaagttatcaagcctgtaccttccccaggtttagactaaaaatttatgtcactacttgtctgggaagttcctacctgaagatcacaaagaaagaaatgtacatggtccttacccattcatagtaagataatggcaagctgaggtgctttgtgaccaaaatcgagaatttaacaacacactcaattaagcaggctgtgcacattgggaactctgatactctcctggtgggaatgcaaaatgtagacctcttatagaggcagtttggcaatatgtagtaacattgcttatctgtgcgttgactttgtgacccagaagctttacttctagaaattggtcccacagacacatcttcaaaaatacaaaataacatatacacaaggaaattcattgctataatatttataatagcaacagattcaaaataacccagttgtgccacagtgggatatttgttgtcaattatagtatatccatcagagtggaatactgtgcagctgtagaaagggatgagaaagatctctattgatatggagcgattcccagaacatactgttaaatgaaaaagcaagatgcagaataatgtatttaacatattactttttatgtaagaaaagggggaacatgtgcaattatatgagtatatgattgctaataattgcaagaagaaacaattgaaagacaaatcaaaaatttacccaaaaaagttacctctaaaaaggagggaacaggatagaggagacaggggtggaagcaagccttctgtgattatacctagttatatagttttgactctagaatcaaatgaatgtattacataatcaaaaataaaattagatctgaaaaaaggaaaaaagcagtccttgaaatttaaaaacaaacagaaacaaatgaatctaattatatattaaattgttgacattcacattgagcaaataattatttcagctaactttataatacagatttttctctgtacatctcagtaggataaactccaagtaaaagaacaaaaatgcgaagttttttttagtggtctcactctctcccaggctggagcgcaggggcacagtcaccactcactgcagcctcaacctcccaggctcaatcgatcctcccacctcagcctcccaagtagctgggactgcgggcacatgccaccgtgtctggctagtttttgtattttttgtagagatggggtttcaccatgttgcccaggctggtctcaaactcctgggctcaagtgatcctccctcctcagcctcccaaagtgctggaattgtagacgtgagccaccgtgcccagcccaaatagattttagagttcatcctgaaggcatattgatagtaattgtattggttttgaattttaaaagcattatattgttagagaaaacaaataacaagtaattatgttattgttaggaaccaaaatttttcagcataagagaaaaaaatataaagtataaaatcaaagtagtttagtaaacccagtcttcaagactgagatctgtaatcttaaatctgaatttaaaacattactgttaaccaataattttctcccttttaaaaaaatatttatttcctatctctgactgaaccagactagaagaaatgataaataataaacaccccacagccggattgtggtttcccacttagtctgtgtatggtatgctgctataacaaagtcggtaggtaggtagattataaagaacagaaatttattttttcacagttctggaactgggaagtctaagatcaaggcaccagcaggtttggttgtctggtaagggccgcttttgacttttaagatggtaccttgttgctgtatcctccagagggcagggacgctttgtccttgcacacatctattcatttactcatttgtttatgtaatgagttccctagtaaacttcagtgctgacaaatgagtttattttcttttctcctacttttttttttttttttttttttttttttttgttgaaacaaggtctcactctgtcaaccaggctggagagcaatggtgcgatcatgacccaaggcagccttgaccttctgggctcaagcaatcctcccacctcagcctccaaagtacctgggactacacacaggcatgtgacatcatgcccagcaatttttttttatttttttgtagatacagggtctggttatgttgcccaggctggtctcaaacttataggctcaagcagtcctcccacctcagcattccaaagtgctgggattacacgtgtgagccatcacgcctgccctctcttaatattttttaagagcaaaagcattatttacttacatggctgcacattggcttattttatatacctttattgagatatgattcacatcccatgcaatttacccgtttaaaatatgccattccatattgtttagtaaatcacagaaatgtgtaaccatcactacaataccctattttttaaagtatctttttctagtattatttcagtgtcatcgctttttatatattaaatacattttcacaaattgaaagcattattgattttgctgctcaaattgttaaatgtagccattgtccctttcccccaggcctggcaaccactgatctactttctctatatatagatttgcctattctggagatttcatataagtgaaataatatactatgttgccttttgcaggacttctttaacttggcatcatgttttcaaggttcattgatacttgtagcatgtatcagtacttcattcctttttatggctaatagctcattatatggatatgccagattttatgtatccattcataagttgttggatatttgggttgttcctcttttttgactataataaataatgatgccgtgaacatttgtgggtgcttttttgcatggaaacacgttttcagttatcttgagtatatacctaggattggaattgctaagtcatatggtaattgtatgtttgccattttaaggaactaccaaaatgttttgcaaagagaccttaccactctacaatcccaccagcaatatatgaccgtccctacacattctcaccaacacttgttattgacttttaatagccaccctggtggatgtgatgtggtatctcattatggggttttgtttgttttgttttatattgtattgcttctccgttgttcctgtagatcactgtggctttgatacgcatttccctattggtgttgcacatcttttcttgtgcttactgcctatttgtgaatcttctttgttgattgaaaagattcaaatcccttgctcatttttaattggggtatttgtatttttattattgagttgtaagagttctagacacaagtcctttatcatatatatgatttataaatatgttctcccatcctgtcgttctcttttcactttcttgttgatactgtttacagcataaaattttataaattttgatgtgctccgatttatttttttttcttttgccgctttcgctctttgggtatattatccaagaaatcactgcctaacccaggcctcaaagatttactcttatgttttgttctaagagttttatagttttagctcttccatttagctctttggcccattttgagtttattcttttatatgttctgagactgagacttaatgagtttgacatcattttctttgcatgtctatttctatttgtcccacaccatgggatgaaaagagtattctttctccattagattgtcttggtacccttactggaaatcagttgaccataaaaaaatgatgatttgtttctggactctcaattttgtttcattgatttctttgtccatctttatgctgataacacactgtaggtaaacctactatttactgtaggatctgaaatcagaaagtatgagtcttcctaactttattcttctcattcaatattgttttggctatttttgtatttttttttttttttttttttttttttttttttttttgtgacggagtcttgctctatcgcccaggctggagtgcagtggcgtgatctgggctcactgcaagctccacctcccgggttcacgccattctcctgcctcagcctcccgagtagctgggactacagacgcccaccgctgcgcccggctaattttttgtatttttagtagagacggggtttcacgtgttagccaggatggtctccatctcctgaccttgtgatccgcccgtctcagccttccaaagtgctgggattacaggcgtgagccaccgcgcccagccctatttttgtattttttaaaacaccatgtgaatttacagttctctcaaaaattgaagaagcagtaatagaagtagcactaatagtagcagtagtcatagtagtagaagaagaaatgctgtagcaaataaaggggagggaggataaaggaagcaggtagagcagtagaatcgtttctgaaggaggacatggatgtatgggttttttctgttctttcctctggtgtatgtttggaaattctccatataaaatataattattttagttttaaaaggagaacaggctctgaagctagactgtttgtattagagctctagccctgtgacttattcatcatatgaatgtcgctaagttatttaggctctctgtacctcaataaaattgacatgcaaattgtaccaacttcatattgttgctatgaggattaaattacctaaagctctcagaatacttggcacttagtaagtattcagtaaatgttggcttggaaattgactatttttgaagggagggcggtaaaaaaaaaaaaaaaaaagagtatttttaaaagtacacgtagatttaccaaataatcaataaatctagttattcaattaaaaacttagtggcaagttaacgtatatgaaaggagaattaatgaacttgaagattctgccgaaattatccaaaatgcagtgcagaaggataaaacaaaattgaaaatatcaaagagagattaggagacatggaaaacagactgagaaggtacattcatctgataggagttttgagaaagaccataggggaaattcagaaggaccaatattgcaaaataggaaagtatacatttaaaaaactggaaattacagattttgcaaattagaaaataaggaaattgcaaatattgtaaaaaagagaaattgcaaaatatttagaacagggaaaaacactttatatcaaaatttgtgagatgctgctaaagcagttcttggaggaaaatttatactcttaacacatatataaaattgaaaatgaaaaggctgggcacggtggctcacgccgtaatcccagcactttgggaggccaaggcaggtggatcacttgaggtcaggagttcaaaaccagcctggccaacatgatgaaaccccgtctctactaaaaatacaaaagttagctgggcatggtggcgggcatctgtaatctcagctactcaggaggctgagaaaggagaatcgcttgaacccggaggttgtagtgagccgagatcacaccactgcactccagcctgggtgacagagagagagactgtctcaaaaaaaagaaagagaaagaaaaaaagaaagaacagtaatgagctaagcatccaaatcaagaaatagaaaaagaatatctgtgtaacccccaacacacacacacacacacacacacacacacaaaagaacaaagaaaataaaaacaaattaaatgaaatagaaaacaagctgtaagagaagatcagtgaaactaaaagctagctcttagagaggatttaatgacttaattagatgtgaaatacatagtgagacagattgttcatgaagaaaagaccagatattataataattttaacagtgacttaatctgatgtcccttcagacttctattactaaagaattaattagtctgcttttattctggttaatagaacctgcaactgaactctcagattttttttatcaatactaaaacacaaatctaattagaatttaaactttttcttttaatagctgcgtttggataacctatcctgtctcttagcttatgtattcttctatgaaatgtagtttctgtaacaagttattttaacattttggacattgacatttttgtcgtagaagaaaaaattaacagaatagacaactaactcctttttcctctgggagggtatgtatacctggagatatacattgatagcaaagaagtctatttcagcaagtttcttccttcttcccttcttccttttttttcccccttccttccttcagacaacgttattctttatgtcgttgggaccaggggtttcatctccctgcacatgcacctggcacggttcaagaggaaaaacatttggatataaaatatctttcatgtcagtaaaacatgaaggaattactccttttgctttttggtcttatcttgagaagagcatactatgagagccccttaagagcacagagtcatttatatgatctgtgtaacatctaatgctctgtgagctgtcagatatttagtgctcaacatcataactatgcagggaacagacttcacaccaagtttcttcatactagacctaggaacactaaactttgatcatcttcgtgtctttttggaaatggagaagtaagttcttacaactgtttttttcattctctgacgtggatcaaataaggaatctttggtcttatctgtccacttggatcagtttttttcaggcaggcatacgtactcactcctaagaagtactttaaatgcgttctgccttgaaaatggatttgtgtgtactttattaggatttctttttaagtttttaaacttatgctagatatcagatattaaagattgtctcatgttctaagaaaataactagccaagtctactttcacccacattcctgttaaagtcaacatggaaaggtttcttaaccaattgaatgacatgatacagatgtttcgctcactttctgtatatgcctctttcctttcttctattttccttttttctgagagctgctttgcagaagactttgtcatgaaataccacatgccataagaaaaattagcctacatcttttcaagattgtcttagtccattcagactgctataacaaaataactcagactgagtaatttataaacaatagaaatttattgctcaccattttggagaccagaagtgcaagatcaaggcagcagcagattcggtgtctgatgagggcttgctctcggcttcgtagataatgctgcttcactgcatcttcacactgcagaagggcaaacgggctccctcgggcctttttccaagtataatggatacatttatttatttactcatccatttatttattcattcatttatttactcatccatttacttattcattcatttgcaataatcctttgaacaactactgtttgcaaaaaaaaaaaaaagtatgttatttgccaccagtttgataatggagataacagttctatatgaaaaaatcgatagttggtctcacaagcaaagtgtgctgggagagcaaaaacagaagaaaaacattattttcatattttctcttttgagtgagacactgtcctctttaggagttcagtttcctaccagtgatagaactagatatttacatctcccaaatcaaagtacaaactttggccatagaaccttgttcctcgttattttctttttattttcaacttttattttagattcgggggatgcatacacaggtttgttccctgggtatattgcatagtaccctcaggccttttttacagggatgctaatctcattcatgagggttccaccctctgacctaatcatctccaaaaggcccatttcataataccaccaaatcaaaggttaagtttcaacatctaaatgtggggagagccgggcgcagtggctcatgcctgtaatcccagcactttgggaggctgaggcaggctgatcacttggggtcaggagtttgagaccagccaggccagcatagcaaaaccctgtctctactaaaaatacaaaaaaaatagccagcgtggtggtgtgtgcctctaatccgagctacttgggagtctgaggcaagagaattgcttgagcccaggaggcaaaagttgcagcgagctgagatctcgccactgcattccagcctgggcaagagaacgagactccggctcaaaaaatataaataaataaataaataaataaataaataaatataaataaaataatataaaattggggggaacacaaacattcagaccatagcaaaggtctctgggggtcctcccagaaaagagaaatttgattcacagataatttattaatcggttttttttttttctatcgttatgtactggagggaggaattgactttaaaatgtgcttacattattaggtgaaaatgtaaagaacctaaatcttcaacagtatgggactcactaaatatccattcaggggaccaggcacagttgctcacgcctgtaatcccagcactttgggaggccaaagcaggcggattatatgaggtcaggagttcgagaccagcaaggccaacatagtgaaacccatctctgttaaaaatacaaaaaatagccgggcgtggtggcaggcgcctgtaatcccagctactcgggaggctgaggcaggagaatcacttgaacccaggaggcagaggttgcagtgagccaggatcacgccattgcactccagtctgggtgacagagcaagactccatctcaaaaaaattaaataaatggatatctattcagccaaatgctgtgtagccagttaaaagtagattttgggctggtcaccgtggctcacgcctgtaatcccaactctctgagaagccaagacggggggatcacttaaggccaggagtttaagaccagcctgggcaacatagtgagaccccatttctaaagtttctaaaaaaaatacataaactttctaaaaccaacaaataaatatatatacatatgtatatatacacacatatacacgtatacatatatgtgtaattttttaaaacagtattttagaatactatttaatgacatgaaaaaatggtcatgataatgatgatagctaaaatgtattgggtgtcagttttacgccagacacctttttaagtgctctccttgtgttaattcaacaggttaatcctcacagcagtcttatgtaggagaaaactgttgttatccccattttaaaggtgaggaaactgagactcaacagcatttacatagcttgcctgaagtcagctggtgagagacagagctagagtttaaactcaggcaatttggctcttttaaatcccttgctcagacatattacatatctctgtaaattttttttatgaaactagacaaactatttttaattcatctagaaactaaaatgtgttaaaaataacctgtcaaattttgacagagtagaattggtggacatattctaccaggtatgaaaatatgctataagatatagtaatttttaaaatatcctagtgtagctgaaatagagaaaaagtagaataaatcagaagagcatgccactttttatgttcacagggaggggactaaatggatacacctaaatattaagagtgacaatcactgatagaggaattatagatgatttttctttcttttctcttttttgtttgtactttattttttaaattatctataatgccaggagttcaagaccaccctagacaacatagtgagaccctgtctctacaaaagaaaattttttaattagctgggtgtggtggtgcctacctatagtcccagctactcaggaggctgagttgggaggatcacttgagcccaggagtctgaggttgcagtgagcagtgatgatgccactgtactgtacagcctgggtgacagaatgagactctctctaaaatataacaaagaaaacccaaattatctttagtgagtatttttaaatcatacagtattagcaagtttatttttaatgctttaaaacttcaagttttaacaatattttactagtgtaacatattgctgtttgattttatgcatcatgtaccctggcattttctaagctgcttactctgcagagttaatttttctaaaatgttcaatatattattcatttattcaaggcctaaattaaccactcacacagaatcactaatccagtcttcctttttgataaagatggagaaaagacaatgggattatagtccttttctggcttagggttgaggagaaggatttcagaacttttaacttatttttaagactcgaattgtttattgatggtataaagaaaagctatttatatatatatatatgagagagagagagcacttctgtctgaacacctcactgaactctgtagtaaattgtaatagttgttcaattgatttttttattgagaccctgtctctacaaagaaaattttaaaattaagcatggtggcgtgcacctgtagtcccagctgctcgggaaactgaggccagaggatggcttgaggccaggagcttgagacaagcctgggcaacatagtgagaccctgtctctttattttattttttatttttttaaaaagacagttcatgaagtgcttgatttggggatattgcctcttccccaaaaatttctgtatcaatttaattgccagtcttagcccaagctgccataataaaatgccattaactggatagcttaatcaaacagaaatttattttctcacagtttggagaaatcaaggtagtgtttgattcagttcctagtgaaggttcttcctggcttgcagaggctgcctaattactggatcctcatatgacagagatataaagagaaatccctctatttttctcttcttcttcttacgaagcccagtcctatcagattaaggccccacccttatgacttcatttaaccttaattacctcctgaagaccctgtctctgggtatggtaacgttggggtttaggggttctacatatgaatttgggggaggcacaattcagcccgtagtattggctaaactctttccagtatcctcagaaatcccatatttagtttattttattgcagacaggattagttttatcctttcttatggaactcttaaaatactcgttactttacagtgtgtcatagaaactttacttaaatttaaccttatgaataatttcttcctagacgcaaaatcgaatgaagctaatggccgacaactacgaggatgaccacttcaaatcctcccattccaatcaaacaaatcacaagccctccccagaccaggtaagatggctctggaatgttttattaaaaaacccacacacttaaattttgaaatgtttttgtactagcatgttgcaaattctgagatataagttagaagaataaaaataaatagctaattcagttctgaaaactctactcttttcaaaaaaatcacagattcagtttctttataggaagaactggatattttaagagcagatacttgaaagatttgaacaataaagaatgcttgaattgggttgagaaaaaaattaacctcagagatacacactaataatatgtaatttttaactgtctttactaatttttaactgtcttggttttctttttaaagaaatagtgccttattagaaaaacaagactctttccttacaagcctagtgaggcacagtttggaggttatttctgtttagttgcaaattatgaactctctgctcattacctattaaaagtgaagattgaaacttagttcttcactccctgtccttgtggatccctccagcatgtcatgcttaaggaaaattgttgccttcaacttctcatcaatgcaaaagagatattgatgaatctgaagggaaccatattccattctagtttcttggaagaagggaactctccccaaatcttgaaaatgatggatgggagagaatggtgaacagattacctcatatcccattaccaaaaatcaaattttaacatctctatcacacccagtcttaaaatatgtagctaagggaaaaaaaaaaccagtcaggtaatcacatccatatgactaaagcatcaaggaaaactttcctgctaaacgtctccactaaataacagctatggcgttatcttagcagaagcaggagaaatagtgcagatgaaagcagcaatggtattcaaattgctgttgcttccaagattcggaaggtatagtcctattatgatgacgtttcctaagccagttgaggcaagccttgtattttagaaggaaaacaatgtaaatatttaatgtgggcaaaatggagagctatctgcctggtgtcagcagtctttccctgccaagagatcattttaccttttctgcctgcttcctgatacctggaactgaatttatgccagggtatataagatgcatgtttgattcctcatgaaaacaggtttttgataatagaactggatgcctggagtaggaagagacaaacagagaaaggttgaaggaaaagcaaaacataaagaaaaacctccaacttggtaattttgcccagatccagccctgagatagagatagcatcttggaaagtaggaagaaaagaagtataatgacaaactacagttgttcctgagtatcctcaggggattggtttcaggacaaacccacccacaaatgccaaaatccatggttgctcaagtcccttatataaaatggcatagtatttgcatataagctacacacatcctcccatatactgtgttttgttttgttttgtttttgagatggagtcttgctgcgttgcccaggctggagtgcagtggcatgatctcagctcactgcaacctacacctcctgggttcaagtgattctcctgcctcacccttctgagtagctgggattacaggcacctgccaccatgcctggctaatgtttgtattttagttagagacagggtttcaccgtgttggccaggctggtctcaaactcctgacctcaggtgatctgcccgccttggcctcccgaagtgctaggattacaggtatgagccaccatacctggcccctcccatatactttaaatcatctctagattacttgtaacctaatacaatgtaaatactgtgtaaatagttgttatactgtatttttaaaattttattatcaatgcattgttattttttattgatttatatatatatatgtatgtatatgtatatatttcatccacggttggttgaatccacagatgtggaacctgcagatacagaggaccaacattaactactaattttgatagtttagggaattagaatctgtatgagagagtcaagaaattctcttctgctacattatgcttatgtctttgttttaaatactaaccacctctttttcattccatgctgccctggggcattgcccccttgtcatctctctccctgtaggatgaggaggagggtatatgggcatagccaatcagaggcttagttcagccattttgttcagaacggtgagaaacagctttccttaactatagaaatggtttttgtttgttttcatttttctttttacacagtaactctcacatctcatttctctgtaattcatgaaatccctggtgtgctttctgtttttttattttcacgtgattcttgtgtgtgttgctgtgctgctgacatagtggggtttggattttgtggcttttttttttttttctcgttgtgtgttaatagtcacttctgtaatttctttttatacatttttgggagaacttctaggacgtgtaactaaatttctccagttgtgattttattaattaccctttctagggtgattttacagtgtcctggcaaggtttatagtaattttatatgaaattggcaatagaaaattgatcaagtactttgctcattggcctaagtttgaggtatactttttatgatgattaattataaatacatggtgtttaaaaaaaaaactgtactgtgaactaaaacctccttttgtttgtttctgtagaagaatgagctctcacagtcagcacctcggacacatcccctggggctttggcattaccctcaaactatccctaaaaatattgaggagcaaagtaaaggaaaactttttttagaagtcattctaaaaattcttttccctcccttttcatggattgctgcagtgttcaacagttgccaggacactgtctagattctccttttcaggacaattggctggaaagtatagtccagccgtggcagtatctccctttgatctgatgcccttgaggtttgactaaggaaatccttttcttagaaaaagtaataattatgattaataagttcacacatatttggtggccttgcactccctggattcactgcccatgcctatcagtgatctcactcccctggagtcagttctccctgaaatgtctttgtcttggtgttaaacttcttaaaatgatgaggacatgtgtagatctcttaacgttgagcacaaccaagaaggatggagaggtaagttgtggaaaggggccatgcgctgtgaggtgggaagctgtccagatggctttatcctgagggcatgaatgaagttgaaacgcactgggtcaaccagaaagctcttcaggttaggatgctgcatgtcagagaaagctaaagctgagagcagtcaatgtgctaattatctgcactggacaagggtaggtatttgtcatcatcaagcatgtgagaccgtgcagtagctggatgtagtttactggtctcttagaaatgagcatgcccctaccttgtctattttggcagaacataggagcttcttagcttccttcagctggaagcaccacatatgtggacatgattatatttttgtcgcaaatcctttttctggccaatcagaggaagcctgttggtattctaggaaacaggcctataggtaacttcaccaggagactagaaagtaagcaaatcagtatataaacttgttcctgaaatcttcattttcctttctctaccaaaataggataacttagctttttccaattatcgcactattgagcatattgcactaatatattaactttcattggtttaacaccatgcaattgcaattagccagccataactggcgtttctatgatatggtgtttccaattttataaaatgtgctgtaaacctcattatatcataaggattttacctaaagaaatgcatgagtgacccctaaaacactgcagaagttttgactggctatccactttccttctcctgtttcctcactaattttacagaagatagattttctttagaaattcaaacttttgaaattgacgatttaccttatcaaacttaaaaacgtgtgttttgcatctgaaacattttctaggacaccaatacatactgatcaagtgtgagccttacttgatgtatccatagatgggaagagaatcacagatgtactgagctgaaaaggattctggagttaggccatttcaggagaggtggtaaaacgtaacgcttaagagtgtaggctttggagcgggatgcctatgttcagattctaccaccaccatgtactagcttctgatttggacaaggtacgtcattgcgctgtacttcaatttcttcatctttaggatggaggttgttgtggggagtagataagttgtgagacacgtggactccagagccagactgcacagctttgaatctagacctctccacctgccctgtgaccttgggaaagtcacttaaactccctgagccccagttcctttatccaaaaaatgggtttatgaataatgcctacttcctaggattattggatagattaataagttgatagctgtagaatgctttgagcagtactgtacatgcctttgttatgctgttgccgttgtcatcattaacttagatccgtctccaggaaatagtaagctttcaataaatgttagttcctgttgttactaacatcatcgtctaatccagtgccctcattttataggtcaggatgcaaaacaaagattgaaaagttgtgacttaaggtccccaggcatttctgtggtctggaaggaagaactagtatctgacagtaaaagaggtagtgaagacatattgatggtgatagctgtcttccatcaccacaagtttcatctcctatatgttgaggaattttttcctttgggaaaacaccttgaattttataaagaaattccctattgtatgacatttagtcagtgaaatctttgaaagaattagctgtcaagcagccctcctaagacacacggactgaagcaaggactgcctccactcataaaaaaaaataacagttccttcactctcctcttggcctatagaaaatccatgtgagggccagactcggtggctcaagcctgtaatcccagcactttgggaggccgaggcaggcagattggttgaagccaggagtttgagaccaggctggccagcatgacaaaaccccatctctactaaaaatacaaaaattagctgggtgtcatggcaggcacctgtagtcccagctactcaggaggctgaggcacaagaatcacttgaacctggggggcagaggttgcagtgaaccaagatcgcaccactgcactgcagcctgggtgaaagagcaagacagtctccaaaaaaaagaaaaggtaaaaaaaaagaaaaagaaattggttctctctctcacatgtcattctgctcaggcattcatgttaggtgttctaagttcaataactaagtagaatttgagcatgatttgataagttatgtaactattcagtaaatcacttgaataaatgtctatattgtaatgtgtttaaattgcactgggtccaatagccatgaagtcttatatgactatctcagtcagctcaggctgctattgaaaatatcatagactggatggcttaaaccagcagtccccaacctttctggcaccaggaaccggtttcgtggaagacagtttttccacaacgggggcttggggaagatggcttcacaatgaaactgttcttcctcacatcatcaggcatcagttagattctcatcaggagcgtgcaacctagatccctcccatgcccagttcgcagtagggtttgcgctcccgtgagaatctaatgccgccgctgatccaggaggcggagctcaggctgtaatgctcgcttgcccgccactcctctcctgctgtgctggacagttcccaacaggccacggacaggtgctggttcagggccctggggttggagacccctggcttaaaaaacaaacatttattttttactgttctaggggctgaaagtctgaggtcaggatcccagcgtggtcagatgtttggtgaggaccctcttcctactttgcagatggctggcttctcactgtgtcttcacagggctgagagagagaggaagcaagctgtctcgtggtgtttctttttataaaggcactaattctatcatgagggctccaccctcaggacctaataatcttcccaaagccatccagataccatcattttgcagattagggtttcaacatatgaattttgaggggacacaaacattcgattgatagcaatgacgttgctgactcatagatctcagtggtgcacatgtgacttagtctccgcccaacagggagttccagagcaaagatttcctatgtaagttagtttatccatgccactctctatccgtttactgtaagttttcttcttttttctttctcctttcttcccctcctccccacctccttttaccctccctcctcctcctccctccttactgtagaatgtaggccccatgaggacagggactttaatatatttacttatgtattcccatcatttaaataaatgcccaggatatagtaggtcctcagtaaatatatatgtgtgtgtgtgtctgtgtgtgtgtgtatttatttaactactgaattcacaaaaatccagaaaagtaaaagtaaagtttacattgaaaccaggagcatagaaattggttgttagctttattgtcagcactgctattactagaaagggaagataagaaagatgaatggaaacaaaagaattttagagaaatgttgagaatttaaaggaaaatcataatgaagtcctagagtctgcctcctgaaattttacactgaatataatggagttgaatgtaattctgaaatctttttcatttaccaactgaaaatccttcgggtagaaactttccttccagtaacctgtggttcttagccatcaagaagaacagcatatgctctttctggacttcaccccgtggagcagtttgtgtgaactggtgctaggtcccttcagtaaaggatggacctaccaaggggcttaaaagttggtcttggtataagaacatgccacttactacaatctggaaatggcctgcctattagatcagcactgtagcatctcaaaacaggatttggaccagtatgctagacttttctttttcattagagatgatgtaaatattaacacaaacttttaagacaagtgttgtaaaacaagcatctccttctcttttggcatttcctttttgtccatcttagtggagttgtcagtgtacttatcagttggaaacatcctaaaattattctcattgcaacagtgcaacaatggaagccttaaatttctagagaatacatccatagaagggaggtgttaaattatcttgcagaattaaatggtgcagtgaattgcactgctttcttggtatggagaaaatggtccaaaaaccaatttgggccaatatcaggactgacttttgatatgacagacaaggaagaattcgatcctctattttcagaagtggatcagagattttagcaagaaacttctttcctggaaagcttagaacaaagccaatggaattaaagaagcacaaggatctagctgctgagaaataggagggagaaaatgaacatttattaagcatttactataggtccagcactttcatgtatcttatctcatacagggctcatagacgttaaataattttccaagattacacagctaacaagcggcagatatttaaacccaggacagactccagaccccctgctgtctccattacaccatacccaaagaggagtcttccattttccagtctagttccttggacatagtagacaactccatggaagggtgttgaattgaattgaattcctaactggggaaataacaaaatggtctttgctggtaaggaatatctgtaggttacccaagacagaccctcactgaaaagaaactaagtggtttctgagttcactgataaatgtgactaaccaggaatctagtgaggaatttggaactatagaagggagaaaaaggaggtcttggaggttgagtaaagtttgggaagatgaaacaggaaaagaaaagttttcagataggaactaacttcaaggaggttccaacctaagaatgagaatatgatgtgtaggggctggtgaggaaaccagcccaagtgaaacagagggtgtctgtccttccattggttccatggctatccccacccacacttctgttttaatattggacacccataattcaaagagacaaactacagatgtgaggagctcacaagaacagttacatattaagctttacagagaattaaagtagtaatcagctgcctttggacgttgtctgaatcactgtcttctaagttgattgtccctttatctagttctgttgctttcaggtcctagtcagaaggtgggctttggaaccagattacttggtttcaaactcctgtgtacctcactttcttcatttgtaaaatcaggataataatacacctgcctcagagggctgtttgatgattaaatgaagtaacataaagcccttaaaacagaacaatgcttttacatatcagtagttgctcagttaatgttagctattagctggctttaacctgaaggcacaagctgaccacttatagcattaatacccttcctgcttttatcgttcccctcccttcttcactttctctgtcttcctcttggctctcatttaatgggagtattgaataagagttccttactcttcaactctggattcaaactattcttgcacaacctgaactccagtttaatagtgtttcctctatatgctcagaaatgtctttagtttactgtttgacctcggcacaccacctgttttctgcttttcaggtttctcttcttccctcctctccacaaagaaatttaaaatcttcatttctgcttttcactgttttccagagggttcactccctttacacctcatccttctgtcctggattctcactagctgtctcagaactctgccgtctgctattaaaagccaagctttctgccagccctttttgcataccatactcagcaggtcccttctgtgtgcctctatcttctctaagtcaccatctcatctcatgagcatgtactgaaacacataaacagttttgctactgctgctgctttttttttttttccttctcccaagcaacttgaacctatgtcaaatcaaaaaagattttggaggccgagcgcggtggctcatacctgtaatcccagcactttgggagacccaggcgggcagatcaccctaaggtcaggagtttgagagcagcgtggccaacatggcaaaatcctgtctctactaaaaatataaaaattagctgggtgtggtggcgcgtgcctgtaatcccagctactcggaaggctgaggcaggagaatcactttaacgcaggagacaaaggttgcagtgagccaagattgtgccattgtacttcagcctgggcaacagagcaagactccatctcaaaaaaaaaaaaaaaaaagattttggaaaagagttatttttgacaaaggcattgggaaataaagagtaaatgatggatgatgctagtagttaccatttaaagaatacctactaagtgccaaacactaagttgtaagtttataatcacattgtaagcatgttttcattgaaaccaatataacaatcctaagagatagataccattttcattattttactgctgaggaaactgaaccatggagaagttagctaacttatccaagttcacatacctggtacacagtagaagccagatttgaagccagatatgtctaattatatcaaaacttgacctacctctgaaggatacatagctagaaggattttttaaagacgttattatgcctttgtgttcatgctgattacaagagagaagagagtaaatgatggaattcaggacatgctaccccaaaatatggcacgttggcattggatacaacaacagaagcaggaaggtctctctgaccttctcctcacccttcttgcctgaagcaagctataaagaattttctgacctgcctctaaagtaagtcataaaaccttcattgcagaggtacccaccccatagctgaaggaaaagaatgtccttatctctgaagacagaggaacacaaagaacaacaggccttgttaattcctcccagtttattactgttattagattagacccaattgtcctcaaatcaatttctccatgactgtctcctcttcatcatacacagatttccttcttttctgaagtcttcattttctttctttctttctttctttctctttctttctttctttctttctttctttctttctttctttctttctttctttctctctctctctctctctctttcttttctttctttctttctttctttctttctttctttctttctttctttctttctttctttttggagacaggatctctctctctgtcgctcagactggagtgtagtggcatgatcatagcttaccgtagcctcggactcatgggctcaagggatcctcttgcctcagacacctgagtagcagggactacacgcgtgtaccaccatgccctgctaaattttgtattttttggtagaagcagggtctcactgtgttgcccaggctggtctcaaactcctgggttcaagcaatcctcccacctacgcctcccaaagttctgtgattacaggcctgagccacagagaccggctgaggtcttcgtttctgaaggctcccacattacataaaacttacagtaaataaatgtgtatgtttttctcttgctagtctctgttatagggttctcccccattaacctagcagtggatgaaaaaagaaaatctcttctcccctaagaatattcccataagaatatccaattataaataagactaacaataaactccttttaaaatctgagtagaaaaggaccccatggtagcaatgtatgtatgttggactaatttgtaactattctcctaagtgttgaccttaatctttctggtaatgcattttaggattagtatactacaaatgtactttttctccaaaattatacgtcctggatacatttctttatgtagatatgacatacctttcttgcttcaaatatcaataacatgtagtgtaagaagcctccaagagtgtggtctttttaaagctggaactcacatcctttattctatctagtaagccatctctcaggtctcattcttgagaagaaaaaaaaaagctgacaaaatttctacatttaaatttatttttcccttaatgtttcatatcaaaatggaagccatgtttttcatcatttcattcaagacataaaaccttgtgaaaaaccaaagtaatggaggaaatgaggaattgtcgtttagtggatatagagttttagttttgcaagatgaaaaagttctggagaatggttgcacaacagtgtgaaagtatttagcactcctaaactgtgcacttcaaatggttaagatggtgaattttatgttatgtgtattttgctacaattttaaaactttcctaattaaaaaagaagtaatggtgattttctggcaaaaaaaaaaaaaaaagatacattcaaaacatgcactgaatattattttgaaaatttttcttagtgaaaagaggcaccttcctctttcccaggtaaacatttcaaggttttgaaatggaaaagaactacccttgaggctttggtttagccttttgttctctgcttgggaaccgggcttatttgtttgtttatttaactggttgctttattagcataataaagcatgacactgttcttccttgatttgaactgcttagaagtctttaaaagaatcatttgcataatttattatttttaaatgtgttcacattcagcatttcctttaacaaagatacacacctataccttttacaaagactgaatatttaggcaacttaacagctacaaacttaactttttaatgaattgaagcacttttcattcaatagagatacaaatttggagaccatcttttagaaattggatccagaaaaatactctgaaccagggactgacttaaataatttcccaacatcaattaaatgagatttttcctttaaaaaaaaagttgttttgctttgtgaggttaaacttttttttattttatttatttatttgtttatttattttgagacggagtctcgctctgtcacccaggctgtagtgcagtggcacaatctcggctcgctacaagctctgcctcccgagttcacactgttctcctgccttagcctcccgagtagctgggactacaggcacctgccaccacgcctggctgatgttttgtatttttagtagagatggggcttcaccatgttagccaggatggtcttgatctcttgacctcatgatccacccacctcggccccccaaagtgctgggattacaggcatgagccaccatgcctggccgaggttaaacttttaagcaaaaccctacaggagagttatctggaactctttacaaaatgagtgtatttctttgtgagaagaacagtgtgtggagtgcaagggtgtgcatttattggtttacttccccaagcccagtatttttgtttgtttgtttggttttggtttggggggggggggggttaattataaagcattctattattgtatttaaatcttttcctttattattatttttaaattgacatctaataattttatgtttatagggtacagtgatattttgataaatgtgtataatgtataatactcaaatcagtaattagcatatctgtcacctcagacatcatttctttgtgttgggaacatttaatattcactcttctagctattgaaaaatacataacaaattgttgttaattatagtcaccttatagtgctatggaacattagaacttgttcctcccatctacctgtgcttttactcgctcagcggattcttctcacccactgcacagaaaagccaatacactgagacagcagcattgcagtagagaaagggtttaattatctcaaggcagctgatcagaggacgagagatatttctcaaatcttcctccccaagaactcagaggctagggtcttccaggataatttagcaggctgagggctaaggaacgggtactgctgattggttggggttgcgatcatagaggtgtcaaaagctatcttcatacactaaatcagtttctaggtgggggtcacaagaccggttgagtcagttccttggtatgagtaacaggtccgagtggagtcagttggttgccagaatgcaaaagtctgaaaaatatcttaaagaccaatcttaggttttacaacagtgatgttatctataggagtaattggggaagttacaaattttgtaacctccagctacatgactcttgatgagtaagcaattttagaaaagtaagctagggaacgggctgcgcacagtggctcacgcctgtaatcccaacactttgggaggctgaggcaggtggatcatgaggtcaggagatcgagaccatcctggccaacatggtgaaaccccatctctactaaaaatacaaaaaaaaaaaaaaattagctgggtatggtggtgcgtgcctgtagtcccagctacttgggaagctgaggcaggagaattgcttgaaccagggaggcagaggttgtagtaagccgagatcatgccattgcactccagcctggcaaaataagctagggaacaatggctggttatcatttaactacacctacatcttagcagaattcagtcttttcccataatcctaaccttgtggcctttcatttgtcttacagagatggtttcagtcccccgtgggggtcagcttgcagagggactattatcatttttgcttcaaagttaaactataagctaaattcctcccatagttagcttggcctatgcccaggaatgagcaggggagtgagcttgtgacgttagaagcaagatggagtcaggttagatttttctcacttttataattcttgcaaaagcaattttatattcattaacccacccctggctttccccttccccctacccttcctggcctctagtaatcactattctactctctgtttgtatgagatcaaccttttaagcttccatacatgaatgagaaagtatggtatttatctctctgtgcctgactttttcacttaacatattgtcctcccagctcatctgtgttgctaaaatgacagaatttcattctttttttttttaatcactaaatagcattgcattgtatagatatttgccacatttatccattcgtctgttgatggatacttaggttagttccatatcttggcagttgtaaatagtgctgcactaaacatgggagtacagtgatctctttgattactgatttcctttcctttggatatatacctagtggtatcatagctggattgtatgatagttctattttagtttgctgaaaaccctccatgctgttttctgtaatggctgttctaatttacattgccacaaacactgtgtaagagttcccttttctccacatcctctccagcatttgttattttttgttttttggggtttttaaataatagcgattttgattggtgtgtgatggtatctcatggtttgcatttgcatgcaaatgattagtgatgctcagcattttttcatgtacctatttcaaactcagcgtaattttggttgggaggccgttaggctaaggcagctccaatgccctgagttcctacataaacaaactgaaacccaactctttgtaaacagtcatattctaggccaatcagaaaccaccaactaaccccctacctaggggctttccaatactcaagtttaaccgatcaggaactgcctggccaacctctaaccagggactttccactggaatgatccaaaaaacattactgccccactttaaccaataagagattttctttaccttgcttctgctttcaccttacaaaagtcttctaccagtctcttcatcagaaccccccaccacttatggcctaaggctgcctgattaacgaattgttgtctgctcaaataaactctttaaaattttaacgtgcctttgtttatcttttaacagctgtttaatctcactgtgatcacaaaccatacattgtattgtcttaattattttacatttttgagactgttgttttatggcccaaaacatgatccatcttagtgaacataacttgtgctcttaaaggaatggtattctttaattgtcacatacagtgttctgtaagtatcaactgggtcaggtggttgatagagtctgtcagatcctccctgtcttcactgaatttttgtagagggagaggtctgttaattgcagagaaagaagcattcaaatctccaacaaaaatcggagatttttctgcttgtcctttgaattatttcaggttttacattgtattttgaagctctggctgtgtttgcagactcatttatgattgttatatactcctgataaactggccttcttaccactgtgaaacatcccttttgattttcagaaatatcatttgtcttgaaatctactttatctgtcttaaatcagcaaggggcactacaaagtaacagtaaaggtagatgtaaatattgttaaacaagtaataggtattcaatgaatacttgttgaatattgaattttagtattttctgggtggcagattgccagataatatggtttcgtgtgtgtatgtacgtgtgtgtgtgtgtgtatgtttcttttttaataatctattttctaagtctcagtgtggatgagatgctgtggataaaatagtactcacttcaggaagttagttacctccaaggttgactgagcgttggtcctagccttctaataactaatattgaaggaagaagcagctcataatgacataatgaatgagtaggcaatctaccttaaatctttagagaaaaaactaatgattgaacatacaatgtcaggtgttttcaatagaggggtaatagaagaattagagcaggtcaggaaggacagcttcataaatacgacaccttatgacctttggctacagttttactgctttcctgatatttgcttgaaccaaagctcattctctgtataccaacacaagtacaattctattctgttctttagctgtttaaaacaaagtggtttcttcatatcacgatttaaaaagagtagtctcttatgtctctaaaagaaccattgggaaaaaagcaaaaaagagtagtttttcttaattctaaagatcctcaaggcagtggtgtcttaaccaggaagacaggagagacccaggcagccttaggaagctcactgtcatcctcccttttcctcttgtttcttcatccctagaagtaaacaaactaaaaatggttttgacctttgaaaaagaaataaacactgaagtaattgcctgtgattctctctacccagccgtctgctgaaagtgtgtcttgagaagagcttgagatgatagatagatagatagatagatagatagatagatagatagatagatagatgatagatagatagatagatcgatagatagatagatagatagatagatagatagatagatagatagataatctgtctctactccacaggtcgataatagctcactaacgcatagccagggagatgtcagagtggcttgagacctcaagaagctttttcttaaatccttaaaacctaagaacctttttttttcttttcttattgttcagttgcctgttaattttttgtggggagtaggggttggaatagcatgctactgcttagagtagaacagggttagaattctttgctgccaggagtattatttcctttaaatttgtgtttctgttgtgtaaacaaaactatctgcttcctggaacataaagcacatacataattttagtaggcacttatgctggattgtgcttggtagttggcagtgagagcactttttagtgtgatggcatagccacatctcttgtggggacaggaatattttcctgttagagtggatggtgacctcttctgcattctgctttcttccccttccccacagacttgtagaagctcttgacaaacagagcagagaaacaaacttaagtaccagcattctcaccagcccaaattcctgaatctctgactgtcctaagacatgccagttgtctgtacctgtgcagcctttcctcatagcaaggactggaacagaggaggaactggttacagtaatcatcattcccctgtgaacaaaggtctcacgcagtcatttctcctcagtgtgttttcggcttcacagaatgactgtgagacaatgttgatctgtttacgtcacttagagctttcagcacatccttttaatggccaaacttactttttttctgacagacttagtattaggatcaactatcatttttctggccctaatgcacagagctattaaattcctcaaggttcagatatgtctgtttttctgcgtaacatgaattatccaagaaaaatgtagacacctacttaaagtaatagaaaaagcattgaatcagggtcagagacttcaaagtaatccattaacctcttggtacctcagtttattcatctctgaaatggaagtgatgataactatcctacttttcttgaggcaccgatgtaatgaatgtgaaagtagtttgtaaatccataatttgccatacaattaatagctgttgtttactaacctgtaggtagccaccatgtacttctatatagcttttgcatagtatctgaagtctaacacagggagtttttagattttttttttttttttttgagatggagcttcgctcttattgcccaggctggagtgcaatggtgcgatctctgctcactgcaacctccacctcctgggttcaagtgattctcctgcctcagcctcccaggtagctgggattacaagtgcgtgcaccaccacacccgtctagttttgtattcttagtagagacaggttttcaccgtgttggccaggctggtctcgaactcctgacctcaggtgatccacccgcctcaacctcccaaaatgctggcattacaggtatgagccactttgcccggcctttagaacattctttacaagtaagttagaggaatgtcaataggagcagggtgtagtcgtttactaatattggaagataccagatttctggatttttagggttagtctcttttgttaaacattaatattctctagaactcaattacttttgaataacttgcagaaattcccagaattctaggatctttgctctagactatacagcttttgccaaatttagactacaactatattgtacgttttgtggactacagtagttcgtctagtgtggtatagtaatgcatactattgcagatttgaaagctctgtcaacattatcatatcactggaatgctgcttttatttcttaattctaccccaggttgtcttaccattctgtctttgtacctctaaattcaatgtgtcgttctttttttcttcataatttagagtggtttgtgactgggccacattccatcttccacctttttcgtaaaaaccattttttctccatagaagtatcaaaacctttggaattccttcaaaacagctgtgtctgccctccttctagtggcccactagaacatatatgtctggagagctgcagtgcctgggacactacaggcagatatatatactttattcttaactagaatttctctgataactggacaccagcctagaagtgtctcagacctgctttcatctgctctttgtgttcttaaatcccagacagacccttccagaaccagatgaccatcaagacaaaagcatactcaagcagacaagaaaggagtaggtctcaccatatctcctagatttataatgtgtgctctctacctggcagacactacacatactgtgtaaagcactgctgggggccttctttgtgtgaaacctgggtgcctcgatgcctatcagaacttttacatgaggaagttggattggaggagagatttatagtcaacagtaaccacttaacttggaaaacagaaaagaaaaagaatcgtccataatcccatcaccccgatgcaatctcagtgaatatcacagatcagcattactgtttctcttatgtgctgttgtcataattgtgatacatgacagtagtgcaactataaatttcgtattttcttttttttaatatattgcatcccacctgtaaaactggcaagatatattttcttttgcttcccctacagggcgtttgtattattttgagggccttttaacttggtgataaagagtgtctttgccctaagacctaatttgaatccagcgtggtggtcgtgtaactgcccacaagtcacgtcacttcttctctaagcatcaggtccctcatttgttaaatggcaatcataaaacctatgccaaaggttaaggtgggaattaaatgtaataatgtagtcagtgcactcagccctttgcctgacatataggacgtgctcaataaatggcagtgagggtgacattgaggcagagacctcttaggctacatgagtgcattgtaagtaatttggggtagaaccttttacttaatgtattttaagacatcatttatagtgtttcacaggtagatcctgcttttctgtggtttctgttgagtgatttaaggtggcatttgtcctgggactcacttgatttatttattagactgaaaattatatagcatttgaagcatctctggaacatatgcactcagatccgtgggttcatatcttaatgattatgggcattttactaatgaggaagagctatcttcccctatttgtggtattatttgtgatttagacattcttcctggacaacaaagtatctttgtactttgtacaaaataaaactcttcacgtattacttgtttcccacacagtcatctgaaaatgtgggcacccgacagggctcaacaaatatttatttaaataaaacgtggatgagttttaccctaaagaaaagttgcatgtatgttatttacagttttctgcagtgtagtagctatttttaatcttttggtttctccctgcaccctaataggttatcctataattgggttccgttcatgtgtattagtgtcccaggctgatcttagctccagtaaatacctagtgtgccttctagaatgttatatcatgaagttcgttactcacccccctcagttagcctacgacttgacctttttttaataccagttttggaagacaggcctaacacttgtgtattccatcacatcttgatttcatagagttacgttgtggaggatatggttcaactcacattttatctgaaatattaaacagcagaccctttacgataggaccccgcagtactgctttcattcacttgtcctcagctccgcgctgatttgttcttcaggattactatctgttttgggttaactgttttgcagttcttagacacagaactgcattatcaaccaaaataaaagagctattctccctgatgtgccttccttcttcttcctgatcctaggatgatgaggctaaagtttccagctggatctggctcggcatttctgggataaattaaatgagcacacttgattgaggggtagctgcactgtatccctggcttcctattatgctaggagatcaaagcagagcacaaatagaggcttgctctatacaatattcaaaacagatggcttttttttggtgaaaattcaggttttaaggcaaaacacttgttagcaaaacttcatttcttttcattgatagatagtcactactgaacacatagcactgtttcttcctgtatttcaagactaggatcacaaactttttgcaggaggagggatttggcaagcctagaaaggtattagattgtctgtgtcttcatgtgaatatgaaataagttattaagattttgctgttggtattctagaatcaaatgaaaacatcttacatttggtcacataatcattttgttgttgggtcactatttaaaaatctagtactcatattgttttgtcttctaagaattgaaccaggatgtttatctctgatttcatgttttaactgaaaagtacattctccacactcctttatcatttacatctgaatcctcaagttcatgtagaataattctatgtgatgtgaaacttttattattttggtttaaaactgaaatgagaaataagattaattcaaaaatatttttgggacgtctgccatgtgcctaacactgcattaggtacgtggtaaaaaatacatgtttcaagacattgaaacaactgctaaatgatggattttctccaacagagaaaaattatacaagatgcaatagaaaaacccaggtctccagagagatttaggggttcacaaagaaggtgacacttgagctaactcttgaaggagcagtaggcatttgccaggcagatacaattttagataaggacatttgcaaagatatagaagcataagcagcataacaaatttagtatattcttggcagctcattatacatagtagttcgggtgtatgtcaattatctgttgcagcattacacattaccccaaagtgtggcagcataaaacaacaataaatgattttcatctcagtggtttctatgtgccaggaattcagcagcgtcttagctgggcagttcttacttggggtctctcatgggaccgcaattatctaaaaccttccctggggatagaacagccaattccaggattgctcacccacagtttgtgccacctattggaaggaaccttccgttccttgccatatggaacctctccattgggctcctggatgtggtgacatggagtccagcttcacccaaaatgagtgatccaagagatgagagccagaaggaagccacaatgccttttatgacctagaatcataagttacacaacatcccttcggccacattctgttccttagaagtgagtcactaagaccatcccacactgagtggggtattagggcttaggcaccactttttgaaaggaggaatgctaaataattttcaggctttttttttttttggcagcagagtctcgctctgttgcccaggctggagtgcagtggcttgatctcggctctctgcaacctctgcctcccgggttcaagcgattctcctgcctcagcctcccgagtatctgggattacaggcatgcaccaccacacttggctaatttttttgtatttttagtagagacagggtttcaccatgttggccaggctagtctcaaactcctgacctcaagagattcacctgccttggcctcccaaagtgctggaattacaggcatgagccactgcacccagcctcaggtttattttttcaattactatgggatgtcagagagggaaaaacaagccattaggtggttgcagtcagcagcaggtggatcgtgaagacctcagcatgccattgcaatctgtagaggttggacaggtggagagggaggtatacggggcagagtactggaaacaggacagccagttcagagcttgctactttgtcctggagagtgatgctgaggggctgaaggggtgcagtgatagaagagtttataagtgagaatatgtttattatcaagaagctctggttcttataggaaatgtcccaaatggtttctagtctctcttggttgagaaaatagagaacaccgtctgaatgcccagttataattcagaaagttaacttgcccgtaggaactactcagggaaaagcaatgaaataaagcctgaaagttctataaccgctccggggagaaccacgagctgtgatgcgctgatgccgactgagaacttagctgctggtcatctttacagatcaagtcacccctcaggattttgaatttttcattcagaaagttaggcaggggacaggggcagatatctctaaaattccttccatcttttgtattctgtactcaaaatgagtacaggatgctgttttgaaccaattagtgttttagacttgtctaaccttgaaaacattggacccaatagaaacatttaacctattcacagatatttaattcaggttgtatcagtatcaaggaatttttaactgagcgttttctggagctgaaactaagttaacttagtatcttgatcaatttatacatgtagttgaaaatgttcagatttttaaattatcttatggaatcattttaattagtatcactttttcatatttaaattgcataacgattttatttatcagtttttacatagattttactaattatcacttcctgtaactgtcagttttcattttatgcctattgccaaatccaattttccatttagccaatgttttattttgtgttaatattattcttgatacaagtacttttcattgtgaatggattttttaagatagtaattattattcctttttacaataatctgttggaaaattataagaatttcctctttaatattatatttaccctgttatctgagattggtctgttatggaaattggcaaacattttttaatggtccagatagtaaatagtgtatagttacacttttggtttttgtttgtttttgagacagggagtgcagtggtgcaatcgcagttccctgcagcctcaacctccttcccaggctcaagcagtcctcttacctcagcctcctgagtaactgggactattggcatgcaccaccttaccctgctgactttttaaactttttgtagagttgagtctctgtgttttgcccaggttggtctcgaactcctgagctcaagcagtcctcccacctcgacctcccaaagtgctgggatagcatatacttaggctttgcaaactgtgtacttcctgccaaaacaatccacctctgctgttgtagtgtgaaagcagccataggcaatatgtgaatgaatgactgtggctatgaactaacaaactttagacactgaaatctcatgttcatataaaaccatttttagctgatgggctgtacgaagaaggcggagctgaatttggttcatggactgtagtgctgtgttgcttatctggttcttgttgtgcttcttgtcattttacatgccttcactagccatccacaggccttggtgaggccaagcatgtggtggcattaaaatgtcctcagggtgaggatgtcaggtagttaccaaggataacttgtctttacatgtaccgtgatcttcacaaggatgggcataattattcccagtttacagatgacaaaacaggttattggaaataatagtagttaataattattgaagaacttaactatgtggcaggcacatagattatcacaaacccattaatacactgttaccaaagcaacttgttccaggtctcctacctagaatgtaacagaccctggaatcaagccgtacagtgtgtctccagagcccatgctcttcaccactgtatcactctgtgtgtaattctgctctgtggcacagaactatcaatacagtgcaaagatgtcatagcacataagtgatacacatctgtctctagtgagcgtagcctctgggttaaaaaacaaaaaccaaaaaaaacttttttcaccacagtctctgaaactgaatacccagtcattaacgtgatgtcaccagccaaccgcctgcatcctcctggctgtgcggtgtttgaatggccatagccacgggagctacattgcctgccctggtactaaaggatggactactgtgtctgcatccagtgtagtactgtaaggtgctgtgatgccacagcagccgttgccaaagaaatgtttaggtagatgcaattcttagttaagattataagatgcagaggatcgcctaaattaatttaattccaggctaattaaaaaatttcctgagggaagtaactgacgtgagagcagataagggcaagcatgcaggcacacagcatgctttcctggaaggtataagttgtaattgctccaagagatggcagaggtaggagtcctagttcagaggagcctggctccagccaatcagacatttcatagctctatgcacgtgtatgttttaagtagcgtgttaacctgatgctttcttctggtgtacagaaatatatgatcattgagacagaatgcgctaatgaagtcggggagctgaaaaccttcacatacatagaatgtagagcactgaactcacaggttgtcggaggcacacacacctgccttagaatggctttgcagtattccttgaaatgctgcatctgggaaatgatgtgtggatggtttgctagctggaggctggtttgttaattagaagtgtatctgaccaatggcatgagatcttattgcttaaacgaacaagatggcggagactttactccctttgaatggtccagcaaaggctatttcctgtcagcagtagcatctcatgcaagaagattacagttgctgaagcccacaaggcaactgagtatggagaattcctcaaaattgtatgttgtgtatatttgggcagactggttaaagcatgaagagagctattgctactgttaaagtatgtgtctgtgctatcaaaagtatactccctgaggctgaggctgcaatgcagtgagctgtgatcacaccactgcactccagcctaggcgacagagtgagaccctgtctcaaaaaaaaaaaaaaaaaaaaaaggtgtactccctggtaggagaaccagggaaaagcagctacaaacaagagcagattaacatggtgcagaaaaggcatgttctgcttcctcttgtcccttttctttgcttgatttctagagttagattttatcatttcactctttaatctgtttcttattttctaaacacccgtaatatattagattctctgattatatcaaaaacgtggtctccatcctctggatttcctcactaaaactggacgtggcttcctttgtgcagtagcttttttgtgagtactaaaaggtggcactggtatgagagcctgggagattaaaaaatagatatatgaagattctatataagcttaactttttcctttctcttttttactatcagtcactttacagctaaactaggagcctacttactctttattgactcgtgtagttacctgtgcttcagtctagatgtgtacaccatgtaccccttggaacttccttctgtggccgcttgctggcgctctgctgttcccccatgagtatcagtccgttctgtcaaatgctagggtttgttctttgcgctcattccatttcccacttcccagtggggctgcccccctttgccactacccttcagaattgatctccagtccctgcttaatgatcctgtgttcggagcagagggaaacagagcacgtgggtccttcttccagagatgggtgttacatacacccaaagggtcgtctgactggagatccttaggctagtcatggtccaggttgtgtaatcttgaaacatcagccaccatttgtagtatctctggtgtttaccatgctgagcctctttcgtcatagtcaattgtatattttcaaataataaagctttgcttaagcgtccacaactatgaatattgaagtggtgatgaccgtcagagtttgtgttgtgctacacggcttaacgtttcgagagagagagaataattcaatcactgcatgggaggttttattctcaaataaaggaagttggtagagaaagccgtcttcctcatgtttgtttttcccaaatctttttttccacccaaagtctggattactcccaaggtgagagggttgatgtctggaaattgttaatccatgggatctattcatggtatataaaattttcagaaagaatttgccttttaaatatgatttcctgattgactatagcaaacataaatccaggaagtacaactctgtcagagcagccaggatccttcttagcttctcagatgtatgagattttttagtgcgtgtgtggagtggaagtaaagattcttcccgtgggcaggtcagaaggagagaggggagttaggagaagaaaggaagagaataataggacatagaaacaaaccaaagctgctagggtcggggaggcaggtatatacccctggctttcctggaattagctgctgtccccctgaaaaaccagctttattttagtttatagtactgagaggaagaagctagggaggcacccttttagtgccttctgtcctggtactgttttcattcttgaagtgctcttttatgatatacagaaacatttcctcatcctcttggtgatacaaagttcttgggccactattttcagagaaaactaagctgtactaagctggaaatattggctgagggccattttgctcagatctctcctcccatctggacttcgtgcccccgtgcattcttaaacaccaaatcacaaccatttctcacctgctgaagtgagaaacagttttctggctgtttccgatgttagcattaaagatcagatttctgtatgtgacttgcctttctccaatggaaaggtgcccatttctgatatttacacacagctacagatatatttatagtttctcttggatttcgggtaatagctaactcttcttccctgccacctgtaccctctcaggccatgttcttattaagcactctaatgagaagctacgtctaccacaggctctagacacatgatgagaccctcagtggctatagcctagctgtgagcactcagcagtagacttatatctgcatagtctgttgtgtttggtttgacgctagagttcaaataataaggtgactaactgcaaactgcctctgcctgctcccccagcccttccatgtacagacagacggacacacacacacacacacacacacacgtgcacgcacgccctcttatcctgaccttgaaatagctaccactcacagaagagtctcctccagagactggcctgtctttgggagcctttgtacagataaactatcaaatctcatagtgactagacagtcatacttggctcttttttgtagtcctatggactgagaaggagccggtaaatgtgttcctcttcagttcaggtcacatctttgacatgttcacatctttattatgttgttccttgtttgttgagatgctatcaaggtcaggaggtcccttttgttgaccctgggtaactccgcttgcctttcccctccactcccaatgccataggtgagaaaggagaagataaaatgtgattatgaggttattatactcttttgccccctaggcaacaagcgtattgttgtttttcagatccatccgtctagcagacatgtgataatgccaaaaggtggtgtcgtgcttgactgcagcagttacagcacgtgaggcaccaggcctcagagggtcagaagagagtgtgagttatcaatttcaatgtttatgtgttcacacgggcatgcagggagttaaaagccaccatttttccctgtgaccaactgcccgcctagcttttcctttgaaatccagcgtcagtccttgtagggctggcctgctcaaaaagtatgactgtctcttctccctcttttgcctcatgtttcttccacatgcctagatttttgcccctaatgtctcattcataaatctgtagccctggaactgtactgtacagtagggaagccattcagatatatatatatatatgtacttatacttaactcttccatttttcactaaaacacaatgagtgatttgtgtggggagccaagcctcaagccaagaactgaattcaaagtgttttctcgtctttgttaactcttaacagcaagaaagaattttggaacacatttctgctcctggaatttctgagtgcagcagtaagtggctttctgagtggctttcttgacttcttgattctggttatctcatcgactttcagcagccatcctttcagggcgcatactgtatgtacccttgattggctggcctgtaataatagcttctgtgcctcctagtagcattctcttcacttttcaccccatttctatgtgctgtcctcatctgtatatacatgttcacccacctggtggtgaatgacctggttttaatgtatcttacaaatttccgagtactaaagcaagtatagagatgcctacagtcttgacatccttttgtagcacatggagagacacatagatatgctcagccagagatgtccttcccttactagtaggcaagcccctaacagtctgttccctatgcactcccttagatttcgtttgagtagcattttttataatgcataaggtaaaagagatgttaactgaatgaagattgaataggcagaatgcagttagcagctctgtagttgagatttcaagatttattttattctgaacgctgttccatatctccttacagctttgaggacataatgttttctcttcatacctgaatccagaaataaaggatgttttgttttgttttgtttgctagagtggtaatgcatccttaaagaaaaattggcaacagatttgtgagctgtaaaactaagaagaaatgatcatttgttattttcaaaaatgattctcatgtttctttgcatttcaaaacctatagtcttttgtggttttcataggcacatttacactttgacagaccataaaaccctttcaatctgaaacctttggagagagtttctacttttagaaccagatatttctattagtagtgagatttctgattaacgtttattcatctcagtgactagtggtccctggacctgaactcctagtggtaactgaattatatgattttgtgaactccattctttcacaaaatagctgtgtttaaataagaacataacacattgctccaaacctttgtgacaaggcttgacacactatccttcattttcctgaccctgaagtacattattgactaagaagatatcttagttattgagggtaaagactttgaggcagaattaatgaattttattttctcgcatcttttacttttcagagtttagctctccgctggggcctctggataagaatgccattctaagatgataatatttatggaaagttaatctgttattctgggattttcttaatgtagtctatgttgagagacagcagtacaatgacagtccaataagaaatcaaaactaccactaacatttatgcagttaatatatggacagttgaacctgcctctgaagacttcagcaggtaaaaagaacaaaaagattttgtagccacttcagggctctgagctagccacagaagaatcgtagtagatataaaaataatttgccaggaagacaataagtcatcaataaatgttagctttaaaaaaatggcatctttcgggctgggtgcagtggctcaggcctgttatcctagcactttgggaagctgagacaggaggatcacatgagcccaggagttaaagaccagcctaggcaatattgtgagaccctttctctacaataaatttaaaaaattagccgggtatggtggtgcatgcctatagtcccagctactttgggggctaaggtaggagaatcgctgagcccaggtggctgaggcttcagtgagctgtgattgcatcactgcactccagtctgggtgacaaagcgagaccttgtctcaatttaaaaaaaaatatatatatatatataaaaaatgacatctttcaacggacaaaagattagtaccccatgagaaaataccttaagccccaaataatattcagtacctgttcatctaggctttatgaggaggctgtgttatgcctctcggaatggttcttagagtaactatctggcacagaggcagtagagtgggaagagaagagcctactggacagacgcttcactctgcacatttcttccaggtattgaagtcacatggcccaagaaagtgtgtttggatctcatagatgagtgagttgcagaagtggaatgctgtagaatcttctgttactatttgtattgaatgatacaggaacaacttacctgtcttcctaaagaccatcagttatccaacctcactgaagtggaaactaggttaaaacaaacacctttggaagattactggtcttgtcactatgccatgaaatgctggcctctgaagcctgtttgagaatctaatacataaacaaataaattcttacaagaagaaacaaagctcttagtacttaaccaaaaatgtctcatccctttttataatttaaatttcctcaacaattttgtaaatgtagcattggggccataatgacgttttggcatcatatttggtacaagcaaatatcatgacgagttcattttttaacttcttttttcctagtgcagaaaagtatatttaagtacagttcattatagctgtacaaccaatttggcctgaccacatatctgatgatttttagtaggaccccttgccaatgtattgaggtcgcatgtggaaaaaagttataacttacgggtcctgtaaggcattctctttctacttggcaaatgtccctcttccctcttgagattaggcagtggcagttctaccttgtgggaaacacagtttcttttctaagtggactgctcaaattagatagggagaaaagggaagagataagggcatttcccacatgattgacatggttcatgtgttccgagaggcttaagtagtttttttacagatagatttggggactatactagttgggcagtttcatatgctttcacaatgatacatattttgggagtatttgtggtattttgatacctctatacaatgtaaatgatcaaatcagagtaatccatcacttcaaacatttatcttttctttgtaaaatgagtttttatcccggataaacaatttagaatttcattcttttttaagttttctttctttctctttttttttttttttttttccttgagacagagtcttgctctgtcgcccaggctggagtgcagtggtgccatctcggctcactgcaagctccgcctcctgggttcacgccattctcctgcctcagcctcccgagtagctgggactacagacgcccgccaccacgcccggctaattttttttgtatttttagtagagacggggtttcaccgtgttagccaggatggtctcgatctcctgacctcgtgatctgccctccttggcctcccaaagtgctgcgattacaggtgtgagccaccgcgcccggccttttttttttttttttaatagagacagagtcttgctatgttgctcaggctggtctcaaactcctggccttaagcaatccccctgcctcagccttttgtgtgtgtgtgtgtgtgtgtgtgtgtgtgtgtgtgtgtgtgtgtgtgtgtgtgtgtgtgtgtgtgtgatggagtctcactctgtcgcccaggctggagtgcagtggtgtgatctcagctcactgcaacctccacctcccaggttcaagcaattcttaatgcctcagcctactgagtagctgagactacaggtgcgcaccacacccagctacttttcatatttttagtagagacaaggtttcactgtgttggccagactgctctcgaactcctgtccccaagtgatccacccaccttgccctcccaaagtgctggaattacaggcatgagccaccacacctgacctcagccttattttttaagttttcgattggactctgaaatttttcagaataccagatgccatcatgtttatttaatcaattagccatcagcataaaatgcatttaaatctgtttgaaaattttttttttttttgagacagatcttgctgcaatgcccagcctggagtgcaatggtgcgatctcggctcactgcaacctccccttttcaggttcaagcaattctcctgccccagcctcccaagtagctgggattacaggcatgcgccaccatgcctggctgatttttgtatttttttagtagagatggggtttcaccgtattggccaggctggtctcgaactcctgaccttaagtgatctacccgcctcagcctcccaaagtgctgggattacaggcatgagccaccgtgcccggctgaaattgattgtttattaagaataaggatctaaaaagtcagcatccgcagtcatagtggttgtaggagtgagctaataatatctttttaaattctgttttactataaggaatttgaccttctcaatatgaccatttatcacattgccccctttcttcgtggtcatacttttttctgccagttttgtcagtcaaaagtaattacctaagataagcagctctttcagcctttgcagcccagatgtggcatttgtgatggcagctctatacccacaaacatgcgcgtgtgcaccaaaagaatgggaataaattgcacaaatccagtgaaaatcccaaaggtgatttttttaaatcaatgtattcatgaaagaagatagagaaaaccaagcttttaaaaaatgaggaatgaaatagggatatgttacttggcatcatgggggtgtagtaacagaaccgtgatgagacggtttcgtcattggcgcacagagtgtgcttgcatttaaagtaattttacctttgaagactgcacctggaatcctttgtaaattttccacaatgagtatactttttgttgttgttgttgttttgagacagagtctcactctgtcgccctggctggagtgcagtggtgtgatctctgctcactgcagcctccgcttcccgggttcaagcgattctccggcctcagcctcccacatagctgggattacaggcgcacgccaccatgcccgactaatttttgtatttttagtagagacagggtttcaccatgttggccaggctgctctcaaaatcctgacctcacgtcatctgcccaccttggcctcccaaagtgctgagtttacaggcatgatccaccatgcccgaccacaagtatacatgtatgcccagaaataaaatacaatatttttgaaaagttggtattgtttgcaaaaaactatccagctcccccactctaaattctctacttgattgaaacactgtcttccttctgtgactggctgtgttgacatgcctgtcataggtaggaaattccagcccagaactggtaccgtaaacctgctgattaggagtctcttacagagcccagcagccttccacagcagaactttggtgtttatcgtttatccttagagagagagagagaattttaaaaacaaaagtaatgctaaattgattaattttctctggtttgtctagccaggctccagcttctgtgtaatatactgtataggcctaaactgaactctgatctttttagcaagctgaagattgttttagccactaagcccttgctctttattctcttttaattatttcctggaaatagtattagaaacaaaggaaatgtgctatatgtattatgcagccatgaaaaacatagtttcggtcatatataatgtagtgaacagtactgacaatataatgttaaatagataatgtatcaagcaaaatgtgaggtgtgatactgttagaagctgatttatataaatttattaaaagacttggcaggaaaatttccaaaatgttacaaatgattacttcttttttatttttttttatttttttgagacagtctcgctctatcgctcaggctggagtgcagtggtgtgatctcggctcactgcaagctccacctcccgggttcacaccattctcctgcctctgcctcccgagtagctgggactacaggcacccgcccagttaattttttgtatttttagtggaaacggggtttcaccatgttagccaggatggtctcgatctcctgatctcatgatctgccctcctcagcctcccaaagtgctggtattacaggcgtgagccaccacacccggccaaataattacttcttgatggaagtgtatgcaaaagtcttatttcctttatatttttcttttttcccccaattttttggagtaaaatatatattgttttcataataaaaacataaaactttatttcttaaaaaaactcttgttgaaaaagaaataaaggaacgtggcaggagcagtcctctgagggggtccaaggaggaatcagtgttactgtggaaagtaataccaggccttgcttctgttgacttgaagattattgagctcccaattcattagttaggccagaggtgtcctgttcatgaaaattgccaggccggtgacatgcaacaggtgcagacctgctgtgtgagccctgggaacacactgagatctgccagcgttttggcggtgcttcgcagtgctcacagctgctgtgtgtcaagcaggggctgctctaatgcttcagtgttctgtgatggtgaggtctggccccactctcttcctcagcactccaggctttgaccagctaccaaatacctggccagactattgtcacgagagctgccaaatgaaatcctggggcaggagtcatcagtcatttagtgtgcttccagaaggaatcaaaggagtagctgttcaagcaggggaaaggaatgagaaaagaaaaaacgtagagcaagtctgttacttaagaaaaacacagaaccaatgttacaactaagaatttcagagtccttggctgtgagtcaggtgtttggtgttatatagggatttatcagtcactggttcagaagaatatcggataacctctgtgaaataaatgagaagagcataagccaggatgagacagaattcgtaatgagttccctcatcacatctcttggccaagaaaaacatgcactttctccagaggcagaatttttcttccattctaggaggtggaggaacacttggagtatatgtagtccaggctttcagatgagcagtttcactagcagttttttgtaatctactcataaataagtgaaaagagaaactgtgaggtaactggagtctttctgtatcaggaatagcatctctgtaaaaacaagttagtcctgtgcttaattcctgcctcgatacagagctgtccgtctggtgtgaatatatgaagccagcgttctcttcctgtctcccagaagggcggctgcgtgtgacagcgtaaatgtgtgacagtatgtgaaaatgtttctgtaatcctgaagatttcagtagtgattagaagagctttagtctttggtcaattttctttgacttggaaagcataaagaatatttgaacctctcatttcagactgaccttgactttcctcattttattttattttattttatttttttgccttagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcaggtgagcctctcactcaaactttgaaaagagcctgtgaaaatccagttgctgtgtaggttgatgcagtgggggctaccttggggaatccagttgccgtgtagttgatgcagtgggggctaccttggggaatcccgttgctgtgtaggttcatgcagtgggagctaccttggggaattccatgtttagattcaagatttggggggtggggaggggtttccagatataatttttaaactgatttttaattgattttttactgttttatttttttaattcaccaattaaaaatgtatgtttctcatgtacaacatgtaattttgaaatatgtatacattgtggaatggctaaatagagctaacatatacattccctcacatactttccatttttgtgtgtgtgtggtgaaaacactttaaaatctactctcagcaatacattattattaagtatagtcagcatgttgtacagtagatttttttttttttttttttttttttgagatgaagtcttgctctgttgcccaggctggagtgcaatggtatgatctcagctcactgcaacttccacctcccaggttcaagccattctcctgcctcagccttccgggtagctgggactacaggcgcgtgccaacatgcccggctagttttttgtgttttcagtagagatggggtttcaccaagctggcgaggctggtctcgaactcctgacctcaagtgatcctcccaccttggcctcccaaggtgctgggattacaggcgtgattcaccgcgcccggccagttgtacgctagatctcctgaaggtaatcctcctgtctagttgatattttgtaactttcagcaacatctttccagcccctggtaaccaccattttcctcttcgattcaagtttcttggcaatgaatagtcttgaacagatatttggaattaccttttgaaggaagtacgattcttggctcagtgtaacttactcaagtatccgaaagggctgatttataagggagaaggctaaggacgatctgttaacattgccatcggttattccatgaagcggtagccactgaaggaaagtctgagtagtttaggttaatcccatgtcttagaccattcaggtagctaaaacaaagtaacacagacagggtggcttataagcagcagacatttattgctttctgttctggaggctggaagtcccagatcagggccccagcatggttggtttctggttccttgtgtcctgtcgcatgctgctgacctcatgacctaatcacctcccaaaggcccacctcctaataccatcacgttgggggttgggatttcaccatatgaattgaggggaggagggtaaacattccatctatagtactccctagacgacattttctgtttactgtcacttgtaaaaatccagtgattctcttttttacatgttgtgatttttaatgcagtaaaagacagggtaaggctagcctggagacaaaaaatcaggaataaaagaaacagaagacaggatgagaacaggcatacagtacagacatggaaagtgaaggaaagaaaaagtgaataaacattgagacatagaaacagaaaaagagaaaaataggtcagtttttgaaatattaacttaaagctccttttgctcctagtttactgatagaagtcagtgatattccttaccccctatagattcaatcataccaacagaaggctaaagaaaggcacaggtggtgtaaacttactaaaactcttcatcagaactttgaagctacttactatttctagctaaatactttctatttcttaaatattgtttgtttactcgtgtgtgaaggtaaattgtatttaatacagaacttcctgtggtgtgatattaaagatgacagtgaaaacccgcaagtcaagaaatgcaaactggtgagccttagagctgtacttactttcccgtgatgtggatgttgcctaataatacacggacatatttcacagcctaactagttacccatcatttatttgatgtgtgaagacaaggccaacttctcaaatttagcgtgttgacataggaattttaatctctttctttcttgaaagaggaaaaaaatgtaacgaacagtattaaattcagcgaggtgctgtggctcacacctgtagtcccagctactcaggaggctgaggcaggaggattgcttgagcccaggagttcaaggttacagtaagctatgattgtgccactgtgctccagcctgggtggtgacaaagtgagaccctgtctctaaaacgaaaaaaaaaaaaaggacagtattaaattcaattcctaatagctctttttgatattgataaccatatactaaaaatgtaatggaaataaatacatacacaactacagtgcaaccaaaagcccattggaaacaaggcacatggctattcattttagagacttttgcttcagaattttgcagaaaaacgatgcttcttaaaagcagtgctactgggcacagtggctcccacctgtaatcccggcattttgggaggctgaggtgggagaatcccttgagcccaggagttcaaaaccagcctgggcaacatagagagacctcgtctttaaaaataattaaaattatccagacatggtgtcacacgcctgtagtcccagctgctcaggtagttaaggtgggaggatggcttgatcccgggcagtcgtggctacaatgagctgagatcgtgccactgtactccagcctgggtggcagagtgagaccccgtctcaaaaacaaacaaacagcaacaacaacaacaaaaaaaaaaaaacccagtgcttattaatgtattaaagtttaactggcattaaattattcctttgtaaaacagtttgtctttgttttgtttttgtttttgtttttgtttttgtttttgttttggagacagagtctcgctctgtcacccaggctggagtgcagtggcacgatctcagctcactgcaagctccacctctcaggttcaagcaattctcgtgcctcagcctcccgaacagttggaactacaggcgcgcgccaccgtgcccagctgattttttgtattttagtagagatggggtttcaccatgttgcccagtctggtctcgaactcctgagctcaggcagacggcctgccttggcctcccaaagtgctaggattacaggaatgagtgaccatgcctgcccagcttgtctttgaaatggaaaagatatttttgctcagtcctgtattttcaatatgcctagatggacttaactcagtcttaccaaggggaaaaaaaaatcttcagagtgataccaagatagaaaatttcaaactgatttttcagcaagttttgagtgaatgaaacctgattaatagacttcccattgcagattgtgttacagtcaagctactgcactcatccaaacaattgtgctcacacacatgacttccgttaatattgtcatgtttccctttaattgagaatgtacttcagttactgaagttactgtttgaggtgtgtgaaattgtattctccccaacagtccctgcgaaacgagagacctgggtcatctacagaggaatacagtaactaacaacccctactataagcttcttcatagcttctaaaggttggtggagaaaccaacccatttcgtgcttccttaccccaagtaagaatttaaggaagtaatgtaggctgtctaacaatacaaaatgacttgcctatgaaagtattgtgatcagagtttgacttcagctttaacggccaagaaacagaagatgtgagtcactgccaaatatgcatattggtttattttgtgtgcgtgttttgtttatagttttgtagttttgtttttgtgatgcagagccttctgctcctgacatttgcatttttcacctcatatctccaatgcatttcactgccaccatgctgccaccaacaccaccgccatgaggacaggacaagaactttgtctttttcaatgctagggcagtgcagaagggaaatgcagggtcagagcccctacacagtccccactggggcactgcctagtggagctctgagaagaaggccaccatcctccagaccccagaacagtagatccaccgctggtttgcaccttgcgccgggaaaagctgtaggcactcagttgtcagcccatgaaagcagctggaaggggcctgtgccctgcagagccacaggggcagagctgcccacggccctgagagcccacctcttgcatcagcgtgacctggatgtgagacgtggagttaaaggagatcattctggaactttaaggtttaatgactgccctattggatttcagacttgcctggggcctgtagtctcttcgttttggccaatttctcccatttggagtaggtgtatttacccaatgcctgtaccctcattgtatctaggaagtaactaacttgcttttgattttacaggcttataggcagaagggacttgcctcgccttatatgagactttggacttggacttttgggttaatgctgggggcctgttgggaaggcatgattgtgttttgaaatgtgaggacatgagatttgggaggggccggggcagaatggtatggtttggctgtgtccccacccaaatctcatcttaaattgtagttcccatcatccccacgtgtcatgggaggcacccagtgggaggtaatagaatcatggaggttgttacccaccatgctgttctcatgatagtgggtggcttctcatgagatttgatggctttataagggtcctttccgcctttgcctggcacttctgtctcctgccaccatgattgtaagtttcctgaggcctccccagccatgcagaagtgtgagtcaattaaacctctttaataattacccagtctcgggtatttcttcatagcagcgtgagaatgggctgacacactatgtctttctatttaaggtgggtttcttgtagagaacatatatcaaatcagtaattgtcttctgattgaagtgtttagaatatttgcacctgatataattattgacacagtaaagttaaacctatcatctttatatttatttgtttcatctatttttttcctctgtttttgttttcttttaaagtaatttttttttgttattttattttatttccactagtggcttaaagctcaactccccaccccttttaagtgattactctgtggtttacagtgtacagttttaccttatcatagtcaaattttgaaaatatagtataccacttcaggtatagtattggaatctgccaatagtatacttctatttcctttgtctcaaactttatgctatcattggcatacattttattcctccatatattataaaagccatagtacattgttactgtttttgctttaaatcagttatctttttttattgtttattgtgctaaaacatacacaacataaattttaccatcttaaaaatttttacgtgcacagttcagtgttatattcataacgtaaactatcaccaccatctatctctgtagctcttttcatcttgcagaactgaaacgccatacctgttaaacagtaactccccattctcccttgccccatattccatctgccttctgattttactcctgtaagggtttcgtataaatggaatcaggcagtatttgtcgttttgtgactgacgtatttcatgtagcaaggttcgtctgtgttgcaccttgtttaaggaaatgctgtgtcagaatttcgttcctttttaaggctactgttttatataccacattttccttattcattcctccattgatgaacactcgggttgcttccacattttagctctcatgaatagtgctaccgtgaacacgggtgtataaataccttttcgagactgtgctttccgttcttttggtataaaatcaaaagaagagaaattgctggactatgagttaaccctattttcaattttttgaggaaccaccgtactgttttccacagcggctgtaccaactgacattcccaccagcggtacacaagcgttccagtttctccatatcccggccaacacttgttattttgtagtctttcgtgtgttttttaaatagtagccaccctaatgggtgtaaggtggcatcacatagttttgatttgcatttccctaatgattcatgatgttgagcatctcttcatgtgcttattggccatttctgttttttctttggagaaatatctattcaagttctcagcctatttttaaatcaggttttctgttgttgttgttactgagttttagaagttctctacatagttagatagttatccctaatcagatatacgatttgcaaatattttctcccgttctgtggttatcttctcactgttactgtggtaatagtgtctttcgatgcacacatttttttattttcaggaagtcccatttgtctattttaatcatttatattttatagagattaagattataaaataatatttttctcatatgtttaccattttcaaaaatctttgttttttatctgtgtatgtctgaatttccatctgtcatcatattccttctctctaaagaacttactgaggctgagagcagtggctcatgcctgtaatcccagcacttttggaggccaaagcaggaggattgcttgaggccaggagttcaagactagcctggacaacggtgaagcccttatctctacaaaaatttaaatttaaatttaaaaaatttagctggatacagtggtgtgtgcctgcagtcccacctactcgggaggcccaggtgggaggatcactttagctcagcagttcaagattgcagtgagctatgatcacgccactgcactccaacctgggctgcagaatgagaccctgtctcagaaaattaaaaataaattaaaaataaattttaaaaaagaacttccttttaaatgtcttgtagtacacatctgctggtaattaattctatgttttatttgtatgagggagtgtatttttatcaacttccgttatggccagaattgtgtcccccctcccaaaattcctatgttgaagtcttaaccctcagtacctcaaagtgtgacgactatatttagagataagacctttaaagagataattaagttaaaatgaggccattagggtgaaccctaatccattgtaactgatatccttttaagagacacaccagggtacacacacacaggaaaataccacataagggcaaagcaagaaggtggccatctgtaagccaaggagagagaggcctcagaagaaatgaaacctgctaatactttgatgttggatttctggcttccagaactgtgagaaaattaacttctgttgtttaagccacccagactggtattttgttatggcagccctagaaaactgtacaccttgtttttgagatgttctctgggcacagatttcttggttgacagggattttttttttcctctttcttttaatacttttaagatgtggttccattttcttttggcttgtatagtttctgttgaggtctgctatattcatgtagctttgttttggggtgagtgggttggttggttggttgatataccatgttcttttttctcctgaggctttcaaaatattctctttatctttagttttcaaccatttgatgataatgtacctagttgtgtttttctgtatatctatcttgtttggaattctctgagcccctgctctggatctgtgttttgttgtctttcattaattttggaaaattcttggccattatctcttcagatatatcttctgcccacttctctcttctcctttgtaactaccattatgtatttgttagatcatttgatattgtcccatatctcttggatttctgttttgttttgttttctatattttcttattatacttgaagttttctgttattagtttggataatttatattgatctatacttaagttcactttctttttgtgtgtgtgtcataattttttattaaatgttaaatagtctaagtaaaaagaacagtggaaaccaaggtaaataaaacttatgtctggaaatatactttcctcttcttctgtcaggccattagcattggggactgaatcaaataactcactaattgagctgggtttgggcttctttccactctagttaccttcatggtgccacaggccttgagcttttcagtggtggattgccactttcatacgtttaatgtgagctctgtggtgccgatgtttctgtttcatgcttctctctcagctttcagcatgtccttcatgcctgcaccgcagagggcctctctccatgctcttgttcttctctaagcagtagactgttcttgttactcagtgaagactcagggtcgggcaggagtggcttcttcattttcctgctccagtcttggtcttggtacttctgtcccacccccagtgacagacaacatctcccccctactcagcacaggtctagactgtcggctgatttcctaccccttccccagtagcagcagacttctagtttgaatccattcataatttggggtcctactggactccctgtctccttcctggcaacagtttgcttttgcctaatgtcagcacaagaggtagggtagattttgtaccaattctctagcctaggaatagaggccatgaaggttgctgccctacccccagaagcacacagcttttcccttgttctaaaatgttgagcatggaaaatttggccttatgtcttctcacttccgggctttcttgatgtcaagctccctgtcattctgtgtccatgttgtgattgaagaaagcaatcttaaacatgcatattttaggagtcacaaaaaattatttgcagaggattccagaagaaagtttcctctgtgaaaaccttctcttaccattttttacattatatataatttctatttttgtccccaggcttttttctttattgtgtgtgattgtatcaaattaattttaatgaaatatttcaaacatttggaaaaatatggagattaatataacattacctttatacccagaattaacaaatattactttgtcttatcttcttcagatcctttttaatgctaaatatagtatgatattgtgatataataagaaatacacatttggtctcggtccctagttccttatacacagctcctgaaactcttggaatcccctgagtgatgcgtgtttgtttttttaatgctaatagatgactggtggctgggagctctggatggagactggttaccaagggaaccaaccctgtgatagatggttgggactctccagcccacaccccagcctctagagagaggaggggagctgcaggttgagttgattgcccgtggccaatgatgtaattaatcatgcctacttaatgaatcttccgtaacactctaaaggatagtgtccagatgggttccagatagccagccgaacacacggaggtgctggaggtgcccagagaggtcacggaagctccacacccctctccatgtgccttgccctgtgcatctcttcatctgccggttcatttgtgttatcctttgaaatatcctttgtaataaatgggtaaacatgagtaaagtgtttccccaagtcccataagccattctatcaaattaacctaatccgaggaagagatcctgagaactccggtttatagctggtcagtcagaagcacaggtcacaacctgtgattggcatctgaagctggagggtggatactgtgggactgagcccttaatctgtgaagtccgacactgtctccaggtaactagtgtcagaattaaattctaggacacccggttggcgtctgctggagaatctgggtcaggagagttgtgccgactctgtgagattaggaaaaacactttgttttttcctgcctctaataataattaaagtcttctttgtatctcttctcagctgtatttttcttttttcaactacagtggcacagccaccatcctaaattggtgtgcatttttacagtccatatttttagcgttttaatacatatatgtttccataaacaatgtacaatactgttgagtgtgatataaatttaaaatatatcgtctcatactacttaggctgtcagttcattattacttactgaactcaggccctctagtcatttgataatagaagaaaacatattcttgacatttttcagagagggtgattcttagaccatttttttaggggcctaagccctaaagaagccttctttaaaggaaatagattgaggtaatgtcaaggtggaacacaattatggtacgaagtgtcttgacccagcactaagaaaaaggttttattaaattcaggagttttttaaattgctgcgcaatagaaatacttatttttggagtgtggataatttgatacattcatatgctgtgtaaatataaataagaataattgggatatctgtcaccctaaatactttcctttcttaatgctaggaaccttgaaattctcttctaatcttcatacaatgtacaacagattaacattaactgtagtcaccctattgatctgtggaacactaggtcttacttctatctaactatattttaacccactaatcagcctctcttcagcacgccccaacccccttcctggcctctcaagttcagttttagatttcagcatcttctctgtttactttaggatgctcccgtatctgaccactgttacttagctttcagaatcgccgatcactgaaattccaggtccaggggttctgcactgcgcttagaatttctcctcatgtataagatgtgctggttgcaccgccaagccctgttgccgtctgtgggacaggaagccttgttagtgcctccatgaatccagcactgacattagctcacgtagaactaacatctactcagggagttgcgttagtggctcttaagaaactccatgaaaattgtgagaaaacttcaatgagaacgtttttgacaagtcgcctttcccttgtatataaatgcgaaccgtttttcattttcaaaatttcaaactttttcatagaactcaaggatttgagtcctgcttcctttgagaggggtaacagtgagttttacataaacactgtgtatgattttaaaaggcagtactgaacatgtgctacacattaattccttagtttcgaaagatgcgacggagtgggaaagttcgatatccacaggtgcagatattggaaagaccacactcaggtgtatgatctttctcatagctgcaagtgactgtgttcagctttccaatgaggtgaggaaacatttatgggcctcctatggctctcttattcattcaccactgtgctgtgtaacacaatttccctgcaacaataaacttcaactttgcaatttgtcaccagtgcaatggctcatgtagttataaagtgaacgtggtgaccaatttggggcgtaatattgttctgcagtcaaagtatcctaatttgaagaaattttatgtatcgtgattttacaccaactggccaaagtcagatagtctgattaaatagatttggttttggctaactatatgtagttaattctacacactttaaatattttggtttgcaggtattttttgaaggcttaagtatttggtttctgtttctttgggtttcctgtctgtagattctaccaagcgtatgttgttgaaataatgaattcagggccaccttacccctagctgcaatcttgtcaagttccagcagctgagtaaacttgggtcaggtcagatttgagacaccctatgaccaagaagatattatttctaaatatcttgtatacattgaagaacagccattattttatctcttcaaggtaattttcttatctagttcatgttatgttttttacttcttttgaattatataaaattggaagttatatttataatattgttgtaatgtgaggccaagggggagcacacatcagaagatggaataagcaagcagaagctcggatctgagtctcacagtactccagatgcagtgagtggttctggagctgtacttctcaaagagggtggcagctctcagagagggtggggccctcagaatcaccagaagaactgtgttctcttgcattcccatccccataattctaataatctagagaaaatgaagagagaaaaaataaggtgaagccaggagtgagctcgcaggcattgtcagagatttaattattgtcatgtgctacataacaatatttcagtcgatgacggaccccatgttccacagtgctcccgtaagatgataagaccatatttttactgtaccttgtctatgtttagatatgtttggatccagaaataccactgtgttccagttgcctacagtacgtagtacagtcacatgctgtacaggtttgtagcctaggagcaataggctgtaccagacaccctcggtgtgtagcagctataccacctaggtctgtgtaagtcagtctgtgatgttcccacaacaagacctcctgacgatgcatttctcagaatgtatccccaccattaagtgacatgtctgtagtatgcagtttatagtaccccacgatattaaaacagaaacagaaaaagaaattcctccctcatgggtcctcataaagaatctgatcgtaagcaacatcttcagcatccttccatatgtacagccgtgaggttcagaagacttctttttttaagaaacatctcagcaatataataaggccaaagttcatctcataaaaaccgttttctaggagaccgtaaatattgctactcaaatatctaatatattatttaatattgggaataaattttcaagtctttggaaagatttaggcagtactctctaaatattagttgtctcaaccatttttttatacattaagcagcaatatgtttaggatctagtctttgacagataccagaatgcagctattcagtgttcaagtatagagtcatacactttaaaagttaatcgaaaaaggaaaaaaaaaattagccaagtatggtggtgcatgcctgtggtcctagctacttgggtggctgaagtgggagggtcacttgagcccagcaggttgaggctgcagtgagccaagatagcaccactgccctccagcctgagccacagagcgagaccctgtctcaaaaaaagaaaaagaaaaagaaaaaaaagttagtcaatctgccccttccccttaatggtggctgaggaatcagctggcatggtcagtgaggctggtgccaagtgttcaactgatatagccaaaatgactggcaggacaaaggcactgggtttgaccagcatggttggcatatttggtagtggagctggtcctcaggatcatgccctgggcatttggcaggaccatggattctgctagcatagctggtgtgtttgtcatgctgagaccaagaagccagcccacatggccaacatttttgggaggcgagggctgaggattcagctagcatgagtggaaatagcaggccagggccaagaaagtggcccacatggttgagagactggttacataccaggagatcaagcaaatgagtaaatatattggagctaatatattgaggatagtgtgtttgttattataggagataagagtaccagatatagaaagagtaaagacaaatcctatcgtattggattgtttttagaggtattgatatgaattcatggtttttaacagataaatagatttagatttctctgtgtgtatgtgtgtttatatatgtgtatatgtgtatgtatacacatatacacatgtatgtattttcttttttttttttttttgagatggagtttcgctcttgttgcccaggctgaagtgcaatggcacgatcttggctcaccacaacctccacctcccaggttcaagtgattctcctgcctcagcctcccgagtaactgaatcggattacaggcatgcgccaccatgcccggctaattttgtatttttagtagagacagggttcctccatgttggtcaggctggtcttgagctcctgacctcaggtgacccacccaccttggcttcccaaagcatgtatgtattttctaaccttatctgctgaagggacctggaagcagtgacacccagtaacagagagctcacttactactcaaatgttggtctagatgccttttcccaccagaaggaaccagagctctttggggaaatgactgagtctagggctgtgtgtgggaaagcacgtgataatcccagaacagttttataccagaaagtaaggaagcattccaagagtggtggggatgtatcaaaacaacatggggaaaatcttgaggaattcgagcatcaaaataagtaaagatagtaacagattataacaactaatatagagagagtattgcctaaatctttccaaagacttgaaaatttatttcctatatcaaataatacattaggtttctgagtacttgggcagcaatatttaatttagggtctcctagaaaatggtttctatgaaatgaactttgacattatgatattgctgagattttttttaaaaaagaaatctctgaacctcatggctatatatatgaaaggatgctgaagatgttgcttacaattagactttttatgaggacccagggggagaaatttctttcagatctctggactagaaataatcaatattctattgaataaaatagaaatctttgagtctgtgatggtataaagaagtgaatgaatgaatgaatgaatgaatgaacaagtaaatgggggagaaaggaaaactccaccctgtggttgaatgccagcataatgtagacggaattatggaattagagaatctgcatttggcaccattatagtagtgactgatttaggcaggtatcatcaatgaatgtgaaaacaccaggtgaaggttgactaagaacagactatttgcatagactgaaagtatctcgtcaaacacacaaaaatgtatgtcagttaattagcacaaagtatttatagttaatttacattggaaaaatctgacacataccatctaaaccaagtgattaaggttagcatctccagtagtgggacacgtcaatgtgtgcctcttcatcataggcacagagaagaacacaggtggtactcttgccaaacaatcacctgaatttaacaccaggaaacatacatagagtgatatagatagagatacagataacgatacagatagagacagatgtgtatacacatgtatatttatcaagatagagaattaattaatgaatgatatgacaaatgtaaaatgttagcagttaaggaatccaggtgaaatttataccagaatagacttaaagatttctgttttattcagtgagttataatattttataatcatttatttcaatgctcaaattctccaagatgtttcccgcatccttctaatatatgcccactactcttggaaaacttccttactttctggtataagatgttcttttgaaattattttaaaataaaaagtttttaaaaacttaaatcagtaaactaggattaagattttaatcctcttgtgaaaattgagaggcacaggagtattgaaaatacaagtattagcctaaatagccaaccccaaggtaacacccacaggcagccgcaaaatggtgccgtggcaggtggagctttgtgtgggctgagtcggtgttaccccatgagcagtgctgccagttacaccaagctccacccatcgctgcaccattacaagaggtaaatacgtttgaatgcgacatccatttcattaccattacagtgtttaattgtaaacattacaagaaggcaggtttaagtttaacagaaagtgaaacttcctagatctctccacaaaaagaatgggcagccatatttgaaataagtccttttgactggagagaagctactcagttgggttataaaaaggattcaggattgcaagatgatttgagtcagcttgtttctaaggtggtggtggtggtgtttttctaaccctgattgtctattatctagtataacagggatgtataatagccccctcctcccagttttaggacagtatttgaatgtgacatcctaacttgaactccataaaaaataaattaggtaaaatagttgaaaaggggaagaaaggaggaatgaaaaatgaacaattgttttgaaaaggcagttttcataggataaagacttgcctaaacgatgaggaggccctttttttttttttttttttttttcatttttctagttccacttaggatagaccaagataatatattaaattacaaaagaaatattttagttaaacatagggaacagctgtctgactataaaactaagcaacatggaaaaaattcaaaagaatgttgtagaatttccttctggagagttttaaaaactaaggttgactccccatcacttagtgcccatcccaacctcaccatacttgtcaatattgtacccatttgatacagatcatctcatacaattagccatatggattatatatgaatatgagacatgtataacctgtatgttgaatgattgaatatttttgaaagtgcagctttcgtttttaaaacctttgtcgcccaggaattttagataaagccaacgtttttggctctaaaattgaactttgagccgggcacagtggctcacacttgtaatcccagcactttgggaggctgaggcaggcagatcacctgaggtcaggatttcgagaccagcctggccaatgtgggaaaatcctgtctctactaaaagtacaaaaattaacctggcgtggtggtgggcacctgtaatctcagctacttgggaggctgaggcaggagaatagcttgaacccaggaggcagaggttgcgtgagctgagattgcaccattgcactccagcctgggagacaagagcgaaactctgtctcaaaaaataataataataataaaataaaactgagcctttgtagcaatgggtggttgttttaagccttaataaagaaatgtgttttaattccagatattaaccaaaaggcacctaacatatattgctaaaactacccccaattcagcaggcatagagacataaaacactaaacttaagagaacaaaatggtaaataggactttatcaaactttaaacttctattcatcaacactgggaaaaaatattcactaaatacatacatacacacacaaaaacacatacacacatgacaaagtacttgtattgagaagatattttaaaagtcagtaacaaaagatatttaatagatatttagtatctattagatacttaaaacaacataagtttttaaatgggcagaagacttgaacagactctccaaatatacaaagtaagcacatgaataagtgtttatgcaaatgaaagccacaaagagatagtactacagtatcactaaaatagctaaaattaacaaaactgacagtaccaaatgctcgtgaagatatggagcaactggaactctgatacactgtgatgagagggtaaaatggcataatattttagaaaactgagaagcagtttcttatagatgtacatctatcctgtaacccagggatcctattcttactcaaaagaaatgaaagcatatgtccacaaaaagacttgtacaagagtgttcatagcagctttactggaaaaagtccaaaagtggaaacaacccaaatgtccattaacaggagaataggtatttttaaatgatcatatatcattaatggaatactactcagcaatagaaaagaatgaactactaatacaaacaactgaatcttcagaaacactgtgttaagcaaaagaagccagacacacacaaaaaattatgtactaaatgtattattccatttatatgacattcaggaacagaataaattatggtggtaaaaattagaacagtgattacttataggaattgactgaaagaggataaaacagaaccttctggggtaatgaaaatgtcctatattttgactggggagatggccatgtgggtagataaattcatcaaaattcattcagttgtacacctaaagatctgtacattttgttatatggcaacgtttaaaaaaaatactccgcctccagtctccttttgaactgtttgaagtagtacaactgataggcagattctgctaaaaagctaaaaatataatttttctctagagtacaaatttcttttttttttccaccgtaaatgccagcctcccatcagaggctgaaccacagtggaatcaactttcatcagccagcccctctgtggctcactgagctttggattccaggtccctttcccagcacttagtcccatttttaattttcaggaagtattgttccaaaacttggctcagacttatcctctccttggattcctttctccatttgttttctcggttttgctcacttactctttaacttgcacccctctttttccaaggtggtggattagggggtgttaatgctggggcagtgttaggcacagaacctaggagtcatctccctcactccgggaccgcatcaatcatcagtcacagacatgacagttcatttttccctcctgaacgcgcctgcacagatgggtgtatcgctcaagtagccaaatggatgtagctgttgggggacagggcctgaggggcagcagggagagaaaagaacaaagaaagaaagaagaatggttctttgtggggcagcaaactttcttctggttcccagcctgaatgtttctgatctggttttcttctttttgtgatgtttgaacttgtttcctcaactcagatgctgaactcttgtccaaaaaacctaagggcagcatagtgtgagagactgtgggaggcaagtccagcaatccagcaaaaagaattgcagaactgtgaagataaatgtgtgtccgtatcaggactgcgctggagaacgggaagagaggggttggggtgctaagactgtgtgtgtgtgtgtgtgtgtgtgtgtgtgtgtgtcttgacaaactgatgagaaacactattgagtagttttctcctctctgctctcacacacagtctggcactttcttcttctgtgacagctgccattaactttttaatgcgaagacaagggtatcttgccaattggatgttgaaatctctggcaaggaaaagcttgctttaaaaaaaaaagaggcagggaatatggggaaggttgggcagacataccaaaggtccgggggaagacagggtactaagttggaccttacaatgcagaatggctgccctgcttctgataaaatcccctcaaatgaagttgggaaaagaaagaggaaatgggagtgtgagtgtaagggagataaggaactcttttacgcagttgcaatgacacagatattaagtattatttgcaattcactcccgatggatgtgagaactcctcatggagttttggtgtatatgtgggaccttgtgctaaatgtagaataatcttgtttgtgcagaaagagaaggaaagagaaaatattaggagacctctgtagaccaaaacattatgatacaaaagattgttccagtcatttccttccatagcttatctcagagaaggggagttctggtgttcgtggctcgcctatcaggtcttcccctcacctctaaactacggcagctcttgatccttattactggtacctaccccaaactcaccaggtctaaataaaactgaacataaaaacatcctgttgtgaattcagttctcatgtaccttcagctttgcagcaaagaatgcaaaagccttttttttttttttttttttttttttgagacagagtttcgctccgttgcccaggctggagttcagtggagcgatctcagctcactgcaacctccccctcccgagttcaagcaattctcctgccctcaccctcccgagtagctgggactacaggtgtgcaccatgacgcccagctaatttttgtatttttagtaagagacagggtttcaccgtgttagccagggtggtctcgatctcttgacctcacgatctgcccacctcagcctcccaaagtgctgggattacaggcgtgagccacggtgcatggccacaaaagccttttttaatctagtttttattagcttggcctcacactggactctttaaaaaagagtcctaaaatatgaatatggaatattatatgaaatattttataaaaatattttataaaaagctcagcatttatggagatcttagtgtattttagctgccctaattgcttttttcctttgtgttgaacgtattcccatgggagaagaaagttcaccctcctgagtccctgagctcctgcaggaagaattatttaccatcctggaattttaatgagtcttgacaattactgtaatccaggtcattgaacgcgggtctgtcatcgccagtgtcatcttccagagatgatgctcccccaactaagctgagaagaaaatgagtccttgtgaatgccaaagagacatgaatgtgacctgcaccaatgctgcaaacctaaagccagtgggactagaaactgtggaaatgacagtcttccggtccggtcagagcatctgaaataaattgcccacagttttcttccaaacttttaaattgtttacaaaaggtttggtggtaccaatcttactgagacggcctagaaatacaagtaacgtaaatttcttacagagtgtctacaatgctgcatgccagaggcactcagcacacctgaaggatgtgaagctcctgtaggaacagtagctctgtacaacagtaatctctagacaaccaacgtaaatttaaacaaaaaggtgtgagaccacacacccttcttccagtggggcataactgcccaggtgtaaaatcagacaggaaccctgaaatatgaaccatctccagtttgcagacagacattgctgccattctccacttgactcccctgtgcccatgcctgaaagccccgcttcccctagagaggtgggggcagtgtggccacagcctctctccccgcagtaccacctggtcccaaaagtcccagccctccacggcagcactagtgaggcctccttgctgttgctgctgttactccctgagccttctagagaatctcctgcatgccctgtgagaatgtgctgatgctggggccactgccacagtcgcgggttttctcccagacccccttctggtgccaagtaggaaagatgggaccaggctaattctgttgccactgagacaagtgaagacatatcctgatgtctggagttggatctcagaaggcgccttccagtgtataaactgatatgaaatggtggttaggtcctgtggcactgcacaccaacactgtattaccttgctcgggacaccgtaacaaaataccacagaccgcgtggcttaagcaacgtaaattgatttcctcacagttctggaggctggaagtccgagatcaaggggtcggcagggttggtttctcctgaggccccctctccttggtgtatacatggctgcctgctcgctgtgtcctcacgtggtctatcctctctccctgtgctccccagtgtctttctgtatgtccagatttcctcctgttacaaagataccagtcatactggatttggaaccaccctgcctgcctcattttaacttaatcgcctctttaaaggccctgtctccaaatgcagtcacatcattctgaggttctggtgatttaggcttccacctatgaatttggtggggacacagctcagcccaccacagacattatgggtaaaataggctcatggcaacaacttccgaacctaactactgcttgggtaattgttaagggtttcaaaataactgactgtcaaacaagctctggaaactgcattccaaataaactgtggggctctgcctgttaaaaggtaggaggtcctggcgaatctgttatgtccagtaattactgaatactcccttaggggccattcagggtctgctggttacttcaataaagaatgctgtaagaaaagcactgagtctctggccctttctaaaagagttgtgtaagagacataaagccataaaatatgaagtaggtgcttgtttagcgactgaatgaaatcaggaattttccggagataagattatggtattcttctacactgtataaatgctatcttcctgctttgtttacctctttttatacaaaagaccacctaggcacaaaaggaagtgcccctacctagcatagtctgaacgagtgaaagagagtctttaattttaacactaaagataacagatcttgctgtaaagtgcaatgatgcttaatagccctaaagatcaggttgtgattgatgggatttctcatggtgttcttgttaaagataaatagtagtttttaatgttatcagactggaaacatcttactcttttctaatgtaagctctaaagcaaacttcggacactaacatcttattgccaacttaacagaaaagtgtgatgggatattggataaggctccgacctgcgtgcctgaaatttcagtggttcggtttgttcctttgaatgaggcatctctctgaggcactgcctttctaagtgcaagttttctaggaagggcagtgtgttgtcagtttctccttagcgtgcccagtgtatctaggatgatacaaacaggaagagactgggaaaaggagggttcaaaaaagggagggacccaatggccagattaaaaaccagcttaacctcttcattgtatcccaggcctgatgattgagcatctttattcttaggattctccaactttaggctacctgatacatctagagcagcggtccccaacgttttcggcaccggggactggtttcacagaaggcagtttttccacagacaggggagtggcagggaagggatggtttcaggataattgaagcacattacatttattgtgcactttatttctgttattattccattgtaatatataatgaaataattatacaattcaccataatgtagaatccatgggagcccagagcttgttttcctgcaactagactgtcccatttgggagtgatgggagacagtgatagattatcaggcattagattctcataaggagcacgcggcctagatccctcgcgtgcgtggttcacaatagggtttgcgctcatatgagaatctaatgcctcagctgatctgacaagagacggaactcaggcagtaatgcacgcaatggagagcggctgtaaatatagatgaagctttgcttcctggctagcccttcacctcctgctgtgtggcccagttcctaacagggcctggaccagtacacggacccagtactgggagttggagactcccgatctacagtatgtgagaaatcacatcaaccttttacaaggattgagcctaaatttgaaccaaaaaatacttacttctaaaagtaagtaagccacagatagatgtcagaatacaactagcaagaaggtaaagactcatggaaaagatggagtaatgagttttcttagcactgtatgatacgacagaaaagctgcagggggaaggcttcacgaaagcaaaaaactccaactagaaatagcctgcaggggccaggtgcagcgactcacgcctgtaatcccagcactttgggaggccaaggtgggtggatcacttgaggtcaggagttcaaggtcagcctggccaacatggtgaaacccatctctactaaaaatacaaaaattagcccagcattgtgttgcacacctgtagtcccagctacttggaaggctgaggcaggagaatcgctagaacccgggaggtggaggttgcagtgagctgagatcatgccactgcactccagcctgggcaacagagcaagaccccatcaaaaaagaaagacagaaaaagagagagagaggaaaggaaaggaggaagaaagaaaggagaaaagaaaggaaagaaagagcctgcaggctctcagggatcactgttctactgttattttataaggcaaaccagggatgagctgtatttagccacagattattaaatctggaaagaatttagaaatcatctaatctcccctttatacacataatgaagctgaggacagagaggctcaagatggtaaagctaagtggcagagttagaactagacatttcttccatttcagaccttttcccactacttccctgtgcaaccttgggaagaaagtcctcttagcctgtcagaggcatctctgtctgtaactgttctccctcacgaatgttaactcctctgcaggatgccacagggacatttgccttctagtgcaagcagagtgtttcaggaatgcataacagcagatagatacatgtctgtgctaggtgttgtgcactaaccaagcactatggatttcttgcagggagaaaaaggaagagtagataactaacaatatcttattaagagtctcctgcagggctgtgactccacgcagctctcttctccctgtcctgctggtgggagccttgagcccagctcttgagcactgtctggtgtggcaccctgcaggctgccagcagctgtcatacgggcattgggatcgttggaaagtgctgcaacatgggagtagctggggcagctgttgattgggagcagcctccacgggctgtgttcagtgggtgattccatgcctttggtctgtgtggagctcactctctcccttggctccttcggaggggtgggcccaccgccctctccagctgttttctcagaaagagaggcaaagaagaaggacctggcggtccttccagagtgcttgctgtggtgtgggcttcgcctcccctccgtgtgggaataaactgtgtgaagccatgtgggtcctggagctccgtggcttcacccacactttctgggggaactgcactcacaagtatggagagccttaagcattcgttgagccagactggactggaaacgtcccgggagtccctcattctcacccttcttcacctaagtaaacacacaacaaaattctctgagctttagggggctgtgggaatatttttctttcaaccccaaccttccccaagagctttcaaatcacataaagtactgttttccctttagcaatccaaaactagtaacatgcaactccaggccccaccccaccccacccccatcctcctcaatgccagccaagtcagacacaacttgccatgtccctgtggtgtgccatgaactgggcaggtatgccccggggtcactcagagcagcccacgggaccctagagctctggcagtcgtggaaccccttccatggcccttgtgagttacggggccaggagtttgtatcacatcaaagggtcatttcgtcatctcacaagggagtcaggagataccacccagagaatgtatcagatttatactaaaaaaaaaaaaaatccagcaagatccatagctctctgtgggagccattccagtttctccctgtcacagtggccctagaatcagataccacgcactggaaatagcagagtgcaaccctggacgtagagggtgcattgagcacgtgccactgtggctggggggaaacttccttctctcttcctgcctggcctgagagattgcctggacgtggatcaggctttgtgctggtttagcacttaaatcttaactgcaacaaagccttgttcttaccaccctgacagtttcagcattaggtttcttattagttgtttgggtttggggttttttttgttttttttttttcttcatcttctcccttttgacacttttcatttctgagagccaaaccaaatacgctaggcggactagctaacctggctgtgtctgcgattcccagagccctgctgctgctctgatgggtccctttggtaaggagggaaatttttctccatttttataacgacgagcccttaatttgaacgtctctgttcacttcagttaatagatttgtaagaaataatgtgagatattaccaaatcagcttagacaaccagattaaaaatctgcctcactgggaaatctgcttctttgtttagaatactccacactttctcaagcctgcatctgcaaatctttggcctgataaagacttccagagtccatccgtccatctcttgcttcaggactgtacttcgtccaagcattccacacagaagggtaactggcttgttctttgagtgggataccacgtcacagttcctttggtgttccagggacatttctatacaagagatggtcccctgttttcttagtgtatagaggctcatcagaccaatgtaaatctcctgttgagttttatttttttaattcccatttttgtcttttatagtcatgttttctgttctcttgccaaactcccgtgctattcagctcccttcccagcttgttcagaaaaggtataacacccacatcaagataaaacctgctgagcatggtggcacacacccgtagtcccagctgctcaggaggctgaggcaggaggatcgtttaaggccaagagttcaagacccacctgagcaacacagcgagaccctttctctaaaaaattagagaggtataacttttcaggaaagaggataatctggaaagttgctgtaggcacagactatcacgtagaaaaaactgaaattatctcagctagggaagaatgctttaggcaggaagacagccagaattttagaagtgtctagacataagtaagttagaaattaagatatgagtatgttggtgacatctgcgaatacaaaatataatcatcagaaagcaaacatttgttctggattttgtccagataacggtttaaaactgaagtgttgtatctattgtagtgcgtggttccagctcctgctgtacatgaggaggttaatttggagtgacaggtgttagcaacacgtgtttcttggtcctgtagattgccactgacccaattcatttgtccacctttgctggggttacttggtctctcagttgttgactttcacaaaataatggttgactctaaccttgcaaagaataataaacaactgtgagtggtgacagctggaagaggtctgacagctagcaagaccagattccttgtaaagctttcctctcaggtaggggagacttcctctttttctccatggagagcttgtgcacctggatgcagtagagcctgatccactaaccactggccaggcgtgatagatacatattaagttttcctacaacagatagatctatcagtctaacctgtgtacctggccctgtacctcttgagacctcagctgtcttacttgtaaggttagagaatgggactagtagttcctgtagctcccttccgggctgatgagtctaaatttcagaattggcctgttttgggtgtagcatttgtaggtctcgttgttccattgttgggtatttgcctgagctgcaggtcggggataggggacagggtagaaaactaaatgataatttatgtttttatatagattcactagaaatcttaactgttttatttcttttagggctgggggctgccagtgcagttgcagagttttcagtgccatagctgggaagcagagaagctcttgatttgtttttgttttgtttttaacctttgaaaatgaatggcagaaatatgtgatgacctaacattaaaaaatctaggccaagcacagtggctccccactataatcccagcactttgggaagccaaggtgggaggattgcttgaggccaggagttcaagaccagtctgggcaacatagtgagacctcctctctacaaaaaaaatttaaaattagtggggtgtgctggcatttcgctgtagtcccagccactcgggaagctgaggtgagagaatcacttcagcccaagaggtagagattgcagtgagccgtgatcacaccactgcactccagcctgggcaacagagtgtaaccctgtctcaaaagaaaaaaaaaaagagaagagaaaaggaaggaagggagaaagaaaaggaaaaaaggaaggaagggaaggagggaggaaggaagataaatctagctaccctaaggcatatggctagcattcactcagtaaatacttaatgaacacttattacatgccaggcataaagtgttgttgataatacaagaaagtaattacatacttgagtttccctcccatccagggaatctcatcttctatcatgagggaaagaaaggaggaagtccctttatatcaccacttgaatctggaggagatgactgtgaactatcaaattgttaagcagtggaattttgactttggatagacagacccgaatggagccaaactcttgttgttttttgtttgtttttctgagaaggagtctcactctgttgcccaggctggagtgcagtggtgcgatctcagctcactgcaacctccgcctcctgggttcaagcagttctcctgcctcagcttcctgagtagctaggattacaggcacgcaccaccatgcccagctaatttttgtatttttttaagtagagacagggtttcaccatgttgatcaggctggtcttgaactcctgacctcgtgatccacccaccttggcctcccaaagtgctgggattacaggtgtgagccactgcgcccggcccaaactctcgtttttattatgccattttgttcaaagttagttatgggagagcagtaacatcttatttacttttggtctaagcaacagcctttccttcctgtaaaaacaaattcatacattgcctggcaagggagttcatcacaaagtaggaaggggagctgggtgtgatggtgcgcacccgtagtcccggctactcagcggtctaaggcaggaagatcacttgagcccaggagttccaggctgcagtgagctgtgatctcgccaccgcactccagcctgggggacagagtgagactctatctcaaaaaaaaaaaaaaaaaaaaggacagggagggagaaggagaagtccccacagcagcctcacagccattaccacttccggcccacttgcacagtctctgcaagtgcagacttgaaaggaaagaggactttggagttaactttaatgagtgggaaataaacataggataaattcttcaagagcaattttagttttccctggtactaagtgctaaagggattctgtagagtcaagaagtgaccagatgcctgtagaaaaatagatccctgggcaaaaaagattgaggtttagagggattgtagagggttagagggattccagatccctctgactgtgtaagttttatgtcttattcaatagatgctcttacggcaaaatacatttccatttattccagttgtgtgaaattccaaactaggaagttattttatgtcttcgtatctcctaagaagcctgcagattcaagttaggggcttgtgggccagacctggccaggacgagcaccatttccacttgatctgtcagctccaaaaggctccgaacatcatgccagattacagctcagacctcatggcctgtgacacatcctgggacttagctgttagaacctcaagtttagattcttgtctgcttaaaccaaactaggcatttctgaataatttcctgccctccaccaaaccatctgcagaaaggaattaatctgagtcactgccaaccacagaggaattcattcactgacccctcttgtaaccgtcccttctttatacccatcaatacatcctccctttcacctcatgctttgtgactatgaatagagttgtttaccttgaaatcaggccaagtccacagaacttttaactgtattttctcttttacaaatttatttcacggagttctggtagctctctctaacatctttactagagagaaaatgttgtttctgttctaaaatcatgacttgtgctgagcggtaaatgtttggggcagtctccctgaatcaagcagcccgcccctcagctctgcttctctttctccattcagccccctcgcattccttattctttagactgtcagcttgttctctggcagttatcctaacactcaaagagggaagggggcctgagtggttttccctgtagccagtcgtaaccatgcttttgtctgccatatgcttggagagcctcatctctgaaatgttcccgctctgctgagcttcctccgttcgtttcttccctgcacagtggtagggtgaggcattctccccttccctctgctgcatacgcttccagcctgtgttgctttgagcattcagattgagttgctcttgcatttgtgattcttggctcaagtccctctagaaatcatattactactctgagttcagggagggctggaacagctactaagaacagaatgcattttaataacattcaacacacaaaaaagccagagaatttctgccagaggccaccttcgtatcctatacttgtcccgtattccatcccttaagaactttaaacacagtggagtgctacactgtatggtttatgtgccctgctgtctaccaaagggcctgtatcatcagattgttttggtttggacatgcttcaaatttgaacttaaatagctctttagaacattatcgaggcctttccccagaattaatatctattcctttatttcattcaccattttcagattgtctgctacgtgcaggccttttgttacgaggcaatattggtatacaaaaaagaattcaccaaggagcttgaagaacagttggggaattaaacataaaaccaactattgaaaggggacaaaatgaatactgtagcagtttacacttctaaccagggatggcattacagagaaaaggggctcaaccgtgaaggataagaaagatagagaagaaagatgtgtaggaagtaagattgtccacattctagaatgagaggaaaggaaaagcaaagacagggaatggcaggtatgtaccaggagatgaaattgaagcagtagctcccatgccaaaaagcttagtcttttattttgtaggaaggaaatcatttaagatgttggaagaggaggagggaactgttccagcctattttagaaagattactcttacaccagggttgaagtagttatgaagctattgcaagatggtagaacatgagagcttgaattaggattgttaacaaggatatcggaaatgaaaaaactaggctagatgtggtggctcacacctgtaatttcaacattatgggaggctgaagtgggaggattgcttaaggccaggagttgaagagcagcctgggcaacatagtgagatgtcatctctttaaaaaaaaaaaaaaggctgggcaaggtgactcatgcctgtaatcccagcactttgggaggccgaggtgggtggatcacacggtcaggagatcgagaccatcctggctaacacagtgaaaccccgtctctactaaaaatattttaaaaattagcctggggccacctgtggtcccagctactcaggaggctgaggcaggagaatggcatgaacccgggaggcagagattgcaatgagctgagatcacgccactacactccagccagggcgacggagcaagactccatctcaaaaaaaaaaaaaaacttagccaggcgtggtggcactctcctgtagccctagctactcgggaagctgatgcaggaggatcacttgaggccaggagttagaggttacagtgagctatgatcactccactgaactccagcctgggcaacagagcaagactctttctcttcaaaagaaaaaaaagaaagaaaaaactaaattagaagaaacatgatctggaaagagcattaataggaaactcacagaagaagtggccaataaatatatattttttaatgttttaccccagtttttggcttcactacagatgggaagaactacgaatgaaaacagtgctgtcatactgggaaggttgggattggttggtttgttggagtccccagtatgttcagagagtgggaaaatggcacccttatttcttgcttatgggctgaatatcagtacagctattctagaatggtctggttacttgtcaaaagctttacacaggtctataccctttgactcgggaattttaagtagaaaatcatagacatgcaaagatttatgtatgggaaaatgtaatacattaatatttatagtaatgaaaacgagaacaaactaaatgtctattggagttaaataaattacaatatattaataaaatggattacaatgcagcccattataaattattttagaagaatattttatcacatgaaaagctgtttaattattgggtgaaaagaacaattcagtaaatagtatgaacagtatgatttgatgtgtaaagggaacattcaccaagagatgtttatcaggcactggaaagatgtgagtctgaaactcagtagaaaaagaagctagagttataattgtgtagatccaccttcataatggttatgtttagatgagggacatagaagagttattatgctagttattatacatgtgatattttctgtgattaaaaaaaaatttaaagaacacctacctcaaaagaaataaatttgaaagaaagtggattaaatgtgttaatcactaaagcacttagaataatacttggcccataataaatgcccagtaagttagttgctgttattatcaccctccccccttttaaagctaaaggtaaacacatttcgctaagcagaggatctaagagagaacagtggacagtctccttagacctcaggaaacccctgcacgtgtgagactgagcagaaagaagaacaacaccaggacagggaagaaatgttggggcaggcagaggagagccagaaacatgtgggtgttgggggcctctagggcagacagcctagcaggtgttttcagggtcagattggatcgtacagttagataatccttgggggtccttgatgggtttttttctgaagttttgaaattataacttgcatacagaaaagtaaacaaatcctatgtatatagctgaattacacactcatatagcaaattcttggaacaagcagcagaatgttaccagtgccgaagccccttgtcatcctccttccagtcactcctcatcctccaaggataacctgacctcaaacaccacagattagttctgcctgtttttaaactttctatgcctggaatcataccatactctattgtgtctggattctgtcattcaacatcatgtttacgaattgtatctgttttgttatacatatagttcattcattctcattgctctatgatattccattgtatgaatgtgccacaaattgtttatcgtctgtttatcattcagtatggacatttgggttgttcccaggttttaatactcttatcagtgtcttcaggtgaatttacatgtacctacaagtccacttgttcagcttggcattcaactttagtagatactgccagatgtttttctaaagtggttatggccatttacactcccaccgggagtgtaggagaggccaagtggttccacgtccttgtcagcacttgatactgtctgtctttttaaattttagccattctggtggtcatttagtggtatctccttgtgattttaacttgtattttcctgatgactaatgagttatccacctttttatatgtctgttaaccatttcagtatactcttgtggtcattcaagtgtcttgcctatttttcattattaactgttgttactgctttataggagttctttatatattatggatatgcatacatcagatatgtatcttctcctgtggactgccctttcactctcttaatggtgtcttttaagagacagaaatccggccgggcgcggtggctcacgcctgtaatcccagcactttgggaggccgaggcgggtggatcacgaggtcaggagatcgagaccatcctggctaacacggtgaaaccccgtctctactaaaaatacaaaaaactagccgggcgtggtggcgagcgcctgtagtcccagctacttggctgaggcaggaggatggtgtgaacccgggatgtggagcttgcagtgagccaagatcgcaccactgcactccagcctgagcgacagagtgagactctgtctcaataaaaaaaagagagagagagagagagacagaaatccttaattttaatgtagatccagtttatcaattttttctctttgtgattattgctttttgtgttctgtttaagaaatctttacattccctaaagatggtctcttacattttcttgtaaatgctttattgttttacccttcacatttatatatgtattcatcatgaattgatttttgttaatggcatgaggtagaaatccaaatgtgttttgcatatagccccaccatttatcagaaagaccatcttttcccagtgcacagtcaagtggccatatacgtgtagggtttttccgtgttctcttttcgtcccattggtctgtgtgtctgctctcgtgccagtgctatgtgtgtgcattgctgccgccttgcagtgacagccttcttccagagaggagcatttgtatagctttgttcttggtggccgtcttggctgttctgggctctctgcatttccacttactctttggaatcagctcgtctattcacatacacacctgccagttttgatatggcttgcatcgactgtatagattagttgaggcagaattcacacctttacagaaatgaggcttccaatccttaatcatgtttattcctccatttaagacattttaacttctccaaatattttatggtttcaatatagaggcttctgtaatctttcgagagggcaatttcagtgaaatagcagaaactaaattctcagttattaaggagagaactcagaaatgcaggtaacacatgtagactattcttttgagaaatttggttacaggaagagaaaagttgctactagcttgtgagatgcagattccaaaagtcttttcaggacgggcaggattcagtgccctcagaagccatagtgaaaaaccaagggaggggttggaaacagagttcactgaagggacagagacatggagagttagctcaggagtgtgggtgctcctgaggcgtgtggaaccctgctcgcctggagaagccaggtggggtcactctgaggcaggacggatccagactccccgggtgcccacgtagtcaacagcacggagctgtcgtgagccgtgccctttgcactgagagcagcagcaagccctgctgccctcacgcctgtcctcatccacacctctaagcccctggaatacagcacatgttattttaacaaagcatgttccattttctctaccgaaggtgtatacttgtacatgtgtcattccaacagtcctttcctccagagtatcttggttaaagtaaggtttggtggaaaggggctttttttttttttttaaataaaatcttgcagtgcccaggaggcttgaggaatattttgtagtagaaatactatatatggaggaaactaaggtgctgagatatgagacttcgtgcttaagttatagaaagggctggcagaattcatgggagcaaacttgttttgcagtttagtgaaaatcggtttactctggaagtgtttttcgatgttttgttattgtttgtttttagatacaaggttttcagcacacgcacagaagatggcatctgcacatctagggagctgattgggtaaacttcagtgctgcccgtaattatggtgtttctaagaaagtaaccaagaagccagtatttttcactgtaatagttgcagtggtgggattacttgccagtattagaaaatggagaatgggaaatggaaaatctcattggattactcctccttacattactgcgtttggatttgtagtcttaacaaggcaataaatggaaggggaaagaaggaatcaattcatggtaactagaatgtaatgagcactttcattaagtcacaatttaatttgtattctttcggaaattcttttctggttttaagcctaaaggggcctgccttgaggaggtgaggaagataagcaggtgtgggagggggtgtgggtagtgggcagggggttgaagagagcaagaatatctcgagtaataccttttaggggaagtttcagacactaaaatacatctttcccaacttatccacagaatccgttgcatcccaaagccatggaaaaactgccttttttcatgtgatgctcatggtaaggaaatgcagacgcccccagacgtcccccttactctgggcagtctgttgcaagctccccagtggatgctgaaactgtggatggtactgaagcctatagatgctgttttcttctatacatatatacctgagataaagtctagtttataaattaggcacagtaagagattaataataaaataggacagttataacaatactcggaacagcatgcactgtaaaacttatgaattgtttatttctggaattttccatttaatatttccagatcgcagttgactgagggtaattgaaaccgtggaaagggaaaccatggacaagggggcgccgccgtattttagtataaggaggttgtgaataatccatttcaggttgtgctttcgcacctgtgctgtataacacattgatctaagtttttagtttgctttcttcacatcgcctctctttcctaagcaatctaaaagttttaacaacacatgcctgtactcctttgacttcagaatgactaaagctttacaatcaaagtcaacaaaataaaagtcgcattttaaaagtaatcacggttacacaagagaagttgatccttgagattctttcaagccaagaaaaaatagaatggatcaagcgccaatgaaatctgtccctgctcagctgtgcccacatgtaatactgctttcagataaaatttgaaccatgcctaatccctggagaacagagaaaggcctcccagatggaaagcaactccagctagtgaaggaacacttccttctctaaacttttcgattctgtgattccctctatttttaaacaccttttcccaggcatagcatacgttagaccctggaaaagcgtagccttgtagtctgcctctggtttttttttctccttaatcttattccaccatttcttgttatacttcctcctccagcgctaaatcactgtcccccttcttgtttacaccctcctggcatgtgtaggtaataatcacatttccctgccctttgtttttacttagttcgggtctccatgtttaggttttctaatcctgcccataaaatgattctttcagcttcttagtcatgctgccatttttctttgaacttactccagtttgtctcaatttttctggtaatgaggtgtctgaaacggaacacagtgcccttaggtgtggcctcgctgaaactgtgtaatggaatggcggtctgctgaggagtgatgcccatgtctggccagcccgggggcctttgtctctcttgaagagctggaatcgcttccatcaagatccggcgattcctgtgctccagaattgcagtgagcagcccagtgcctttcctcctttgtgcctcacctcatactgtgtttccatttgaactgaccattttctgtcccctgctgtcaagaaaatacccacccccccaaccctgccttcctttctgtccagactactgaaggcagtagcattttatctctacctatttgtggcagttactacacagtgttttgcatagagcactcagtcaattttttaaagagtttttttgtttgtgttttttttgtttgtttgagatggagtttcgctcttgtctcccaggctggagtgcactggcgcgatctcggctcactgcaacacccacctcttgggtccaagtgattctcctgcctcagcctcctgagtagctgggattacaggcacctgccaccacgcccggctaatttttttgtatttttgatagacggggtttcaccatgttgggtaggctggtctcgaactcctgatctcaagtgatccacctgcctcggcctcccaaagttctgggattacaggcgtgagccactgcacctggccaatttttttatagttttactgagatataatttacatacatacaactcacccattgcaagtacataattcagtagatttagtgtgttctcagagttgtgcagccatcaccatagtcaatttttgaacatttttgtcaccccaaagggaagcccccacctattagcagtcactgccaatcaccccatcctaccccagccccaagcagctgccactcttacttcccaactctggatttggctactctggaatttcatcaagaatggaatcaggctgggcatggtggctcacgcctgtaatcccagcactttgggagaccaaggtgggcagatcgcttgagcccaggagttcgagaccagcctgggcaacatggcaaaaccccatctctacaaaaaaatacaaaaattagccaggtgtagtggcatgtgcatatagtcccagctacttgggaggctaaggcaggaggatcacttgagtctgggaggtggaggttgcagtgagctgagatcctgacactgcactccagcctgagcaacagaatgagaccctgtctcaaaaataaaaaaagaatagaatcatacaagacgtggtctgttgagaccggcttctttcatttaatgtaatgtttttatatactttacatagtgtagctttacataatgtcacgtgtcagaacttcgttcctttttattggccagttggttaatactttttgagtggatattttatacacttcaatttttcccttcttaaggtcgtagagtatcagaattatgcctttaaaagtatatacagttttaaaaggtatttatgttatatattttggtatatttcttattgcaaaattgatgttgcttgtgctataaacagtacagaagtatgtaaagtaaaagtaaaatcaaaactccttccagccactgagagcttttttttttttttttttttttttttttttttttttttggagacagagtcttgctctgtcacccaggctggagtgcagtggcgcgatctcgccttactgcaacctccgcctctggggttcaagcttttcttgtgccttagcctcccgagtacctgggaactacaggcactcaccaccacatgtgaccgattttttttgtatgtttagtagagacggggtttcaccattttggccaggctggcctcaaactcctgacctcacgtgatccacctgcctcggcctccctgagtgctgggattataggcgtgagccgctgcgcccagcttcaatgaggtctttaaaaaatctttgttccagccgggcgtggtggctcacgcctgtaatcccagcactttgggaggctgaggcgggcggatcacgaggtcaggagatcaagaccttcctggctaacatggtgaaaccccatctctactaaaaatacaaaaaattagccgagcgtggtagcgggcacctgtagtcccagctactcgggaggctgaggcaggaggatggtgtgaacctgggatgtggagcttgcagtgagccgagatcgcaccactgcactccagcctggtgacagagcgagactccgtctcaaaaaaaaaaaaaattctttgttcctacaaattgccttagtaaacatacttgtacatacgttcttaaatttcttactggtgtttctgttgaacatactctaaaagtagaattatttggtcaaaggacatatacaattaaatttggctgatgagaccaaattgctcacctccctacaattgtcccacaggtcgttgctctgctgttcccacttcccatgccctagccaactctgtagtttatatttcttgttcgtttgtttgttttgagtttttcttttccttttttttttttttgagatggagtcttgctctcgcccaggctggagtgcagtggcgtgatctcggctcactgtaagctccgcctcccgggctcaagcaattctcctgcctcagcctcctgagtagctgggactacaggtgcacgccaccatgcccggctaattttttgtattttttttagtagagatggggtttcaccatgctagtcaggctggtctcgaactcttgacctcgtgatgcgcctgccacctcagcctcccaaagtgctgggattacaggcgtgagccaccgtgctgggtcttgtttttctttttttgagacagggtctcgctgtgttgcgcaggctagagtgcagcaatacaatcacatagctcattgcagcctcaacctcctgggctcaagagttcctcccaccttagcttccagagcggctagaactagaggcacgcacaaccacacctgactaatttttttgttttagttttttgtagagatggggtctcgctgtgttgcgcaggctggtcttgaactcctaggctcaagtgatctgcctgcctcagcctcccaaagtgctgggattacaggtgtgagtccccaaacctggtcaagtttatatttctttttttttttttttttttttgagacagagtctcgctctgtcacccaggctggagtgcagtggcgtgatcttagcccactgcaacctccacctcctggattcaagcaattcttctgcctcagccacccaagtagctgggattataggcgcccgccaccacgcctggctagtttttgtatttttagtagagacagagtttcaccacattggccaggctggtcttgaactcctgaccttgtgatctgcccaccttggcctcctaaagtgctgggattacaggcgtgagccactgcatctggccatatttaattattaatgaaattgggtattatttttgtgtttgttagccatttgtatttcttctgtgagttttttgttcatattctctgcctgtttttctattaggttataggtttttaggcttatggtaccacttcataatacagtaatgtcaatcctttgtctttttgttttgtgtttattatgtctttcaagccgtcatttgtacttcaattaaatgtatagctcttctgtctctatacagacattttaaatttctaaatagcccaacttacccttttattcctttatgacttctgaatttaaaagcacttaccctcctctccaaaataaagctaaaaatacttttctgtctcccatcccaagattataaaaaatatgctcttaaatttactttcagtgttttcacagcataggttttaaatatacatctttaaccagtttggaatttatgttgctgtatggtataagcaagaatacaaccataaatgggcctagttgaccccgtacagttcattgacttcatatgcttcctggtcatatcctaaatcccagtcatttaatggtatcaacccaacactcttctaattattgtacttttatggcatgttttgtttggtaaagcaagtcttaacatcactcttctttctttaaaatattttcttgactcttctctatatttatacttcagtataaatgttagactccattatcaaattccaaaaagaacctttaggatttgtttggaaatgtgttatacacacaaatacacacatacataaagcctcaagtaatgcatgataaaatatatagcagtggttatctctagatgatggtaatattctaggtgatttttttcttgtttttttttctttattttcgaaagtttttacaatatttgtgaagcactttttactttattttattttattttatttttgagataagagtcttgctctgtcacccaggctggagtacagtggcacgatctcggctcactgcaacctccgcctcccagtttcatgcagttctcatgcctcagcctcccgagtagctgggactacaggcacgtgccagcatgcccagctattttttgtatttttagtagagacggggttttgccgtgttggccaggctggttttgaactcctggcctcaagggatccgcccacctcggcctcccaaagtgctgggtttacaggcgtgagccaccgcacccggctgtgaaatcactcccggctgtgaagcactttttaaattgcggaaaactcctgaaaaaaatgttcttaaactaaattatatccttcagtaacttcatgattatctacttaacataacagaagcccaattagaataaagactatttcatgggaaataaataagtgacttgtagagactgaagaagagttacctggctcagaatataaactagaattgtctggaatattcctgggaaggatccagctggaatcaagatactgaagcaacaccaccccataaccttttctgtagcttggttgatgtcagttctgctgagactttagggtctgtagccttttcacttagcagcattcctgggttgttttctctgcagctgtatttacaaggtacccagcctcctagctttccccgttgaagagattcttactcatgtgacacagccagagtttggggtgcaccaaggccgcgtggtctaaatcgggcccctcagtgtcctggtcttttagtcagcatttagcagaaggaagattgctaggtctattcttaactctttgatatatttaagaagcactgtgctcattcttgactcagagcatctagattctttcttttctttttcttgccctgtcttatggtgccaagcatctagattttttttttttttttttttttttttttgcctgttttaagatggaatctcagctgggtgtggtggctcacacctgtaatctcaacattttaggaggccgaggcaggaggatcccttgaggccaggagttcaagaccagcctgggcaacatagttagaccgcacctctaaaaaagaaaaagaaaagagaaatacaaaaattagccaggcatggtggtacacatctgtaatcccagctacttaagaggctgcagcaggaagatcacatgaggtcaggaggtcgaggccacagtgagcctgatcaaaccattgcactccccccagacaatagagggagaccctgtctcaaattaatagaaagagagagagaggagaagggtaggaggcaaggagggagggagggagggaggaaggaagaaaagaaggaaagaaaagaaacgagagagagagagagaaagaaaagaaaagaaaggaaagagagaaaaaggccaggcgcggtgactcaggcctgtaatcccaacactttgggaggccgaggcgggcggatcacaaggtcaggagatctagaccattctggctaacacggtgaagccctgtctctactaaaaatataaaaaattagctgggcgtggtagcaggcgcctgtagtcccaggtactcggaaggctgaggcaggagaatggcacgaacctgggaggcggaggttgcagtgagctgagatcgcgccactgcactccagcctgggtgacagagcgagactcacgtctcagaaaaaaaaaaaaaaaaaaaaaagatagatggggtctcactaccttgcccaggctggactcaaactcctgggctcaagcgattcccccaccctcagcctcccaagtagctgggattacaggcatgcaccactgtacgcagctccctttttgctttttaatctgtatgctcttgctgggtgatcttacccatttagtaacagttagaacacctaatatttgtcaagcactttatatgactatctcattaaatccttaaaacagccctataaggtagggcacaggagctcacgactgtaagcactttgggaggccgaggcagaggcgggattacttgagcctgggcgttcaagacaagcgtaggcaatatagactcccatctctccaaaaaattaaaatttaaaacattggcctgacatggttattattgcctcattttacagatgaggaaactgagactcagacaagtcaaggtcagatgaactgatcggcagaactgaccttgaaacccaggcagcctaactccagagcctatgttcttaactagactttatattccatttttaattttcctcctttctttcctaaaacctgctgtctccttcgttcttggtcttatttgtccaatatccccagctagaattgtcagaaatgattctccagttctccctcacttgacacctcctccttttagtcctgccttttgaagaggctcagacctgtgtgttcctttccacgtccctggccctcccttgcatcagccttgcctaacccccacctgggctgcgagcaggagctgcccttggtggactcttccttctgctcagtctgagaaagtggcgatgctcatgtcactgtaccatttaaaactgcgtggactccttttttgtggttgtggtttggtttctaggcagatcacgctggaacgtcctcacttcacgtgctcagtctggccctcgcgtgtgttttcagctccatttcctgtcattctccacccactccctgtgccttacattcctgccatcctgaggcttcccttttcgcaagatctgggccaggcctgtcccagccccacgcatcagcctttgttcttctgcgctaagcctcctttgtctttggtctcccagacggactctagtcagctctgaagatccagaccccacgcctctttagtagcatttcctcagactcctcagggtgagcagacactcttagggctgccacagcacatgctcaagcctcagctgcggcctcactctgctgggtggtcgtttatctgtttacatgcttgtctccattaacctaaatgtgtcttcaggacaaggaccaaatcccatcagctttcaccacccagcacagagtagcgctcaataaaggttggttaaaatgcttgaaggaatgtgaaagaggctgttaaaaacaacaggaagttagaaatatacttacttctaagcaaagggattatcttgtgtttctcaaagtaatctcttcagctaaattagcaggcctcaggtgggtaggctaatgtaccggatgaaagcgatacacggcaaatggagaagtcctttaaattctaagttcccttagggcgagggtcgctccacaaggttaggatcctctctgagatcaccatgcccctctctcctgctctcatgcacgttcatgagcctgtgacttggtggagagaacattctgtttacagtgagaggccaggactgaagtcacagctctgcaaaaatgatcagctttcggcctagaaccagtgactaactttttgggcctcactttcatgaagacgcatttgatatttgcttttacacttttcttatggttaattttgatgcagagagacttcacatacagagtgcctttgtcatttattgatgaaaaataattcttagctcagtgcaaatgggattgttgtatctgaaatccatctctcctttccctttcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtcactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcaggaggcaggagaatcgcttgagcctgggaggcagaggctgcggtgagccgagatcgtgtcactgcactccagcctgggtgacagagactccatttaaaaaaaaaaaaaaaaaatatatatatatatatatatatatatatatggatgggaatcaccaaattcatctcagctctaaccttttaacctttgtccttgcactttacaatctaaagatctacctgtggctctcagacttcctcacacttgggttttagaaataacttgtaaagcagactggacccaaggccgccttcagtgtcaagaagggcattgtgacttgcccctcaatttctgtccattgaagtctggttttccatgaggaacttgcgggctcacccacccccagagtgagagaagaggaaggcgaagtcatcacagacacggtcttagccacctgctgaactaatccctccgctattgagggtcagggttgtgaggcaaccatcatgtgtcaccccaaaatataaatgtttctgagccgcccatccactggcatttggatttgctgccagagtcctgttcctcccagaaccatcccgccctcctgttgaccatgttacttgagtgtaggcccggtgtcaagaccctcagagtctttgaggaaagagccaagcagagaagaccgctgcgtggagtgtgacaccacatggcatttctcaagcccagcggaccctgtgtcagcaaataccagtaatttaacatctgctcctggcctcctcttcacctgcctgggttcggaactgaggaggaaggatgagaagagactgcaatgcagcaggcaccctctgcagagtgaggccgcccgtccatcactgccagccctgggctgctcaggaggggacgtgaaccactcaaaggaatgtcttaaagaggatctggagtttcccccatgcaaattagggaagaattaggcaagaaaagacatacattacagggaaatccttctgaacaaaatggctgtcttcacctactcttcttgcaagaaaagacatacattacagggaaatccttctgaacaaaatggctatcttcacctactcttcagcaaaaaccgtctccagactttttagtgtcaaaaatgtaaccaactgtctcctgattttttccaatgtgtttggcaagtgctgtggccctgttgtaggtacttctcctgactcttgggggagaagtggttttagggattgatttgggggagcgggtttttgtcccatcccacctcctctcttctttctctgcttgtcgatattgtctgtgtgattcagagaattggggcagttacattgtgtctgttgttgagattattaaaagattaaaacgtagttgtagaaatgaaaaattaaacagctgtgttttaaaaatgcaaaccaatatcttgttaataaaggaattcaagctatggggcagccacactcccctcctcccaggctggcataggtggccctgggctggcggcttaggaagcatggagcacacttagggtagtgcctgcctgggcaagagacacctgccgagcaaaaggaacgagaatctggggctcagagcctcgcagttgtgccaggattttcctatacatgttcaggacctctgggtagaggtttcacagtttgtgaccccataaccaccctcacccgacgtgggttctagctcagtgtgcctaatactgcatggtaacctgggcttgaccctgaagcccctgcctggcaggccacaggacctctcctgcccacttggtgctatctcttccagtgaccacccagcacgggtgagcactggccagcctggagcctgcaatccaggtggaacagactgtcctccatgtcagttccttctggcttcaggccctcaattatttccctttgagcttttttagaccctagatctcctaggcccaggctctctcttgaccccagagaagccactgtcaggaaaggaagtgaaccctactgaagccagagaattcaccccggccaaagcaggccctctgggtccagcccctcattccacaccacgccagtattgcatccatctactgcagctacacatcctgagggcagcaccacccactctggcctgctggcccatcgcaggactagcccaggcacctgccgggcattgcaggatatccagtggggcctgtgactgctccctgatgcgtcagaagagaagtgttgcactttagtggaggagctgaggagcacctgcccccttgtagcttgagttccttttggtaacagtagcagcctccatggtggtgtctgggatgcacgtgcacccgctgccttcagctgtatgtgtgtgttcctgctggagttgtgttactgacaggataatgacattacaaagaaattgtgttatattcaactttgccttgataattattgtaaacactttgttcattttttcttttttattcacaaactaaatccaccaggaaattataaagttatttaaaaaccgt

SEQ ID NO: 2660 - DNA, 504697 bp, Homo sapiens; identical to SEQ ID NO: 2659

SEQ ID NO: 2661 - DNA, 504697 bp, Homo sapiens; identical to SEQ ID NO: 2659

SEQ ID NO: 2662 - DNA, 504697 bp, Homo sapiens; identical to SEQ ID NO: 2659

SEQ ID NO: 2663 - DNA, 504697 bp, Homo sapiens; identical to SEQ ID NO: 2659

SEQ ID NO: 2664 - DNA, 147464 bp, Homo sapiens
atcagtttttaaaactttttttattttttaaattttttttaagtttttattttatattatctacaaagtaaaagtttttcccttaacttaaaagttgaaccactgtagacagtgatcacctcatcaaacttgatttataaataataatccgtcagtttgacggtaagaatttactgaaactttgtcaagtttagtaaaagggcgttccaagtcttgatttttttttttttttttttttagcagtaatagcagcaagaatcactcttgttacttcttttgctagctgatgtgttcatgactttcaagggttattaaaaaataaataacttccagtttcggcaagcagagctggggtacctgcgggactctgaaacagcatatggaattatggaatagcccccaagttcctaaatgcctctactcggtccaagtatcttccactgcaagtgaactgttagcattcctattggatgttacaagaaatcaacatatatattttaaaaacaaaataaatgaaattctagttttctgtgcttccagttggtagaagcagtagaagggaggagggaatttggcctttcggttcctccagggcagccttacaactgctgttggtggtgggcttgtactgtaaaaagaaaagcgaacattgaaacagaaaactggcaacaccacacatcagcctagtgtctctgcagcacatgattgtaaactatcctcgtgctagctgaacaaaactcaaaattgaattcgcttttccccctcccatctgcaccaaagtggggagggttgggtgggtgggtagaaacaaaccagtcagacgtaaaaccacttcagataaaactcccagaagacttgttcatggggtagaaaaaaaggccttaacaaaccccctccccaaatattagccaagcaccagtattgctttcagaataacaggtcagactgtgaagtatcgccatggcagccatcaagtagtagagcacaatcacagggcgctctcccctgttcaggggctggggctaacgctacactcaaagccagtccatccacagcgctttctcagcagtatcttctccagagctacaatcaaactctgccatggtaataaccccccacatgtcagacttttgggactcaggaaggaaaacactgccctgtccagcctgtcataacaaggaaggccaactgagtcctaggcatgcatcaggctgctgttgctgctgctgctgcttctcatcaagccaaatcctgtataccatcagaacacacacagactcggctcccggaagcctcaggccctgatgctgaactgatcgtcacagtccctcctgtgcacactcctggacgggtcttgctagttctcaaatgcggggcttgaagcactggccctgcctgccattccacctgtgcgagcagaatgctttggggtgccccggcggcccctgcacacacacgcctcacctgaagggtgcgtcatataggggaaatgcgctgttgtcgagactggaatgggctgtagtgcactttgagcgagggcggcctggggaccgccgggtggctgtgtcgtcattagcatcattggcgcatgggcagttggatgagaaggaaccattcctgactgtacatgagcctgaaacagagagctcttttacgcatacaggcaacatctccggcttcaacaacatgtcaactgtgttcctttcactgggctgggactctcaggaaagggcaacggtgggcctcagggcccagttctgttctctggggacaatctctagtagattatctattgacctgaagacgcgcttcacctttgggcagatcctgcaagggtcagggagcaggcaacaagtgagcctgggtagaagtcagggctgtgctgtcctaacccttgacatttctgatcattgtattctatgtatggggtaagatcttcacaaagattagacactggatccaagggcagctttctcaacttaatatcatacaagattcaatgatgcttcagaatcaggctgccatgtggggcctgaggtagttttgcagataacatccctttcaaataggaaaacagattacattaataagcagagactgtcacagtcaagtatgtgaattacttggacctctgttcatttgcctctctccctctgcttctggtctgctcaccaggcagtgaaaagagactcttaggcccccgtgactctctcagagatatgctgatggagcaggaggaggaggaggagttggagtttttaatggctccagtgagatggaaaggagtaacctgaagtcatctgggccagcccagcgtctctgtaccaagttcaacctggtctcactcactgtcaagttggaaaggtgattttagtcagcccaaacagctggattccagctctgcagggggttggcagggccaggaagagcccttgtttcctttttcccacactgtgcactgttctagactacgataagccttggatgaaatgccgtttttactctcacatattcaaacgggcacatggcaaatttgagcttccctgtgttaacctttttgccctttcagcacaaaaacagagtgaggttttagggatccctgacttacatgtaagttcacatgcctacttagccaccagcctctggtagacacctacaggaccccagctcttatgaagctgactccaccaaaccacgctggcccacacggaccaaaccggcttccctccccactatcaaaaagcaaatcaactgcagtgcgctacaccacagaacctaaactttgcagggtgaggacgcccaaacttcccagagctgtggaactctacttacaaggtagccttctgagagatagatccaactgagtcgcatctctagcccacaccttgccagagcctcactggcgcactatttaacaggaaatggaattcattgtggcaggtctcacttagacccgcctcagagagttctgttatgaaagtagcagagacatctaatacagccaattcacccgtaacagccccagggagggcctcaaggccagcgttagagcccaacttcagtgcagctccttctcctcattaagacaatcccctgggccctggagtgcagggacctttgtcagcagctgatgcagacagcaaccactgagatggcaagcacacctttcacctgtagcagcttacactggaggtgagctccaaagtgcttccagggctgctcttaaagaaaaatgggaccacctgggtgcttccagcttctagttacactgcaccaatgtccaaggccaagccctctcaagagtacaacttatggtcaaagcagatatatggataaccagggaaaacaattggagagatgtgtctggaactcatgtgagtaacaatcaagttgacaggccccggtagtcacttcggagagctgagactctgtgaaggccatcatccctgcctggcttccaaggtaagtgtgtaggggaatatatatgtacacatatatatagtagtgaggctatatagacatagcaaagcagacacagaaaggaaagaaggactgggttgcattccagagtcaaagatatttttaaggtctcagttggaaaactaaaggactgaccaatcagcaccttcactgatcccatgacaaaaccacacaaacattcccttagggccagatcacgtgtatttgagagggaaagggagacaggcaaatggcatgacacacagggtttcctagctgggagagcctctagctgcttactgataaccttcacattctacttggccttcacagaaagttggctaaagctggtattacctgaggtacgtgggccatgtggggtgggttggtatacgccggctgaacgtgagaaggatggatcgtaaagacagtctgttgtgctgctgggaaactattctgtggcgactgcgtgttggaggcaggtgtcatggagggtggagttggcgcaagccccgcgtggtaaatggctgactgctgctgtggactggccagatggagagcctgggcggcctggtgctgatggtgctgcaaagcgacaggaaagaattgagaggaaaacttctttaatgaaaagcagccaagggatacccacaaagctaagctttgcacacttgggcctatgatgagggtcactggaaagtacaggagaatgtacagggtggtaagagcaaggctggaggtgcctcccatctggacaactcctttctagggtacagaagcctgattctcagtctggcagttagaaacttctgagcatacatactaaagtcaaaaaagactactgccccagggaactgatagatatcaaagacatctttaactgcctccattagcaaacataattcaagaagctcataggaaaataacctcatcacataaaccttagaaattaaaaagtcccaagcaaataggaatttgccttatgaactttatgttaaatttgatttttcattactgcaagtttccagagcttatccaatcaccttattatcaacatgtatcttaaatgtgattttttttaattttttatttttttgagacagagtctcgctgttgtccaagctggagtgcagtggcgcgatctctgctcactgcaagctccgcctcccgggttcacgccattctccttcctcagcctcccgagaagctgggactacaggcgcccaccaccacgcccggctaatttttttgtatttttattagagacggagtttcacagtgttcgccaggatggtctcaatctcctgacctcgtgatccacccgcctcggcctcccaaagtggtgggattacaggcgtgagccactgcgcccagcctttaaatgtgattcttaaaaccaccaccccaggggcacagctgtatccatcttcacgagggtggacatgccatgtgttctgacgatgcgatacctggcacctgaagaaagcactcagatactaggataaagaagccactccatgcagacctctgagttgcccttacctgaacaggactgggtgcaggatgacttccaccatgttggctttgctgctgtccagtgggggtagctgaaggctgagggtgtggagtatgtgggtgcagggtagcgttagggtgcgcatactgctgagcaagggagcccgtggaaactaaagtgaaagaaaaaggagcatgtacacaaccgatgtctgacaacctccatcgctcctctacacttcatcaactgaactttcttgatggttacaatgcataactcacgccactaccaatttctatagatgactccatttaaaccatccattgtcttgaaaaaataagtgtagctattgcttaacagactagcatttggttcatataatacagctctacatatgatattaaaatcaaattagtttgcatttactcttaacggtcactaggttttcccaaaaaggcaacttgaaggcataggcagaaactactcaaacaagtgcattttaggtgcacactctttagctcaaggccatcatcaggctaacctcaccatgctactgccctggagcaatgtcctgagggcacagactatattgggtgtggtgggggatgggggtgcgggcactgtgtatggtatgtggcaaggccagggatctatcatcagggccgaaggaccacagtctctctcagctaatcacaggagcccttctgccactcagtttactttcccaagccctaatggaggatctcccatctttgctttatgaaataaatatagaaaagtaaactcccttctgagtgccccagccctttggaaagaaatttactagactaacttcaaaggacaacatgatgggccagtttaaatcaaaataaagataagaactgaaagccagttctttgtgaatctcagcgtgggccaaaccttggtacaaaaaccatttcttcatgtctttcagttttttgttttttgtttttttttgagatataagtctcactcactctgttgcccaggctcactgcaacctctgcctcccaggttcaagcaattctcctgcctcagcctcccgagtagctgagattacaggcatgtgccaccacgcccagctaatttttgtatttttagtagagatggggtttcgccatgctggccaggctgatctcaaactcctgacctcaaatgatccgcccacttcagcctcccaaagtgctgggattacagacgtgagccaccgtgcctggcctgttcatgtgcttcaaaaacagtaagttgagaatcagaagcagagtaggatgtgttcactgcttccagtgactatggacagcacaccgatgataaaaaactaacctccacgaggcaatgagctgagaatagagcgttctcaagacaactctagcaaggtatagttcccagccctctcttgagaaacaaatcctaaaatccctcaagataataagcccatacacagaaatgattccaaaatagttccccacattcttcatataacgtgttagcaaacacagacatatgcaggactgattggtgagagaagcaagcacagctttgggaagaggcaccctagttccagcagtctggtaggcaaggctgccgagtcaccagcatagacggctctgggtatattccacgtaaatggtgtgcagagggttaggctaggcacatggagcagttctataatcctaggtgttgtagggctaagggccaccaactctccagccctaacagttacgtctccagctgcaaagctatctcttagcaggggaaagggcaaggcaaagagccagttctaggatcacctgtgcatccactgccaatgccacagctggcattaatattccttcatatccagtttagactggatacagcagctttgtttatacactgggaaaattttccagactgtaggaattaacatatgccagaatattttaacaagaaaactgtggcaacatagtctctgaatgtttttaagagtagtgaacgtcttctgggagctagaacaaatgatgtacaaacgatgaagccttcctgagcttcacagtcccataagtctataagacagtcctttttttctaacttggtggcttattaacaggccctccatcatcatcatactcattaagtttacttccagctcctccaagttgtataggcactgacttggtctaaaagatttgatgtaaatttcgaacctgagtttgttgtacttgtaaaaatcttacgttcattttaaaaatgtatttatttgtttaatttttgacagagtctcgctctgttgcccaggctggagtgcaggggcaccatctcggctcactgcaacctccgcctcccgggttcaagcgattctcctgcctcagcctgccgagtagctggaactataggcaagcatcaccatgcctggctgatttttgtatttttagtagagacgggtttcaccatgttggccaggctggtctcgaactactggcctcaagtgatccatccgcctcggcctcccaaagtgctgggattacaggcatgagccactgcgcccggccatgtttgtttatttttgagacccagtcttgctgtcacccaggctggagtgcagtggagcgatctcggctcactgcagcctccgcctcctgggttaaagtgatactcctgcttcagcctctgagtagctgggattacctggctaatttttgtatttttagtagagacggggtttcaccatgttggccaggctggtctcaaactcctggcctcaagtgatccgtccatctcggcctcccaaagtgttgggattacaggtgtgagcaactgcacccggcctaaaaatttatttttgaataataaaaaagccacatgtagctaagtagctaatacggtggacagtgcagttttgttgttgttttgagacggagtctcgctctgttgcccagggtggagtgcagtggcgtgatatcagctcaccgcaacctctgcctcccgggttcaagcgattctcctgtgtcagcctcctgagtagctaggactacaggcgcgcctggctaacttttttgtatttttagtagagacagggtttcaccatgttggtctggctggtcttgaactcctgacctcaggtgatccacttgtcttggcctcccaaagtgctgggactacaggcgtgagccaccgcgcccagccacaaaatgttctactggatagtgatgtctacagttgtccatggtcccctactgttaaaccattagcactaacccctaccgccaccccagcctcttaaaaatgtcatttgtaacaatctaaatctgtctaaggaaaagcaattcccaaatcccaaattctgttcatggaggttcataaagatacagtacggaatctcagaggtttttgttttttttttgtaactttatttattcaagaaattttgtactaaaaagtttgaaatttcacttttaaataccttctaagcaaagtattaagaatattaaaaagtaacaataaatatagaaaataattatgcccatgaaatctcataatttaagttattcatcaactggaaaaatgtaaaaatcttaaaatcatttgaagagaaaagtaaagatgaaatatttttactatgcatttttaaaaggcatctctgcaatttaagtttaccagtatttaaagactataatacggttttctaatctatagctaatttgcatgcatagcacaaatacccaagctgagtgaatgtacataggctttgtttaaaaaaacaaaaacaaaatcctttccctacctaaataccggtaaacttgcaaggcattgattaaaaacaagacgaacaaaaaccacaaaggatgtgtaaaatatgtatcatacgttgtaaacaaaatttaaaaagagttaattagaaatatttccctttgtttttttgttctagctcaaaagatctgaaagaagtaccttaatcaggaattcttttcctccttgaatttgaaattgggagaaatggagccgggcacggtggctcacgcttgtaatcccagcattttgggaggccgaggcgggcggatcacctgaggttaggagttcgagaccagcttggccaacacggcgaaaccctgtctctactaaaaatacaaaaattagctgggcgtggtggcaggcacctgtaatcacagctactagggagagtggggaaggagaatagcttgaacccgggaggtggaggttgcagtgaaccgacatcacaccattgcactccagcttgggcaacaagagcgaaactccgtctcaaaaaataaaataaacaaataaataaataaataataataataaattgggagaaatgtgaaacttatactttaaatcaatactagtaacaaaaatacagttcggttccttgataggccagttaagtgacagtgacacaaagcagggtaggaagaaaatttaaaagccaaggaaaaaaatagcttggaagacaagagagacaaaaaaggaaccaggggccgaggtaggtgatcacgaggtcaggagttcaagaccagcctggccaagatggtgaaaccctgtctctactaaaaatacaaaaaaaattagctgggtgtggcagcaggcgcctgtaatcccagctactctggaagctgaggcagagaattgcttgaacctaggaggcggaggttgcagtgagccgagatcgcaccactgcactccagcctggacgacagagtgagactccatctcaaaagaaaaaaaaaaaaaaaggaaccaagataaggtaaagaaggaaaaaacacaggagaatcagggaaaaggagagtggagtgggaagggcagtgggttctgacccacacatattatttcactgcttttgttatatatgctcattctggctaaagatcccagagaggttaaaaataaagttaattttatttgtaatactgatttattcatcagttaaacttctatttataaaactttagtcttcataaaatcttttagattaaagataatcaaagacatatgcttctttggtccagacctagtccagaagtttcccactcagtgttccttgacataaatatttaagattctaaacatatgatcagtcaaaaatccttaataacactaaccacattccagaactagtttcctcagctgtgatctcactgaagcaaattaagtacagaaagctgtgtgtttaatttgtaactaggttttgtcattttgactttggatgcacaagtcataagagatcaccagcattgcaaaacttataaaacaaaacaaaatcttccaacttgtaaatctgatgttaaattcagaaaaagggaagtgaaggaaagttgaaaactctaaaaggggaataaaaggcaacttgaccaaaccatcataaaatggcttagaacagggggaaatgaagcagcagattaaattagcagcccaactgttagtttcttttaaaaagtactgatactcccttttaggggaagttgtgctaaggcaattaaggcttaggtgttaatgattaaggaccttagctacttaccaggaaaacaacaccaaactactaacagagacagtaagatggtgaggataactacatttgagacctcaaattgagtacataataaaatcacctactatcttttacacactacaatcacagacatagtttcccctttaatagtatatacatacagcaagactcctttttaaagagcatctattaaaggattaaatttaacatttcctagcaccaaataaattatatatacacacatacatatatatatatatacacacacacacacacacacacacatatatgtatgtatgtatgtatcagcttatttttggataccaagtcatggcataattaacaaagatttaaggtcaaatgcattttaaatgctaatatggcatttagtagagtcagacattgagtcaccccaaaataactcaaaatgtgcctaacataaaatttgaatccttaatatcctctagaacacaacatttcatacaaggtgacaatattaatggcacaaatttctaaaggatttctacaaatattagtactccttcctatttaaataccaaagtccaagactagccttatttttattttttattttgagacagagtctctctctgttgcccaggcctgagtgcagtggtacaatctcagctcactgcaacctccacctccagggttcatggaactcttgtgcctccgcctcccaagtagctgggactacaggtgcgtgccaccatgctttggtagagatagggtttcaccatgttggccaggctgttctcgaactcctggcctcaagcaatccacccacctcggcctcccaaagtactgggattacaggcgtgagccaccacgtccggcccttatttttacaaattgccctacaaataggaaaaatgtaccttaaaagttcatttccagaagaaagctctgcccagactttctccatgaaggagcaactatttctgtactttttgccaggtggggagaggggacctgtgctgtccaagataatgacctgagaggtcatgatctcttgcttaagctcaagatatcctgaggggtctgcttcctgaatattttattttttgagacagaatttcgctctgccacccaggctggagtggagtggcacgacttcggctcactgcaacctctgcctcccaagttcaagcaattctcctgtctcagcctccctagtagctgagattataggcgcatgccagcatgcatggctgatttttgtattttttagtagagatggagttttaccatgttggctaggctggtcttgaactgctgacctcagatgatccacccgcctcagcctcccaaagcactgggattacaggtgtgagccaccgtgcctggcccttcctgagtattttaaacctttagccatgcacaggactgaaaagtttttcccttagtatttcatcaatcctattcaattaaaaatcctggtaggcataaatttcatcttatcagaatataaataaacattttaagtttataccaagcttgtggcttggggtgtgtgtgtgtgtgtgtgtgtgtgtgtgtgtgtgtataaataaacattttaaatttataccaagcttgtggcttgggtgtgtgtgtttgtgtgtgtgtgtgtgtgtgtgtgtgtgtgtgtgtataaagctgtttaggaagtttctctaacaaggaaaatattaggcatttcccagtcacatttgcttggtatgcaaaaattgatttctgaaacaactccatttttcattaactccagccttcttaaattgggtatttccattttaaaaactgaattatttatatatataagtactttcaataatttgactggcacaaggaaaatattgttcaacaagtctactcccttaacatgtatcctttaaaaagtgttttactgtacaattaaaaattagtataaaaaacccaactcactggcaaagtagaaagaagggcttgtctccttgttgtatggtaatttgggacatgctgaatttgggaaatagaaaggtaaattagccttttgaggtgtgcattttccaaattttctggaaaggttgacatattagtaatttctttttgtattcatgcataattcattttcataagagatgacaagcactttaaacactgctacagaattttaaaagaaaggactaaaccggaagacactgttcttctgtacttaggtgtcaagttgtcatgctgacttgcttaaaagtaaaaggaataaaatcattatctaataaaaacaccaacatggcattctactgaacaaccttgatataaatcatgtaccaaaataaaactattttacaagtttaattcaatagacacacaattttgcaaaaacattactaatggaaatgtcattatcctgaaagattatctagtaatggatccaaaaatttaggatcatagcaagaatataaacatgaatattatttcttattaaaacatgtctacataaaggggtagggtatttgagtgtatttaaatacacctggaaggatacacatcaaaatgttaaaaggcagttgtcaggtggagggattatggatgcttttcattttttttttttttaacttaactatattttcttacttatctgcattaaactaccaaaaacaaatcaaaaaaggattctggatctaattcttcctaatggctctagttagtcggaaaagttgtattattactgtttctgaaaggtaaaagcatcaccataaaacaaaattagatggattagaagagtagatgtgaggctgggcgtggtggctcacatctgtaatcccagcactttgggaggcctaggcagacaaatcacaaggtcagaagttcgagatcagcctggccaagacggtgaaaccccgtctctactaaaaatacaaaaattggccggtcgtggtggcgcacacctgtagtcccacctactcgggaggctgaggcagaaaaaccgcttgaacctgggaggcagatgttgcagtgagctgagatcgcaccgctgcacttcagaatgggtgacagagtgagactacctcaaaaaaaaaaaaaaaaaaaaaaaaagagtagatgtgagaggaaaaaaaattaaagtaacttcttagaagggatggggtagaggcaatgatggaagttagattaagagacatcaaagaggccggggcagtggctcacgcctgtaatcccagcactttgggaggctgaggtgggtggatcacctgaggtcgggaattcaagaccagcctgaccaacatggtgaaaccctgtctctactaaaaacacaaaaattagccaggtgtggtggcgggcacctgtagtcccagctactcaggaggctgaggcaggagaactgcttgaacccaggaggcggagtttgcagggagctgagatcgcgccactgcactccagcctgggtggcagagggagactccttctcaaaaattaaaaaaaaaataaaaaataaataaaaaataaaaaaaaaaaaagaggctgggcacagtggctcacgcctgtaatcccagcactttgggaggctgaggcaggcggatcacgaggtcaggagatcaagaccatcctggctaacacagtgaaaccccatctctactaaacaaaatacaaaaaattagccgggcatggtggcgggcgcctgtagtcctagctactcgggaggctgaggtaggagaatggcgtgaacgcaggaggcggagcgtgcagtgagctgagatcacgccactgcactccagcctgggcgacagggagagactccatctcaaaaaaagagacatcaaagagataaggtttttgacaaaagccctttctaagatagctagaaagaggtcaaggtcaatacttttttagaataaaataattatcctattttatcatttaactgttcagtaatgttagcatatgtgtattaaacatactaaaaatttaaaaacaataatcaggatttcattttgcagtcattagtggtcctatgttttcaatgcctttggctatggctataacaattaatgaatgagaaaaggtgacataaaattgtcaccaacatctgggtgcatgttcttctgtttgcattaaatgttttaaaaacctagatatgatgtagcttaaaaagaaaagcacaattcatactcaaagtatttggttcctttgagaaaatttattacaatatatttaatatatttataaaatataaattgttcagggaagatgagtataaaattaacacttctatgtaagtttgttgtagtttataagaatgtacttcaaattttgtttatatttgatataataaggctttgaaagtctaataattcaaataaatcactgcagatttaatgaagaacatgcttaagcagattaaattatggcttatgatggcatagaacaaaacaattctttcttatgttttcttttttttaaatagagacagggtcttgctctgtcacccaggctggattacagtggtgccatgatagctcactgtagcctcaaagtcctggactcaagtgatcctcccatctcagcttcctgtgtaggtgggactacaggcatgtgccaccatgactgggctttttttttttttttttttttttttttttggtagagatgggatctcgccatcttgcctagactggtcttgaacacctgggctaagcgatcctccacttcagcctccccaagttcttggattacaggtgtcagccaccatgcccagctcctagtgtcctttttagggtcttaagcaccacaaagggaatcttgattaactagtgacaatcacaacaagtccacagccttgctcctagcctgcctccatacagacagcaattaaataccacctgtgtaaactgcaggagagtagttcagatttggctgagtaactttttcctggcatgaaagaaccggctctaatgactagttcattccagatttcactggacattagatctagtgctttgttttgtttgcaacatttcctatttgcccacacataaatggactttggggtctaaggccccactgctcttcaaatggacatgttctaggaagtagttatgaaaatcatctgtacctcaaacacagtatttaccctataggctgtttcaaaaccaatgaacattcatccaaaagatgaagccagatgttggcagtgaatgaacacaatgaggagaaagattcggctcaacattacagtattattgctacaatgtctcaaaagcatgcatacacaaataactactctccaaatgcaatggaaattttagcttaaaagtttcagatctgattccaaggggagtatgccagaaaatggaaggaaagagatgttctttccacttgttaaatcatgatgtattcaccagaaatgtataaacaatcataatgaacttttaacctaagcctttagcaaacaggaaaattgttaaaatatatacaagttgcataaaagccagcatgataaatcaatcgtgcctttgcacgcatattcagtccccgttaagacaactaaagacaagtcaaatgacggggtcataaccaaaataataaaccaagttagtttgtcagtatcttttacaattaaattacggatgggcctcttgaaaaaaatgttttccaaaatgtagcaatcacacaattttttatttaaaatgcgtaatccacaatacaaaattgaaagtgataatgtggaaaattaagactggacttaactgttttataaaactaaacacctttgatcatatacaaattcctatcagcagtgagcctttgtggcagacaagaacctccaggaagaaagcataagctgtgggttacaggtgacaggaaggatgattgctgctgcccaagtcctattctcattaacctacggaatgttaaaacttttattcttcaaaaaggacagaggtggtatgaaaagtagtaatgtctcaagaagaaggtttgccagaaatctgtaaattctttttttttttttttttttttggagatggagtctcactctgtcgctcaggctagagtgtagtggcgcgatctcggctcactgcaacctctgcctcccgggttcaagcaattctgttgcctcagcctccgaagtagccgggactacaggcacatgccaccacacccggccaattttttggatttttagtagagatggggtttcaccatgttggccaggctggtctcgatctcctgacctcatgatccgccagccttggcctcccaaagtgctgggattacaggcgtgagccactgcgcccagcctataaattcttaaataactcaattttgcctaaacatactcgttcaggacatctaaacttaaaaaataaaaattttatattcttagtatttcaaaaagttcaaagaggctttaaaaatgaaatgcccatgtagttacatgtaaccataatctcattctcatagcagtacacttttcaactgtatgaataaaccaaaattatcccctactccaaacaaccaaaaacgcaaataggaaaactaaacgacactacggtagttctcagaaatattcagaacaaaacatcttaatgaaatcagtactatttaaaaacatattctgaaaaacatttgaagcaatccattaattctgtatcataagatatacaaatggacattttattttaaattatcaacagtgaaaaatctattattttggtactttagacagctgctaagttgatctacacaaatttctctgtttagtcacaaaacgaagatgggtttttttgcttattattctcacatataaatactgcttagttttacataaaatacttctcattttcatttcagcattctgttcacattggttatatttaaagtgtgactcatgtctaaaatatatctaatatgacataatattcaaccattaaaatacagcatgatgtagaaacatagtattatcattataacaaacagcaaaaaaaatatgtaatgccagtgaccctcagatcaagtagtgaagcaaaatgttttcatgctggagaacacctttatgcttttattattataaaattctcttgcatgtcgtaggcaggatataccaaagcataatattgatgaggaagaggagaaaggtacctttctccacaaagatgctttgccattatatacatcattacattttagttaaagcaggaaagagatctgaagaccaggtacagaagtagaaactatttgccaaaagttataaagcaagtcaggcaaagaaatgggttcatcttttccttcagattcttgaccctcaatgtcataaaaggtcaggttattcttagatagagtatgttttcagaaacttaaattaagaagagtcacacacactggaagagacaaacaaagtgcttcctaccatacatcgcatgcgtctgctcatgagccccgtactgagttgctgaagaagatactaaaccaggctgggcgtgtgttggtggtgccatcattctagcattaccctgtattacaggactatagacatgaggatgctgtgttcaaacaaaaaataaagaaagcacattaacactgcaaatagagccaagcagactttagttaagatttttaactccatggtttccagatttccagaaacagctgtaaactctcaaatctttcttggctgtttcctctgaacctcttacaatcatcagtaaccttcgaatatatattgaaaagggtccccaagtccttagctatctaccctaccatcacacaaaagcaaaaattataaaggaaaatccctttaccatattaaaagtttttttatatggtacaaaaattaagagttaggccttaccagccttacctgagactgataatgtggcacatgctgaacaaggggctgatttgggaactgctgaggactgtaggcaacatattgcgtggagtaagctggtggggtggctgcaatcggtgggcccgctgctgacgctgggtgcatcatggcactctgatgatgctggtcttgccgctgttggggcatatttggtactgcagaaaaaaaagcagactgcctattaaacagtatctccacagcataatacatgtgttcacatggtctaggaggctctgaatgatttgaccctgaatctgcgtctctgatgccatctcataccactcccacttctgccactctgggttattttcctatcatgcatgctagtcctcagcctcaaacaccagttcccaaatcccagctgggataattctgcttcatccttcaggtgtcagcttgaaagcaacttcctcagagggactttctctcatggccctcagacttgatcaagtccctgtaacagactctcacagcattatgaaatcgcttctcatatggtattttctgggacgggcactgcattcattttgagaaaaacaaaggcatgaccaaagagccaaaacagatccaacactaactttctatcttccttaatttccaaccactgaatccttgtaacacttcccattctttctcaaacccagtataacacagcaccatgtagcatataccaggtttctaaataatagttcttttaaaagattactttatgtcttatcttaatccacacaggtggtctgcatgtaagggcctcgccctgttacaactctagttaagaattcagctcaactgtcatctcccatgtgaggtttttttccagttcctccagcacgagctagctacttcccatgtgcctctttcctcacacatttcttacagcactattgtctgtgacctgtttctggtgtggcattaaccaagccacttcaggaaaataattgtggaatgactgcttacaactaggtataaggcacaaagaatatagaacttgttcataaaatcctaagaactgattatataattaactgcaaatttgtggctaaacattcactaactgttgctgaaatttgggagagctagttacatattattttatctatgtaggaaagcaaacctgaacatttttttatattttatcttggatgcacgtatttaaaaaccacctccttctggtaaacaaaaaagccactgaaaactacttatcacttttatcaaatgaaagtttgcccgattatgctaactgagcttaaactattcactattattactttgttacttattaccttcctgtatatttaaaaaataattaaaaagctagtcaagtatactatggtgctattatttagatatcatgtgtttgtctccactaattctcatgttaaaacatgatccccaggccaggcgcagtggctcacgcttataatccctacactttaggaggccagggcgagcggactgcttgagctcatgagtttgggaccaccctgggcaacatggggagacactgcctccacaaaaaatacaaaaatattagccagctgcggtgctgtgcatctatggtcccagctactcaggaggctgaggtgggaggaacttttcagccagggaggcagatgccgcggtaagccgtaactgcaccactgcactccagcctcggcgaagaagtgagaccctgtctcaaaaaaggggagggtaggggacaggaggggaagaaaagaaaccaagcccttgactctgcctgttatttgaaaaatgctaaaaatatttttatccaatacctcaaaggattggaatttagtaaaggagcagggtaaaaactaacatataaacagcaatagccttcatatatggtacttcataagtaattacttagaagatgcaatggaagagaagtccctgggttacactaacattaaaaaagaacctacctaaggcatacactgaaaaaaatgtacaaaaccttaaagataaactttatttttatttatttattttctttgagacagagtgtcgctcggttgcccaagctggagtgcagtggtgcaatcttgactcactgcactctctgcctcctgggttcaagcgattctcctacctcagcctccagagtagctgggactacaggtgcacaccacacccagctaatactttttttaaaatatttttagtagagacggggtttcaccatgttggccaggctggtctcgaactccagacctcaggtgatctgcccacctctgcctcccaaagaggtgggattacaggcgtcagccactgcatccagccaaggataaactttaatatgctattgaaggtatactttgttcttgaacaggaagactcaacatcatgaagacatcaatcatttcttctcaagttaatttataagtttattgtgattctggcctgccatggtggctcatgcctgtagtcccaccactttgtgaggctgacacaggcagactgcttgagctcaggagttcgacaccagcctgggcaacatggtgaaaccctgtctctgcaaaatatacaaaaattaagccaggcacggtggtgcttgcctgtagtcccagctacttgggaggctgaggtggggggattgccttagctcgggaagttgaggctgcagtatgcccagatcatcccactgcactccagcctaggtaacagagccagaccttgtctccaaaaaattaaaaaaaaaaaaaaaattccagaagtttatactgatagtaagaaccaacgacaaaaaaaccacctcactggttacctttggaggataacagaaaaccaactcattattttgaagactgccttaaaaagggaaatgattaacattttaaattacttttcctaagaaagctatacctcagggtaaccaaacagctggatatgggaaagtttttctttatagaaatattccaggcaataattgaagaagggatgaaaggaaaagaatgtcaccattttacaacccctaaggaaataactgatcttgggctagacaattatcatcaatggctgctaaaaaacacaccaaaaaaattaaggcgctaaagggacatattatctcctggatagataaaacatctaggaactcactgactactcctatcaggaaaaagactgattacatgactcctcactgaaagtacacacatctgtgaaacattggggaaaaaaaaaaaaaacccaatctgatcaagccttcattatttactatcagtttacaaagattacaggggacagaagtctactttaaatatcaacacagggatacagtcagcaaaattcagatcgtgggaaaaaaatacaagacaagctggatatgaacaagacaaaaactaagggaaaaactgtaattaaaactgtgagggctgagtgcagtggctcatgcctgtaatcctggcaccttgggagtcaaggcaggcagactgcttgagctcaggaattcgaaaccctgtctctacaaaaaatacaaaaattagccaggtatggtggcgcgcacctttagtcccagctacttgggaggttgaggtgggaggaccacctaagcccaattggtagagactgcactgagctgaaatcatgccactgcactccagcttgggtgacagagttagacactgtctcaaaaaacaaacaaacaaaaaaacctatgacttggctgggtgtgatggctcatccagcacctcctaaagtgctggcctgtaatcctagcactttaggaggctgaggtagaaagataacttaagccctggaatttaggactagcctgggcaagatagaaagatggtgagactctgtctcaaaaaaaaacaaaaaacaaacaaaaaaacaaagaagaagaaagacaagacaagaaaagaaaagctggcaaggtggcatgtgcctgtagtcacagttacttgagaggctgaggagggaggatcctttgagaccaggaattcgcagcagcagtgagctatgattgcactactgcactccaagcctgggcaacaaagccagaccccatctcaaaaacaaaaaacaaaaccaaaaccaacttaaagatacacactaaaatgttggtggataaactgatgcaatgtctagaatttgcttcagaataatccagtggactcaaagcttttaagagacaatgggtagggatgaaacatgactggcctaggttattaatgtctcaatacattcgtaataaaaagttaccgcaaggctgagagcgatggctcacacctgtaatcccagcactttgggaggccgaggcgggtggatcatttgaggtcaggagttcaagaccgggctggccaacatggtgaaaccccatctctattaaaaatacaaggccgggcgcagtggctcacacctgtaatcccagcactttgggaggccgaggcgggcggatcacgaggtcaggagatcgataccatcctggctaacacggtgaaaccctgtctctactaaaaatacaaaaaaattagccgggtgtggtggcgggcgaatgtagtcccagctactcaggaggctgaggcaggagaatggcatgaacccaagaggcggagcttgcagtgagccgagatcgcatcactgcactccagcctgggcaacagagcgagactctgtctcaaaaaaaaaaggctgggctacttgggaggctgaggcaggagaattgcttgaaccccagagggggaggttgcagtgagttgagattgtgccactgtactccagcctaggtgacagagccaagattccatctcaaaaaaaaaaaaaaaaagttaccacaatatgaaacaattaaaaaaaaaaaaagacttcaacatataaacaaatccaaattgcaagcctgacttggaccctaattggaacaaattattgtaaaaagatttatcttttctgtttcttttttttttttttttttttaagagggaatcttgctctgtcacccaggctggagtacaggtgcgcaatctcaactcaactacaacttccgcctcctgggttcaagcaattcttctgcctcagtctcccaagtagctagaattacaggtgcctgccaccgggcccagccaagatatattttaaagatcagttggttttaaaaaggcaactgatttttttagtagtaagttaattatagagttcatatggaaaaataaacagaaaattcaaggtaatctgaaaaaaaaaatcaatgttggcagtgagtggatgagaaggtagtcctattagattagtgaagcagagtgaaaaatccagaaacaaattcaaccacaaaaagacacttgttatatgataaaatggcatttcatatcagtttgtatgaccataatggaattacattattatctatccatctatgcgcacgcatacacacacactttaaatacagggtctccttctgtcacccaggctggagtacagtggtacaatcacagctcactgctgctttaaactactgggctcaagcaattctccttcctcagcctctcaagtagttaggactacaggtgtgtgccaccacacccagcaaatttttaaattgttttgtagatatggggttttcctacatcacccaggttggtcttgaactcctggcctcaagcgatcctcctgccttggcctcccaaagctctgaggttacaggtatgagccactgttcctggtcaatatgatatacttagtagatgataagtatttgaacataatccaacaaccattcatgattaaaaagaaaacaaacccacctctgcaaattaggaactgaagtaacacctaactgtatgcttaatagtgaaagacaatgtctcacccctaaaaatgggagcatggcaaaatctcatgcctttttcagtaatgcaccagtacaataagacaaaaaaaaaaaacccaaaaacaccaacatggtgattagatcatgattgtatgtttaagtcttaaagggctgccagaaacagtgggtttaccaacacatcaagacacaaggtcaatattcaaaaatcaagtgcatctctatttacgaataaacaaacgttgaaagtttttaaaatataactcacaacagcacaaaacagatgaaatattaagggataaatttaagaaagcaggcacaaaactgatacaaagaaaactagaaaacactggtgaaacttaagacttaaataaatggagcagtatatgatgacctcaatgaagattccatattgttaagatatttctcccagaactgatataaagattcagtgcacaatcccaagctgattctaaaatttatttgcaaattcaaagaacgcagaataagagtaattttgacgagaataaaactgggagactcatatgaacttaaaggttggttacaaagtaacagcaataaagagagaattggcataaggatatatacaaagatcaatacaacaaaacagttcacaaatagacacacatacaatacagtcaactgaattcaataaagctactatggctgggcgcagtggctcatgcctgtaatcccagaactttgggaggctgagatgagcagatcacctgaggtcaggagttcgagactagcctggccaacatggtgagaccctgtctctactaaaaaaaaaaaaaaaaaaaatacaaattagctgggtgtagtggcgggcacctgtaatcctagctactcgagaggctgaggcagaatcgcttgaccctgggaagtggaggttgcagtgagccaaggtcacactactgcactccagcctgggtaacaagatcgagactcttgtttcaagaacagaaaaaaaataaagccaccaatggaaaacagaggctggtgccagagaaaccgagtaaatatttatggtggagaaaatgaagctagacctttacatcacaccctacacaaaacctaacctgaaatcaaccatatacctaaccataaaaacattcataacctagggtacgtaaaagatttcttattatgatacaaaaaagcatgaaccttaagagaaaagcttgataaataaggcttcattaaaattaacaatactggctcttcaaaaaaaaccgcagactgggagaaaatattcacaatattctgagaaaggacttgtaaccagaatatataaataacttaaaataatttactaaaagtagtaactttattttcacagtaagaaaagaaacatgacttttttttcttttttttgtgagacagggtctggctctattgcccaggctggagtgcagtagtgcaatctcagctcactgcaacctcgatcacccctccatcgccctccaaacccccgcaacctcgctcaagcgattgtcccacctcagccccccaagtagctgggaccataggaatgcgcttctgtgcctggctaatttttcttttttcttttttttttttgcaaagacagggttttgtcatgttcctcaggctggtctcaaactgttggctcaaatgatccatccaggttggcctcccaaagtgctggaattacaggcgtgagccagtgcacccaggcagaaacattgagacaaaaagaaattattaggacaggcgcagtggctcacacctgtaatctcagcactttgggaggccgaggcaggtagatcacctgaggtcaggagttagagaccagcatgaccaacatggtgaaaccccacctacactaaaaatacaaaattagccaggcatggtggcgcatgcctgtaatcccagctacttgggaggctaaggcgtaagaattgcttgaacctgggaggcggaggttgcagtgagccaagatggcaccactgcgttccagcctgggcaatagagtgagattccatcaaataaataaataaataaataaaatggaaaaaagatttgaaccatttactaaaaaaaggttgacagctgaaaacaaacacacacatgatgaggtgctcctggatcagtcatcatcagagaaatgtacatttaagatcacaatgagataccataagacacccattagacctgttgaaattaaaaagataacacaataccaagtgttggcaaggatgcagaacacatggaacctacacatgtacctgatcagttggaatgtaaaatgacacaatcactttagaagattgctagtttcttattaattgaaatatgtatttaccaggcagtgtgtggtggctcacatctgtaatcccaacactttgggaggctggggcgggtggatcacttgtggtcaggagttcgagaccagcctggccaacgtggtgaaaccccgtctctactaaaaatacaaaaaaattagccaggcatggtggtgcgcgcctgtaatcccagctacttgggaggctgaggcgggagaattgcttgaacccgggacagggaggttgccatgagctgaaatcacgccactgaactccagcctgggcaacagagtgagacttcatctcaaaaaaaataaataaataaaaaataaaataaattttttaaaaaaatgaaatatgcacttaccatacctcagcaattccaattctaggtatttaactaaaagaaataaaaacacaaacacttgtacacaaatgctcacagcagcttcattcataatagccaaaagctggcaataactcaaatgcccatcgactagtaatgggtaaattaactgtggtataatcataaaatgaaatgctacccagcaataaaaaggaataagctggctgggcacggtgactcacacctgtaatcccagcactttgggaggccaaggcaggtggatcatttggggtcaggagtttgagaccagcctggccaacatggtgaaatcccgtctctgctaaaaaaaaaaaaaaaaaaaaaaaaaagagagagagacaaaaattagccaggtgtggtggcacgtgcctgtaatcccagctacttgggaggctgaggcagtggaattgcagaccaattctgggacacagaacaagactccatctcaaaaacaaacaaacaaacaaaaaggaataagctgatactaacatgaaattcaaattactacactgtttaggacacacatatgaaattatataccaagcttgtccaacttgcgtcctgggacggctttgaatgtggcccaacacaaattcataaactttcttaaaacattataagttttgctatttttttttgttttgttcatcagctatcattagtgttactgtattttatgtgtggcccaacacaattcttcttccaatatgacccagggaagccaaaagattgaacacctctgttacacgctgtttgattccatttattaaaaaaaaaaaaaaaatctaggggctggctgaggtggctcacatctgtaatcctagcactctgggaggctgaggtgagctcaagagttcgagaccaacctgggcaatataatgagacgtctccaaaaaaagatttttttacgtaaaaaaagaaaaaaaaaaacctaatcaaaaaaaaaaaaagaaaaagaaatctaaagaggataaatctaatctatagtaaaagaaggcagattactggttaactggagctagtggtaataaagtacagttggacagagaagaggaacaggcacaatgttttccatcttcactgatgaagcaagtagttacatgagcaaatatatttgtcaaaactcattaaaatgtaaacataaaaagatgagcattttcttgtatgtaaattacagactaataaaactggttaaaacattttggatagtcatttagaacaagataaattggattcacattttatactttaagataaattctaaaattagccaggcataatggtacaggctggtctcaaactcctgagctcaagtgatcctcccacctcagcctctcagcctcccagggtgccaggagacaggcagatcacgagatcaggagttcgagaccagcctgaccaacacggtaaaaccccgtctctactaaaaatacaaaaattagctgggtgtggtggcgcacccctgtaattccagctactcaggaggctgaggcaggggaatcgcttgaatctgagaggcggaggttgcagtgaagctaagttagcgccactccatcagagcgacactccatctcaaaaataaataaacaaacaaacaatttaagaggaaagaatagtcttttcaacaaatgaggtggggacaacggatatccacaagcaaaaggaaaaacctggaccactactctcatctcatacacaaaaattaactcaaaagagattgtagacttaaatgttaagagctaaactataaaaatcataggagttttataggcgtttcataggagtaaatctctgtggccttgagttaggcaatgctttgtctgatatgacatcaggagcaacagcaacaaaagaaaaaacaaacagataaattgaacttcatcaaaattaaaaactgtgttacaaagaacaccatcaagcaagtaaaaagataacctatagtcagggcatggtggttcgcgtctaaaatctcagcactttgggaaggtgaggcaggcggatcatttgaggtcaggagttcaagaccagcctggccaacatggtgaaattccatctctactaaaaatacaaaaatgggccgagcgcggtggtgcacgcctataaccccagctactctggaggctgacgcagggggatcgcttgagctcaggaattcgagaccagcctgggaagcacggagaagctccatctctacaaaaaatataaaaattagcctggtgtggtggcgtatgcctgcagccccagctatctgggagggtgaggcaggagaattgcttgaacccaggaagcgaaggctgcagtgagccgagattgtgccactgtgctccagcctgggcacgatctcaaaacaatacaaaaaaacaaaaaaccacaatgacacttcataaccactagaatggacataacccaaaccaaagacatatcggttatttatgaggatgtggagaaactggaacacttgtacattactggtagaaatacaaaatgatgcagctgctttggaaaagtttggcagttccatcacagcatttctactttaggagaaatgaaaatctaaggccacatgaaaaaaaattttattttttattttttgagactcactctttcactcaggctggggtgcagtggtgtgatctcagctcactgcagcctccgcctcccaggttcaagcgattctgatgctcctgcctcagcctcctgaatagctgggattataggtgcacgctaccatgccagtgtaatttttgtatttttagtagagatgggatttcaccatgttggccaggctggtctcaaactcctgacctcaagtcatctgcccacctcagcctcccagactgctgggattataggcatgagccactgctcccagcctcatatgaaaatttgtacatgaaaatccacaaaagcattactcattgccagaaaaaggaaataatccaaatgttcatcaactgatgataggtaaaagtggtatattcaggccaggagcagtggctcacacctgtaatcccagcactttgggaggccgagggaggtggatcacttgaggccaggagttcaagaccagcccggccaacatggcaaagccctttctctactattttttttttttttttttttttgagacggagtctcgctctgtcacccaggctggagtgcagtggcaccatctcagctcactgccagctctgcctcccaggttcatgccattctcctgcctcagcctcccgagtagctgggactataggcacctgccaccacgctcagctaattgtttgtatttttagtagagacacggtttcactgtattagccaggatggtcttgatctcctgacctcgtgatctgcccacctcggcctcccaaagtgctggattacaggcgtgagccaccgtgcccagactctgagtatatcatttctattaaaaagacagtacctcctgaagttagaatgtgactctcccatcagatagccaaactgtcatgcttgctcttactacagtaaccttttatattttaatgacaacaaaaagttcccattgcattgttttaagtaatcattgaaaacagctacacctgctggtgatacatgaacaccttaacactacattaaaatggcagtaaaaaaaaaaacccactttcttctcagaatttctaaaggccctcaaaataagattaaactctataatttgattacattatttcaggcagagttctttcaacaggttcatatgttccaaggctaaaaaaaaaaaaaatagcatactgagaaaacgaaaattaagagttttagttaacatctatgaaatcacaattaggtcaaacatggagaaaattggctgggcgcaggcactttgggaagcagagccaggcagatcgcttgagcccaggagtttgagaccagcctaggcaacatggcaaaacccatctctacaaaaaatacaaaaattagctaggtgtggtggtgtgcacctgtagcccccgctatccaggggactgagaagggaggatcgcttgagcccaggaggtcaaggctgcattgagccatgatagcgccactgcgttccagcctcagcagcaaagcaagaccctgtatcaaacacatacacacacacacacacacacacacacacacacacacacacacacaaaacacccaaaaaaacacattgaggaaatcttattaattcaggaaaaatgaaaactttatgtcagaaaggcaattattgggcactgagaaatgtcttttctgtataaattattctactttctatagtttctcaactgatagcagttaatcactctaaattaactggttggcaaaaaaaaaaccctttagcattttccaacattaaaagaactctttttttttttttttttttttggacggagtctcgctctgtcacccaggcacgcaccaccatgcccagctgatctttgtatttttagtagagacgggttttcaccatgttggccaggatggttttgtactcctgacctcaagtgatctgcccacctcggcttcccagagtgttgggcttacagatgtgagccaccacacctggccaaaagatttccttttaagaaaaatgtgggattttttctacgaaggctctttaaccacacaagcacagaatactagtttatgcaactacattatacgacaactccctaattttaatgcagaaacatccatcttatttttctttttgaggcagggtttcgctctttcacccaagctggagcccagtggtgcagtcacagttccctgcagcctggaccttctggtttcaattgatcctcccacctcagtctcccaagtagctaggactacaggagcacaccatgacggctggctaagatttctattttttttttgcagagataggtttttgccatgttgcccaggctggtcttaaaactcccggtcatgtgatctgcccacctcagcctctcaaagtgctggaattacacgtgagccaccaagcctagccgaaacatccttctaataggatcttaacattggttgaagttagttgcccctctgcttcaaaagaaattctggctttggggaaataactgtaggtatatataaagcaaggttagcaatctagtaaattaatctagcaaaccctcttcttcaaatttaagttcagatttaaatcagatttcagatcaaaaagctttggaattaacttttttttttttttttgagatagggtctcactatattgcccatgctgctctcgaactcatgggttcaagtcatcctccagctgggatatcaggcatggagccactgtgtccagccaattagtctggtttttttgtttgtttgttttttgtttgtttgtttgttttgagatggagtctcactctgttgcccaggctgaagtgcagtggcacgatcttggctcactgcaacccctgcctcccgggttcaagcaattctcctgcctcagccccacctagtagctgggattacaggcggcaggtgccaccatgtccggctaatttttgtattttagtagagatggggtttcgccatgttggccaggctggtctcaaactactgacctcaggtgatacacccacctcggcctcccaaagtgctgggattacaggcataagccaccatgcccagccagtatttatgtttgagacggggtctcactctgtcgcccaggctggagggcagtggcataatcacagctcactgcagcctctacttcctgggctcaagtgatcctctcgcctcagtcccccaaacagctggggctacaggcatatgccaccatgcccagctaatttttttgaattttagtagagacaaagtctctgttgtccaggctgatcttgggctcctgagctcaagcaatcctcctgccttggcctcccaaagtgctaaaattacaggtgtgagccatcacaccaggcctccaattactctttttgaagaggatactatataatcacaactgatgggcattttttctcccctgtttttcttcataaaatccatgtgaatatctatgtaatgttgttcatcaaaagccaatgcatagcctcatcaaaaagtcagagctaaactacaactatttattcattataaacttagttactcaattcatgcagcatgcaaactacaagcaaacacaggcaggattattctcacctttacctgctctatatgtcttggcttgattcactggcatgggcgtcataggtattgggtataaaggcttgagagaattaaaaaaaaaattaacattaggcacctatgataataacaaggtattctgtcactcttagttttatattgctagagagctaggcatgagaaggtttcctgattctccattagtcattaaaaaattagatcatacccacagctaaaaggaacaaaccccaaactacagtaaatctaaaccatctttttcacagaaaacattctcagatttaggtcctcatacttaacaacacactgaatctctgcatgcctgtctgtttcaaatgcatatgcataaccatcacaccctcaagtcactgaaaacctaaagagtgcttggtgtcagatacaaacaattggggaggctaagtgaacatcaaattctatgacttacttgcacgcctgggctcactgggactggatacatcatatttggtgcaaaacaaacaggctgagtataaactggagttggctgttgatgacccaccatagatgggctaggttgtgcttgaggccgaggtgaagttggggtagtagaaggctttggctacaaaaacaacaataaattcaattatctcaaggtaacagatgaactattattgcaatttaaagacggattttcccagtctttctaattttacttgctttaactatgtcccttttattgaaaacaaaaacacagcacataaattttcacatttcaataaaagaaaaaatgtttcagtaggaacttaaaactttgtcaattaaaaaatattaaaaacagtggcagctatttttaagaaactgatggaagtgtttttaaaaattaaaaataaatatatcttcttatgatctcagtcgaataataacaatagtacagtcatctcttagtatctgtgggggattggttacagtaccctgtgaagataccaaagtcttggaatgctcaagtcccttacataaaatcatgtagtattcgcatacaacctatgcatatcctcctatatactttacatcatctctagattatttataatacctaaaacaaggtaaatgctttactgtattgttttggaataatgacaaggaaacgtctgcatgtgttcagtatagattatcctaactatgtttttgatccatggttggttgaatccagtgatgcaaaaccctcaggtgcagaggacgtatctataaacctgacagcctagctagccaaccatcgtcaaattctgggtcagagaaattcaaagatttgcccaagatcacatctaattgatgacaaaacaaagacctttttttaatgtttaaaaagtattcattaatggccatgtaaaaaaaagaaagaaggttggttcagcacactaaaacaaaattcagatggcaggtatggaagaaggactattactaataatttttctttttttgggactagataacctcaaagaaagtaataaacctacctgagagaaggaacgtgggttgaactcctttgcattgggattcaatgttgatttcctaacttgcctaaaaaaaatataaaggccagtgaaatctacatggactttacgttgctctaaaatcttccatacctgacaatttaaaaaaaattgctaaatatagatttaaactgttctcactagaagatcactaatcgtttttattgaaacatatacacttatattgcccattccttaatcccttaaagaatacagccataaaagaacaattttttaaaaatctgagtaatatacaaccgttcctctcaaaggcaatcaaaaaatactttttttttttccttcacagagtcccactctgttgctcaggttggagtgcagcagtgcaatcttggctcactgcaacctctgcctcccgagtttaagccattctcttgccttagcctcctgattagctgggattacaggagactgccaccacgcccagctaattttttttaatatttatttttagtaaagatggggtttcaccattttggccacgctgaccttaagtgatctgcctgactcagcctcccaaagtgctgggattacaggtatgagctaccacgcctggccaatcaacaaacacttgagctgaaaagacagtagctacttatgaaatatccttaaaagcaattcttaacataacagtatccttttatttatttatttatttatttttgagacagagtctcgctctgtcacccaggctggagtgcagtggcatgatctcggctcactgcagcctccaccttctgggttcaagcaattctcctgcctcagcctcccgagtagctgggatacaggcacctaccaccatgcctggctaatttttgtatttttagtacagacagggtttcacatgttggccaggctggtcttcaactcctaacctcaagtaatctacctgcttggacctcccagagtgctgggattataggtatgagctaccagtcaacataccaatattctagcatgcagtaattcttatgtgagaagatattttacatgacatacctggaaaaagtcatggctgtaaaaaaaaattgcctcaaatcaagaataagcagtccccaatttatcaataagctgcattccaaaacttcagctttaactggattgtttggtacccaaacacctaagtcaatggtagttaagttctgaggttagcccctaaaagtccatttaattaatatactgaatgtgcagaattaagtctatcttaacaaatctaaacattaactaaaacacagtttctgatgaaaaatattttgaattccaagtagaagcaccgcatgcttctctccttgacagtggcagtttttcaacctagcagcacagtgagggtgactaatgagtggaatccagtaaagataggtcccctgaattgataatttttcaactcctgttcatttacagaaaaacttttcttaatttatgccttgtttttctagccctggggtacaaaaaaggggaagaacagaagagtagcacagggtgcaataacctcatttacttaagatgtcatttgtttggactagctgtttgtaaactaagggcaatgtataaagtagtctaaaagtccagatggattcttcacagttggaaggacctaaatgcctttaaaaaaaaaaaagttaattgagtaacaggatggtctaagttccaggtttactcactcagctgcgtctttcttctcttccttatcgtctttctcttgtttacatgctgggctggaagtctgaaccccttgggaagtgacctcaggtcccctcttgtgctccgtgttactaagtattgaaggggaaatgctggggctattcggcttgctgctgccactggtacagttgctgctgctattttcaatgaaagaatccttagcacttggttcaattttgtctttgatcaaatctcttgatttttctccctctctatttttgtttagtagttgatccatagattcagaagtagaacttggctgtaactaaataaaggaaacaattatacttaaatatcttaaataactttagtaatacatttttgccatgagcacaagctacgtaatattaactatacgcatgaaatgttctgaataaggcttttttcatactttaagagtaatgcttttactataaactaacaataacagagtacctatatagcacaaccacagtcaccaaagcactcaaatgtcctagcctctaaagttcaatatttactgagtgcttaccacatgtcagaaattgtgcctgctgggtgagaaaaatatgaaatagtttctatcctcttatacttgtcatttaaataagatcagacacttcacaataaaatgagtaaatgctaagagagtctatagaaaaagcaacctataaaaaagaaaggtttctcagtaaagtgtcagctagtctaaggtgtgaaagaagtttaggaaaggtgttgggatggagaatagtctaagtaaaaggaagagtatgtttaaaaatccaaagaaaagggagaagctggctctatcacataaaacaatagcaccaatgggggccgggcacggtggctcacgcctgtaatcccagcactttgggaggccaaggcaggcggatcacgaggtcaggagatcgagaccatcttggctcacacgctgaaaccccatctctactaaaaatacaaaaattagccaggcatggtggcaggcgcctatagtccctgctactcgggaggctgaggtaggagaatggtgtgaacctgggaagtggagctgcagtgagccaagatcacgccactgcactccagcctgggtgacagagcgagactccgtctcaaaaaaaaaaaaaaagatagcaccaatgagctgggcacagtagctcatcactgtaattccagccctttgggaggctgagacaagcagactgcttaagctcaggagttcaagaccagcctgggcaacatagtgataccctgtctcatttaaaaaataataataaaataaaataaaataacaaaaataaagaagtaaagaaaagcaccaatggctggaccaagggtgagacacacatgtacaagtgagtcagaaaatgatagactcgtcaaaaggaatatgacaataaaggaacttaaaagctatgttcagggctgcgtgcagtggctaacacctatcatcctagcactttgggaagccaaggcaggtggatcacttgaggtcaggagtttaagaccagactggccaacatggtgaaactccgtctctactaaagataaaaaaaaaaaattagccaggcgtgatggcacacgtgtaaatcccagctacttgggaggctgacatatgagaattgcttgaacccaggaggcggaggttgcagtgagccaagatcacaccactgcactccagcctgggtgacagagcaagactccatctaaaaattaaaaaaaaaaaaaaaaaagttttaaaaagctacgtttaggactttggcttttaattctcagggcaaatgggcagtctatacggaattttaagtagggtagagtactgggcagatttatagttcagaaaggtgaacacagcagctttgtgtgaaatgaactggagggaggctaattaggatgtggagggaccgtcatggaggctggactaagcgctgggcctagtcagcttggaaggtcattaagtaggtgaattcagaatgagacctgactgtacatattggtcagttagacattctaaacccctaagtaaaaaaaggagatggcaggggagaagagacagagcatggtggccaaacagaaccttccagtgatcatccccaacaaggagcaccaaattgaacaactatccacacaagaaagcaccttcataagaaccaaaaattaggtaagcgatcacagtacccagttttgacatcctatcaaggaaaaagacaccaaaaaagataaggaagatagtcttgaactgcccctccaacacccctgacattcccccacaatgcagtgtggggtggagaaagaatctgtgtgctcgggggagagagagagaaatgactgtgggattttgcattgaaactcagtgctgccctgtcacagtggaaagcagcataggacagaattcagccagcacccacagagggagtatttagactagccctagtcagaggggaattgtccatcccagtgattagaatctgaatttcgggctgggcactatggtctgtaatcccagcactttgggaggccgaggcggacggataacctgaggtcgggagttcaagaccagcctgaccaacatggagaaacctcatctctactaaaaaacaaaaaaattagccagaggtggtagcgcatgccggtaatcccagctactcaggaggctgaggtaggagaattatttgaacccgggaggcggaggttgtggtgagctgagattgcgtcactatactccagcctgggcaataagagcgaaactctgccaaaaaaaaccaaaagaatcttaattttggtaagccccaccaccgtgggtaaagtcctctggggtcctaaataaacttgaaaggcagtctagaccagaaggactgcaattcctggacaagtcatggtactgtgctgggctcatagtcagtggacttggggtacatgtgacccactgagacaccagctagggtggccaagggagtgcttgtgccagccttcccccaactccaggtaccacagctcacagctctgggaggagagggaagagtagggaggactttgtcttgcaatgtggatactagttcagccacagtaaaataaagcaccaagcatagttctgaagcctcaattctaggccatagctcccagatgacatttctagacatattctggaccagaagggaacccattgccttgaagggaaatacctagtcctagtaggattcaccaccagctgactaaagagcccttgtgccttgaataaaaaacaaggtgccatgtcgtattgtgccagcttcagatatgaccccgcacattcacagctgtggtgtccatggggagacccacctgcttgaggtgagagaagagtaaaaaggactttatcttgcaagtgggtgccagctcagccccagtacaataaagcagattcctaaagctcccgatcccaggccctggctcctgggcagcatttctagacacaccctgggccagaagggaacctgctgcactgaaagtaaagacccagttcttgcaggattcttcacctactgactaaagcacccttgggccttaaattaacatcagtggtggccagaaaatagctgccacaggccttgggtgagaccaagtacagttccagtgacggtggccatggcagtgcttgtgtcacccttccccaaactccaagcagctcagcacaaagagagactccatttgtttggagaaatgtaagaggacaagagactgcctggtaatacagggaattctcccagatcttccccaagactaccaaggtgatacctctacagagtcacaacattactagtcttggggtgccctctaatgcatgtatggctgcagtgagcgaagacttagatgacaacacttaattccctttgaatacttgaaaaaccttctcaagaagaatgggagccggatgcagtggctaacgcctgtaatcccaacactctgagaggccaaggcggacagatcacgaggttaggagttcgagaccagcctgaccaacatggtgaaacaccatatttactaaaaatacaaaaattagccaggcgtggtggcacgcacctgtaatcccagctactcaggaggctgaggcaggagaattgcttgaatccgggagacggaggttgcggtgagcaaagactgtgccactgcactccagcctgggcgacagagcgagactctgtctcaaaaacagaaaaaaaaaaaaaagaatgcgtacaaacaaaaccagactacaaagaacagaatacccaactcttcaatgcccagacactgatgaacatccacaagcatcaaggccatctgagaaaacatgacctcaccaaatgaactaaaaataaaggacaccagtgaccaattcccaagtgataagagatatgtgaactttcagacagaattcaagctgaatgctttgagaaagttcaacgaaatccaagataatacagagaacaaattcagaatcctataaatttaaaaaagagactgcaataattattagtaaaaagaatcaagcagaaatcccaaagtggaaaaattcaattgacaaactgaaaaatgcatcagtctctcaatagcagaaatgtatcaagcagcagaaaacattagtgagcttgaattcaggctatttgaaaataaacaaccaagttgggcacgatgactcacgcttataatcctagcactttaggatgccaaggcgggcggatcaccctgaggtcaggagctcaagaccagcctggcaaatatggcaaaaccccgtctttactaaaaatacaaaaagtagctgggcgtggtggcacatgcttgtaatcccagctacttgggaggctgaggcagaagaatcgcttgaacctgggagttggaggttgtagtgagccaagatggcaccactgcactccaggctggtaacagagcatgactctgtctcaaaaaaaaaaaaaaaaaaaaaaagttcttcaatctgcaagaaaaggatgttaacaaacaataataaatcacctgaaggtgcaaaaactcactggtaacaagtacacagaaaaatacagaatattgtaacactgtaattgtggtgtataaactactactcatattttgagcaggaagaataaaaaatgaacctttcaaaaataagaactacaattttttttttttttgtgagacagagtcttgctctgctgcccaggctggacggcagtggcgcgatctcggctaactgcaacctccgcctcccaggttcaagcgattctcctgcctcagcctcctgagtagctaggattacaggtgcgtgccaccacgcctggctaatttttgtatttttagtagagacagagtttcaccacgttggtcaggctggtctcgaactcctaaccttgtgattcgccccacctttgccttccaaagtgctgggattaggcgtgagccactaggccagggttttgttttgttttgtattgttttttgagacagtcttactctgttgcccagactggagtgcagtggcgcactctcggctcactgcaacctgggcctcctgggttcaagtgattctcctgcctcagcctccgagtagctgggattacaggcacccgccaccatgtccggctaatttttctatttttagtagagagggggttttgccatattggctaggctggtctcgaactcctgaccttaggtgatccgcccacctcagcctcccaaagtgctgggattacacacgtgaaccactgcgcctggcttataactacagttttttaagacatagtataataaagatataaataaaaacaacaaaagttaaaaagcgggcagatgaagtgtagagtttttattagttttctctttgcttgcttgtttttgcaatcaaagtttcaagttgtcattggtttaaaataatgggttataaaatgttatttgcaacccttatgtgatctcttttttttttttttttttgagacggagtctcactctgtcgcccaggctggggtgcagtggcacaatattgactcactgcaacctctgcctcctgggttcaagcaattctcctgcctcagcctcctgagtatctgagattacaggcacgtgcctccacgcctggctaagttttgtatttttagtagagatggggtttcaccatgttagccaggctggtctcaatctcctgacctcttgatccacccacctcggcctcccaaagtgctgggattacaggtgtgaaccactgcacccagctgtcatggtgatcttaaatcaaaaacacctacaacagatacacaaaaaatataaagcaggaaattaaaacataccaccagagaaaatcactttcaaaacaaggaagggagggagggaaaaaaggagcgaagaggaagtaaaaaagaagggggaagggagggagtaggactacaaaacaaccagataataagtaacaaaatggtagtagttaagtcctcactaatcagtaacaacactgaatgtaaatcgactaaactctccaatcaaaagatacagagtggctaaatggatttaaaaaaaaggctgggtgcggtggctcacgcctgtaatcccaggactttgggaggccaaggcaggcaaatcacctgaggttaggagttcaagaacagcctgacgaacatactgaaaccccatctctactgaaaatacaaaaaatttagctgggcttggtggcaggcgcctgtaatcccagctacttgggaggctgaggcaggagaatcgcttgaactcaggaggcggaggttgcagtgagctgagatagcgccattgccctccagcctgggcaacaatagcaaaactctgtctcaaaaaaaaaaaaaaaaaaaccaaagatccattgcctacaagaaacacactttacctataaaatcacacatagactaaaattgaagagctggaaaacaatattccatgcaaatggaaaccagaaaagaacaggagtagctatgcttagataaaatagattttgagacaaagtctataaaaacagacaaagaagattattgtataatgataaagggatcaattcggcaagaggttataacaagtataaatacatatgcaaccaatactggagcatccagatatataaagcaaacattattagagcaaaaaagagaaacagacctcagtaacagtcggaaacttcaacaccccactctcagcaatggacagatcattcagacagaaaatcaacaaagaaacattagacctaatttgctctatagaccaaataggcccaatacatatttacagaacattgtgtccaacagctatagaatacacattcttctcctcaacatatggattgctctcaaagatagaccctatgttaagccacaaaacaagtctaaagatttgacgtggcacagtggctcatgtctgtaatcccagcaccttgggaggccgaaataggtggattgcttgagctcaggagttcgaaacaaccctgggacacatcgcaaagccccatctctacaaaaaaaaaaaaaatccaaaaatatcagccatatgtgacggcatgtgcctgtagtcccagctacttggaaggctaaggtgggaggattgcttgagccaggaaggcggaggttgcaggtgagccaagatcatgacatgtactccagcctgggtaacagagtgagactctgttacaaacaaacaaacaaacaaacaaataaataaataaaaattcaaaaaagttaaaatcatatcaactatcttctctgatcacaataagataacactagaggccgggcacggtggctcatgcctgtaattccagcactttaggaggccaaggtgggtggatcatctgaggtcaggagttcgagatcagcttgaccaacatggtgaaaccccctctctactaaaaatacaaaaaaaaattagccaggagtggtggtacatgcctgtaatcccagctactcaggaggctgaggcagaagaatcacttgaactggggaggcagaggttgcagtaagccgagatcgcgccactacactccagcatgggtgacagagcgagactccatctcaaaaaaacaaaaataaaaataaaataaaataacactagataacaagaggaactttggaaagtatacaaatacatgaaaattaagcaatatgctcctgaatgaccagtgggtccatgaagaaattaagaagaaaactggaaaattccttgaaacaaatgaaaatggaaacacagcttatcaaaacctataggatacagtaaaagcaacaataagaggaatgtttacagcagtaagtgcctacatcaaaaaagtggaaaaacttcatctgccaatacatcctaaagaactagaaaagcaaggacaaaacctaaaatcagtagaagaaataaaaaaaatcaaagcagaaataaataaaattgaaatgaagaaaatacaaaagatcaataaaacagtaaattgttttgaagagataaacaaaactgacaaacctttagccagactcagaaaaaaaagagaaaacccaaataataaaatgagagatgaaaaaggagacattataattgttaccaccgaaattcaaaggatcattagagactactatgagcatctatatgctgatacattggaaaaccttgaagaaatggataaattcctagacacatacaacctaccaagactgaaccacaaagaaatccaaaacccaaatacaataacaagtaacgagaccaataacaagtaacgagatcaaagctataagaaatagtctcccagcaaagaaaagccatggacctgatggcttcactgctgaattctactaaacctttaaagaagaactaataccaatcctactcaaactattccaacacaatacaggaagagggaatacttctaaactcattctacaaggccactattaccctatacaaaaccaaaggacacatcaaaaagggaaaactagaagccagtgtctctgaagaacattatgcaaaaatcctcaatataatactagcaaaccgaattcagtaacacattaaaaagatcattcatcatgactaagtgggattcatcccagggatgcaaggatggttcgacatacgcaaatcaataaacatggtacatcttaacagaataaaagacaaagactaaaaaatatatatatatattatttatactgtgtatgatataaatatatatcacatgatataaatatataatttatatcacataaaatgccacatccccttatgattaaaacccttggccgggcgtggtggctcacgcctgtaatcccagcactttgggaggctgagacgggcagatcatgaggtcaggagttcgagaccatcctggctaacacggtgaaaccccgtctctactaaaaatacaaaaaattagccgggcgtgttagcggacacctgtagtcccagctactcgggaggctgaggcaggagaacggcatgaacccaggaggtggagcttgcagtgagccaacattgcgccactgcactccagcctgggtgacagagtgagactccatctcaaaaacaaacaaacaaaaaaaccccaaagaactgggtatagaaggaatatacctcaacaaaacagaagccatatatgacagacccataactagtaccatactgaaaagggaaaaactgaaaggctttcctctaagatctggaacaagacaaggatgcccactttcaccattgttattcaacataatactcggaagtcctaattggagcaatcagacaacagaaagaaataaaaagcatccacactggaatggaagaagtcaaattatccttgtttgcagataatatgatcttacatttggaaaaacctagactccaaaaaagaaaaacctattagaactgacaaacaaattcagtaaaattgcaggatacaaaaatcaacacacaaaaatcaggagcatttttatatttaacagcaaacaatctgaaaaattttttaaacgcaatcccatttacaatagctacaaatataataaaatacttaggaataaacttaaccaaatgagtaaaagatttctataatgacaactttaaaacactgaaattgatgacacagaaaaaacatgaaaagagattccatgtttatggattagaagaattaatattgctaaaatgttgataatactcaaagcaatctacagattcagtgcaatccctatcaaaataccaatgacattcctcacagaagtagacaaaaataattctaaaatttgtagggaaccacaaaaggcccaaaagagcaaaagccatactgagcaaaatgaacaaaacgggaggaatcattatctgacttcaaattattgtaaccaaaatggcatggtactggcataaaaaaagatatagatcaatgaaacagaacagagaactcagaaatgaatccatacgtctaagtgaactcattttccacaaagaagccatgaacatacactggggaaaggacagtctcttcaataaatggtgctgggaaaactggatatccatatgcagaagaatgaaaccagacccctgtgtcccaccatattaaaaaaaaatcaaatcaaaatggactaaagatttaaatctaagacctcaaactatgaaactactaaaagaaaacattaaactcccagggacattactctgggcaaagatttcttgagtaataccccaaaagtacaggcaaccaaagcaaagatggacaaatgggatcacatcaagttaaaaagcttctgcacagcaaaggaaaccatcaacaaagtgaagagacagcccacagaatgggagaaaatatttgcaaactactcatctgacaagggatcaataaccagaatataaaaggcactcaagcaactccatagggaaaattttagtaactcaattaaaaatgggcaaaagatctgaatagacatttctcaaaagacgacatacaggctgggcgcagcagctcacgcctgtaatcctagcactttgggaggctgaggcaggtaaatcacctgaggttaggagttcaagaccagcctgggcaacaaggagaaatcccgtctctactaaaaatacaaaaattaggcagacatggtggcaggaggcaggagaattgcttgaatccgggaggtgtagggcgcagtgagccaagatcacaccactacgctccagcctgggcaacaaagtgagactctgtctcaaaaacaaaacaaaacaaaaaaaaaaggaagacatacaaggccaggtgcagtggctcacaactataatttcagcattttgggaagccaaggtgggaggattgcttgagcccaggagttcgagaccagcctgggccaaacagcaagacctcatcgttatttatgaatggcaaacaggtatatgaaaggtattcaatactactgatcaccagaaaaatggaaattaaaactacaacaagatatcatctcaccccagttaaaatggcttttatccaaaagacaggcaataacaaatgctggtaacgatgtggataaaggggaaccttcacacactgttggtggacatgtaaattggtaaaaccactatggagaacagtatggaaattcctcaaaaaactaaaaatagagctaccatatgatccagcaattgcactgctaggtatatactcagaaaggaaatcagtttattgaaggaatatctgcactcccatgtttactacggcactatatacacaacagccaagatttggaatcaacctacgtgtccactgacagacaaatggagaaagaaaatgtggtatatatacacaatagattaccattcagccataaaaaagaatgagatcctgtcatttgcagcaatgtagatggcactggaggacattatgttaagtaaaataagccagggacagaaagataaactttgcatattcttactcgtttgcaggcactaaaaataaaaacaattgaacacatggagatagcagaatggttaccagaagttgggaagggtaatggggagaagaagggaaatgaggtgattagtgggtgcaaagaaaatttagaaagaacgaataagaactctgcaggaccggaggcagaaatgaaaaagatattaaaatgatttaaaataattttaaaggccgggcacggtggctcacgcctgcaaccccagcactttgggaggctgtggcagccggatcacaaggtcaagagatcaagaccatcccagccaacatagtgaaaccccgtctctactaaaaatacaaaaattagctgggcgtggtggcacgtgcctgtagttccagctagtcaggaggctgaggcaggagaatcacttgaaccctggaggcggaggttgcagtgagttgagactgcgccaccgcactccagcctggcgacagagtgagactccgtctaaaaataaataaataaaataagtttaaaatttaaaaagttaaataaagaatgaataagatctagtatttgacaacaaagcagggtgactacagtcagcattaatttgttgtactttttagaataactgagggagtacaattgcaacgttcattacacaaagaaatgatgaatgatgatggtgatggataccccatttaccctaatgtgattattacacattatatgcctttatctaaatatctcacagaccctatgaataatacgtctactatgtacccataaaaaaataaaaacctttaaagtagactgcaaaaccaaggaccatcaaaaagaacagaagacaaagatattagcaaaataagtgatgaggtttttaagtttgcagaccagaaaaaataaaatgctaccactggctgaagatgatttaagatggcatcctctacaaaagaaagaaaacaggaatggctgaaaaaagggggagcaagtacaagcaacaaaaacagaacctaagccacaggttaggacaacggacctaagccacagccccaggtggtgagaaacaagctaaagagaaacctacacagccaaaaaggttgccttaaaattagagagccaagatacctcttcagcctcagtataggcaaaccaatttcaatggtttcattaccaaggctcttggtgtcatggcaaacagcattatgcaactctggcgcatcgcaagctttactgcattaccaatatagctaaagagtcaagtggctaagggcaaatgttgacagggtatttatgtgggcacactggcaatttaagtcacgatgtaggaacttactacttaaactttcatttgttcacaaaaatctttagtagaggcgatccacataacagaccaactatatatattgccaaggacttcggagtttaattatcataagagttcttgagtgaaggcaaaaatcagacttttggtgttgctttttcttacaatgtcaaacacatctgcatttcttactatgggttggacacttttttttttttttccaaacagggtctgactccgttgcccagactggagcgcagtggtgcaagctcacctcactgcaacctccatctcccaggctcaagtgattctcccacctcagcctcctgagtagctggtactattagcatgtgccaccacacctggctaatgtgtgtatttttttgtagaaacagggttttaccatgttacccaggttggtctttaatgcctgagctcaagctatccacctgtctcagcctcccaaagtgctaagattcaggcatgagccactgtacctgtccagacactgttctaaactatttatagacttattcatttagtcttcacaacagccctatttgatgtagatactattattgccatcttacaaatagcaagtccactagttggtatctgaatatagcactctgctgtattggaatatattgttctaatgctatattgctatatatggaatatagcactctgctgtatttcctctctgcactatactaaatctaatggaaaacttaagttctttttttttcttttttttggagacggagtttcgctcttattgcccaggctggagtgcagcggcacgatcttaactcatggcaaccaccgcctcccgggttcaagcatttctcctgcctcagtcttgcgagtagctgggattacaggcacctgccaccacgcctggctaattttttgtatttttagtagagatggggtttcatcatgtcggccaggctggtctggaactcctgacctcagctgatccatccacctcagcctcccaaagtgctgggattacaggagtgagccatcatgcccagcagaaaactgaaattcttatgtgactccacatgaaatggtacaatgacaccattgtacatactctgtacaatactgggtcatctatattttgctagtaagaatgaacatgtattgaatacataccatgtgctaggcactatgctaaacactttataggcaatatctcatcgagctctcacaggaacactatgaagcaggttctaaaattaacccattttggcttgggggaagtagatagcatgccacaatgttacgcacatgatgtatagaggccaacattcaaacctaggtccatttacctctaaaacccacattattaacccaaaacagatcaaattactagcaattcttacacaaataaagctatcagcactctgcatatggctcaaaagggaaggaacaacaaacacacaaggtatttctatttctgcctaaatgaaggactacagatatttgtgaacaaatgcagtttggggctatgagcatgtcatgaagttagctctaatgaatcactgactgacagtgcagcatgcactatgcattagttactattcaaagcactgctagaagcttaaacaccagatggtcagccctcttacttactagccatgtgagtttgggcagattacttaacttctctttgcccaagctgcctaatatacacagtgcagatacaaacagaacttgcttgacagagatgttagacaagatttaacatacaagcatgaagaacagcatctggtacacaggaaatacgcaataaaacataagagaataacattatattatctgaagagaacaattagaaagttcactcttttatttttttttaattaaaatttaagttctgggacacatattttttttttccactctctttttttttctttgagacagattctcgctctgtcgcccactgatgcaatctcggatcactgcaacctccacctcctggattcaagtgattctcctgcctcagcctcctgagtagctgggattacaggcatgtgccaccatgcccggctaatttatatatttttaataaagatagggtttcgccatgttatccaggctggtctcaaactcctgacctcaagtgatccacccgcctcagcctcccaaagtgttaggattataggtatcagccaccgtgcccggcccactctcattttttaaaaaccacttcttttcttcctggtatgcccctatggatcaaggagttattagtaagaggctaaataatacatttggttattcaggcacctaaaagtagtaagactaaaactcctaaagagataagactttttatgttgctccttcttggaatttaagtcaagcattaatgaaggtttacagaaagttgtgctgatagctaaaatgttttctgctaactgaaaaagtacagccttttaaaatacagtaactctaatcaagacagtatggtactgccataaggataagacatagagattcagtggaggacaattcagagtccagtaataaactttcacatttgtagtcaacagacttccaacaagcatgtgaagataattcaatggaggaaagaatagtcttttttttgagatggagtctcactctgtcgcccacactggagtgcatgatctcagctcactgcaacctctacctcctgggttcaagcgaatctcctgcctcagccactacagtagtgggactagactacaggtgtgcgccaccacacccaggtaatttttgtatttttagtagacatgcggtttcaccatttggtcagactggtttcgaactcctgacctcatgtgatctgcctgcttgggactcccaaagtgctgggattacaggcgttgagagccactgtgcctggccaagaatagtctttttaacagatggtgctgggacaactaatacctacatacggaagaatgaatctgaacttacacagtaaaaatggttataagtgtatggttatgtgtcaattagaaataaaaaattaatataaagaatgaatttgaaccccaccttatgctatattaaataactgctcaaaatgggctgagcaccaagtcactctcctatgaccttttttaattttttaataacaatttgtttcacttaaaaaaaatcaaatgttattctcataatattgttataggaaaggggtcccgatccagacccccagagagggctcttggatcttgcacaagaaagaattcagggcgagtccgcagtgcaaggtgaaagcaatttttcactttgggaggctgaggtgggcgtgtcacttgagtccaagtgtttgagaccagcctgggcaacatggcgaaattctgtctctacaaaaaaatacaaaagttattaatagcaaggtgtggtggtgcacacctgtagtaccagctactcatttgagcccaggaggctgaggctgctgtgagccaagattgcaccactgccctccagcctaagcaaaagagcgagattctgtgtcaaaagaaaaaaaaagttgctccaaatggatcacacctctaaatgtaattcttaaaaaaacccagaagagtaataaaccttaatgattgatgaaacagtattttcttagatacgacaccaaaagcttacttcaaaatcagataaattggacttcatcaaaattaaaaatttttgtgcttcaagggatgaaaaagtaaaaagacaaccaacagaacaggagaaaacatttgcaaaccatgtatctaacagggacttgtacacacaatatataaagaactcccacaacccaataataaaaagacaactcaatttttaaaatgggtaaagatttgaacagacatcaatccaaagaagatatataaatggccaataaacacaaaagatgttcaacatcattagccatgaaagaactgcacattaaagccacaatgaggttaacacttcacacccacaaggatgactataatcaaaaaagacaagacaataagtgttagcaaggatgtggagaaacagaaaccctcataccctgctggtgggaatgtaaaatagtgtagatatcttggcaaatagcttggtagttcctcaaaaggttaaacacagttgccatatgacccagcaattcaactcctaggtaggtacacaaaagaaatgaaaagataggacgagaaaaaaactgcacactcatgtttgtggcagtgttattcagaatagtcaaacagtgagaacaccacaaatagctacaaactgattaatggataaacaaaatgtggtattatccacatcaaggaatattagtcagtcacaaaaagaaatgaagtactgaaacatgctccaacatggatgaacttttataacactactctgagtgaaagaagccagtcataaaagccacatattttattattccatttgtatgaaatggaatttgccccaaataagcccatccatagagacagaaagtagattaacggttgcttagggttgggagtaggggaaagagaagggctggaggcaaatgtggaacgactgctaaactgggcacggggtttcttttgggggtgaagagtatgttttaaaatcaactgagaagacggttgtacaacattgtgaatattttaaaaaccactgatttatacactttaaatggttgatttatatatgtaaattatatctcattaaaaaccactgatttatacactttaaacggtttatttatatatgtaaattatatctcaataaagctgttataaaaacatgctaattcacatgcttcaaagtagaaatgttttttcttcatgagatattaaattcaatccaagtgtagtataagaggagactgaatgatgttaaaaaaaataatgctgaggaaaaaattcaaatggggaagaatacctacagcaagacatcattgtccctctccctctccccccctccccctccccctccttctccttctccccacggtctccctctccctctctttccacggtctccctctgatgccgagccgaagctagactgtactgctgccatctcggctcactgcaacctccctgcctgattctcctgcctcagcctgcctagtgcctgtgattgcaggcccgcgccgccacgcctgactggttttcgtatttttttggtggagacggggtttcgctgtgttggccgggctggtctccagctcctaaccgcgagtgatctgccagcctcggcctcccgaggtgccgggattgcagacggagtctcgttcactcagtgctcaatggtgcccaggctggagtgcagtggcgtgatctcggctcgctacaacctccacctcccagccacctgccttggcctcccaaagtgccgagattgcagcctctgcccggccgccaccccgtctgggaagtgaggagcgtctctgcctggccacccatcgtctgggatgtgaggagcccctctgcccggctgcccagtctgggaagtgaggagcacctcttcccggccgccatcccgtctaggaagtgaggagcgtctctgcccggccacccgtcgtctgagatgtggggagcgcctctgccccgctgccccgtctgggatgtgaggagcgcctctgcccggccgcgaccccgtctgggaggtgaggagcgtctctgcctggccgccccgtctgagaagtgaggagcccctctgcccggcagccgccccgtctgagaagtgagaagcccctccgcctggcagccaccccgtctgggaagtgaggagcatctccacccggcagccaacccgtccgggagggaggtgggggtcagcccccgcccggccagccgccccatccgggagggaggtggggggtcagcccccgcccagccagccgccccgtccgggaggtggggggcacctctgcccggccgccccttctgggaagtgaggagcccctctgcccggccaccaccccgtctgggaggtgtacccaacagcttattgagaacgggccatgatgacaatggcggctttgtggaatagaaaagggggaaaggtggggaaaagattgagaaatcggatggttgctgcgtctgtggagaaagaagtagacatggtagacttttcattttgttctgtactaagaaagattcttctgccttgggatcctgttgatctatgaccttacccccaaccctgtgctctctgaaacatgtgctgtgtcactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcactttttatctgctgaccttccctccactattgtcctatgaccctgccaaatccccctctgcgagaaacacccaagaatgatcaattaaaaaaaaaaaaaagactttatagcaaatttaagattatgcaaaatatcatctattgctcacagatatattcatatgcagtataaatataaagaactgcacagaaaagaaacccttccttttggaaggaaacagggggaagcagctgaggaggggcagatacataagaggagtttaactgtgttagaatgctttatttactaagctgggtagtgggcacatgatcatattcaatattctttgtatcatttgtatgtgttaactattgtttaacaaattgaaaaactttttttttttttttttttttttgagatgcagtcttgctctgtcgcccaggatggagtggagtggtgtgatctcggctcactgcaacctctgtctcctgggttcaagcgattatcctgcctcagcctgccaagtagctgggattacaagtgtgcgccaccatgcctagctaatttttctatttttggtcaagacagggtttcaccatgttgaccaggctggtctcgaactcctgaccttaggtgatctgcccacctcggcctcccaaagtgctaggattacaggtgtgagccaccgtgcccgccaacaaatgaaaacttaggttaacaactgttaatagcattaaagctgaatagatacatgtgctaaagtatgaaataataagtagtattttgaatgttaccaataagtcaagaatgaagctattgttaacatttagaaagctaaaacacaggctgaggaaaggctacctttgcctttggttcactcatcctttaattcagctactttttttaaaaggctggtatttagattttcctttctaagaagctaagtttcaagaagatttattggttggtctcaaaatctacctcgatacctatagtaaataacatgcaaaagaatgaaatgacaatcaaggagagatgttaagtaaagcctgtgctaagacagagaaataatgttacagaaagattttgaccacaatatatttgtgtacaaagtataaatctccaactacctcagaacaccagagtccagtacatcttccatttgccacactagattattaatgacttggccttgctctactaatatctagcttcactgaacaaagtacaaatgaccatcaaatagtaagctgtgctatggtggtttcaaatgtcagggctatactctcatttgatacctacatattgttgttaccaaatctcatgattttagttatcccacttaaaggataggcaaagaccactttaaaaatgttctgctttctacatatatggtttgatgtttctgactgtatacataacgcatttttataaatagataaatctttagtaatgcttattttctaaaactcaaattcatcagttagtacaatacttaccctaaaatcattcttaaatttctttaaatcatcaatctgttttctatgttcagaaacaactggtgatatacctgtaaaattaagaactgttaagacacaggtttatttttaaactttaacatcacattctttttagtatgagatgatagaaattagaataagatataagatcagaaaataatttcaaatattaaatttggattttggaatttgtcaagcaatacatttatctatcacaatagtaagaagaaatgttgaacaaaaatattctgtatgggcatgaaattagacatacttcttcctattcctacagttaagcttaatgactctttaaactctaacctttgttttcagcttttgagaagctaggtgatgtttcattgggtttaatattttctttattccctgcaggagagttctgcctctgatcttgaagcctggaatctttagctagaaaacaattttttaaaaaaaattcagataagttagaaaagcaaaacaagaaaacactgaacaataattttgatttcctatgtttttggaaaataatgctttcatttaaacagaggctttttttcctttgcagatgtcatatgaaacaccaataattttatttatgtaggtatttgacacccaggaatgttaacctttgtaacacagacactatattaaattagtagtattaaacaacatcaaaatttacataaacttttaaatgtgcactaaaaatacttgtctatgaataaaaataacctagaattttttcatataatatcaccctctaacattcaatttcacagctgagattatggatccagaagccctttgttacataccctcactagaaggggtaacagctctgttcgatgcaggactagcaggcgtaggagatgcagctggaataggcatggcaacagcttcagttggaataataccagcttggggagaagcaagaactggcccactgggggtatttccaatactgttctgtctgggagacctgggtctatgagttttaggggataatcttggaactagaagaaagggaaaatgtatttattacattctcagttcaaatgttacttcctaaaagaggcttcaggcttctctgaagatctaggtaaataaaactgtcctctctagcccttaccctttatcccattactgttttcttttccaaaatgttaggaatttgctggcaatcaaaaccacaagtatatgaagaacagcagcaattactaacataagtatgattttctctcctaactaaatgtatcaagtgattctcctgcctcagcctctggagtagctgggattaaaggcactcgccaccacaaccagctaatttttttgtatttttagtagagacggggtttcaccatgctggccaggctggtctcaaactcctgacctcaggtgatctgcctaccttggcctcccaaagtgctgggattacaggcatgagccaccatgcccagccctacacattctttatagcaacatcaaggtccactgtgcagtaattaaggaaacttgagacccaagttagtcaaaaggggaagataataaaagcagggtttgtatcccatatgacttccaagtatatatctaataggtttcatataccattataaacctaactgcagagctcagattcaaaggtttagagaaaatggttcgattatttcatttcagtgtttttttttttttaagtcacaagggtcacggaagaaaactattattcaacaactgccatttttccaattagtaaaaagagaaaatctataatgctattctgagtgtatctccaaaactatgcttatactctctcacttctaatcatgttattctcaaaatttatttccagaccatctaagtaatgtcaaaagattaacagaatagctgaagcagatttttttttttttttttgaaatggagtctcactctatagcccaggctggagtgcagtggcgcgatctccgctcaccgcaacctacacctcccgggtcctggttcaagcaattctcctgcctcagcctcctgagcagctgggattacaagaacgcgccacaatgcccagctaatttttgtatttttagtagagacgacgtttcaccatgttggccaggctggtgttgaactcctgacctcgtgatccacccgcctcagcctccccaagtgctgggattacagccgtgagccactgcgcctgaccggctgaagaagatttttaaaatttttgttttcttggtagtcttaagataattgaagaccaaggaagaaaataaaaagtacaaaggaatttaggatacaattacatgaatgtgcatcacatgaagctgagcagaaatgtatagcaactaaaaacagatttaacacagctgagttttgtttttgtttccttaagcttgaagatcttgtttcttttttcttttttttgagatagagtttcgctcttgtcacccagactggagtgcaatggtgtgatcttggctcactgcaaccttcacctcctgggttcaaatgattctcctgcctcagcctctcaaatagccaccacactcagctaattttgtatttttagtagagatggggtttcatcatgttggtcaggccagtcttgaactcctgacctcaagtgatccacccacctcagcctcccaaagtgctgggattacaggcatgagccacagcaactggccgatcttgtttcttttaaaggttctctggactgattaaaagagaaaaagtgttttttttgtttgtttgtttgtttgttttaagtattctttgtaagctcttgcttaccacagttatgggaacaaagcactaaggactgattggcaaagtagcaaaagcagtcagccttattgtaaaatcatgtcaacgtctagtttttaaactttttttttttttttttttttgagacagagtcttgctctgttgcccatgctggagtgcaatggcgtgatctcagctaactgcaagctccgcttcccgagttcatgccattctcctgcctcagcctcccaagtagctgggactacaggcacccgccaccatgcccggctaattttttttgtacttttagtagggacggggtttcaccgtgttagccaggatggtctcgatctcctgaccttgtgatccgcccacctcagcctcccaaagtgctgggattacaggcgtgagccaccacacccagcctaatttttatacttttatagctgctgtcagcatattccttatgctaatcacaaataaaacttggaccctttatttgtatttgatattccttattatggaaatatagttgggaattagtgccatatacagatgctatagaaacacactacaatgtaagccaaaaataaatgtttatagaatgtactgataaacaaagctgctaaaaagataaggaaatacggtccctccaaatagtgttacatactgtgtttgcctcatattagagaggtactttacaaaactttatagttttacaatatatctgtatttatgaaccttataggaatctcatcacaatcccataatgtagactaggcaagaattattaacactttactcactgcgaaatctcaacttcagaatgagtgtctgacttgctttaatatatgatgaataagtggtagagcccagaataaaaatatgggtttcccaattcctggtgattctactatttttaacatatacatacttacacttcctcaaacagagttgtagctcagccctctttatatctagtgtaatgacaaaatgagtaccatcattatgcccaagtgttacctacccccactgaccactgatgaccacgttccccccgagggactggtccttgctactggaggagtagctgcttcactgggtgggttgtgggatacaaattctaggccactggatatggaacccctcccagcagaaactctgtgatttcgaggatgtcgctgggcctttggggacatccttggaggccctaaggaagaaacagtgaacatcacataaattccatgatattcatcagtactacttttctgctaaatacacccattcacacacacatgcacacacactcactcactctacagtttttccttggttaaaaatagaaaaaaaaaaaacaccatacatatttttttggccatactaattctttcagaattattttgtggaatgccacaaagttttataaataaattttattatttccctttatttttaaagaaagggagggatgaagttggtggtaagaaatcaacaataagatgtcaactcttaaaagaactgtagcaatctgtttcaactatgtcttatttgtaaagaaatatgttactagaaattatgactacatgataaaatatttttaactttccatatattttacctttccctgacccgaattttctacattacttctaaaattagaaaaaaaaaatttaaacagaagactattaatccctatacaccccgataccactaaaacatatgtacatacccttcttaaatttctctaaaattttagtttatttatctcttctatcatgatcatcaattttaaaactcggcttaaaacagtaagcagtaacctgtaagcagtttcttaggcttagcaggctgtgagctgaaaattctattaaagggatgacttgtattagtctattaatagatgaccaaaataactgacatttgggggagaaatcagcactatatgaattgtcaaaattctacattattgattctgccatgccactagtgactactctttctaaatcagtctactgtgcattagaccaatctatcaggtaaaagagtggacagaatggccctcatcagagaagcctactggtgttaacaccaagcgaaaacttccctaatgtcaaagccaaatctcctcactctctcacccggctgccaaactctttagaacttcaaattaatatatgttgccaatagaattattattttatttttatttttataagacagagtctgtctctgtcgcccaggctggagtgcagtggtacgatctcaactcactgcaacctctgcctcccaggttcaagtgattctcctgcctcagcctcccaagtagctgggtatttttagtagagacgaggtttcaccatgttggccaggctggtctcaaactcctgacctcaagtgatccacctgcctcagcctcccaaagtgctgagattacaggcgttagccaccatgcctggcttccaacaggaatttaaacacgaacatgatctttagaagaatgctaatgttatacactataattttcaaatggaaatattcaacatctctgaatgacacagaaagtatatttctgtgtgaagttaatacatgagcagtccttaaatcttaatgtaataaagatgttcacagtcattaatgatcatgttttatttaatatattctcattaaataaacatcgcttactcaaatgatggactacaagaaaaatatcaacagaattttgcatttagtgaccactattaaggcccttttgagcaaagaagtcaccttgaaaatcagtggaacttgctcttcaaggttagatgcttcagtcaaagtcatatgacctgcctgcttagatggtaacaatttatttaaaagtagccaatacagttttctccagggaagcaggagaaacacattttgtgcggaaaactttattagtcccaacataagcaatattaactaattttaatgaacaaatcagattaaaattttaacacaaatattcagaactagtatcaaaaggacattatgattcagaaaacaggtttttaatatatgggtggcatttaaattagaatgttacctttctacaacatatccctgtatttgatatgtggcaatgatggatttagcgccaaatactgaataagaattacaagattttattcttatttttgacgaggaaagaaatagctaaatattcaaattcatatgtcgtttttatcaattttatctcagatcaaggacttcttccagattaaagcagcctttcactatgtaagattgcaaagctaactttaaaaaaattactcagttaaatttagaattcttctggcattctaaaaatcaactactttaatctaagggcagacacgcaaagtcagctacatgggctgtcgctctcaaaaaagacccagaaaacaccatccctgcttatggccaataggaaggttcactaggaccttggccaaagagctgtaaaatgaacctaagttcaagactggctgaagaaagttcatttgtttaactactgtatacagtgcaaataaggagggggaaggctgtggggcagacccttctggggctgtaaagaagcataattatcaggcagagataaaccccctttttaacaacaattcaagagagtttatagcttcacacatttatcaaatttctctctaatgaacaaaaggttaatagaaatagttttaataaactaaagttaaaacacagaaattataggttattaaataatgaagaggaaactattttgtaattataaactcacataggagttaaacaaagacaaacaaaaacatgaacaaattgtggtattgtaccttctgaagacatgcgtttaggcatagtagagacaggagctggagaaccatgagcagaggggtgagacgggggtctggatggccgcgaggggggcctggagggcggccgtgtaggggtggctgcccgaggtggaagagagttgggacctgactggtagcgagaaggtgggcgagaggaaggagatgggcaaggcgatggccagggaacacctgacagaacaaatgatatgaaggaaagtataaaaactaaagaaaaaaatgagggaaaaaagtaaacagaaaaaaagtaaaatgacaaaaatgatttcttgtacattttaaccctttgaggacagtcatttgatttgtgataagttttagcataacttaactgacataaattcacattttactttaacctccttaagattaagtctgtttaaatgaatacacgttcccaaagggttaattaggatctatacacactattgaagaagacagttaagactttgcctattaatcctgcttctataactgtttctcagtaactggttgtttaaaggaatataacatacactagataatttcacataataaatcacaataattcctactcaggagtaagattatttactgtattagttttaactctgaggcataacgaaaataagcagtagctattatatccaattagaaatgctggttccttacaattatctatgattttcatcaggtttacacttgaacccagaactcagtttggaatcttattaagcaagtcccatttaagtagaaataaaacattactcttctagagtttgtgactcctgtgagtatcaaatgataatattcattgctatttcaaaaaaaaagtcttgacctcattaaactagaaaaagggagaccttctaaataatttatacagttaaacacttatctaagcgactgcttaataaatactgcaactacaaagcagtcatcaccaaataaatttatactgatggatatgcctaggtaaagatacagctagtatttaacattacatatcacttaccttaatcttatcaaacagtccaggtctcctctccatagggttccacacacttaagtatcatatatttctcagcccccttcaggttttttaactttaaaattctgtttataaacaactaaaatctttcctcagtgagcaaagaaatttcacccccaatattaagtactgaaaatactcaagagtgtccatttggagaggaattctggagaaaagactcaatgaaaacaaatgaaattggaaacttagtgttctctattttcatctaactttccaaatttaaatagctaaaattgaatgtccactcttttcccacaaagttagtaacatactattgctattactatttccataccatccatagaactgttgttcagtatccctgatttatggaaaagatccacaacctacaagatatattcaacctagatttagaggtagagtaaaaaatgtcttcctactaaagattcaggtttcttttacttaagttgctaaactgtaacatccacccttagactaagggttgtttttgttgttttttaagcaaatttctctagtcactttcttcacatgactcttgatcatgtcttgtattataagttacctcagatcctttcttgaagtaagcataatatagaaacaaataatgaaaattgatctatattaaccacagtgttgcacataggttagaattttccatataaattatgtctaaaaaattttattatccagtgtttttaaaattgagaacctacccaaagtttccaatttctttatatgtgaagtgtttttggccaagtgattgtcttgggttaaatgtagcactttatcttagtacatcatgaatatttcatcatgctaaataatatatatgtcaatgacatatacaatgttttactaatttaatatccacaaaagccaattttaagtaatgctgaagtgaaagctactcaccaaatcattaaagtgcacattcatatcagttatgtaaactattttaagtattttaagtatttagaaaactattttatcaatgatattgacaagtctggtcaaaatacttgcctccattaactactctttggtctgaaccagaattcgggttgaaatctgaagtgtgagaagtggatcttgatggcatggagcccgatccaggctggcccatacgcggtgaattctgtctcccacttccccaggatatgacttctctatttctttgtccaggaggaatatatttattttccctgaaaatgagagatcctctaaatcattttattctaaaaggtaccaagccaatgaaacatatctaaaagtcatctagacagaagggaatgcttgttacaaaaaggttctacactaaaccaaactgcctcactcccagatgcccctgttcttccatcttaccctgagttctaacctctggactgtcccttcccttagattctgctcctaagcacaaagtttaacagatgcgtgctcattctcatcccacttgacctctctatggctgattccatcaatcttggtctatcttcacaacattttttgtccttcactttctcaattttattttctctgagatctcttctctcactggctgttctttggtttttcatggctccaatatcggcaatgctgatgaaacctcaaactgaaccgccagtctcacagtgtcaacatctatcagtggacatgtcaattcaaatcaccagactctaagctgactgcctttaagagaggatgcatctcttactttactagataggtagcaggtatttctcaacacgtttatgaataaatgaaagacccacaagcccacatatgcaattagctgcacaaacggagtcactgtttttcccctcaaacttgctccatgtttcctctctctcttaccagtacatccattaagtcacttagttatcaaataaacctcaggctcatcccttaactaggtggttaccaaattctcacagttgaactatttcagtgcactaactgttctctgtgtctcagccagtcctcaatgccccagggtttattcaccccatctccttccaacagggtgctctttagcatgacatgccaagtcctttaatgacctcagttcctactatcaactgccactgctgcacctgacacagatcctgtgttccagacacatgcaacaaccagccctctcctgagctggccaaattttctcatagccatgcttgtacatggcttttcatcaggtgataaactcttctcccaactcttctctaagtgtcaaagaccctattatcttatcacaaaatgtcacctcctcaatgaggttttctctgactctacaggttatgctagctcctcctcattctgtatgttcctagtactttgaacatgcctttaaccaagcaaatcatattgtactgctgtgattgttacacgtgtcccccaccagataactattttaacaagctcttcaagatcttggattgctcaccgtgatataccaacacttggctccacagagcttactctcaaaagcatattttccaagatcaccataaccttttctctaacagatcttaaaccaattctacttgcattctctacctaagctatattaaaggaagaggaaatataataacaatacaccgtctcacacagaccttgagttgtgtatccaaaatactgcatcatgatttcctttaaatacctagtgtttatgctgtgcccctcacgttcactggaatttctctgaactgctgtgtatttttcttcctcactcctatcatcattttccagggccactcgagctttgtactgggcacttgactcaatttcttctgctaactggtttgcccttgcttcccgttttaaaaattcttctgagttatctctttctaagggcactctgaaacatgaggaaaagaaaagcaaaatgagtcctttaaagccacagtttatgtatctgtcataatcaactactaagaaagtttagagtttagaatactggtaaaaacagaaactaaaactaaaactaaaactaaaagttatagtgatctgtgtatttataaatcaaaattctaacttttttttctgttaccttttctccagaggaacatatttcaaaaactggttaaactgttcaccataatctctgcccttgcaaatttagatattttttaacaacttagaagacaaaaccggccaggcacagtggctcacacctgtaatcccagcactttgggaggccgaggcaggtggatcacgaggtgaagagatcgagactatcctggccaacatggtgaaaccccgtctctactaaaaatacagaaattagatgggcatggtagcacgcgcctatagtcccagctactcgggaggctgaggcaggagaatcgcttgaacccgggatgcagaggttgcagtgagccgagattgcaccactgcactccagcctggagacacagcgagattccctctcaaaagaaaaaaaaagacaaaaccaaaatttgtttagagcataaaaacagggtataggcaaactacatttattccctttttttaatggaaatttatcacagttggtaataagagaaaaattatttcatgtaattgtttaacttaaaaactaacaaacatttattcatcataaattaagctgatgaaaatcaaagacaaatgcactaaaataaaaacaaacttttcaaacttacgtatacgaagataaactgctatcatacgtagacactacaccataattttcttcattatatcgaaacatatcattgggatcccatccattagactagaagaaaatgaagcttgtttttcaaaatgtcaaagtagttgttccctttcattcagttataaccaacatctatattaacaatatctaacaaactacttgagcaaaattagcaaattagaaaataggaaaaaatttccttaaaaatgttttagaaaaatacttatcagcccctccagttgataagtaactatacaacacaattatttgagcagttatttttaaagtttagaacattttaattacttcataaaatagccttcagatcagggttctctcttttctctaacctgtaaaagccacctttcagttagagacatctacatttacctgtaaccttcttgagatcacactggtcctcaggtctgtggaggacaggaggtacatattttacttcttttaaacaagggattccacatggaacaaggggtgctttttaacagccaaaaatacttccaatgtttgggagaaagaagggagaagccaacgctttccctcatattcaacgattccaaggtcggactatggtactaggtccctggcaacctccccttcctcctgggaatgctcaaatgggaaggcagcatgaaacggtgaacaggcaatcactggacaaagtcacaagaactgggctttagaaatggttttaccattagcagttgtgacacctcagaagtggcaactctggatctcaataccctaacctataacctcagcataggtaactccacaattctacgaggaaactataggaaattaccattcgcaaaagggaggctgccttctttttttggtgggggggagccaggggcaagcaagtttattaagaaagtaaataaaagaatcctactccataggcagagcagctgaggctgcattctttaacgtaaaagaatcaaccaattgggccacaggctggaagactatttaccagtgaatattactgcctggataattattctctaatgtttcaactccttttttaaagccttactggtgaaaagtataaagtccagtaaaggttgtaatccatcccagaagaatgaacacatcaaccaagcaatgctgatggcaacctcaatgctaaggcttgcctcgaagttcacctattaaccttgggtcctcctgtgctactccaggtaagactataatgtaagtctaccaccaatgcaattccttttgccaaacacatgggcaggaaatcacacttacttatggaggctttaaaattacttaagtaatgtatgccctacataaaaaaaaaaaaaaaaaagcacacaatacggaaagacatccagtaaaaagtaaatgtcttccaatcccagcgtgcataaataactactattaagagttctggccgggcacggtggctcatgcctggtatcccagcactttgggaggccgaggcaggaggatcacgaagtcaggagattgagaccatgctggctaacatggtgaaaccctgtctctactaaaaatacaaaaaattagccaggtgtggtggcgggagcctgtagtcccagctacttgggaggctagggcaggagaatggtgtgaacccgggaggcagagcttgcagtgagctgagatcacaccactgcactcaagtctgggcgacagagcgagactccatcttaaaagaaaaaaaaagagtttcagccgggcgcagtggctcatgcctgtaatcccagcactttgagaggccaaggtgggtggatcacctgagattaggagttcgggaccagcctggccaacatgttgaaaccctgtctctactaaaaatacaaaaaattagccagatgtggtggcgggcgcttgtagtcccagctactcagaaggctgaagcaggagaatcgcttgaacctggaaggcagaggtttcagtgagccaagatcacgccattgcactccagcctggacaacagagcaagactccgtctcaaaaagagtttcttgggtgtaatttcagacatcttctaggcaataagaatatgaacagctctttaaaaaaaaaaaaaaatttcatggccaggtgcggtggctcatgccagtaatcgcagcactttgggaggctgaggcaggtggatcacgagttcaggagttcaagaccagcctgacaaacatggtgaaaccccttctctactaaaaacacaaaaattagctgggcatggtggcagctactcaggaggctgaggcaggagaatcgcttgaacccgggaggcggaggttgcagtgtgacagagcaagactctgtctcaaaaaaagaaaaaaaaaagcaaataggatcccagtgttctgcaatgtgctttttctcttaataaatcttagatatctttccatattggaacaccattctttttgggagatatgtagtgtttcaattgaatggtgacatcataaatctaactcatgctatattgatagacacttagcatgtttccaatttttcactattagaaataatgctatggccaggcatggtggttcacgcctataatctcagcactttgggaggccgaggtgggcagatcacctgaggtcaggagttcaagaccagcctggccaacatatggtgaaaccccgtctctactaaaaatacaaaaattagctgggtgtggtggcgcacgcctatagtcccagctgcttggaaagctgaggcagtagaatcacttgaacccaggaggtggaggttacagggagccgagatcgcaccactgcactccagtctgggtgacagagtgagactccatctctcaaaacaacagcaacaacaacaaaagaaataatgctgaaaaaaaaaaaaatcctggtcaggcatgatggctcacacctgtaatcccagcactttgggaggctgaggtgggtggattacctgagctcaggagttccagatcaccctgggcaacatggtaaaaccctgtctctgcagaaaaagaaaaaaaaaaaatcttcacatataattatttgcatgtcttatggatatatgagggcaaaaataaattactagagatagaactgctggaacaaagtgtatgtgcattttaaattttgattagcattgccagattctctccagaaagactctatcaatttatccacctcaccaatagtgtaaaagaagtctctgtttcctcatatttttcatacaggtgacgtgatgtacagacttgagaaccattatattaggttatatatgatttgttaaagtttgagaattaatgacatgttgcctgtgtatgtccagttttattactagactttaggtcaaagtaggacatttcaggcttcctgtctgaggaagagtgtcattattaagctgttatgccttaaacatcaaacacagatatgttacaaattctctttctactcaatggaagattcttcattctactcaaatattggtaccataacactcatttttggcaagacactttgctttatatctctatgctctctatcctaaagacagagtctttattaagtatttgtttttatttttatttcttagagaaggggtctccttatgtcattcaggctggactccaactcctgggctcaagtgatcctcctgcttcagcctcccaagtagctgggactgcaggcatgtgccagcatacccagctaagcacttcaagtacagataatgcattaaagagagaaacaaaactagtatgtgacaagaggcgttttagaaataaaagaattttgtggagaataatccaaatttaagaccaagaaatttatgtaatgctttaattccaatgtaacctaattatttatcttaatgacaaccttttcttcagacaagaggcttaaaatgtcctacttcaacctcttctctaggtgaagtcaacaattaagacaccactttccttaggctaccttatttggctgggtgttaaagcaaaacacaccggcatttcccatggtttctaattttaatttaagctacttcttattatttattttaatcacaaagaagtaattcatgagcatccacaagaacagacagtactcctgcttaacccctacaagtaaaatgacaaacatttttctttatatattgcttgggagaaagtctctagttatacaacaaacctgctgctctaaatacactcactacaataacaacaacaacaaaagcacatttaaattacaaccaagtgacaggatgtcatactgaccagagtctagcaataattacaaagatgttacttactacgtcattttccaaagcctcaagttcctcattggctgtgagttcacctgcatcccagggctccaggtccttctctttgtgttcgccattcactttagcactgatagcagagtcagtaaaagcatctgcaaagaatggttttggttgaaagtttatataatctggcaatcagttacactcacacacgtgaattaccaacaaagacatatgttaaaaaacaattacgaaaaatgaatttcacataattgtttaacttaaaatctaacagaaacatttattgaacataatttaggttgatgaaaacaaaagaccaatgcactataataaaggtaaacttaaaacttatgtatgtgaagataaactgctatctaaactgatacggaatatatagtattcagtaaaagtatgctttcacgtttaatttagcaaatggaatcacagatgactatcagtaaaggtattttcttttcatataattttaagccacacgaagcattttttttttttttttgagatagagtctcgttctgttgcccaggctggaatgcagtggcgtgatctcggctcactgcaacctctgcctcccgggttcaagcgattctcctgcctcagtctcccgagtagctgggactacaggtgtgtaccaccacgcccggataattttttgtatttttagtagacggggtttcaccgtgttagccaggctggtcttgatctcctgacctagtgatacccccaccttggcctcccaaagtgctgggattacaggcatgagccaccatgcccagcccacatgaagcatattttaatatattgacataattcattaaattatattacaggtaattactctgcatgtctcagaagtgaccaagaaaatttctggccagatgtggtggctcatgcctgtaataccagcactttgggaggcccaggcaggtggatcatgaggttaagagatcgagaccatcctggccaacatggtgaaaccctctctctactaaaaatacaaaaattagttgggcatggtggcacatgcctgtagtcccagctactcgggaggctgaggaaggagaatcgtttgaacccgggaggtggaggttgcaatgaatggagatcacgccactgtgctccagcctggcgacagagtgagaccctgtctcaaaaaaaaaaagaaaaagaaaatttctatcaatccatcaaaaatatctctttttttttttttcttttttgagatggagcttgctctttcacccagaccggagtgcagtgacaccatctcggctccctgcaacatccaccttccaggttcaagggaatctcctgcctcagcctcccaagtagctaagattacaggcgcccaccaacacgcccagctaatgtttgtatttttagcagagacagggtttcaccatgttggccaggctggtctcgaactcctgacctcaggtgatccacccaccttggcctcccaaagtgctgggattacaggtgtgagcaaccatgcccggcctaaaatatctcttttgtttaatggatgcactaattagatataccttcggagtacttgcagccaaatatatgtggattttgtttttaactttccatattcatgtctatgtacagtggtcaatatcccagcaaactcttgccattagtaaatgaagccattctaagtggtttaacccctcccagaacccacttcttcatatataaccactctgctacaaagttcaggccctacagtattacctgtctcagaaagttcaggtagcaggcatacctggacttcctattaacacactctcactttgtgtcctcttctcttctactaatgttattgaagagtactgacttatgaaagcaaatgtagcatccacatgttagctgaccatactgctgtctggcacaggaaattttctctagttgggagttagactcagctaaataaaggcccactgggcaatgatggcactaggaaacgctctgtagatacaggcttgcatttaaatgactggacccatagggtaccacctactacgaactaaggagtaatacttctgctgatctggctctgctgaggaatataagctcccagccactgttccttcccagtactgtaagttgccactaagaggaggaagggacgaatcaacaactaaacacacaatactcctacaaaagaggttattccagatggattttttatttggcaatgcttctataactgtcattgtctccctaatgggcaaagtgatgccaaaataagaaatctgagccagcaaatttaagcatggaacttcaagcctagctaattctaacctcttcttatcccaaactaggtgtgggtaggtatgagtgtgtgtacctgtacatcagggaataaaagcattaatccacctctgggcttagctgccagctccaccagcagcactactcccattgctagcaattctaagagccaagagtgtgctgagggagttccccagagcagcaggactcagctgggggtggaatggagcattcactagaaatggctgaattttggaaaatctctctaagagattctaagagactaatgctatcttaccaacacctcatctttgctgaaagctactgatggcactagaaatctgaccttatttgatactaacctgaatcacgttcttctctacattatcttaaagttatgtggattgctggcaaaaattaatttagccatgtgtattttcaagaatgtaaaatgttccaagaaaacatcaaataataacctaccttaagatcctgaaatccctttaattctcacaacactagacaaaaaactacactataggaaaattccaaacgagtcatattatcttctggaagaagcaacaggactgttcctttacgtctaagatcctgttaatgtcttaatcatactagtttttgaaaagcacacatttaagtaaataaagcatttatttagatagaagctcagtattaaaaacaatactcttttgattcaagaaattaaagctcgaagcagctagagatttttatagaaccatataaacggatttttttctcactacagggtatgtgtgtgtgtgtgaaaatatttagaaagtcttgagtcaagccgtcttcaaaccaaaagatcccaaatgtacacacaaagtagcttaaatatgtttttacagtattattctaaacaaatttctaaaaggatccccaagtaagagccagtgtggaaaagcaagcaagcgtctaaaactttaggacccaggctttattccactgaccagaatttaggttgtgttaagagggcattattaataaatctatttttctcaatgctacattttaatcttaaatcttctgtttacaataccaaactttttttaaaaaaaagtattcacaggttatgtagcagtctgtcgctttcgagacagaaatggggaaggggaaaacacagaagtgtgattctataaagaatgatattccttggttttaaaatttcaccaaaagtagctctttctaaagatgagtaaaggacttaggggaagatgtgcagaagtggagagttagcacgaaatgaggctatatcatcaggatgctgagaaaatccctggctataagtaatgcatttcaggccaacattgcatcattagctagaaaggaagcaagatctgggtatccattctgcactattaataatatccactatcgtaaattctgatttgttttacagtggttacaagtttggatttttgtttctgtttctttaaaaaaaatttgtttttgtttttgttttttcagagatggggtctttgtcactcatgctggagtgtagtgccgcaatcactgcagccctgggctcaagcaatcctcccacctcagcctcccaagtcgctgagattacaggcatgagccactatgcccagcaagtctggattttaaaaaaaaaaaacactgttggtagtaaatagtacaatgttgtaaccaggattcctgcaaagttgagaaaaaaacaactggctctaatctacaggcaactgtgggaatttgcatgcagattttaccaatgccataagtcaaagaatattaattttccatcatcccctatggtgagaaacaaaagcattgtaacaacaagatgcaagaatacaacgtgactattagaaaagtgttacctgtttctgaaggaactacaggtatagagagaaaaaaggaaaaacataaaaaccatcagatgagatgataaagaattagtttttcaatttataaaagcctctagactagcaggcgatgttggaggaagaaacaaaattgtatcacctccagcccctgtatcccacctccatgctacccccacagcagtgggctctcaacaccttctcttctgattctgggcagaaacttagtcattttgggccggtgatgccacctgctggtggtcataaagaaatgtctcgaccaacgtgtgaacctcttctgggtatccccagccccatacccaggaaacagagtacatattcagcttctcaatctttcctcttttacctctgagccaataatgcctctgaaaaatcattcaaacttgtctgagcattttttaaagggccagaataatggtcaaataactaaaatggtagtgttaaacattagaaataaatatacttaaatgtataaaaactataaaatgacataaaactggatgaaataatcattaacatcagatttaacatcacaaaccctcaaatgtgcttccagagaagtcatcaaaatcctcagctaaccatttcttctcaactaaatcagccttttctcaaacatcaaagttccatataaacctaaaaaatcatattgttttgatcaattcctattcctgcggcactttcaacaactttttaagacagtttctcattatgtgtcatcgttatatgtggaccaatctatatactatataaagtatcagtatatagattggtatcagtgggactatttagtcatttttagcacttactgagtacctacaatgcactcataagtctggacgaggtggggattcacatttgactgatacaattcccagcatttcctgtaggaactaggagctcctgggtgtaagagactagttacagaaatgaagcaaatcttttagaatcgaatacaatgagtgctacaatacaattaaaaacaaagttctaaggaacaaaaggctctgggctttctaaagtgacagtgacagcctatcagcaacagctgatctaggccttcaagaacacaagaagaaaataagaaaggggaagtaaaatggttccaacatagactggagtggcattaaaaatacgtgtatagctgggagcggtggctcacgcctgtaatctcagcattttgggaggcccagtcaggcagatcacgaggtcaggagatcaagaccatcctggttaacacggtgaaaccccatctctactaaaaatacaaaaagttagatgggcgtagtggccggcgcctgtaatcccagctactcgggaggctgaggcaggagaatggtgtgaaccagggaggcagagcttgcagtgagcagagatcgcgccactgcactccagcctggacaacagagcgagactccatctcaaaaaaacaaaaaacaaaaaaatgtgtataggcggggtgcagtggctgacgcctgtaatcccatcactttgggaggccgaggcgggcggatcacctgaggtccggagttcgagaccagcctgaccaacatggagaaacccccatctctactaaatatagctgtgcatggtggtgcatgcctgtaatcccagctgctcgggaggctgaagcaggagaatcacttgaacctgggaggcagaggctgcggtgagccgagatcgcaccattgcactccagcctgggtaacaagagcgaaactctgtttaaaattaaatcaacaggctgggcacagtggctcacatctgtaatcccagcactttgggaggctgaggcgggtggatcatgaggtcaagagatcgagaccatcctggccaacatggtgaaaccctgtctctactaaaaatacaaaaattaggtaggcgtggtggtacacgcctatagtcccagctactcgggaggctgaggcaggcgaattgcttgaaccttgaattgcttgaactactagggaggcggaggttgtagtgagccaagattgcgccactgcactccaacctggcgagagcgagactccgtctcaaaaaataaataaataaaaaatatgtgtataaacattttctgaattgtacacaagaacacaggcttccccagggaagtgggactgggggttagagaggagattatcttttcattgaatactcatctgttctaactgaattgtatactacgagcatatactactacaccatgtattatacagattatattaaagactataatactgaagaataacacaaagaaacaagttggggataagaaacacagttaagggtgcaggatgtatggactggaacaacaaaaccaagggcacaggtggagccacgctcctcaggctagaatggggtaggggtatgatgacaaaagaggactgtggggagcctctagattagggattcttagcctttttcttaatccatgggccccttcaatattttagggaagcctatgaaaccgtattcagaatgtacttaaattcgtaaaatacacaggaaatcaaatgagaacaagtaacaatgaaatgcagttatcaaaaactaaaaaaatctgttggcatagtaacatacatgttcttaattaaagcattaaatattaagatccagtaacaggtttaataactattataaatttaaagaggtgatgaacatacataataatttgaagcctggtgcagtggcacatgcctataatcccagctactcaggaggctgaggtgggaggactgcctgagcccacaagttcaaggccagagcggataccatatcaagattctgtttctaaaaataatttgaggccgggtgcggtggctcacacctgtaatcccagcactttggaagccaaggcaggcggatcacttgaggtcaggagttggtgaccagcctggccaatatggtgaaaccccttctctactgaaaatacaaacattagctaggcgtggtggtgtgcgcctgtaatcccagctactcaggaggctgaggcaggagaatcgtttgaacccaggaggcagaggttgcaatgggctgagactgcaccactgcactcagcctgggagacagagcgagactccatctcaaaaatatatatacataaaataataatttgagatacccataacatcaagcgatatgaaattaactgagttctataggtgcttaagtcataaatactgctaatactactagttgtttgttgcccatatttttaaatggcaaaaaatgctaaatttcacttgaaggttagtgtaaataaagatgtaaatttctcttcatccaaggtcatcaatgccctgaattctctccacaaattctttgagaatccacagatccaggtgaagaatcctgcctctttgtactgacaagcaggaagaaagagcctctgccatgaataaagcaaataggtgagggactggaaggagtggtcatcaaggctgcagaaataggtttaaggaaaaaaaaaaaaaaaaaagtctgctgaactcttctgaggctccagcaagagctggaaaccctacattcctaactaatcagccccccagtgggactttctccagccacacccagcaggctggattaggagtagacagagtttaagatcttagaggaacagagaacactgtgaggggcaagaagagaatagaagtgtaaagtttatagctgtggtcagagtagatcttgaaaagcattctggaagagaagcagttccttccgagtgatgacacagtcatgaaagcaggatgctacaacgccgtggaggtgaaagggatgtatggaacagaacttaggaggctatgtttcctaaagaatagtgttctccaaatgatccatttgaaaataaattattccaacacacactacagttgtccttcagcatctatgggggattggttctaataccccctagggataccaaaatccagggatgcttaagtccctgatacaaagtggtgtagtatttgcatactctcgcatactttaaacctctaggttacctataatacctaatacaaagtaaatgctacggaaatagttgtggtactgcttaaggaataatgacaagaaaaaaagtctgtacatgttcagtatagatgcttttgatttcccatataatttttttttttcttttcagacagttttttttcttttcttctcacactctgttgcgcaggctggagtgcagtgacacaatctcagctcatggaaacctctacttctcaggttcaagcaaattgcttgtctcaacctctcgagtagctgggattacacatgtgcactaccatggccagctaattttttgtacttatagtagagctagggttttgccatgttggccaggctggtcttgaactcctgacctcaggtgatccatctgcctcagcctccctaagtgctggaattacaggtgtgacccacagccccagcgtatttcccatatattttggatccatggttggttgaattcacagctgtgtaacccatggatagagagggctgactgtatttgcaaactaacatttgaagacatcagtgtcccagccacaaaactaagaaatgaatggtaattacaattttaatcattgtctatggtatcatgcctatgtaagagaaaaaaaaacagttattccctggtttaggagtataaaattgggtctagtgagtataaaaatattttttaaaatataaaaacataaaaatataataaatataaataaattaagtttaaaaatataagtatttcagtggtggctcacacttgggaagccaaggcaggtggactgcctgagctcaggagttcgaaaccaacctgggcaacacggcaaaatcctgtctctaccaaaaatataaaaaattagccaggcatggtgatgcgcacctgtggtcccaggtactcgggaggctgaggtgggagaatcacttgagcctgggaggaggaggttgcggtgagccaagatctgcatcaccacactccaacctcagtgatagagtgagaccccgtatataaaaaatatatacatgtaaacttttcaaaaatcaatcaaaggaatatatatatgttgaacacctgttatctgtaagtcactgtatatatactagacaccatggttgggggggacgcatttccttaattctataaatttgttttctgaactccagaaaagtttaatgcattgggagagagaaaatataccggtaaaaaagacactacatactgcttcgtgaagatgagtgtttggtacatgatggagaccactggttctccaactgtacttcatgacaccctatgatgtcttcaggacaccccagaaggcaagggaaagtggagtaagtagggagctaggacatcactagctcttcttccaaccaaagccttgttttaactaagagtcagcatgggatctcatcagagggaaaaaaactgacctattctatactaaaaagaaaatgttaaagtctgggcatggtgactcacacctgtaatcccagcacttggggaggctgagatgggaggatcaagtgagcccaggagttcaagatcagcctgtgcaacacagtgagacatctgtctctacaaaaactaaactaaaaaaaacaaacaaaaaaattagccaggtagggtggtgcatggggaggctgaaatgggagaacagcttgagcccaggaagcagtaagccatgatggcgccactgcattctagtaggggtgacagagagagaccctttctcaacaaataaatacatacaaacataaattaatttaaaatgtaaagtttaacagccattgttacaggcaataaaaacaaaccacaatgagcagggaaggtcagagaagactctaaaaaggacagatgtgggcttggttttgaaaaagtatctaaaactctagttagtaaggtagattcttcacgttgggattaaatccaggagtaaaagaagaaggcacagggggccgcggtggctcacgcctgtaatcccagcaatttgggagcccaaggcaggtggatcacaaggtcaggagttcgagaccagcctgggaaacacagtgaaacccatctctactaaaaatacaaaagttagcagggcatggtggcgcgcgcctgtcgtctcagcttctcgggaggctcaggcaggagaatcactggaacccgggaggcagaggttgtggtgagccaagatcgcgccactgcactccaacctgggcaacagagtgagactccaactcaaaaacaaacaaaaaaagaaggcacaaagttggtgatgtctaacacacagaacatgccagcttagtaggtcaataagtagattaacattgggaaataggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaacattgggaaataatgagagataaggttgaaaaagagaagttccactgggaagggccctgtatagcatcccaactttattctgtaaacaacagtggccactgaagattttgagcaagggatgagatgatctaataaaagcaatgtctaagaatttctttatgtcaatgcccaagattgactgaaaatgagaaatctggaagacaagttgtttaggagattataacaatatttgccttggtggaagaaaacaaggaccacacttattttctattttcactgttaaatcttttggtacacacgttttgaactttttaccatgtgtgcatatataatttttaaagtaaagttgtaaacagaaaaaaaaaatctacagtgagatactacttcttactctcccactaggatgggtataatcaaagagacagacaataacaaatgctggtgaggatgtgaaaaacataagaaacctcagacactgctagtaggattgtaaaatgatacagctacgttggaaacagctatgtaggattgtaaaatgatacagccactatgcccaggaaatcagcctgtgcaacagtgagaccccaactctattttcaaaaaataataaaaagaaaacaaaacagcccaacagttatgtaaaaggttcaacatagatttagcatacgagccagcaattatcttgcaggtatgtgtatgtatgtatgagtatgcatacacacacacccccatgagaattgaaaacctatgtccacacgcagttttttttttttttttttttttttgagatgaagtttcactctgtcacccaggctggagtgcagtggcgtgatctcggctcactgtagcctcggcttcccagcttcaagtgattctctgcctcagcctccctagtagctgagattacaggtgcacgccaccacacccagctcatttttgtatttttagtagagacagggtttcaccatgttgggcaggctggtctcgaactcccggcctcaaatgatctgccagccccagcctcccaaagtgctgggattacagaggcatgagccaccacacccggcccacacaaaaactttaaaagtcactgttcgcagcaggattatgtataaatcaaaaggtggaaacaatgaaaatgtccaccaactgatgaataaacaaaatgtagtgtacctgtgtaactgtataatggaatatttggccatgaaaaagaaagaagtactaatacatgctacagcatggaagaaacatactaagtgaaacaagcctatcataatatatatggccagatgcggtggctcatggctgcaatcccagcactttgggagtccgaggtgggcagatcacttgaggtcaggaattcgagaccagcctggccaacatggtgcaaccccgtctttactaaaaatataaaattagtaggtgtggtggcaggcgcctatagtcccagctactcaagaggctgaggcaggagaatcgcttcaacctgggaggcagaggatgcagtgagctgcaatcatgccactgcgctccagcctgggcgacacagtgagactctgtttcaaaaaaaaaaaagaaaaaaaaaggctatatattatatgattccattaatacgcaatgtccagaatgggcaaacctatgaagacaataaatcaatagttgcctggagctggggaaaattgaaacaaacagagaggaactgctaaggggttcagagtttcttttcagggtgatgaaaatgtaaattgattgtagtgatggttgcacaatgctgtgaatatattttaaaaaatgggctgggagcagaggttcatgcctgtaatcccagcactttgggaggctggggcaggaggatcatttgaggcccagagtttgagaccagcctgggcaacataatgagacctcatcaaacaaaaaataacaacaaaaattagccaggagtggtgatacacatctgcagtcccagcttaatcaggaggctaaggtgaatcacctgaacccatgagtttgaggttatggtgagctacgatggcgccactgcactccagcctggacaacaaaatgagaccctgtctcaaaatagaagaaaaaaaaaaacctaattttctccctatctcaaatgaatgattaaattttctagcactacgataaagtgagataaaatagaaaaaaaatccctaagagaaaaatatatcctatttaagtaataaaaagcagtatttattttccttactaatacattctgtttgtgagaggtacaaattggattcttcagttaaaattcaagggaaaacatttataagataaaatacatcatcttagtttgactaagcccattaaataagataaaaggcactgcaattagtaacctttttttttttgaaaccagggtctcacttggctcactgcagcctcaatctccctgcgctcagatgatcctctcacctctgccacccgaatagctgggactacaggtacataccaccgtgtctggctactttttgtattttttttgtagaaacggggttccaccatattgcccaggctggtcttgaactactgggctcaagcaattcatctgccttggcctcccaaagtgctgagattacaggaatgagccactgtacccagccagtaattttatgtttttaaagcaattttcttaagctctaaattagctaacttaaaatttgaactgaaaattgtttagaaatggtatcagttaaaatggtgctgtattttacttcaaaatcaactaaaaaataataaaaaactcaaacttactaatcagattcctctgaaagctgagtgaagatcaatagcccatgctctacagaatcaaatatacatcaaattctacagcaaagcctgagtggtgcaaaactaacaagaacaagaaaaaatatggaaattcacttcatgaggtttgctgtatttaaaaaaacaaggtgacagattccacgtacgtaatactagattgctgattcccacactatctcctaaaaagatcaaaagaagttttagaaaagattccaatacaaagatactgtttatgggtgaacattctgttttcattttctccattaggcttctggatcaggatctattttaagtggggaggaggaggaaaagctagctacctgaaagaaatttgtgccatctcaaaatatgaaattagcctaggcctggtgtgatagcttaagcctgtaatccgagcactttgggaggctgaggcaaagaggattgcttgggctcaggagttcaagacagcctgggcaacatagtgggacctcgtctctacttaaaaaagaaaaattctaaaaagagagtgaaagagacagagagaaagagagaaataaggagaaatcagtccaatcatcgtttgagcacttctttataaaaggtactattttcagctcagaagttaaagagaaagaaaaaaagaaggccgggtgcgatggctcatgcctgtaatcccagcactttgggaggccgaggcggatggatcacgaggtcaggagattgagaccaccttggctaacacggtgaaaccccgtctctactaaaaatacaaaaaattagccgggcgctgtggcgggtacctctagtcccagctacccgggaggctgaggcaggagaaaatggcatgaacccgggaggcggagcttgcagtgagccgagatcgcgctactgcactccagcctgggcaacagagcaagactctgtctcaaaaataaaaaataaaaataaaaaaagaaaaaagaagaaaatgattctgtagaagaactaagacaaaaaaagtaaattcagaaatgttcaagaatcaaaaaacagaatttaggaattgaaatgccaatactattagtgaagaatagtagtcattttataacaacttattctcaaacctatggcaaaagtgttcagaattaggttaaggaaaagtcagtaaaatgaaattaattccaattcttacagctgtacaaatatcttttctgtttccctggcaaatatgtaaaacattttatagattcggattcttttctaataaaaaacagaacaactgttcaagtacacatgcccacttaatattctttcccaggagtatgaaatagaaatagaacaaaatagaaattagagataatttatccacattccttctcttgctttattactagttttaatatatctgcatgcataagactccattgaaaccatccaagacaagagaaaaaaataatactaaaactagatagtaagtatattagcattacacaaccctatcagtaaacagtcttactgaaaatgtcctggaaacatatgcattacttacctattctttacctaatagagagtttaagaatgctacttgttttacttaaaccatcccactagcagtgttaagtgttttgcaactccctcagtaccactaagtagtagtaatctttctcacatttaccattcagcgcaagctgatagacaatcatattccactgctttaaaactgaatttctttaaaaatacaataaaataaaaataaactgcatttcttaaatcattacaagtgaggagggccaccttttcatacattcactggtcatttttaaaactatttttctacttttcccagtttgtggcatgtctttttaaatgtatggtacttttggacacgtctaagtcttttttttttttttttttgagatggagtcactctgtcgcccaagctggagtgatgtggcacaatctcggctcactgcaacctccacttcccaaattcaagcaattctcctgccttagcctcctgagtagctgggattacaggcatgtgctaccatgcctgactaatttttttgtatttttagtagagatggggtttcaccaggttgaccaggttggtctcaaactcctgacctcaagtgatccacccgctttggcctcccaaagtgctgggattacaagcgtgagcaccacacccggcctaaatctttaatctctttataatcaaaggtatcgatcttttacttcatgatttttttgctctggtagtcatgcttataaagtccttctccactcaaaattaaacaaattcacagatttgctccagtgtagtctgggtgttgttttgtttaatcacagttttctcattaatctatttggttttatttatcagtgtgaagtaggtatctaatttgtccccaatgtcccagaatcatttactgaataatccacctttcctccagaattaaagtgctatattgcatattaataaaatacccacataaattcagttttggatgctccatacgtagccactgtgacagttataattcttttttttttttttttttttttgaaacagagttttactcttgttgcccaggctggagtgcaatggcgcgatctcggctcactgcaacctccacctcccgagttcaagcgattctcctgcctcagcctcccgagtagctgggactacaggtatgcgccaccatgaccggctaattttgtatttttagtagagacggggtttctccatgttggtcaggctggtcatgatctgcctgcctcagcctcccaaagtgctggaattataggcgtgagccaccgcacccagctgacaagttatgttttaattctgacatattttgtagggcaagtcctcctttatgactcttgtggaaaaaaatttccaaagttcttctgttaatacacataatctaataagctttagaatcattttgtcaatttctacaaaaacggatatatatatatatattataaaaatttttttttttttgagatggagtcacccggctggagtgcaatctcagctcactgcaacctccacctacggggttcgagtaattctcctgcctcagcttcccaagtagctggtacctgccaccatgtccagatgatttttgtatttttagtagagacagggtttcaccatgttggccaggctggtctcaaactcccgtcctcaagtgatcggcccacctcagccttccaaagtgctgggattacaggcgtgagccaacgtgcccggccaaaactgaatatattatctttagagatttatttgaggaaaattgacaacgttgtagtattaaataattccattcaaagtatggcatgtttccatttagccaaatctacttttatgtctccttcagctgtgtcttcataaatcttcaatttatccccatgtcctatgcttatttttgtttttgagacagagtctggctctgtcacccaggctggagtgcagcaccaccatctcggctcattgcaaactccgtctcctggattcaagcgattctcctgcctcagcctcccaagtagctgggattacaggtgcccgtcacctcgcccagctaatttttgtatttttagtagagccatgtcggccaggctggtctccaactccttacctcaggtgatccgccacgcctggctggtttgtttttgagacaaggtcttgcttgtcacccagctggagtgccgtggcataaccacagctcactgcagccttgacttactggctgcaagtgaacctctcacctcagcccaccaagtagctgggtttacaggagtacaccaccacacccggctaatttttgtactttttgtagagatggggttttgccaagttgccaaggcgagtcttgaactcctgaactcatcctcccgcctcagcctccaaaagtgttgaaattacaggcatgagccactgcacctggcctatttctacactttggattctgctcccatgtatcttgaatcaaccttactcttactagtaccacacagtatttttttatcgtttgtccaaataaaattctattttatgctagaggtttttattttttttatatttaataaatgaagttattgttctgactttggcaaacatgatagggtagagaatttctatatactctaaaaattataaaacatgtaactttaataaatggaagatgaccatatcttaataaacatgtaatgcttttctactgtgtaccacgaactattctgtttagctttccattacatagatccgttccacctgtttctttcttttaatctcaataatctctgtactgcctccatactggcctcaataagtgccactctccagttactgcttggccccagaatgaacacatatctgtgtcttaataaaccacagcaaagttgaggccgtaaacagcttttctaatgtcacgccgttcagaagagatccctgtttgttactcgtactctgttactgatacactatcaagaccaaaaagacaaccatatgagaacacaacagcacaccagaataaaacaatctgtagaattttatttctcactgttctctaattacacattaacactccaacttcttccaactactaaaatctacacaattcttttattttttatttttgagatggagtctcgctctgtcactcaggctggagtgcagtggtacgatctcagctcattgcaacctccaccttctgggttcaaatgattctcctgtctcagcctcccgagtagctgggattagaggcgcacaccagcacaccaggctaattttttttgtaaaatctagacaattatttgcatcgctgactccatttgatattcaatgtcatgcagtacaacattccatttttcttgaatttattcacgtgctttgctatctctaactctaaaaatgcttagaatagagtacatggcgtatatgaactccctgaagaaactgtgaacaccatgaaattacattagcgtgggcacagtggcttgcacctataatcccatcacttttgaaggccaaggtagaggattgcttgaacccaggaggtaaaggccagcctgggaaacatagtgagaaccagtgtctataaaatatttttaaaaattagccgggcatagcggcgtgcacctgtagccccagctacttgggaggctgaggtgggagagtcgcttgagccaggaggtcgaggctacagtaagccatgatcacaccactgcattccagcctgagtgacagagcatgaccctgtttctttaaaaaaaagaaaaaaaattaatttttaaaagaattacatgtaaaatctacatgtgtgtaaatttttctagggtgagggtatacagtttcactaggtacacagtttcactaggttctcaaaagggacccaaaatagattcttgtatttctccgtactgtccatagcaacaagcacagcaaggaacacatcccagagctctctaagtatctgctggatgactatatatgtaagaccacttacagctttttcattctttccataaaataatgcttctacaaaagtgtattaaggcactgaatttcatttattcaaacacatttatattgagcctgtactatgtgccaaagcactatactagaccatgagaataaataataaagacagtatcactgtctttacttggagcacaaagagctcaaactgtaacaggggagacaagcatataattttaatacaacatggtataagggcaatgatacacacatgataggagggaacttgtgtgtggtagctggcagtgtgtgtcatgtggcaagagcagcaggcaaagaaacaaacactggggacacacatctaaggggtgtgtgaaggaaaagaagcccaggaatgaggcagggaaggaatgatcaataaacataaaaaatacagaagaggaaattctgaaggagggtgaaaccaacattcaagtgcagcaataaagacagaaaaagattccaaaggacctggcagttagaggttaatcgtagccttaggcaggataatggctagaagaattcaggattaaaaagaatccttttgggcccagtgcggtggctcatgcctgtaatcccagcactttgggaggccgaggcagatggatcacaaggtcaggagatcgagaccatcctagctaacacggtgaaaccccatctctactaaaaatacaaaaatttagctgggcgtggtggcaggtgcctgtagtcccagctactcgggaggctgaggcaggagaatggcgtgaacccgggaggcggagcttgcagtgagccaagatagtgccactgcactccagcctgggcaagagcgagactctgtctcaaaaacaaaaacaaaacaaaacaaaaaagaatcctttttaggatgagcaggaagtgaataggttttcatgctaaagggaaagattaactagaaaggcagatgttgaagagcccagaaacagagaagtggtataaaagagcaaggagaaaaaaaaagatggccaggcgtggtggctcacgcctgtaatcccagcactttgggaggctgaggcaggtgatcacttgaggtcaggagttcgagaccagcctggccaacatggtgaaaccccatctctactaaaaatacaaaaattagccgggcgtggtggcaggcacctatagccccagctactcaggaggctgaggctgcagtgagctgaaatcacgccactgcacttcagcctgggtgacagaccgagactccatctaaaaaaaaagaaaaagaaaaagagaacaaggaggtaagtagaagggagagagtcaagggcatgattgaagttggcttaaaaatcctctctactaaaaccagaggaaaaataataatgaggccgggtgcggtgactcatgtaatcccaggactttgggaggccaaggtgggaagactcttaggcccagcagtttgagaccagcctgtgcaatacagggaaaccccatctctacaaaaaatataaatataaaaaattagtcaggcatagtgatgtgcacatacagtcccagttatgtaggaggttgaggtgagaggatcacctgagcctgggaagtcgaggctgcagtgagctgtgattgcatcactgcactccagcctgggcaacagagcaagatcatctgaaaaaaaaaaaaaaaaagatggcacggaggaagaagataaatttgtagataaggaaggtagtggttagttgatggagatcttttccattaaccaaccttccccttttatgatttttcactaaatgtgacaaagaatctgttaagcaaaagtaattcttcagactaaatccaattagaatggtcatgaataagaatcgcaggatattatacagtattagaatcaaagcatgcaattagttgtaagtttaaaggacagagcacattctgttacttcaccaaagccagtatagcatgtatttttgatcagtcctaaaaagccctaaatgcagcggaaaatatgatttaggccaagagctggcaaacttttctgtaaagagacagtcaaattttctggctttgcaagtcctacagtcagctacaactactcaactctatggctacagccatcaaaacagccatagacaatgcacaaacgcatgggcatagctatgctacaataaaatttatttactgatgagcagatttgctgacccctatcatctaggctgagaatactgcaaagaaaatgaagcagtaggaaaaagtatgaggaacaatggaataaggaaacagaagtaaagccatagttgagttggagtaaagaggaaaacatgaataatggcgcaacaggaagagcagaaagaaaatgaaggaaaaaaatagaggagaaaggaatactggaaatggatggaaaatcaagtaaaaaacaagcagagataacaggacaattccaaagatacacgaatacagagccaaaagcgactgaaggccctaagaagttttagcaaaatgaagagaacctcagatctgtctgcactggaattcaaataaaggataaatacaaactgattttccaatgataatctgatggtctcttctaattatgaatgtgccaaggtgactcacagctcatatgacgtaaaggtactttcagtttctcagtaaatcaaactggaacatgtataacattcaagagaccaaaggaaacttattcactgtaccgtaagaagtcactatttcaaagccttttattcatttgcatatatgcatgaatataacttttaaactttattgaaatcaatgatgttagcatcaagaacttaaaagtcacactgaccttactcatgttaaaaggtttccccagcagccgagtgtggtggctcacgcctgtaatcctagcactttgggaggccaaggtgggtggatcatgaggtcaggaatttgagaagagcctggccaatatggtgaaaccccgtctctactaaaaatataaaaattagctgggcatggtggcagacgcctataatcccagctcctcgggaggcttaggcagaagaattgcttgaacctaggaagcagaggttgcagtgagctgagatcacgccactgcactccagcctgggtgacagagcgagactccgcctcaaaataaaggtttccctggctgggcgcggtggctcacgcttgtgatcccagcactttgggaggcctaggcaggtggatcacctgaggtcaggagttcaagaccagcctgaccaacgtggagaaacccagtctctactaaaaatacaaagttagccgggcatggtggcacatgcctgtaatcccagctactcgggaggctgagataggagaatcgcttgaacccagaaggcggaggttgcagtgagcgaagattgcaccattgcactccagcctgggcgacaagagcaaaactccgtcccaaggaaaacaaaaaagaaaaaaaaggtttccccaaaaataaagccaaagattaaaaaaaaaaaaaaaaaacttgaacaacataatagtctgcatcttatattgcttgagaattttttttttttttttttttttttacttttagctttatttgtggagaaatcctttaacaaccatggaacttactggctgggcacagtggttcatgcctacaatcccagcaatttgggaggcccaggtgggtggatcacctaaggtcaggagcttgaaatcagcctggccaacatggtaaaaccccatctctactaaaaatacaaaaattacccgggtgtggtggtacgtgcctgtaatcccagttattagggaggctgaagcaagataactgcttgaacccaggaggtggaggttgcagtgcgccaagatcacgccactgtacccagcctgggcgacagagcaagactctgtctcaaaacaaacaaacaaacattaattcgacttatgacaactgagataaacaacaaaccaaaccacataatttatgtcactgcagtataatgttaagaacatgagttagagtagaaaagctagatttgtgtcctcactttagcaagtttcctaaatatgcctgtttcctcatctatgacgtggataatagctgtatctactacagaaacaacttgtgatgattatgtgaacaaatgtaggtaaatctgttagcacagagtctggcacatagaatatgcactcaaattttagttaatattatcaaccttaataatttgacagactattacagaagagaattataaaagctcagaaatgaaatcaattcatatcttttaggaaaatacaatgtcatattagtatactctaatcattcatccacttctattataaaaaacactctatctatccattcaagatgtggaaaagtactatcaaatgataacagcagagactatttcaggcagttgccaattctgagacagaaaggggactgtgaggcaagaaaataaagcacaaattctttttttattctgttgcccaggctggagtgcagtggcatgatctcgcaatctctgcctcccgggttcaagcgattcttctgcctcagcctctccccaagtagctgggattatagacatgtgccatcacgtcccgctaattttttacttttttagtaaagacggggtttcaacatgttggccaggctggtctcgaactcctgacctcaaatgatctgcccaccttggtctcccaaagtgagattacaggagtgagccaccgcacctggcctagaaagcacaaattctcaaggccacagaacagagccactcctgggatctcatcacatgaaacccatagctcacaccctgactgtccagagcctcacccaggctaattataattaaaccaggatccctagaagtgagaacatttttaaaaactccccaggtgactaaacgtgaacccagcattaagaagcattgattaaaccataccttcctttactttgggagtaatctgagtaagtctctaataaaaaataaaaaaaatctagatgcagtaataaatgccttaattttgttattaaggaaaaccatgcggcctggccaacatggtgaaacccagtctgtactaagaatacaaacaaaaaaaaaaattagcagggcatggtggtatgtgcctataatcccagctactcgggaggctgaggcaggagaatcgcttaaacccaggaggcagaggttgcagtgagccgagatcgcaccactgcactccagcctgggaaatagagtgagactccatctcgaaataaaaaaaaaaagaaggaaaccatgccaattaataattctaaaatggttttctccatactgatagtacttcctaattaatacttttcttcttttatagaagagggcaatttctgcctggatagtcttagcttaagagacctgatgtcctaaacacatgacttaatactattttcaggatactacgcactggacgcaattgtataattcactaaaccactgtaagttttgaaataagatacctgcccaggcgtggtggctcacgcctataatcccagcactctgggaggccaaggcaggaggatcacaaggtcaggagttcaagaccagcctggccaacatagtgaaaccccgtctctactaaaaatacaaaaattagccgggcatggtggcacatgcctcagtaaccagctactcgggaggctgaggcaagagaatcgcttgaacccaggaggcagaggttgcggtgagccgagatcaggccactgcactccagcctgggcaacagagcgaaactccgtctccaaaaaaaaaaaaaaaaagagagagaaaagaaaaaataagatacctgaaattactccaatagtggatgtcctcatcaagaaaactaattttgtaatatatagcaaaatacacccatccccttatgagtagagtgagattttcaaagttgtcactctgatctgtattttcttgcctttctataatgaactaaaattatctgagaaatgaagatctaataaagtaataaaaatttaatgacattaattttgaagaggagcaaggaatggactatcacaaacatctcaaagtaatattcactcttccacatttgggaaatatcaattcatcataaaaacaaaaagacaatgcataccgtaaatggctgttaaatgacctggtatccaatagagtagggaacctttttttttgttgtggccaatactctttccagagtgctatgtattaaattcaactaaaattttatcttccaaagtcaatttttgaatttataacagaggaatatttcaatagtataagtataaataatttagtgctcctagacataaacaaaatcaactccaaaggtagcagctaaaaaaagacttgtttccttgtatgggatgctgaaggcctcttaagacaaaaagttgtgaatcaaagacaaggacatttgagaagattcaaaaacagaacactgtgctttcatcagcatatcaagacagttaaagaatacccagtactgttagcctctgaaaaagcaagcaaagagaaagactcctaagtctaagagaaagaatcctggtatattattatttccaagtaacagtgtagaagaatcagcccaacaataaaaacagcttttggtatagatttgaatagtgaaaatcaaattgtactgaactacaatttacaacagaattacgtatttcactacagaatttggcatatacaaataaataaaagaattttagaaccggctgggtgcagtggctcatgcctgtaattccagcactttgggaggccgaggcgggcggatcacgaggtcaaacaatcgagaccatcctggccaacatggtgaaaccctgtctctacaaaaaatacaaaaattagcttggtgtggtggcacacgcctgtagtcccagctactcaggaggctgaggcaggagaatcgcttgaacctgggaggcagaggctgcagtgagccgagatcgtgccactgcactccacccaggggacagaacaagactccgtctcaaaaaaaaaaaaaaaaagaatttgagaaccaagttcaggattgcccagaagtgccttgcaacgtgttactgaacactcaataatgccttgcaaatgagtaacaggaattcccactttgttcatcaatggacacttaaaaagagactaaatttttaatataactacataatcgcttttaaattctcaaaaccttgtctcatactctgaatatttttaaaatacgtatgttctacttcttcaccctttttcattttcattagacaattgttttctaccaaccgttctctacctttcttccttagccttatactttgatttctttccagatttgccacatgcccacttataaactaaagcattgtaggccaaatgggacaagaaattttcagttgaatataatcagtagcattcttgaccacaaaactgtagaaaatgctttacaaactaattttttaagagatcacaaaaactctatttaatttttctctaaagttctaattgttttccaacaaaaatgcattaacattctcatttttctaaaaaattaccttacttgggctattctagaaagtagatatttcttttttctttctttttttttttgaaacggagtcttgctctgtcacccaggctggagtgcagtggtgcggtatcagctcactgcaacctctgcctcctgggttcaagcaattctgtctcagcctccctagtagctaggactataggcgcacgccaccacacacaaaaataaatttttgtatttttagtagagacggggtttcgccatgttggccaggctggtctcgaactcctgacctcaggtgatccacccgcctcagcctccctaagtgctaagattacaggaatgagccgccatacccagcccagatatttctttaaaaaaagtttgtaagatcactgtgaaaatctttgcttgaataaatctaataaaccatgaggcatatttaggaaatcaaaacccacctctttttgcataactggagtccatatctttaaactgtaccacaacaaagtctgaacatttgaacaaaatactctccattatttcttcacgtttcggccccgaactggattctgtacttttctcatgtgcggcatcaagtaccaaatcacactaaaatgaaaaacacaagtaagtactccaaacctttacaaaataaaatttgttaggaattctttagctcatcaaggtaccagttcttatatgcctttgacaaaaataatctcaagagaatcataccctttttcccaggcatatgatctattatccattccatcatttaaaaatcctcatatctaaatgttttttgtttctatggtttgtcttaagtacattaataataatttttaagaggaaaaaacaaaccaccacatccctctattagctcacaatgcttaaaaatggttgaaatattttaataagcacacacatcaagaagcctctctgattacacaaaccagtctataaaataatcagtatttgaaactgagaagtaaaatcattcaaagtggctttaaaaactaggtaaaacactgactatgaaaatgttcttttactttgtaagaaaaagaaaaaaagtaaaaattaccttcggactgtaagttttaaaaactccttcatatatacctccatttttcacttgtacttcacatttggagccctaaaaacatataatttatttatcaaagaaacagtatactacccggtcaccagggatatttgttttcattttactttttatacctcatcaggcttcattcaatattaggtattcactaacaaaacaataaaaaaatttcaaaacattaacaatacactgaactcttgaaattcttcaggaggctctactcagagtttgcagtacgaattttaatactgaagtcaaacatttctgaccccagctattttaagtgacaaaataatgtacaaaagacaatcaactactaacattattttacacacacagcagggttaacaagaatacagctatctgttgttattggtaggggactggttccaggacctccttcagataccgaattacataatacttaagtcacttacataaaatgtaatagtatttgcatataactaagcacattctcccaaatactttaaactatccctaaattacttgtaatacctaatataatgtaaatgctatgtaaattgtcatactgtattgttttaggaataatgacaagaaaaacgtccgtacatctttggttcagacgcaaccatgcctcttttttctcaaaaaaaaaaaaaaaaaaaaaaaaaaaaaaaatttttttttttgagaaggggtctgtctggcactgttgaccaggctgagtgcaggggcattatctcagctcagtgaaacctccacctcccaggctcaaacaatcctcccacgtcagcctcccaagtcactaggactacaggcacgtaccaccacgttcggctagtttttttactttttgtagagacggagttctgccatgttgcccaggctggtcttaaacttgtgagctcaagccatctgcccacctcaaactcccaaagtgctgggattacaggcgtgagtcactgtgcctggcctttttaacaaatatttttgatccaaggttggctgaatccatgaatatggaacccacagatgcagaggaccaactgtacttttacaatgaattatattagactggataaaaggagttctaatctatttctctaaatcatcctgactaaacatgatctaagcaatgttactttgacaatcatttatccacattttaacttcatggaattactttattctacccccaaggcagtttatccccaataatctaataacttacaacaactgatgtaagtatatgaaccatcctcatatttgcatagattccatcaaaagaaatctggaatattaaaaaaaaaaaaaactattagaaattagtacaaactgaatcttcctcatctaaaatgcttgggaccagaagtattttagactgcggatttttttcggatttggggatatttgcattatacttagtgcttgaacatccctaattcaaaatatgaaattttggagcatttccgattagggatgctcagcctgtatttacatttgcatataaagctaacgtttattatttgttgcaaaatgtttagttaggtttatgatatcttacatgtattaagggaagattttgtttatttaatattttgcttccatagagaacagaaggaacagaaggtcaggttttcaagtgttatcagtcaaaccaactaatggtgttttgactaaacatgacataaaaaagcaagagtaaacttccatagaggaggaaggacacaaaccgtaaggatggaagacaaatcaatggttggagagagaggagggttcactgaaaagtgatttgagggattttggtgggcaatgaaactgttctattaacttgattgtggtggtagttacactgattgtatgcaattgttaaaactcacagaaatgtaccctaagaagggtgaagtataaataaatggggtaggaagccaggtcataccttcatagaagaaccctgactaggttctcccagcatatcagcatcagtgacagtgcttaagtctgatcaaccacactactccatattactaccatatacgtgtatatcttcctgattcttgtaaaacaatctaataaaggcaaagtctcaaaaatttgtgatagcttctcatttatttcttccatcatgtgggacttatagtttctgcccttcatgtccggttcaatttcattgataacattccaaaatttaagaccagaaagccaaaggagaaaaatgaaagcagcagaaaaaaagcacattaattcaaaataaaaagcataaagaactctgcagactccactcttggtgttctacgtatcttttggaggtttttcacttagatttgcacttagtcatttagaaaagaacaagcgacttgttcttgttattacacgtgacaaaaatactatttacaaatgatatggtttggttctgtgtccccacccaaatcttatctttaattataataattctcgtgtgtcaagggcaagaccaggtggagataactgaatcatgggggcagtttcccctacgctgctctcatgatagtgagtgagttctcaggagatctgatggttttataaggggctttccctgctttgctcagcacttctctctcctgtcgctatgtgaagaaggatgtgtttgcttccccttccaccatgattgtaagtttcctgaggcctccccagcaatgcagagcatgagtcaattaaacctctttcctttataaattacccagtcttaggtatatctttattagcagtgtaagaatggactaatacaacaagtaattgtacattttatacagagtcattaaaaaaacacatataggctaataacatacttaaacagtcaagttatctatgacaaaattcaaaagaagggaatcttttgccttggcatttggtctgtggttagagatcatgttttagctactaattttccccaataagtaacattaaagttactcaccgtagactgaggcagtcctttgttactgtttcgacctctgaaaagattaaatattatttttattaaattcaacaggctaaataagctgaaaaatatttccaaacttaaaatataattccattcaaataaaggagaggctatctgtggggagagctcacctaatattaagtctaaaggctacctaaggatggctctacctatgcactgcttgcctggagacccacaacaggtaggggtcatagaaggaagcaaactagaaataatcaaacttcatcaaaatcaaataaataaagtaaaatagcctactggaagaaaaaaactaatgctaaacgtaaattaataataattatagccaggcatgtggcatgcacctctagtcctagctactcaggaggctgaggcaggatcaccagagtccaggagtctgaggctgcagtaggctacgatcattccactgcagtctagcctgggcgacaaagcaagactctgtctctaaataataatctttactcccaaagtaaccaatcactgttataaagagctattcagaagcaaaacacggattatattcttgatttaaccaacacagatgactgacaccaagtcacttcccatatttctcccccatctataaaagaaaaacaggtcatatgggccgggcgcagtggctcatgcctgtaatcccagcactttgggaggcagaggtgggcagatcacaaggtcaggagttcgagaccatcctggctaacacagtgaaaccccatctctactaagaataaaaaaattagccaggtgtggtggcatgcgcctgtagtcccagctactagggaggctgaggcagaagaatcgcctgaacctgggaggtggaggttgcagtgagctgagaccgccccattgtactccagccggggtgacagagcaagactctgtctcaaaaaaaaaaaaagaaagaaaaacaggtcatatgattacaactgcagaaaaaaaaaaactgaaaataagctaaatcattcaaagcactttcatttctaaataatatgcgtctatatgtgtggatcgttgtaacaagtgcctttccttgccaactctctccctcagaaaagatgcagtacacaaaatttggctgtcaagtaaagatgaattctattttcaagtgaattatagaatataatacaacctaaagcttattccactgaaaaagattaggccccttagaataattaaaaaacatcattaaagtgaaatgttatatttctcataaacattagtcatgacaataggactggaatctcattttaataaaataatcacaacactcaagccaaaattcaaaacattcaaggaaaagcacaattcagatccaaaaagtctagtaacacgactggtcgatccctagaagagtactcttaacattctgaggccagtcctagcttggtctccaactctgtcacttttcctcactttcttctctcatccagaaaacaatggacttgaattaaatgacatctaggattcctttcatttctaacattctaattctgtaactgtttgcctcaaacatggcacagagataaattcctgaagtctaaggaatatgactaataatttatcttttatagatcttactacaaaaccagacaccatactaagtacttcacatgcaacatgtctaatctatcacctctactttacaggtgaggaaactgaacctcagcagtcaagtatcttgaccaaaatcatccagttcatgagcagtagagctggtatttaaaccaggtgtatctgattccacgtctaagtttttcattcctaggttatgctgcctctctggaactgtatcacaaggaataaactacctcgcctaacaaaaattctatgctttttcaaacatcatttgaatttacagttttggtaggggtgtgggggggtgtacttatagtctgtacatgaaggctaaaatgcctaaatcttacttagaacgatgatctggtatcctggtggctgctgagatgccaagttacaaaaccttgaacaaatgccacgaactgtccttaaactcatatggcctccctacaaagctatataaaagacttaaaaacataatcccctttaaataagtcacactgttctttttagtgattatgtggttacatctttgactaataaaaagtaattgtttgaccatggagtttactcaaaagaacgaatcattcaaccaggaaaatattatcatataaaaaaacagtacagtaaagtgcagaaaccactaatttccactgatctatgacacggttggacacccaacaggaatgttagcatatcgaagcagtattctctgaaatccactgaagtctaaattcttgtttctttttgtatccattcaagttatgctttacttttaatcttttcattagtatctcaaaccaaatattttactatttaatatagtaacaaatactgaaccgcaataaacaaaggccaagagcatattttagacctaagtatatttatgattagatagatcaggtttaacaaaacactaatatccaggactctatgcttttaatagttgccaaatatgaaattcaagtgtgacttaaaatgccagtcaaattaatataaagaaatttacatgctgaatgtggtagctcatgcttgtaatcccagcactttaggaggctgaggcaggaggatcacttgagtgccggagtttgagatcagtctgggcaacaaagcaaaaccctgtttctacaaaaaataaaaaactagccaggcatggtggcacacgcctgtggtccccgctacttggtagggtgaggtgggaggatcacttgagcccaggaggtcaagacagcagtgagctgtgattatgccactgcactccagcattggtgacagagcaaaaccctgtctcaaaaaataattaactaaataataataatacagaagggagaaatgaatggggttgtaaatcaaacaagaatggtatgagctgataactattaaagctgggtgataggtgtgcaggggttcactttaccattctgtctactttcacacaatttcccttaaaaaaaaaaaaaagcaccttctgcttctgatgtgatacaataggatagacctaatcaagtttacagatctaccagtttacgagaaacattaagatggaagaatatattaactgataccatgaggttcctcacagtttaaatccagaatgcagtaaatgcaacataaaaaatgacagttttttgtttttttttttttctgagacagagtctcactctgtcgccaggctggagtgcagtggcacgatcttggctcactgcaacctccgcctcccaggtagctaggactacaggtacgcgtcaccatgcccagataatttttgtattcttagtagagacggggtttcaccatgttggccaggatggtcttgatctcttaaccttgtgatccacccacctcagcctcccaaagtgctgggattacaggcgtgagctaccacgcccggccaaagatgacggtttaacaaataaatcacatgggacaaaaacatcataggaggagaacttatgaattttaaaatacatataaaagcaatgcataggccaggtgtggtggctaaggcctgtaatcccagcactttgggaggccgaggtgggtggatcacgagctcagaagttcaagaccagcctgaccaatatggtgaaaccccgtttctactaaaaatagaaaaattagccaggcgtggtggtgcacacctgtaatcccagatatttggggaggctgagaccagagaatcacttgaacccgggaagtggaggttccagtgagccgagatcgtgccactgcactccagcctgggcgacagagcaagactatctcaaaaaacaaaaaaaaaaaaactacaaaaaaaaaaaacacttaatacacttaaaattgttaaaatggtatattacttatattgcaccataatttaggagaaaaaaaactcacaatctcttcccaaagaaatttcatttgcaacaaggtatgaaagagttaatgatgctttcaaaggcacttggtaggaggagaatcattggagataagtgctaaattgtagttgtctagtttggtggccagaactagggaaagagagctgggaggactcctctgtggattggaacaaatttcaaacactgatctcagaaactatcccttcaaagaagcgcaaatttgatcagatcagtctgtggagcagtttaggcccaaagctccacggaaaacaatgcaggccctccatatctgcagatttcacatcctcagattcaatcactcgagattaaaaacacttaaaaataaatacaataaaaataagacaaataaaaaatatataacaactatttacctagtgtttacaccatattaggtattataagtaatctagaaatgacaaagcatacaggaggatgtgcaccggtatatgcaaatactgtgccattttatgagggactagagcatccataaatttttatatccaacgggggggtcctgggaccaatcccccaaggacaccaagaaatgactacacagcatcacctagtaattagtgtagcttaacagctgggtacagtcaggaaaagagacaaagccatgccaaaatcactgtgattctagagtgatggtaggcatacccaaggctgcatcccaagaaaactagcatcagacgtgtcacactgtacagggagggaagaaggatagaacactaaaatcattcagccagtcattagacaaataagcaaataacagtaacaaccaccacccccaaccataggctaatgaggtatccagagttactacattacttaaaatgtccagttttcaacaacaaaaaaaaaaacgacaagctaagacacaggaaagtataaccccacccactggaaaaagaagtaggcaatagaaattgcttgtataaccagatgtctgacttaataagaatttcaaaagtggtcactataaacatgttttaagaacgaaagaaaaccataattaatgcagtaaaagaaggtatgattggccaggcgccctgactcacgcctgtaatcccagcactccaggaggccaaggcgggctgaaaccccatctctactaaaaatacaaaaacaaaattagccaggcgtggtggcaggcacctgtagtcccagctactcaggaggctaaggcaggacaatggtgtgaacttgggaggcggagcttgcagtgagccgagattgtgccactgcactccagcctgggcaatacagcgagactccgcctcaaaaaaaaaaaataaatgaacagtctctggccgggcatggtggctcatgccttaatcccagcactttgggaggccaaggcaggtggatcacctgaggtcagaggttcaagaccagcctggcaacatgctcaaactccatcactactagatatacaaaaaattagccaggcatggtggcaggcgcctataatcccaactattcaggaggaggtggctgagggaggagaacggcttgaacccaggaggtggaggctgcagtgagccgagatggcaccactgtactccagcttgggcaacaagagcaaacctccgtctcaaagaaaaaaaaatcataaaattaaaatactacataagcaaatactcacttggctgggcacagtggctcacactcataatcccaccacttcaagaggccaaggcgggtggatcacctgaagtcaggagttcaagaccagcctagccaacatggtgaaactccacctctactaaaactataaaaattagccacgtgtggtggcacatgtctgtaatcccagctacttgggaggctgaggcacaagaattgcttgaactcaggaggcggagttcatgccactgcaatgcagcctgggtgacagagcaagactccgtctttctgttttttttgagacagagtctacctctgtcgctcaggctggagtgcagtggcatgatcttgactcactgcaacctccacctcctgggttcaagcaattctcctgcctcagcctcccgagtagctgggactacaggcgtgtgccaccatgcccagttaattttttgtatttttagtagagacagggtttcaccatgttagccaggatggtctcgatctcctgacctcttgatccacccacctcggccttccaaagtgctgggattacaggtgtgagccactgcgcccggcctcgagactccaccttaaaaaaaaaaaaagaaaatatgcacttgccaggtacaatggctcatgcctgtaatgccaactaatccagaggctgaggcagaaggaccacttaagacccggagttcaagaccatcctgagcaacttcgcaagaccccatctctaaaatagttttaaaaaacagtcaggtgttatgcaggtgcctgtagtcccagctacagatgggaggttcacttgagcccaggagtttgaggctgcagtgaactatcatcatgccactgcactccagccttggtgacaaagcaggactctatctcttaaaagagaaaaagaaggcctggtgtggcagctcacgcctgtaatcctagcactctgggaggctgaggtgggtggatcacctgaggtcgggagttggagaccagcctgaccaacatggaaaaatcctgtctctactgaacatacaaaattagccaggagtggtggcgcatgtctgtaatcccagctactcgggaggctgacgcaggagaactgcttgaacccgggaggcagaggttgcagtgagccaagatcaggccaccgcactccagcctgggcaataagagcgaaactccatctcaaaaaaaaaaaaaaaaaaaaaaaaatgtagacagaatgatggaagaaaagggcatcactacttggtaacaccatagtaaataactgtttcaggcaaaagtgtccacagaagctaaatatagtaagggaaagtagaaacagagtatttatataaccacaaagtaactccccacaagatactgatgaaatgaccaagtgaaaaataactttatagtgaagaaacttagtagacacaactctaaccaagtgatcaaagttaacaaccccagtaatgggataaatatatacaatgcactttctgatatcatgcaatgagaaaaacacacaaatcatttctgttgtattcctgccaaaaataaatatctgaatctaatcataaggaaacctcagataaaccctagttgagggacagtctacaaaataacctgtaatcttcaaaagtgtcaagtcataaaagacaaagaaactgctttggattaaaggagaccaaagatacatgataaccgaaggtaacaatcctggattggttcttggacagagggagtaaatacgtatattccacatatatatgtagaatatatgtgtgtatatatatgtgtatatatatatgtagaatatacatatttactggttcttgaccagaaaaatgttgatttgttgattgttttaaaggacattagaaggtctataaacagaataacagtttgacacaattattaatttccttattttgacaactgtactgtggttttgaaatagaatgcccttgttattagtacatacaagttgaagtatttagggctaaagaggcatcatgtctctcatatgtttaataagaatttttattttatattaaatcttacatatacaattaccaatacagagaaaatgttaaggtgaatatggtaaaatgttacttgaagaatacaggtgagatatataggagaattctttataatatctttgcaatttttctaaaagtctaaaattatgtttaagtaaaatgtttttaattggagactataagtgatgtgatttgttaactctatttaatgcattgtccaaggcattttttaaataataatacttaatcctactcagccttgaaactcaaatgccatcttttcaggaagtcttccttcgattatctcaatcaaatatacgatgctgttttcaactctccagtttagatctgtattataattactagtgtatctgtcatatacccactactcaggaccatcacctgaccatattatgcttctgtgaaaatcagaaaatgatgcctcttccagggggtcatagccccacattagacaaaacagtgtggtcggcaagcagtgtctttgtgaaaattaaaagaaggtaccagaagcacatagatatagcccccaaaggcacattgtgtggccaaagaaacaccttgatttcaacatccattcacacttggtcaggaactcttggacaaatgaaaacctaacaaccaagcttggcaaaagtatctttctaccactaccaaaattagcagaggaatcatgcctcatatgatacacactgagtaaatacctaatgaattaacagcccaatcagaacaagggaaagaaaaaaaaagaaagttaaaactttccatttcaaagctatcaatctttaaatcaggggtcaggacactacagcccacaacctgttttggtctggcttctgggctaagaatgatttttatgttcctcaagagttgcttatggtaaaaggaatttgaggggaaatggaaaaaaaaaaaaaggatatgcaacagagaagctatatggccctagagcctaaaatacttattacctgagactttacataaaaagtttgcccatcctcacactgaagaaaaaaaaaaacatagctgcaacagcaatacaacaattaaaaatcaagcagagccaggtgcagaggtgcagcctgtagtctcagctactcaaaaggctcaggtgagaggatcgcttgagcccaggaattaaaggccagtctgggcaacgttacaagaccctgtcttttaaaaactgaaagataaagttgtttattattttacatgaatcagtatttactacttctgcatgggggcatttctggtaaagactggaaaacctgctagacaaattctgtaagagctgcaacactccagtacttcttttctcttttgtagagatggggtcgcactatattgcccaagctggtctccagctcctgaactcaagtgatcctcctacctcagcctcccaaagtgctgggattacaggcataagacaccatgcctagcctccagtacttctaaaataaactgctggatagcattaaattattttcatgaagttttatgtacatataagaaatgtcatgaatgtccccatattctcctttaagtaatgctttatattaaaatttgaggttgatccacctactgaaaaaaaaaacgtattttactagtgtacatgtgatggcaatacatgcatacctcattttattctgctttgctttattgaaattcacagatgctgcatttttgacaagctgaccgtctgtggaaaccccgagtcgggcaagtccattagtgccgtatttccagtaacatgtgctctctttgcgcctgtgtcacattctcataaatctcacaatattttcaaacttttccactattattgtatacgttatagtaatctgtaatcagattgtattttacaataattgtaaataataaagaaaagattgtattttacaattgtaaataataatttacaattattattgtatctgttatagtaatctgtaatcagtaatcgttgatgttaccctgatttcttttaaggcaccacaaacggtccatataagacagcaatcttaataaatgttgtgtgttatgactactccacgaaccagcagtcagcttgtctctctttctcctcgtgcctctctattccctgagatataacaatattgaaattaggccaattaggccaggcatagtggctcacacctacaatcccagcactttgggaggccaaggcaggtggatcacttgaagccaggagttcgagcccagcctggccaacatcgtgaaaccccatctctactaaaaatacaaaaattagccagacgtggtggtgggcgcctgtaatcccagctactcagtaagctgaggcacgagaattgcttgaacctcagagttgtaggatgcactgagctgagatcatgccactgcactccacgctgggaaacagagtgagattctgtctcaaaaaaaaaaaaaaaattacttctcattgacaaaaagctatgatgggaatgtacaaggacataaatgttttcataactgctaacacaagaatcagtccatagcccagggatcaagggataattttgacgtttaagccattttatttaagaaatacggccgggcgcggtggctcacgcctgtaatctcaacacttcggaaggccgaggcaggcagatcacctgagatcgggagttcaagaccagcctgaccaacatggagaaaccccgcctctactaaaaatacaaaattaggtgggcatggtggtgcatgcctgtaatcccagctactcaggaggctgaggcaggagaattgcttgaacccgggaggcggaggttgcggtgagccgagatagcatgccactgcactccagcctgggtgacaagagcaaaaaaaactccatctcaaaaaaaaagaaaaaaaaaaaaagaaatacattctgtaaggctactactgccattcatagccattctctgatggcaaaataaattgaaaactttctaaaaagtattcaccattctagatgccactgagaatgccatccatgagcatgggaggaggttaaaacatcaacattaacaggagttttagaggaaattgcttttctttttttttttttttaagatagagtttcgctcctgttgcccaggctggagtgcaagggcacaatctcaactcactgcaacctccacctcccaggttcaagcgattctcctgcctcagtctcccaagtagctgggattataggcgcccgccaccacatccccgctaatttttgtatttttagtagaaacggggtttcaccacgtttgccagactggtcttgaactcctgacttcaggtgatccgccctccttggcctcccaaagtactgggattacaggcatgagccaccgtgcccaaccaggaaattgcttctaatactcatgaatgattttgaggggttcaggacttcagtagagcaagtaactgcagatgtggtaaaaaagcaagagaactaaaattagaagtggggtcagaagatgtaactgaattgctgcaatctcatgataaaacttgaatagatgaggtgttgcttctcatggataagcaaagaaagtggtttcttaagatggaatctacacctggtgaagctgctgtgagcactgttgaaatgacaacaaaagattatgaatattccagaaacaggccgggcgtggtggctcacacttgtaatcccagcactttgcgaagttgaggcgggcagatcacgaagccaggagttcaagaccagcctcaccaatatggtgaaaccccgtctctactaaaaatacaaaaattagcctggcgtggtggcatgcacctgtagtcccagatactcaggaggctgaggcaggagaatcacttgaacccggaaggcagaggttgcagtaagctgagattgagccactgcactccagcctgggagacagagcgagaccccatttcaaaaaaaaaaaagaacgttccaaaaatgaaatggcctggcacagtggctcatgcctgtagtcccagcactttgggagaccaaggcgggcagatcacctgaggtcaggaattcgagaccagcctggccaatatggtgaaaccccatctctactaaaaatataaaaattagccgggtatggtggcgtgcacccatggccccagctactcatgaggctgacacaagagaatcgcttcaactcaggaggcagaggttgcagtgggccgagattgggccactgcactccagcctgggcaacagactgtctcaaaaaaataaaataaatgtacattttcgtatgtttgtctgtcttattcactgtgttacttaattaacaagcaaaacaatatacacaaacaatctaacacatcctgataactgaaaaacattaaataatctaagaataaaattaccttccattattgtttcaacaactgggggaggccgggcgcagtggctcacacctgtaatcccggcactttgggaggctgaggcaggtggattatctgaggtcaggaactcaagaccagccttgccaacatggtgaaatcccctctcaaataaaaatacaaaaattagccgggcgtggtggcacatgcctgtaatcccagctactcaggaggctgaggcaggagaatcgcttgaacccaggaagcagaggttgcagtaagccaatatcacgacaatgcactccagcctgagtgacacagtgagactctgtctcaaaaacaaaaaacaaaacaaaaaaaaaaactggggagaaaaaacatgcaatctctattggtactgtcaccatacaatataattatagagcttcatgtctttttatttttcaccattctgctcatccatcaccatttttcaacactcctcctctatatgtccttcagtagtttctaatgctatttcaacaagacctgggtaacagatttttttatataatcaaaatatttcattgatccaggtttctagaatcagactggttgtatagaagtaactaattttctttggcataagggtaccacatacctctaacccccttccagtaaaactgtaagaatgctcttccctccagctattcacatggctgcccctttcttgttagttaccaacttaaatgtcacctcctgaaagaagccttctcaaactaccccctctacagcagctccccaactattatgtctacccgttttaatacttaagtaactaatatttagtacatcagttagacaattaactaaaatctagaaatcaagttccacctcttaaggttaactcacttaggtgagtcattttgttcttccaatttcagacttcttgttgttgtttacattattattagaaagggaaatcctataccacgtattgaatattttctccctaaaaagttgagtcaaatgaggtggcaagagggggtaggccatgacaacccaaacacagtgaagctagagttttttttgttttgttttgttttgttttgtttttaggaaactgaggtgggaaggcaactctaaattcacacagaacaactgccagattaatccggtcatataatcatctaggatcattgtttcaaaacaattaccattcacacaagaactaatatcagcattaattgcttgggttcaaattccggctccatcacttctcagctctgtggccttaatcctgtgacttcagctctctgtgtttcaatttcaacatctatgaaatgaagatgaaaatagtaccttctcaaaagaaaaaaaatagtatcttttcataaggttgtggaaattaagtaatattccatacagatcgcatagcttaaaacagtgcctggtatgttattaagtgtttaataactgctagctaatataattatttcctcatattccagcatacactagagtagtaaaggagaaaaaaaaggccagtcgcagtggcccacacctgcaatcccagcactctgggaggccaaggtgagtccaggaatttgagaccagcctggacaacatggcgaaatctcgtctctacagaaagttttaaaaattaggcaggtgtggtggctcatgcctacagttccagttacttgggagctgaggtgggaggatcacttaagcccaggaagtcgaggctgcagtgagccaggatcatgccactggactccagcctgagtgacagagcgagaccctgtcttaaaacaccaccaccaccaccacactcttcatatgaagttttaccccttcagtgcctttaccccttgagtccctctagagaaagggataaaaggcttggtcatgaagccatgaacaactagatccaacctagacacaccaaaaaatccaaacaactcaggtagaaaaggatcttagggctctagtcccatgctgtccaagagaactttgtacaatgatgaagatgtcctatgtcatgctgtccaatattgcagccattaggcacatgtggcagctaagcacttgaaatacgattagtatggctgaggaactgaaatatttaaattttaatcaacataattttaaatttaaagaaccatgtgtggaagtagccacaatactggacagtgcccattcccatcttctcgagttctccagacagtaagccacccccttccacggcattcatatcacctctgacttatgcaccaagaatgcttcctgacaggaaactcaagtctctcccaacgatctacccgttgctcataaacttatccctttctggaggccacaaaacaattgtattccccttcaaaagactatcagtggaggagaggggagtatagctgaaacaacgttggccatttactgataactgctaaagctgagtgacaggtacataagattcatccagctgttctctttctaaatacgttgaaattttacattttaaaaaccttattagcgtttactttaagctcatttcattttctaactgaaacatattcttccaaatgtgtttccttactttcagtgaggaccccctccaattcttctatcacactgtgaaccaaattttttctacatacaccatgtgtatagcaatccctgtactttagcacaaactcttcccgcctggaacttcctcctctcttcatggccttactgaaaactgcttatcttccttgaagatccatctcaactctcattattttgaagccctttttcttcactgcccacccatggcagtcccctcccagtgctaccaatttaaactatctgcatgcctgccttctctactacactgggtaacctggaagcagagataatgtttcattcatctttgtctctgtcctagtctgacagcatcaaatgtgtaatgaattaatgaatatacaaacttaatgaaacgctaaactgtagccattcatactgtactaccccaagcccatcaataccacttttcaaccttaacttgctggtgtagtttctactggtttccaaacatgctaataagaacagctaaaagttactgagcacttattacttgccaggcattgctttaagcgtgttacatgtttaattcatttaatcctcttccatcccctttttacaggggaagaaacttaagcataagtgaaaataacttgccttacatcacgaagtatgaaggagcagggatgcgaatactaattgtaaagtccctgctcctgtgtacaacaaggaagacaaatcataatctcaaatgcaagcttcaaatcccaaaattcagatttgggaaaggggattaggatgccaaataggaatactgacctgtaaaaagaaaaagtaactttaggcattctccacaaaacagtgtgagggaaaatggtaatctttttattcttgtaatttatagtaagctactactgaataagaaagctaacttgtactagacaaagttaagttctacaggaagtttttaattattagaattagtttcatggaaaatttgggctagatcttaaagggtaagtatgaggatctcgaatggcagaacaatgatggaggagcaagcaagaggcagacactgggcactggacctccacaagcagtgaggaaggagaccatcttgatttaaatggaggtcatatttttgaagagttaatgggaaacatgatcagaaaggtaaaatggagttctattaggggtcagcaaatgcccatggcctattttcacatggcttaaagctcagaatattttttacactgtaaagagcttttaggtcaggcacggtggctcacacctgtaatcccagcactttgggaggcagaggtgggcagatcacctgagatcaggagaccagcctggccaatgtggcgaaaccccatctttactaaaaatacaaaaattagctgggcgtggcagcatgtgcctgtaatcccagttactcgggaagctgagacaggagaatcgcctgaacccaggaggcagaggttgcagtgagccaagattgcaccactgcactccagcctgagcaacacagcaagactctgtctcaaaaaaaaaaaaaaaggggcttttaaaatatgtaaagaaaacgtgcaaacatacacaaaaaaatgggactgtatatggactgcaaagcctaaaatatttactatcgggctgggcacggtggttcacactggtaatcccagcactttgggaggccgcagcaggtggatcacctgaggtcaggagttcgagaccagcctgaccaaaatggtgaaacccccatctctactaaatacaaagaaattagccgagcgtggtggcacatgcctataaccccagctacttgagaggctgaggcaggagaatcacttgaacctgggaggcagaggttgcagtgagccaagatggcaccattgcactccagcctgggtgacaagagcaaaactccatctcaaaaaaaaaaaacaaatttactatctggccctttacgaagtttgacaggccttggattaggtcatagaaagctttgaaggtagactccctcaggcttgggaatagggtgatttttaagcagaggggtaacccaacacaagtagagttgaagtctaacagcaaaaggtaggctaggttaaacccatggataaaattaatgtatcgcagtaattaagaataaaatgtacaacctcctgatattgtttggcccaaataaataacagcatagccaagaatttgcctaaagtcacagaggaaaggaattattctctcaactattatattccttccctctggaagactaacatgtactgctgaagtcttgttcagtgtccttctagccccagactttgcagcctaccaacatggactgagacagggaaagcgtgggcaagtgagttccatactctaattttcctacagaagcatcctaagtggtgtgtgggttctcagatcaagtcacaaacacattcacagcccatgatatcgtacaacactactttttagttcaaattaattatgagtaacaacagactatctgccaaaatagggagctgcagaaaactaaccatcatttatgatgttgtttccaaatttcaaaattttaaaaaaaaaaaaattataaacaaactttttgattgaaactcactgatagagaactgccaggactaaagcatggttgattgaagaaattttattgctgacaataatcaccggattgttttcttcattattgttattatttttatttatttatttatttattttttgagacggagtcttgctttgttgcctacgctggagtgcaatggagcgatctcagctcactgcaacctccacctcccaggttcaagcgattctccttgcctcagcctactgagtagctgggattacaggtgcttgtcaccacgcctggctaacttttttgtatttttagtagagacggagttttgtcatgttggccaggctggtctcaaattcctgacctcaggcgatccacacgcctcggcctcccaaactgctgggattacaggcataagcgactgctcccagccttcttcactgatttttacttgtttttgtcatatctctatattagaagcaatggaacagttattaaaaagcaaagactttgaaatctcacaaggttaaaaatctcagctttgtcacttcctatctctttgacctaaaggcaatttccttaatttctccaatccatcacttcctcatctgtaaaacagatatggcactaccagcctgacaggctgggctgttgtaaggcttaaaagatatacaagtaatgctcttggcacagctctcctgaaacctaataggcacacaataaatggtattttatgacataacatttattacctaaataaaatgttcatcttttcacatcatagatagctaaatgtgttttttctttctttttttttttttttccagaaaaaatggccactactaccacttggctcagaaatgctagtctttattttctgaaatgttttatatagaaaaaatttaataataaatagacattcttatatatttccttaccattttagattgggttaaaaagtatggagacttccggccgggtgcggtgattcaagcctgcaatcccagcactttgggaggctgaggcagacagatcatgaggtcgggatctgtggctaacacagtgaaacctcatctctaccaaaaatacaaaaaaattagccgggcgtggtggcgggcacctgtagtcccagctactcgggaggtggaggcaggagaatggcgtgaacccgagaggcagagcttgtagtgagccaagatcgcaccactgcactccagcctgggcgacagagcaagactctgtctccaaaaaaaaaaaaaaaaaaaaaaaaaggtatggagacttcttatagcatttatagactatgaacaactaaattccctgaattccgtatctgtcacaaatgtaaattcctcattttcttttcttttttttggcggtggggggatagggtctcactctgtcgcctgggatggtatacagtggcgcaatcatagctcactgcaacctccaattcctgggtttaagtgaccctcctgagtcagcctcccaagtagctgagactatacgcatgcaccaccatgcccagctaatttatttttgtagagatggggcctcactatgttgcctaggctgatcttgaattcctgagctcaagcgaccctcctcccttggcttcccaaagtgctagaattacaggtgtgagccactgtgcccagccaaaattcctcattttcttttccgtttttcatactgttgaagtatagtccttcacccagagaagctagtgactcaagttcctggttgattaaaagaaactattaataacattttttaataccatcactagttttctttctttccagagatccaaaatacaatgatagtaactcatctctgccaccttctgagtgaatttgaataggtcatttaacctctctgggccttcatttcctcatgggtaaaatgaggacaggataacagattatctaacagggctatgtggtaatcacatgagattatgtatgccctgggagaataaactcacggtagcgtccggttcactcaatcctgtttccctccctttttaattatgaccctaatcaatttttcaagctgaggtcagaaagcttctcaaacatacttatttctgggcatagccagtggctgtccctgaagcactaaaaagaacaagacccttagcaacataccagactgctgataagaggggctggagcgcagtgctgtgatcatagctcctgcaatctttaactcctgagctcaagcaatcctctcgcttcagcctcgtagtagctgcgactacaggtgtgtgctgccatcccccattaattaaaaaatattttttgtagagatggggtcttgttatgtttctcagcctggtcttgaactcctggcccttcccatttcagcctccccatgacgtggggaggtttacagacatgacccaggcccattcttctgattttgttttcctcttcatctaaaagaactcctttcaagattttatgagacagaagtaaacatcagcatctcaaacacctcaatgccataaggtggcaggggcaatgagaactttctgcctagtctatactaccacataagctccaaaaagagagagacctcatctggcttattcactactgtattcccaagcctcacaagcaggaggtactccaaaaataaaaaaaggggaggaaattaaacgtggtatgcctataaatgccatgctttctacatgacagggtcaactactactgcttaataataaaaccaatagtcagccaggcgcagtggctcacgcctgtaatcccagcactttgggaggccaaggcgggtggatcatgaggtcaggagttccagaacagcctggccaagatggtgaaaccctgtctctactaaaaatacaaaaattagccaggcacggtggtgggcgcctgtaatcccagctacttgggaggctaagacaggagaatcacttgaacctgggaggcggaggttgcagtaagccgagatcatgccgctgcactccagcctgggcgacaagagacaaactctgtcttaaaataacataacataacataacataacataacataacataacataacataacatcacaccaaaccaaaccaatagtctggccgggcaccacggctcacacctataattccgccactttggaaggtcgaggtaggcggatcacttgagaataggagtttgagaccaggctgaccaacatggtgaaaccccatttctactaaaaatacaaaaattagtcaggcacggtagtgcacgtctgtagtctcaggtacttgggaggctgaatcacctgaacacaggaggcggaggttgcagtgagctaagattgcgccactgcacgccactgtactccaacctgggcaacagagtgagactccatctcataaaaataaaaattaaaccaacagtcacatattcaacaaattattattattattttgagacacagtctcactctgtcacccaggctgaagtacagtggcacgatctctgctcactgcaacctctgcctcccgggttcaagagattctcctgcctcagccttctgagtcactgagactgtagatgagccacgcacaaatggccaatttgtgtatttgtaataaacacagggtaggccaggtgtggtggctcacgcctgtaatcccagaactttgggaggccgaggcgggcggatcacaaagtcaggagttcgagaccatcccagataacacggcgaaaccccatctctactaaaaataaaaaaattagccaggcatggtggcgggctcctgtagtcccagctacttgggaggctgaggcaggagaatggcatgaacctgggagtcggaggttgcagtgagccgagatcacgccactgcactccagcctgggcgacagagcgagactccgtctccaaaaaataaataaataaataaacaaacaaacaaacccagggtttcaccacgttggccacgctggtctcgaactcctgacctcaggtgatctgcccgcctcggcctcccaaagtgctgggattacagtcgtgagccactgcgcctggccacgacaagttaattgataacttactaagcatacaaagttgtacaaaacacttgttcctactgtcaagatgctctaaatctagaaggaagataatgcaaatatttccaaacaagtcagatcgcaaataaacacatgcaccgcatgtttcaattatttatttatttatttatttattttgagacagagtctcgctctgttgcccaggctggagtgcagtggcacgatctcggctcactgcaagctccgcctcccgggttcacgccattctcctgcctcagcctcccgagtagctgggattacaggcgcccgccaccacacccggttaatttttagtatttttagtagagacggggtttcaccgtgttagccaggatggtctcgatctcctgaccttgtgatccacccgcctcggcctcccaaagtgctgggattacaggcatgagccaccgggcccggcccgcatgtttcaattaacaacagacctatatacaatgatcaaccagtaagttaaggtaaatttactcttaaagaaagatatttttgaccaggcgtgatggctcacacctgtaatcccagcactttgggaggtcaaggtgggcagatcacttgaggtcagaggttaaaagtcttaactcctaaccacagtgaactttctgtctgcagaaaagagcattggtcaacagttcacaaaacggctaggcatgatggcgtgcacccacagtcccagctacgtgggaagctgaggtgggaggattgctggagcccaggagttcaacgccctgggcaatacagcaagacctcatctctggccaggtgcggtggctcacatctgtaatcccagcactttgggaggccacggcgggtggatcacctgaggtcaggagttcgagaccagcctggccaacatggtgaaacccccgtctctactaaaaatacaaaaattagccaggtgtggtggcacgcacctgtaatcccagctattcaggaggttgaggcaggagaatcgcttgaacccagaaggcagagactgcagtgagccaacatcacgccactacactccagcctgggcgatagagcgagactccatctcaaaaaacaaaataagaaagatatttatcaatttagtgtatcctaactgttcagtgtttgtctacagtagcatacagtaatgtcctaggcctgcacattcacacaccactgataaatgactcatcccaagcaacttcctgtcctgcaagctccattcatggtaagtgacctattcagatataccacttttatcttttacgctgtatttttactcaccttttctatgtttagatatgtttagattcacaaatacttaacattatgttacatctgccaacagtgttcagtaccgcaacatgctatacagatttgtagcctaagagtaatactctgtacgacagcctatgtgtctagtaggtataccatctaggcttgtgtaagtaaactctatatttgtacaatgataagatcaccgaaaaaatttctcaaaacacatccccatcattaagcaatgcataaacatagtttctcatcaccaaagatggtatgaatgtcaaataaacacatgaaaaaatgctcaatatcactgggcattagggaaatgcaaattaaaaccacaatgaggccaggcacaggggctcatatctataatcccagcactttgggaggctgaggtagatgaatcacttgagcccaggagttcaacaccacccagggcaacatagtgagacctcttctctactaaaaatcaaagcaaactaccaggtgtggtggtacatgcctgtggtcccagccaggaggctgaggcaggaggatcacttgagcccaggaggtcaatgttgcagtcagacaatatcgcaccactgcactccaccctgggtgacagagcaagaccctgcctcaaaaaaaaattcatacactgctagggaaagaaaatatagcagtcactttagcaaacagtttagcaattacttttaaaattaaataaacactcacaggattatatgtaccctggaaaaataaacacttgccacaaaacccagcaatctcatttctatgcattccaaccaagagaaataaaatcatatgttcacacaaaacctgtacataaatattcataccagctttatttatttatttttttgagacggagtttcactcttgatgcccaggctggagtgcaatggtgcaatcttggctcaccacaacctctgcctcccgggttcaagcgattctcctgcctcagcctcctgagtagctaggattacaggcatgcgccaccacgcctggctaattttgtatttttagtagagatggggtttctccatgttggtcaggctggtctcaaactcccaaccttaggtgatccgcctgcctcggccttccaaaatgctgggattacaggcgtgagacatcgcacccggcctccagctttatttttaatagccaaaacctgctaactcaatgtccaccactagatgaacaaactggtacatgcatacaatagactactactcaacaataagcagaaagaaactactaacatgcaatagtacagacgaccttttttttttttttttgagataagagtctcactatgtcacccaggctggagtgcagtggcgtgttcttggttcactgcaacctcctcctcctgggttcaagtgattctcctgtctcagcccccccgagtagctgggattacaggagcgcgccaccgtgcctggctaatttttgtacttttagtagacacagggtctcaccatgttggccaggctggtctcgaactcctgacctcaggtgatccacccacctcagcctcccaaagtgctgggattacaggcgtgagccactgggcccagccagagataaggtcttgctgtgttgcccagggccttgaactcctgggctccagcgatcctcccacctcagctccccaagtagctgggactatgggtgcacgccatcacacctagccattttgtgaactgctgaccaatgctcctctctgcagacagaaagttcggtgtggttaggagttaaatgggaagaaagaggaggctgggtgcagtggctcatgcctgtaatccctcccaacactttgggaggccaaggcaagagtttcacttgagcccaggagtttgacaccagcctgggcaacagagcaagatcctatctccgaaaaattaaaaataagaaaagtaattagccggacatggtggtacacacctgtagccccaggtactcagcaagctgaggtgggatgatgggatgattgcttgagcccaagaattcgaggttacacagttacagtaagctatgatcgtgccactacactccaccctgagcaacagaggaagattctgtctccaaaaaagaaaaaaaaaaaaaagatgacaacggaacgggaggtgggtgtagtcccagctactaaggaggcagaatcatctgggctcaggagttcaaggtcagcctcagcaacataaggagaccctgtctcttaggaacaaaaggggagggggagagagaaggggagggagggggggagagagaaggggagggagggagggagagaggaagggttgggagagacagagaaagaaaaagaaaggaaaaaataaaaaggagagaaaggaaggaaagaagggaagacaggaggaggcagcggggaggggaaaaaaggagaggagggatgaagagaaagaaaggaaacgacaaagaaaggccaggcatggtggctcatgcctataatcccagcactgggaggccgaggcaggtggatcacctgaggtcatgagttcgagaccagcctggccaacatggtgctaccccatctctactaaaatacaaaacctagccggctgtggtggcaggtgcctgtagtcccagctacttgggaggctgagacaggaatagcttgaacccaggaggtggaggttgcaaggagccaagattgccccactgcactctaggctcggcaacagagcgagactccatctcaaaaaaaaaaaaaaaaaaagaaatgtattagaaataaaagtacatcagattctaatgccagttatgcagccaatgatgagatactctggtaaataaccctcttggtctcaatttcttcacccgtaaatagaatgagtactaaaaaaccaccagagccagagaaatccaaactaccagggaaagggaggggcccactgagaaccaccccagcaacccgaccacagctggtcttccctggacaccatgaaccacaatgtccaaacctcttcactcctgccaacatcggccatccccctaactatgagatgctcaaggaggagcaagaggtggctgtgctgggggcaccccacaaccctgctcccccaatgtccaccgtgatccccatccacagcgagaactccgtgcccgaccatgtcgtctggtccctgttcaacacccacttcatgaactcctgctgcctgggcttcatagcattggcctactccgtgaagtctagggacaagaagatggttggcgacctgatcagggcccaggcctatgcctttaccgccaagtgcctgaacatctgggccctgattgtgcgcatcattacgaccattctgctcagcatcatcccagtgttgatctttcaagtctatcaacagatcaggaggcattatctaggccaggagctctgcccgtgatctgattcccatgtactccatccaccctccattcctcgccctgcccccagagccaagttctctatcagccgtttatcctcacacacttttctacaatggcattcaataaactgcacgtgtttctggtttaaaaaaaaaaaaaaaacaccagagccattccaactccaaatgcgtttgactctacattgttgaacatctactatgtgccaagaacagaacataagaagaatttaggctgggtgtgctgcctcatggccttaatttcaatactttgggaggccaaggcaagaggagtacttgagggcagaagttcaaaaccagcccgggtaacagtgagactgtctctacaaaaatttttttaaattgtagggcgcagacactttgggaggcgaaggcgggcagatcacttgagctcaggagtttgagaccaacctgggcaacatggtaagaccctgtcactactaaaaatacaaaaaattaaccaggcatgatggcacacacatgtggtcccaagctactcaggaggctgaggcagaactgcttgaactcgggaggtggaggttagagtgagcagaaattgcaccacgcactgcagcctgggtgacaaagcgagacggtgtctcaaaaaaaaaaaaagaactgcagggtgtgatgttgcatgtgcctgtggtcccagctactcaggaggctgaggtgggaggatcacttgaacccaggagttaaaggctgcaataagccatgatcacaatactgtactccaacctgggcaatacagcaagatcccatctcaaaaaataaatacataaaaacagaaaatattaagactttagtatctcagtttttttgtttgtttgtttgtttgtttgagacggagtctcgctctgtcgcccagcaggctggagtgcagtggcaccatctccgctcactgcaagctctgcctcccgggttcacgccattctcctgcctcagcctcccaagtagctgggattacaggcgcccgccaccacgcctggctaattttttgtatttttagtagagacagggtttccccatgttaggcaggacggtctcgatctcctgacctcgtgatccacccgcctcggccttccaaagtgctgggattacaggcacgagccaccgcgcccggccagtatctcagtttttttttttgtttgttttttttttttttttggagacagagtctcgttctgtcgcccaggctggagtgcagtggcacaatcttggctcactgcaacctccacctcctgggttcaagcgattcccctgcctcagcctctcgagtagctgggactacagatgcgcaccaccatgcccagctaattttttctattttagtagagatgaggtttcacaatgttgcccaggttggtctcgatctcctgacctcgtgatccacccgcctcagcctcccaaagtgctgggattataggcgtgagccaccgcgcccagccaaggaagatattctttctcttttaataggtaaataaactaagcctgagagtggctgagtaacttgcccattcaaacatgtgaccaagcagttaagtgccaaccattcaagaaatagggatacaatcaatagtgaacaaaacaaagttcctgctttcatagagcttaaattttagttactgaagagtgaaccatggccaggcacggtagatcatgcctgtaatcccagcacgttgggaggcccaggtgggcggaccacctgaggtcaggagttcaagaccagcctgaacaacatggcgaaaaccccgtctctactaaaaatataaaaattagctgggcatggtggtgggtgcctgtaatcccaactattcaggaggctgaggcaggagaatcacttgaacacaggaggtggaggttgcagtgagccaagatcgcaccattgcactccagcctgggcaacacagcaagactccgactcaaaaaaaaaaaaaaaaaaaaaaaacagtgaaccatgattccagcttagactggagttgccagataaaatacaagatgctcagttaaatttcaactttagataaataacttttttctatgcaatttaatacacaattatactaaaaaactggtcaatgttcatcaaaaattcaaatttaactgagtgtcctgtatttctatttgccaaatctgacaaccctagcttagatataacctcaaaactctttctcaatccttttactgcgtttctctggctctaaagcagtaacttttttgactatatcaataaaaaattacttaaaaaaaaatttttggctaggcacggtggctcatccctgtaatcccagcatttctggacaccaaggtgggtggatcatctgagctccagagttcaagactagcctgaacaacatggcaaaacctcatctcttcaaaaaatacaaaaattagccaggcatggtagcgtgctcctgtactcccagctactcaggaggctgaggtgggaggatcgcttgagcccaggaaacagaggttgcagtgagccgagactgcaccactacattctagccttggtgacagagaccctgtctcaaaaaaaaaaaaaaaaaaaaaaaaaaaaaaaaaattcattgaactgttgctgctcgtggcagagcaggactagtccataggcaatgtgcccagagttggccaaaaattacattttgaattacaatgcggtatatatacattaactcaaaccaaagcttaaaacaattcttggcagctgggtgcagtggctcacacctgtaatcccagcactttgggagtcgaggtgggcagattacgaggtcaagagatcaagactatcctggccaacatggtgaaaccccatctctactaaaaatacaaaaattaggccgggcacaggggttcatgcctgtatccccagcactttgggaggccgaggcaagtggatcacctgaggtcaggagttcaagaccagcctgaccaacatggagaaaccccatctctactaaaactaaatacaaaattagccaggcatggtggagcatgtctgtaatcccagctactcaggaggctgaggtaggagaatcacttgaacccgggaggcagatcgggccattgcactccagcctcggcaactaagagcgaaactccatctcaaaaacaattatttcaataatgcaatgcatcctaacacttcttattctttttcatttttctaaaaatgcttgtcataatccactaatgtgtttcacaatctactaaggggtcatgatctgcagattgaaaaatacttctttgggagatataaaaaatcatttaacctggtgttatgagtcaccattatgagcacattaactaactacactgtgctataaaacagtaatgcccttagggcctaagatatacagctataaacttacagtcaaaactcccaggccgggagtggtggctcacgcctgtaatcccggcactttgggaggcctaggcaggtggatcatctgaggtcaggagttcaagaccggcctggccaatatggcaaaaccccatctctactaaaaatacaaaaattatccgggtgtggtggcgggcacccgtaatcccagctactcaggagtcagaggcaggaaaatcgctagaagctgggaggcagaggttgcagtgggccaagattgtaccattgcactccagcctgggcaacagaacaagattctatgtcaaaaaaaaaaagccaggtgcggtggctcacgcctgtggtcccggcactttgggaggctgaagcaggcggatcacctgaggtcaggagttcgagaccagcctggccaaaatggggaaaccccgtctctactaaaaatacaaaaattaacccggtgtgtgaccaatatctgtactcccagctactcaggagtcaggcaggagaactgcttgaacctgggaggcggaactacagtgagcagagatggcgccattgcactccagcctgggtgacaagagcaaaactccatctcaaaaaaaaaaaaaaaaaaaaaaaaaaaaacctcccagaatggtatacttgttgagctcttgtgtctgttttttagtagttcccattttagtagttcccaggctctttgctttgtttttttgagataaggtctcattttaacgcccaggctggagtgcagtggtgcaatcatggctcacctcgacatccagacttaagtgaaccacctgcctcagcctcccaagtagctgagactacagaagtgcacgaccatgactggctaaattttttgtattaatattttttgttgagatggggtttccctgtgttgcccaggctggacttgaactcctgggctcaggtaatctgcctgcttcagcctcccaaagtgttgggattacaggtgtgagccaccatgcccagccaccagtcttccaaactttttttttttttttgagacagagtctcactctgctctgtggcccaggctggggcacagtggcacaatctgagctcactgcaaccttcacctcccgggttcaagcgattctcctgcctcagcctcccaagtagctgggattacaggcgcccgcccagccccaagtctggttttttttttttttttttttttttagacggagtctccctctgtcgtcagtgcagtggcccgatctcggctcactgcaacctctgcctcccgggttcaagcaattctcctgcctcagcctcccgagtagctgggactacaggcacacatcaccacgcccatttaatttttttgtatttttagtagagatggggtttcaccctgttggccagaatggtctcaatctcttgaccttgtaatccgccctcctcaacctcccaaagtgctgggattacaggggtgagccaccacgcccggccctttttctgtttttcagtagagacagggtttcaccatgttggccagactggtctcgaactcctgacctcaagtgatccaccctccttggcctcccaaagtgctgggattacaagcgtgagccaccgcacccagctaagtctttcaactttctatcacgctactgttatttctcattgctgttaatatatctgcctctgaaaacattgcttttctacttgctgccaatatgtacatcagaaaagaaagctagatagaatcatgtgtaaagtaaaagttctcaaagaggccataaagaactctccagaccagaggctaaagcaggaggacagtttaagcccagaagttggaggccagcctgggcaacataacaagacccccatttctaccaaaaaaaaaaaaaaaaaaaagaactcccctttctaaaatctgctcaagcttcagtgaaaagacatttagtcttcaattcctgatttcgaaatgtgtttcaggaatgaaaatagttaactgcacaaagtccacagcaaatgtttataaacccgaaaagaaaaatgcagtacttgtttcaaaacccgccctttataaaaaactaaaattataatcaagattaattccacttagaaaaattattaagaatattttaacatgactttaaaaagcaatatgaaaaacgtcaatgaaaaatatttgacctggccagccacggtgcctcacacatgtaattaaagcactttgggaaaactaggtgggtggatcatttgaatttaagagtttgagaccagcctgggcaacatggctaaaccctgtctctacaaaatatacaaaagccaggcatggtggcatacacctgtagttccagctactcgggagactgaggtaggaggactgcttgagcccaggatgttgaggctgcagtgagccatgaccataccactatactccaacctggccaacagggtaagactcagtctcaaaaaaaaggaaatttaaaaaaaaactgatcattggcaacactgttcaataaagcctctcaaggcaatggtttcaggagaccaacattctaaagttctgatacagttaataaaaataaaccacgttcacttatattgccgacaagcctcataccacaactaatgagttttacaaagacttcattatagaatgaaattttattacattcccaaaatgtagttagctattaatcatggcacgaaactgacattttcgggctggacacagtggctcacacctgtaacaccagcatgttaggaggcctaagtggggtggatcactcgaggccatgagttcaagatcaacatggcaaaactccacatctactgaaaatacaaaaaaactaggcaggcactgtggggcgcaccagtagttccaactacttgggaggctgaggtgggaggatggcttgaacccgggagacagaggttgcagtgagccgtatttgcaacactgcactccagccttagcaacagagccagatcctatcacaaaaataaataaataaataaataaataaataaataaaacaaattgacattgtaaagtcacttgacacaacttcagggttaaaattacaagcaatctatgtaagaatctttaaatgttaatgagaatttcaaattttcacatgaatgcaaacacaaataattaccagcaaataaaaagttaaggttgccaggcatgggaggccaaggcaggtggatcacttgaggccagaagttccagaccagcctggccaatatggtgaaaccccatctctactaaaatacaaaaattagccaggcgagatggtgcgtgcctgcagtcccagctactcaggaggctgaggcagaaaaatcgctttaacctgggaggcagaggttgcaatgagccgagatcgcaccactgcactccagcctaggtgacagagcgagactccgtctcggaaaaaaaagaaaaaaaaaaagttaaggttaacagctgtgacaagttttcataaacaacccagactcataaaaaaaataccaaaccaggccggacgcggtggctcatgcctataatcccagcactttgggaagccgaggcgggcagatcaagaggtcgggagattgagacaatcctggctaacacagtgaaaccccatctctacttaaaatgcataaaaaaaattagccgggcatggtggcgggcgcatgtagtcccagctactcgggaggctgaggcaggagaatggcatgaacctgggaggtggagcttgcagtgagctgagattgtgtcaccgcactctagcctgggcgacagagcgagatttctcaaaaaaaaaaaaaaaaaaaaaaaaaaaaaaaaactaaaccaaactggtcacggtggctcacacctgtaatcccagcactttgggaggacgaggcgggtggatcatctaaggtcaggagttcgagaccagcctggccaacatgatgaaaccccatctctactaaaaatacaaaaattagccaggcatggtggcacacagctgttatcccagctactcaggaggctgaggcaggacaatcacttgaacctaggaggcggaggttgcagtaagccgagatcacatcactgcattccagcctgggtgacagggtaagatcctgcaacacacacacacaaacaataataataatttaaaaaaccagccaggcatagtggctcacacctgtaatcccagcaccttgggaggccaaggagggcaaattgtttgaggtcaggaattcaaggccatcctgggcaacaggtaaaatctctgtccctacaaaataaaaacaaacaaaaaagctaggcgcagtggcttatgcctgtaattccagcacttcaggaggccaaggtatatggatcacctgaggtcgggagttcgagaccagcctggccaacatgataaaaccccatctctaccaataatacaaaaattagccaggtgtagtggcgcatgcctataatcccagctactcgggaggctgaggcatgagaatcatttgaacgcaagaggcagaggttgcactgagccgatatcctgccactgcaccccaccctaggcaacagagtgaaacaaaaattttgctgggcatagtggcgcatgcctgtggtcccagctactcaggaggctgagataggaggatcacttgggcctgagaactcgaggttgcaatgagccatgatggcaccactgcactcccgcctgggtgacagagctagaacctgtctcaaaaaaataaggcgaggcgcagtggctcatgctgtaatcccaaaactttgggaggccaagacaggcagatcacctaaggtcaggagttcaagacgagcctggccaacatggtgaaaccccatctctactaaaaaaaaatacaaaaatttgccaggtgtagtggtgcatgcctgtaatcccagctactcaggaggctgaggcaggagaatcactggaacctgggaagtggaggttacagtgagccgagattatgccactgctttccagactgggtgacagagtgagactctgtctcaaaataaataaataaccaaggatttaacatttatgtagatttcacaccacgtaagtacagaaccacatacattaaaaacaaagaaaagaaaatagacctcctattttagcaagccaaaatcaaggttacaaaaagatatcctgaagggcaagtactgtccgtgactgtattccataaaacaagcctgttagggggccggacgcagcagctcacgcctgtaattccagcactttgggaggctgttgggcggatcacaaggtcaggagatcgacaccatcctggccaacatggtgaaaccccgtctctactaaaaatacaaaaattagctgggcatcacagtgtgcgcctgtagtaccaactacatgggaggctaaggcaggagaatcgcttgaacccgggaggcagaggttgcagtgagctgagatcgtgccactgcactccagcctggtgacagagcgagactccatctaattaaaaaaaaaaaaacaggcctgttaggaaccagactgcacaacaggagctgtgtgagcattagcacctgagccccacctgttagatcaggtgcagcattaggttcttatagaagcacaaaccctactgggaactgcatatagcaagagatgtaggttgtatgctctttatgagaatctaacaaatgcataatgatctgaggtggaacaatttttttttttttagacggagtctcactttgtcccccaggctgaagtacagtggtgctatctcagctcactgcaagctctgcctcccgggtttcatgccattctcttgcctcggcctccggagtagctgtgactacaggcgccctccaccgcgcccagctaatttttttgtatttttagtagaggggggtttcaccatgttagccaggatggtctcgatctcctgacctcgtgatctgcccgcctcggcctcccaaagtgctgggattacaggcgtgagccaccgtgcccggccggtggaacagtttcatctcaaaatcatcccctgcccctatggaaaaaccatcttccacaaaaccggtccctagtgttaaaaaggttgaggaccattgccttaaaatacacagcatgatcttgtgtatatattacgtttctatttatttcaagggaggggccccagaacttaaaatttaaaaataaaaataaagggagggggctcggtgcagtggctcacacctgtaatctcagcactttgggaagctgaggcaggaggatcacttgagcccaggagtttgagaccaatctgggcaacatggcaggaccctgtctctacaaaaaatttaaatgttagccagctggtgtacacctgtagttccagctactcaggaggctaagacaggagaaatgcttggccccatagattgaggctgcactccagcctgggtgacagagggagaccttgactctaaaaaaataaataaagggagaggtgtaataaaatcctacaaatattgctttgggcaagtcccctaatctctcaaagcttagagtttttgccttccatttttaagatttaggattttttgttgttgttgttgttgttactgttttttaagagacagggtaggctgcgcacggtggctcatgcctataatcccagcactttgggaggccaaggcaggtggatcgcttaaggtcaggagttcgagatgagcctaaccaacatggtgaaaccctgtctctgctaaaaatacaaaaattagctgagtggggtagcaggcacctgtaatctcagctactcagaaggctgaggcaggagaatcgcttgaacccgggaaacagaggttgcagtgagctgagattgcaccactgcactccagcctgggaaagagcaaaactgtctcaaaaaaaaaaaaaacaccttagctcatgaggctgggcgggggtggctcacgcctgtaatcccagcactttgggaggccgaggcaagcgaatcacctgaggtcaggagttcaagagcagcctggccaacatggtgaaactccatatctactaaaaatgcaaaacttagccaggcatggtggcgggtgcctgtaatcccagctattcgggagggctaaggcaggagaattgcttgaacctgggaggcggaggttgcagtgagccaagatcacgccactgcactccagcctgggcgacagagactctgtctcaaaaacaaacaaaaaaacccttagatggtaacagtaacatcatagatgacccagatatcctttggaaaaaaacaaaaaaaacacaagtactttcatttaaaaagatacggcagcggccaagcacggtggctcatgcctgtaatcccagaactttgggaggctgaggcaggtggatcacctgaggtcaggagtttgagaccattctagccaacatggtgaaaccctgtctctactaaaaatacaaaaattagccaggcgtggtggtgtgcgcatgtagacccagctactcaggaggctgaggcaggagaatcacttgaacccgggaggcaaaggttgcagtaagcagagatcgtgccactgcactccagcctgggcgacagagcaagactccgtctcaaaaaaaaaaaaaaaaaaaaaagataataggtgtgactgttaataaactgtttacatctccgttgaagttgtcacaatcacttgaaatagctaaaaaaaaaaatagggttttgttcatgctcaactatttacacaacatcaaaatactatcactagtcaaaacagaaaattgtaattctagagaacaatcttctaaaaccttaaaattcgtttcaaagtaaaaaaacaatactttgctaaggtgacagttctaacacggctgtagctatttaggacaaaaaaatgagatcctcctttttttgtttgtttgtttgttttgagacagagtctcgctctgttgcccaggctggagtgtaatggcatgatctcagctcactgcaacctccgcactcattgcaacctccgggatcaagcaattctcttccctcagcctcccaagaagctgggattacaggcgcccaccaccatgcccggctaatttttgtatttttagtagagatgggggtttcaccatgttggccagactagtctcaaactcctgaccccaggtgatccacccgcctcagcctcctaaagtgctgggattacaggtatgagccaccgcgcctggccttgagatcctcctttaagtcaaaatatatggctattaaatagctacaatatgagttaacatcccttatgtagaagtataaaccattgctaattagagtaacactgaaaatacaagtttacatttaaccaaaaaaaggaacaccatgactgatcccatgttttcactgtttcagaatgtggaatctttaagcaactacaggcttacatttttctcttaaaaaaaaaaaaagaaaaagaaaaagaaaaccaaagcaagttttggcccaaacttaaaaagtttattttctccacatacttgaaacaaaaactaaactaattaggtaaaatacgtaagcccaaaagaaaaacaaaacatgtctctttggttagtaatagccatctacaatttacctctaatgaccctcaatgtcaattaacttttttggtctaacttcagagatggttagtatcaatgtgcacataaaagaataacaaaggatgatgccatttaaaccttataaattactaatgaagccacatgactaattaacctagataaaaagcaaacggctaaatacccaaccttcaaatctttgctcaaatgttagctcctcaattaagttcccccaatccatttaaaattgtaactcattcccctccccacactccctatacctttaatctgctttcttctaattccatagctcttatacactattatacataggctggtaatttaatgtctcattgtctgcctagtcacattagaatgtaaactccaaaaggacaatatgtttgctttattcactgattcatcccaaaaaccccatgtacatagatgcttcaataaagctgtattcaacgtagatattttaggcccttctacaagatatttaactgcaaaagatgaacagtctcactgaaatttaaatggaagcatgatgaacaactacattaaatcacagcacattttttttttttttgagatagagtctcactctgtctcccaggctggagtgcagtggcacaatctcagctgactgcaacctccgcctcctgggctcaagtgatgctcctgcctcagcctcccaagtagctgggattacaggcgcctggctaaacagcacaatttttaagttgcaatgcctcaagagaaagaagcagtaaaaatactaagctgaaaatcactaaaagaaaaatattttattcagactgaatcctgtatcccaagcaattctaatgtcatattatttaggtttaggaatagagtaacaattgtaaatccatatttttatttttaatggggaagggaatgtagaagaagaagagtcaaccagcgaaaattcccaatagtgccatgaaattacaaaaaagttaccaaaaataacttggtcataggctagcagctaataaaaaacactttcagatgaaaaagaaaggttaacaacaacaacaaagctttagaacagttcctcaggaatttcattcctgcactttactcagtactatcagcacgacagataaaccaagtaccctcattaataataatggttacaggtttcaaaacatcttcacatatattaccttattaaatcctcagaggaaccaaattaaactcaaatatcaataatccagtaactaacaaaagcacttaataatatatgcacttgacagtaaaaatgcaatttttcctttaaaaattccccacaatatttgacaaactacaaagaaaccattccatggaagagcaaccttcttgacactggaagtaatacaagtcttctaaagaataatagagcaccgctagcaagagccataaaaatcctgaagccctctgaactagtaaaaccactcttggtaactttctctaaggaaataattacactgaagcaaaaagctatttaaaaatgttcactgcaccactatctataacaaaaaagtggaaacccaattcccaacaatagaatggttaagtaaaaaccttacagccgggcgcagtggctcacgcctgcaatcccagcactttgggaggccgaggcgggcgcatcacctgaggtcggtagtacgagaccaaactggccaacatggtgaaaccttgtctctaccaaaaatacaaaaattagccaagcgtggtggaacattcctgtagccccagctactcaagaggctgaggtgggagaatcgcttgaacccaggagtcagaggctgcagtgagctgagatcgtaccactgcacttcagactgggcaaacaccgagactctgtctcaaaaaaaaaaaaaaaaatttacatttacaatacaacgttcaggggaaaaaagctaactacaaaataacatacacaatcacctctactacataaaaatgaaaaggtaaaaagcaaaaataagaattagactgatggttgggggcagtggctcattcctgcctgtaatcctggcactttgggaggccgaggctggcgaatcacttgaggtcaggaggagttcgagaccagcctggccaacatggtgaaaccccatctctactaaaaatacaaaaattggccaggggcagtagctcacgcctgtaatcccagcactttgggaggccaaggcaggcggatcacttgaggtcaggagttcgagaccagcctggccaacatggcaaaatcccgtcctcactaaaaatacaaaaaaattagccaggtgtggtagcacgaacctgtaatcccagctactggggaggctgaggctggagaatcacttaaatgaacccaggagacagagactgcagtaagctgagatcaggccactgcactccagcctgggcgacagagtgagattccatccaaaacacacacacacacacacacacacacacacacacacacacaaaattagattacagtaaaattatgttctaatattgtgattacattatctttcctaaaacagccaccttcaaaaatatatataacaaagaacaaaataaatcacttctgaaagtcatgaaaaactattcacacacacacacacaaagtcaaattatgaaatgtttcttaaagcagatgtgaatttccagactttcaagcatattttgctatctcgaaacttgtcaaaccgaatgctgcattttttttcacccttgctctcagagacttattttcactgttgatacgcacaaacctaagtgaggagattctagaagctgaaacttatttacaaggaatgcaggaaagtgattcaaattcaaagtaattctacaagtacattaacgatctgttcaagaataaaacttcacattacacaaatccaacacagtaaacaaaatttcacctattcatcagaaagaataagggctgccatttaggtctcaagtaaaagaacttaaagcaaggaaaaatctaaattaaccttaaattgttgtaaagcctcaaggaacagaaaaaagaccttgtggtactaaaacattccaaatatctttgatcactcaaactactcaggagcaaattctcttataatctaatttttaagcctagtagtcaatgcaacttaataaccttagttttaatgtttatatatttgaacatgttgaattatctgccaaatctcttcctaatacctaagaaagtaaaaacagaatacatccttttctataaaagttgtattttaaattttttcatttttcgctagatgccaacgaaaaagggaaactgaagttaccctacttggggaaacgatcacttcatctgaactagtttggctaagtagtgtttgggatgcttcagactcagagaaggggaagggggggcggggcgtgtaaagtcaaataaccgactgtttccgccccctttgaaggcagcagaattccttaaaaaccagctgattcctcttgatggggaatttctgctgtaaataaaaattctttggaaatgggttgctgaaaatgtgttttcaaaaagaaaactcgggtgaatgaaaaatcctcttattccaccttccaaagcccaagatgcctatttaaggaggacgccggtcacccgccgtcaagccggcggcctaggcctaaagaaggcacagtagtgcctacaacacggatggacttgaggcacaagggaaatggacttgcgtgcccttggtaagctctggcggcactcccgaagttaaggacaccggccacaatggaatggagtctattgacgtttccttctccctttgaacactaagcattttcttagttcgtgaaatacgaactgacaaccgcccgccacccccaacaggccctcctgcacaaacacaccctcgagtcaaacccagttagccgggacaacactgagcccccagcccctactacaaccccggcttaggagggaaaaagacgctagtaaacacccgcctttctgccttcaggaacccgaccacgtcccctgctgcaatctctctctcctagcatttccgaaattggggcgggggttgggataagtgcgcagggtgcccgccccctgccaccagcaccgccaccccggatctccagggtccagcctgggtccagccctcacccaccgatgttccacaggcgccttctccactgcggcctcgaacagcaatgcggatcggccaccacccgcgcgccggagaggtctggcgggggaaggaggaaggccgggacggggccgggcactccccaccccttcccttccccaggtgggggagggtggaacgctgccggaggccacatggagccccacgatttcaggggagttcgggagcccccgccgccgcctcggacacgaacgcagaggggtgcgggggccaaggcccacttgtctccaccccgtcctccgatctttcccaggactcggagggggcggggagagagccccgacagaccctgatgattccggaggagcccggtgcctacccctttaaccggcacgggggacgcggccctaacttctcccctccagagatgtcccccatggagggggacatgttccggaaaacgccaccacagcctccagacccctccaacgttcacacctaaaccgggagtggaggagctgcccgagcatccccacgctgcgggcggaggatcgtgcggaagggggagccggggctgaccatcgccgctacccgagaacccctcccaacacgcgtggggaggggaggccgcccgctccctccatcttgaccgccgggggagggggcggggatgctgcgggaggctggacaggcctgacaatcccagaggaccccggctgcgcccaccggccgagcctcggggctcaggcccgagcgagtctcccccgcgctgccggcccccagcccaccccgggtagcccggcgggtcacggggcggggacggcggcgcgggccgcgggggaggggacgccgggcccggagcggagggggctggggtgccgacacccacctgcccaggccgggcctcccgccgccggaggtcgccgcgaccaccgaggagggagccgtggccgaggacgaggagaccgaggacgaggacggcgaaggcgcggcggcgggcgacgctagaaggccgctgccgccgggcttgcggacattggcagccgcgggcggcggctgctgctgctgctgctgctgctgctgttgctgctgctgctgctgctgctgctgctgctgctgctgctggggcttcagcgacatggtgaggggcccatacaccggctcgcacgccgggcggggacagccgggagccgggcgcgccaaggagacgccggaacgcggcggggacgcgcgggcgccgagcggggaggcgcgggttggcgcggccggaggggcgcccgggctggcgagggggagaaggaggacgacgaaggggcggggaggcccgccgagaccaaggagccgccgggagccgggccgaaacgcgccgccgccgttgccgttgctaccaaaacagtctgaggcggagggaggcgagctctgccgggagggaggggggccggggccgggcgggggaggggcggcggagggatacggtcccggggccgcgccaccgccgccccgcccgctccgccgcgccggccgctggagcgagcgccacccgggccacctggctgcggcgaagcggcgagactcggtggccaccgcgggactccgaggagctgcggccgctgagcgcatcggagggcgggcgcgccgaggcgccgggtgggagcggaggtgcggatagggactctttaccggaagtcggaggggtcagacggaagcagaacgtgaggtggccccggggccgggagggacacgtgaggagcgggcggcgcgctgggttgctttctcgggggt

SEQ ID NO: 2665 - DNA, 2453 bp, Homo sapiens
ataatgatagaaactaaatgttacaatttattccatcttcaggattacagacattacagggcaggatgagtaaacaaggcaaatgaagcgagcaccttcagcttcccccctaccccgacatttaaccagatgcagcattttgacatttttaggatatgcaggttgacaattcactgacttgggttgagagctggcaatagcagatctttgcaatttaggttcttcctccacagctattccaagtatcttaattcctgaactgcacactgagagctctgaaatggtgttcactgcaacattcttgcagctttcacatcttaatctgacacctcttgtgaaggcagggaactgtgttaaaagctgtcttcctctttgctaatccaggccaccatcaatcttaaccattagttactatataaaaataaaagtgtgctcaaaagcactcactgaaactgttgtgcccagatcccttttcagagcattagttccctgagaggaaaaaaagaggtcctaaccaattgctttcataaatagtgaccccagtacagtgtatatgtcttttgcagcagaaatcaagaggtcaggcagctctgctcatcctgactagtttatcatcgtttgcatacaaggtatatttatgtaaagctgattccacgccaagtattgcaaccataatctcaaaaaaattgttcaattttagcacacagttcctgcaagataccacagcaggtgagaaatcatctcaaagagttcatcttttacaactgagaggaaaacatcgaaggaggaaataaaactcctctctcctaagttcctcatcaaatctgatggctatgttcacagagttagttgacaaaaatccagagtcctcaatttctggacttgcgaaatccttcaaggtgactgtcaaggtcaagaagaattttcaggcttttctttgccatggcccatgaactccagtccttcaataggaatctctttctcctttattgctttctggtaggaggagaaaacacattataaagacctacatgaagcttaagttgcaagctttgtaaataaaatatgacagtacaaaagtaaaatcaagctgattataaagacttataaccatgattcaaaccacatactttttaaaaaacaagtaccggtcaggtgtggtggctcacgcctataatcgcagcattttgggagaccaaggcaggtggatcacttgaggccagaagttagagaccaacctggccaacatggcgagaccctgtttatactaaaaatacaaaaattagctgggcatggtggcgcatgcctgtaagcccagctactcgggtggctgaggcatgagaatagcttgaacctgggaggcggaggttgcagtgagctgagattgtgccattgcactccaggctgggagacagagtgagactctgcctcaaaaataaataaaaaccagaagtaccataatgaataaatcaagtgtaagacctgagggagactggaaaaggagttgtgagggaaccgttaaaattaagtgaaatttgaaaaataatcatcactttgtgttagtgaaagacttaggttcaaatctgggttccaggacttactggctatgtgactaactgtaaatgggatgaagacagcaactacctcggggaattgctgtgaggatgtgttgggttaacttattggaagtgctttgcccggtgctgttcttaacaattcaaagcagttccacatccattgggccagaataaacatttcctggctgcagttgcggggactggtcaagagagagaaacaggctaacgaagggtttataacaacaaaaaaatgtgaccctccagtctgaattctgaagtataatcccgcccagaccccagcagtaatagtggaaaagtgcaccacctgcgaaagaaccaaggaaacctgatgctagtgaactcggattaatcacttcctatttctgggtgttagttttttatgtataaaatatgagtaactatgcccaccttgcgagtttagggtgaacaccaaatgaaccaaaggatgtgactgtgcttcttgaaaagcactgccccaatatttgtcattcggagagacacccaagtggcctcggtggtgatggtaggggagcgagctcctgccactggcctcactgcgacttttctccacccttccagtccagtcccaatccccgtaaaatacgatgagtgtggtgggacacagcgccgagaatgcagggcctgggaacagaggcgggagggctcacctgaacacactgctggtagcgcttgaagaggtcggtgcacgggtccccggagctgtcccccttgagaaatttctcggcgaaccagcgattgaagcactggtcgtactcgcgcttcatgtccgtgcatgcctcccccacactgttcatggcgacagtggtggcggcggcgacgacggcgcactctgat

SEQ ID NO: 2666 - DNA, 17317 bp, Homo sapiens
cggcgttacgcgcgggcgcactgcgggggccaaggaaggaagaaatgtggtcgcggttggtgtggctgggccttcgggcccctctgggcgggcgccagggcttcacctccaaggcggatcctcaggtaaaggccagggccatctaggcgggtggcggagcaagccgggaggcacttcggagcgccggtgacccacactccccgcctcatccctcctccagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacaggtaaactcgcggctgcagccccgaagccttgaccgtggcccgttcgcagccgtttaatgtgacgattagcgaacagttttccagggggttaaagagtgttagcaagattcaggaacttgcccacagtcacctcgcgagtcagtggcttcactcttccccttgttcattactgatgctctcgctagtgtaagtggaaacaaaacccgaactgctaatcactgcctttgtttttttttttgtttgtttgttttgtttttttttttttgagacggagtctcgctgtgttgcctaggctggagtgcagtggctcgatctcggctcactgcaacctccgcctcccgtgttcaagcaattctctgcctcagcctcccgagtagctgggattacaggcgactgccaccaggcccggcttattttttttgtatttttagtagagacgtggtttcaccatcttggccaggttggtcttgaactcctgaccgtgatccacccgcctcggcctcccaaagtgctgggattacaggtgtgagccaccgcgcctggcctaatcatcgcctttaaggccctactccatagagtccctacctactcactccaacgtactcttctcagtactctccttggctaccttgactgcttctccagcaagacaagttcttttcctctctagatctctgcactggcccttcgtttttttccttcctctcagtatttgcatggctgcctccctcttggcacaggtctcagcttatcttctcagaaagggctctcctaaccactccaaatcccttctccccttctagttagtaactcatcctattgggttttttccctaacattttaatggacttttgttcatttgttatatctcttttattaaaatgtgagctcattatgtagttactgttttattcctgccttgaatttttattttatttgtttttgagatggagtctcactctatcacccaggttagagtgcagtggcatgatctcagctcattgtaatgtccacctcccagactcaagagagcctcccatctcagcctcccaagtacaggaccacaggcgcgtgccacttggcctggctaattttttgtatttttgatagagacgggattttgccatgttccccaggcttgtctggactcctgagcaaaggtgatccacccatctcagcctcctaaagtactgggattacaggcatgagccacagcacctggccgtgtttgattctttcaaatgtcttctctactttgcaattttctttttcctttgggacggggtctcactatgttgcccaggctggtcgcaaacttctagactcaagagatcctcctgcctcagcctcccaaatagctgggactataggtgtgcaccaccacacctggctaatacttaaaatttttgtagaaacggggtcttgccatgttgccccatatggtctcaaactcctggtctcaagcaatcctcctgcctcagcctcccacttcctcaagaaagtttttttttttttttgaggtggagtcctgccccatcacccaggctggagtgcagtggcatgatcttggctcactgcaacctccaccctccaggttcaagtgatttttgtgcctcagcctccggagtagctgggattacaggcacccgccaccacactcagctagtttttgcatttttagtagagacagggtttcaccatgttgaccaggctggtctcgaacccctggcctcaagtgatccgcccatcttcgcctcccaaagtgctgggattacaggtatgagtcactgcactggccaaaaaagtccattcctttttttttttttttttttttgagacggagtttcactcttccacccaggctggagtacagtggtgcaatctcagctcactgcaacctccaccttccggtttcaagtgattctcttgcctcagcctcccgagtagctgggactacaggcgcccgccaccacgcccagctaatttttgtatttttaatagagacggggtttcaccatgttggccaggctggtctcgaactcatgacctcacagtccacccgcctcggcctcccaaagtgctgggattataggcgtgagccacaagtcttcattcttttatacttaggttctttttttttttttttaattgagacaagagtctcgctctgtcgctgaggctggagtgcagtggcgtgatcttggctcactgcaagttccgcctcctgggttcatgccattctcctgcctcagcctcccaagtagctgggtctacaagtgcccactaccacgcctggctaattttttgtatttttagtagagatgaggtttcaccgtagccaagatggtctcgatctcctgacctcgtgatctgcccacctcagcctcccaaaggtgctgattacaggcgtgagccactgtgcctggctatacttaggttctctacctgtggctctcgtgatatccaaaagggctgatttatacatgcgtttatacatctatttaagggatgtgttgagtctctgcccctctcctgctcacccaccttccacagcatgtctgtttttccttatcatgttctcagtggttggcactgagtattcagtaaatgtgttttgttttgttttgttttgtttttttgagatggagtctcactctgttgcccacgctggaggcagtggcgtgatctcggctcactgcaacctctgcctcctgggtttgagattctcttgcctcagcttcccgagcacccgggattacaggcatgcaccaccatgcctggttaatttttgtatttttagtagagaggggtttcaccatgttggcaaggctcgtcttgaactcctgacctcaggtgatctgcctgcctcagcctcccaaagtgctgggaatacagccttgagctgccgtgcccggccacagtaaatgtttaatgaatttttttttttttagagacagagttttgctcacgttgcccaggctggagtgcaatggcgcgatctcagctcaccacaacctctgcctcccaggttcaagcgattctcctgcctcagcctcccaagtagctgggattacaggtgcacgccaccacgcccagctaattttgtatttttagtagagacagggtttctccatgttggtcaggctggtctcaaactcccgacctcaggtgatctgcccaccttggcctcccaaagtgctgggattacaggcatgagccaccatgcccggtcccagtgttctttattaatatctctaggaaaggagggactagaagcacagagtcatcagaatttccccaagttatctagagggtaaatacaaagaaatataaccatcattaataagggaaaaggtcgtgaaaaaagatgaggaatttggatccagtagctagcatctcaacctcgtattcagtgatctgtactgtttttcataaatttggaaaccagtttgggttaataattcccattaatcattttaatgtgacatctgtaggactttaatgctttgaacacacagaatgtaaagtgaagacaagtattaaaccttttattttttatttttttgtagtttttataacttcatttgatgtatttgatgatcagcagttagttcccatccacactgactgtagatttgtgaaagtggtaacaagtatataaccaaagtatagagcttatttggtgaatttctaacctcattatgttttctggaccatccactgcacatggacacagtatggacattccttactactttggcccagacagctttgttgagcctggtatcaatacacatatctggagttttctatctccttcattgcaaatttccggtctctttaagagcctgaggggcacacttcttgaagcccactccatggatacacttgtgaatattaatggtgtactcttgggtcaccacctagttgatggcataatggccattcttctcaccatccttctttgcaggaggccaagttgcttaaatgttttaggtagtaggcatcttagctataaaagccctgacttggccgggcataatggctcactcctgtaatcccagcattttgggaggccgaggcaggcagatcactttaggtcaggagttcgagaccagcctggccaacatggcgaaaccctgtttctacttaaaaaatacaaaaatttgccgggcatggtggtgcatgcctgtaatcccggctactctgaaggctgaggcaggagaattgcttgaaatcaggaggcggaggttgcagtgagctgagatcacgccactgcactccagcctgggcgacagagcaagactccatctcaaaaaaaaaaaaaaaaaggtagactgggcgcggtggctcacacctgtaattccagcactttgggaagctgaggtgggtggatcatggggtcaggagttgaagaccagcctggccaagatggtgaaaccccatctgtactaaaaatacaaaattagccaggcaaggtggcaggcgcctgtaatcccagctactcgggaggctgaagcaggagaatcggttgaaccaggacggcagaggttgcagtcagccaagatggagccactgcactccagcctgggcgacagagtgagactccgtcttaaaaaatacaaaacaaggctgggcgtggtgtttcacgcctgtaatcccagcactttgggaggctgaggcaggtggatcacctgaggccaggagttcgagaccagcctgaccaatatggtgaaactccttctctactaaaaatacaaaaattagccgggcatggtggcgcactcctgtagtcctagctgttcgggaggctgagacagaagaattgcttgaacctggggagcagaggttgcagtgagccgagatcacgtcactgcactccagcctgggcaacagagcaagactccatctcaaaaaaacaaacaaacaaacaaaaaacgccttgactggctaatagaaacccctttgcacactaataacatgtcatttggtttgaggtaaaaacagtatgcttacatgccaggggctaataaattatataaattcttttttttttttttttttttgagctggagtctcactctgtcgtccaggctggatgcagtggcacgatctcagctcactgcaacctctgcctcccaggttgaagcaattctcctgtctcagcctcccaagtagctgggactacaggtgcccggcaccatgcccagctaatttttgtatttttagtagagacggggtttcaccatattggtcaggctgctcttgaactcctgacctcaggtcatccgcctgccctggcctcccaaagtgctgggattgcaggcatgagccaccgtgcccggcctaaattatttcaattttcacatgcagtcctggaaggtcaatacaagttatctattttatatagatggaaaaaactgaggttcagaaaggttatataatgtgcccaaagtttcacaggtaataagcagagaatttggaactcagagcttctgctgccaaatactgttctaagatatgccagctaaagtcgattcctaggaactttactctctttcatctgaaatccagagaatgagttgacagcaactctgcagccaaatacttaaatgtccctcatagtcttatgaaccaaaaacttcaaactcttaggctcaagccatcctcctgtctcagcctctcaagtagctgggactacaggtgtgtacccctatggccagctaatttttttctttgttactttttttttggtggagacaggatcttgctgtgttgcccaagctggtctcgaactcctgggctcaagtgatcctcctgcctcggcctcccaaagtgctggcattataggcatgagccatcatgcctggcctgaatccagaactttttttttctcattctgttgcccaggctgcagtgcagtggcgcaatcttggctcactgcagactccacctcctgaactcaagtgatcctcccacctcagcctcccgagtagctgagactataggcacacgccaccacccctggctaacttttgtattttttaggggagatggggtctcaccatgtttcccaggctggtcttgaactcctgggctcaaacaattcacccccttcggcctcctgaagtgttgggaatatagatgtgagccaccttgcctggctcagaacttttaaccaagttaattagcccccattccagtctgcatcaaactagaaataaagtaggaggaagggagaaggcttttagatggaagtagaggggtccacaagaagctattccttccagccagatagcagaaaagaagctcaaagaaagaaaagcagtgggagaacggtcccatcagtgagtccaagggctgacagaatcacaaatggagccactttgtcctccctgttgccacagcactttccaatgccaccgtagcagcatttctcacagttacttaagttattgttcctgagttttaaccagcagggacttctagtttacaactgaagtctttctcaaccagggttcctcagccaaaccagaacacagaaagattcaagtgactttttttcagttctcccaaggacagtatatgacaaatgttagcttaaacacacaggagataagttaacttatcatcagaatgggtgtcttggggtatgtaggctaacttatcttacagaaccctgattgggaaagacaggtggtgaggtagaagtttagtcaatcattaattgatctgaaaagctcatctggtcctgttcagtgttttatataattctgaggtccaagaaagtgaagcaactcaccaagtgagaggtatgcttgctgtaccactgtcacagagaccgtgggttcaggagcctgtaattaataaagctaggtatggtggtgcacacctgtaatcccagctgcttgggaagctaaggtgggaggatcacttgagcccagaagtttgagaccagcctaggcaacacagcaagaccctgtctcaaaaaaaaaaagtaaaacaacaacaacaacaacaacaacaaaaaaccaaccccagaaaatgtgtctattttaggaacaactccatcataaccaataactaaatagaaatgtatgtatgtatgtacatacatacataaatagaaaggtatgtaaaggggtgaattttgttttcctggaaatttcacttacgcaggaaacttaattatgaaacttgattacttgatgagtaaatagattagttgctattagatctactcttggggaagcagtagcatttaaccgcctattggcggtagtagagagtcttcccaaaccttcagatgctaggcaggttgtgcctcatcaggagtgcacagactttgaatgagtggtagggactgagatgtactggggtgcactaaggctttctgaaaggagcaggtgctactcagagccctcttactgccgtgaatgctggctcagcattatcagatcttgtttttttaacatttcatttaatcttcccagaaatcctatgaagcattcaacaaacaaggaaactgaaatatagagaggataagtaatgtgtagcaatgggatctgaattcagctgtgacttgagagcctaagctcttagcctttttgagacggagtcttgctctgtcgcccaggctggagtgcagtagcatgatatccgctcactgcaagctccacctccagggttcacgccgttcccctcctcagcctctcgctacaggcccccgccaccacgcctggctaatttttttttttttgtatttttagtagagacggggtttcaccctgtcagccaggatggtcttgatctcctgacctcgtgatctgcccgcctcagtctcccaaagtgctgggatcacaggcatgaggcaccgcgcccggcctcttagccattttttaatactgtccaacagaaactataaactccagaaagtccaagggttacctttgaatagtataattatgatttttattttacttttgttctcccaagttttcttaaatgaatacagtccttgtgttattcaaaaaaaaaaaaaaatctagtacaactctcttttgtgtgtgtgtgtgtgagacactgtctcactctgtcacccaggttggagtgcagtggtgtgatctccgctcactacaaactctgcttcctacattcaagtgattcttgtgcctcagcctcccaggtagctgggattacaggtatgtaccaccatgcccggctaacttttatatttttagtagagacagggtttcaccatattggatggtctcgaactcctgacctcaggtgatccacctgctttggcctcccaaagtgctgggattacaggcttgagccactgtgcctggcctttttttttttcttcttgctctgtcgcccaggcttgagtgcagtggtgccatctcagctcactgcaacctccgcctcctgggttcaggcgattctcccgcctcagcctcccgagtagttgggatcacacgtgcgtgccaccacgcttggctagtttttgtatttttagtagagatgtggtttccccacgttgcccaggctggtcttgaactcctgaattcaggtgatccacccgccttagccttccaaagtgctgggattacatgcaagagccaccacacctggcctttctcccccacaccccgccgcccccctccaagaaatttaatgtctgaaaagatcatacttgttcaaggccacacagttaagaatgtgccaggtcctgtaacagacttcaactttctaatattcataccatgagtaaatatttgttgtgtctagctttgggctgggtgccacaaaaaaagaactagtcctttcctaaaataatcttattgtgacaacttagttctctttttttttgaggcagagtatcgctctgtcgcccaggctggagtgcagtggcgcgatctcggctcactgcaagctccgcctcccgggttcacgccattctcctgcctcagcctcccaagtagctgggtctacaggcgcccaccaccacgcccggctaatttttttgtatttttagtagagatggggtttcaccgtgttagccaggatggtctcgatctcctgacctcgtgatccgcccacctcggcctcccaaagtgctgggattacaggcgtgagccaccgcgcccggctgacaacttagttcttatgtgcagccttagcccagatgtacctgtcacatctttgtccctctctgacatgactcaaacgccattagggtctgccctcagtctgtgcccactcaaagcaggaggagcgtggctactaccgaataccatatcagtgatttaacagactgcttatttttttaatctaagtatctggaagcaggcttacacacttttacaccttgaaacaatagtgaagcctcatgcaaatgttcaagctcttgtgtgttttttaccggtttgccatctgaaggctttagtaaagtcactaggtcccacagaacactgggagattcttgagctgttggtggcacatcttgctcaagggcaggcacatccaccaaagtggctgtggtggaaaaagcattcattttaggtgtatcagattgggctgagatcccagttgttacttagcagccaacatccttaagttactcttgtggcaagtttgcttccccatctctgcttagctttccagcttcatcttccaccccggcagaccacaccccagcctgctaaactccctgtccttctctgaatctctgagctctcggctctattgctttgggattcatgctgctatacgtgccaggaagtccatttctcataccttcatcccccaatccagctatttcttgcccatccttgaacagtgacatcagctattctgaggatgtgctactcacgcaggctggactaggtaccctttctatcctttggcaggctgtactaacctctgttagatttaaaatattgtttttgtaattgcttttacctgtccccaccaaaagacagttgcccatataatcatcaaaaactatttgttaaatcaatccagagaagtaattagcacttacttctcagggttgttcggtcaatctataaactgtaggctgttatttggtctactgttgatcccagcttctctatctttgaacagtgcccattaactcaagaatatactgcttccttgttctctccttcttgcccctctccatcatcccctaaaagcccccttctctgagagggtaaccttgagcttctgggttttgtagatgtctatacctgagatccgacaatgtggtagaaggcaactgtgctgatgaattactacaaaactcccatcgcgtcgtggaggagtactttgtggcccccccaggtacgtgctgcccagaatggtttaacagatagtctcacagtaaccttaggaatgaagcaggaagcatgaggaccaaagatgctatgtgaaggcactttgaaaaggatgaagtgcatacagatggtggcattaaggtggcagtagggtccagggtcatactcacctctagggggcagttagtaacaggaacaagcaaaacaggattgggggcatgcgggaggtttaaagtaggtggaaatctggagctcaagatctccctaaaggggcagctggcattcagtgtttctcaaagccacagttaagaccctgccagatcctgtaatcgactccaactttctagtattcataccatgaataaatatttgttaggtctagctttgggctgggtaccacaaaaaaaccagtcctttcctaaaagaatcctttttttttttttttttttttgagacggagtttcgctcttgttgcccaggctggagtgcaatggtgcaatctcggctcaccgcaacctccacctcccgggttcaagcgattctcctgctcaggctccccagtagctgggattacaggcatgcaccagcacgcctggctaattttttgtatttttagtagagacagggtttcactgtgttagccaggatggtctcgatctcccgacctcaggtgatccacccacctcggcctcccaaaacgaatcttattgtgacaacttagttatcatgtgtggccttagcccagatgtttctgtcacatctttgcctatgacatgattcaaacgccattagggtctgccctcagtctgtgcccattcaaagcaggaggagcatggctgctaccctatcagtgttgccaggcaggaatgtaaacccatttctccagagaacctggatacctgacattttgtgtgatatttcttaaatttttttttttttttttgagatggagtctcgctcggtcacccaggctggagtgcaatcttgactcactgcaacctctgcctcccgggttcaagcaattctctgcctcagcctgccgagtagctgggattacaggtgcctgccaccatgcctggctaatatttttgtatttttagtagaggcaggatttcaccatcttggccaggctagtcttgaactggtgatctacccgcctcagcctcccaaagtgctgggattacaggggtgagccactgcaccccgccgatatttcttaaattttaagtgctagcaaccaattcaaaatttaaaaaacaaaataccatccaagccaaataaaacacatctgcaagccaggtgcagtctgtgagccatcagtttacaacagctggtatagagatttgcatcatctacctactgtaaatattttaaatagaagctttaaaattactctgggctgacagtaaaatccagaaccttggataggttgactgtttttatctcctctgcaggtaggtgaatacttggagctgttgtactacccctctgggcatctgggagtgggactagccaaaagcaatcaggtagcctgctaagtgccaacttccagttcaggatatcctgagggagaatcattctgagcagactccacagaagacattggccctggtcagcttaaggtgccagttaaaggcaggctctggttgatgcaaggatgggaaagaaagctagaaattttgtgagctaaactttttgtttgttttgagacggagtcttgctctgttgcccaagctggagtgcagtggcgcgatctcggctcactgcaagctccaccttccacgttcatgccattctcctgccttagcctcccaagtagctaggactacaggcgcccaccacaacgcctggctaattttttgtatttttagtagagacggggtttcaccgtgttagccaggatggtctctctctcctgacctcgtgatcgtccgcttcggcctcccagagtgctgggattacaggtgtgagccaccgcacccggccgtgagctaaactcttaatcatgcctccaatccactaaaccacctgttaactgtggagagaaaggagactctccatctcagagcctgatagttgtggctccagcagaaatatcttttgatcagacatgctatctcccacacagaaccttacttcagactttgctttttgggaccacctgagttcatggtcagtgtttccttctagtcctatctgcatattagtggctaatcaacctgtatactccttactgaaaaaggtgaatttggctacacttagaactgattctttcagatactcccagttaggaaaacaggacagtagctacattacttccatattttccatgagaaagtagtgatcagttagctcagtagagccagctgggcggcaggctcagctataacattctctgttgtggccgggcgcggtggctcatgcctgtaatcctagcactttgggaggccgaggagggcggatcacgaggtcaggagatcgagaccatcctggctaacacggtgaaaccccgtctctattaaaaatacaaaaaattagccgggagaggtggcgggcgcctgtagtcccagctactctggaggccgaggcaggagaatggcgtgaaccccagggggcggagcctgcagtgagctgagattgcgccactgcactccagcctgggcaacagcgagactctgtctcaaaacaaaaacaaacaaacaaacaaaaattctcttttgttattttcaaacaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgacaaccttggctgtcatttttagttgccatttgcattgatttgagcagccctatctttaccgaacatacctgaatttgttcctgggctcccactttcttcccagaagagggctaacttcctactaaggtctgaagagtgttgaaagtagactagagcttgggaactcctaacctagaactatctgccatcccacaaagtgattatatgccaaagggatactagtcatacctagtgtttctctttctgaaaagagaacttatcctaaaattagccctgggcctgggacaaaggagccctctccgcccccaaaatgattattaaattgagatgagtccaggataaaactcagataccaaggataaatgaaacttatttagggataaaagtgggctgggcgcagtggctcactcctgtaatcccagcactttgggaggctgagacgggcggatcacaaggtcaggagatcaagaccatcctggctaatgcggtgaaacctcatctctactaaaaatacaaaaaattagctgggtgtgatgacaggtgcctgtagtcccagctactcgggaggctgaggcaggagaatggcgtgaacccgggagacggagcttgcagtaagccgagatcgcaccactgcactccagcctgggcgacagagcaagtctcaaaaaaaaaaaaaaagtgatagaatcagagagtttttcctctaaccaaactgccaaagttggttttggctaagaatttcccaataatatttatgctgctgctcatttttttagttttctgagacaggggtctccctctgtcacccaggctggagtgcagtggtgacagatcactgcagcctccaactcctgggctcaagtgatcctcccacctcagcctcctaagtaactgggactacatatgtgcatcaccacgtccagttaatttttttttaagtagaggtgggggttttgctatgttgcctatctggtcgtgaactcctggcctcaagggatcctctggcatgccttggcctcccaaagggctaggatcacaggcaaaagccaccgtgtgtttatttttcccattcccttcctttatctgcaatgcttttttctttaaggcagcctaatttacaagcttggccttgaattaaaagagaacccagaacccgctcttggagtttacgttctcaaaccaacatcagagcaactgtctatccccatataaataaagttatctacccctgctcctaactgggtacaagttatgactacaactcagtgattttttaaattagtgtgcctatttggtgaaatctgtgaacttaatcaaggacaaccacacatgtcaattactaaacatttaaaatatatttctaaacagaatgggccgactcagtcacagtaactgttgatctccatagtagagcaacccacaaagacagaactgatttttttcccataatcaggggtgaaaaatatacaacttgtttctgaaccaaaaccacaatttctgcagtttaaaatgtttcactgctaatatggccctggtagaaattatgtagttttttttcttctttaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctgaaatgcaaacaaaaacaaaaagagtaaaggggaaaaaaatcagagccagaagaataagcaaaccaacatctaacaataatagttaagtattgagcacttactgtgtactctgtgcctggcatgaggctatctcattaaaccttcataacattatgaggtaggtactcttactatcccatttcaagaatgaagaaaattaagacttaagttatatcatttgcccaaggtaacacaataaatgccaatttgacatgttgatactcaattaactatgataaacaatatatctgaattactgccattgacccccctcaaagctaagaactggaaaggatctcaggggtcatatagtttaatcccctgccacctcatgtatgcatctttggatgggcatctatggaaggagctagcctgtatttaataccttccagatgtgaggacctgagctagatgctttagacgttatcctcttgctctagattcctggcaagtcttgtgatggtgctattatgtgaccattttgcccatgaaggaatcgaggtcccaagagtagttcaggtaaggaattaataagcagcagaggagtcatgtccaggctggcttgtccccaggccctctgccttcagccaccattctcagaagatccaaagatgccaaggggaaagaagccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactgtctctaaaatcaaaaattagagaaatataaaaattataaaattaaaaaagaaaatgtcatgatagctcaggtttcagagaggatgctgcactactctgggaaaaaagtgaagtgacagctcagccctgacagcaggacctagaagggctgagatgaagaggctgacctgtagagctcagcctggacccacaggaggggtagttgagttcacagagggatactgccatttaagctggttgtgaatggggtggtatgaagaccgactgcactagtattctctccaggttacaaataccatgaccaaactgtgtaatgtgatactaatatgcagaataaagcatattaaaaaacaaacgta

SEQ ID NO: 2667 - DNA, 2654 bp, Homo sapiens
cacttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcaggtactggggccggggtcgacgggtcgagcctcagccccactcgggcgagacagggagggactgtgaccttggcccgaggccttgcgggagggaaagtgagacccgggcccgccccataccggcgctgaacgtttgtggcttctccgcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaaggtacgcccttgtacatctcttcaagcgtccgttctcttttcgttatgtgtgccttagtgcaagttcttcattctctgaaggcatgggtgccaggcgtgtacagcttgtttatcctcacaaacagaaaatgtattttcttccattttgtggatggacagctgacacttgggattacgtctcaattctcttcttcaaggtcatacaataagtgctcttcagtttcccttttctccgattcatcctacctcctgccttctgagacagttcttttttttttttttttttttttttttacttctgagacagttctgaaacaggtgtccgttgtgtaaagcctggaggtttgggaaatccaattagagtggcaaagtctgaaggtggttcgcgtaagcgaacccagcagctacatgggaggctgaagcaggagaatcccttgaacctaggaggcggagtttgcagggagctgagatcgtgccactgcactccggcctgggcaacagagcgagactctggtctcaaaacaaaacaaaacagcaacaacaaaacatgggcatctggcagctactagttgcataatgaagagactgacagctttctctattccccaccaataccttttctcgactgttttatcattggttgttgatgtagatatattacaatgttgtgtcctctgttgtttgctgtatctttaacaagggcttattctgattcttcaatactggccatgcgcggtggctcacgcctgtaatcccagcactttgggaggccaaggtgggtggatcgccggaggtcaggagttcaagaccagcctcgtcaacatggcgaaacactatctctactaaaagtacaaaaagtagccgggcgtggtggcgggcgcctgtaatcccagctactcgggaggctgcggtgggagaatctaggaggttgaacccaggaggaggaggttgcagtgagccaagatccagccattgcactgcagcctgggcaacaggagtgaaactccgtctcaaaaaaaaatagtaataatatacttgatcttagccaaaaggccgagaagtgatgaaaaaagttattattattattattattattacatcacctagcccatataggactggccttgtagaaacttaacctagactcttgaatttgttgagtctttgagcggcactcccatccttgtacaatgcaattagaagccaaacagtaaaggtttctcagcctcagcactgttgacatttggggctgggtaattcttgttggggggctatcttgtgcattgtgaaatgtttagccatatccttggcctgtacccactaggtggcagtagtacctgcgcaaccccactcccgcttccccctcccccgcccccatcacagtgtctcccgatactacccagtgtgccctgaaggggcaaaatcaccctgggttggagaccgttgccctaaagtaatgcttttcaaaggtaataggcaagataattcagggtgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaatttagattggtcatga

SEQ ID NO: 2668 - DNA, 17317 bp, Homo sapiens; identical to SEQ ID NO: 2666

SEQ ID NO: 2669 - DNA, 674402 bp, Homo sapiens
aagcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccattcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacaggtaaccgggggaggaggtctgggacctatgaggctgctgtccctgcattgccttaggcttttcgcctgtggtggcccttctctgcggcctcgggaggagggaaggctgaagaagggaaccgcgggggtgcattttacaaccgctgagaaccgccggagattgggggtgttcccgcgggtcccctcccccaggccccaggagccggggtcgaccccgtgggatgttaggccccagcgccttcggaagcaaagtcctgggcccccggggaccgaggggccggtgcggagggcgctgcggggctccgcgctgtcggtgcaggcggcgggatcccggctccgcagtctgaagcatgccgctctcggctggcctgggcgcatcctccgctagtgctcttcagagagaggggggaatcccatctccacccccttcctctccttcccttccccccacctgggcggccccacgccagtatctgtgcttgcctggacgagactcaggtgttaatcagatgaaactgctcctcctcgggttgtccctcgcgggccgggcgtcccctcagccacccatggggcacccttcgcctccctcgggggatgggggatcggcttgcgtccggacctcggaaagtgtctgccttctgcctttccgcgcaaaaggccctctgtctgcctcgtcgtttccttagcgaggacgggctgcagcctgctgccggggatccagctttttacttgagagggcaggattcccctactcgggctcctctccccctcctttctgggaacccccaccccggtagagcgtcccgaggctggtgaggagcgcacttttcccgggtcgcgtttccctccctcgcgaaagccgtgtgtgttctgcatgtctgattccgttgcgctgaatttggttaatatccgtcacttcggcgatcggcagttgctgcagggcatgacttccaagatgaacagcaagcggatttgtaggggtttctgctgtggttctgtaattggcaaggtttatgtgtaattgagtggcgagacgggggttaaagaactatatttggaatctgagggcttagtttggagtgaaggaaatccaagactcagtgatgtgatttcggaaaaagaagcagtgtggacgggaatcctagtgtttcccttacttctttttttaattttttctttaactgtcaaattctgacaggtcgagacggtgctcgagaagggactaaattgaataagacttgcttttattattaggtagaaaaaaaatgtctgagactgccggcagatattgagtgcaaagcttaatttagctgctgaattttatgaaaaggtgatatccaaagcctccttttttctcttttaagtaaaggattgcctttccctggtattctttccgtatatcgatggtgattaattgaattttcctaattaaaagacccttggatagagaaactagtctaaaccagttgcagaaaagggaacccccaaatcagaaggtgcgctgttctcttcttttggtcctgaaactgtttgggtatgtgaagattcagttgtatttcagaattcctggagctgacattgccaattttcgaataatctgatggtgggatgtcaaagtgtatatcttttatctaccctcaacttgcactttaaattccagccattctttgacaataatagagtagtgagaaaccaaaatatgtcagttgtctgtggaaataaaaaaggccatagatgtttaaaagttaaaccgtagaaacatttttaaaatgaacattttctacttaagctttccattaaataatagtttcatttaacgaatcaacttacctttgtgaagtgacatagcagataggtgttgtacagactgctttgaaagatgcagcccttatctggtgtccctacagtctaatatggataacattgatacgcaaacaaatgaagaaacattgtatgtaattattgtgcaaaacttttctaaatacattacctatgagtttggggttaactgcaaaagaaattccgtattcagatggattaggagagaatgtgactacctgaagggagaatttaatacatttactaggtcaagaagaaactgtcaattttaaggggagttgaaagtcagcagccactttataaataaatatatagttgatgatgaggcttctgagctaaataaaaatgcaatgtaaaggccttgaaaagctgaagtggaatgggtaggtggcataggtaaaatgttagagagaaggtaacattaacattgacagtggaattaaagacagtcaggggaagccgtctcatgagaatgaggtacagtagtctagggggaaaagtctagggccaggaacaaggatgtagctgaaggaatgaaaaggcagctacagatttggaataagtgataatagaggaaaataggttttgatgataacatgtatatttgaagtcagaagtaactcaggctttttcttgaaagttgttgatacagatattgtctactatgatggagaggaaagaaaactgatttttctcaagtctgtaactagtgggtttcattatcaacagcttaatttctgtggtcttgcctgatataccatatgatttgggggaaagaacttacaaaaatgaagctgtgctgtacaattttgtgtattctagaacttgaggttttgcagttttactatgtagaattattctttactgaactgaagtattgtgatttcatacttaagaaagttgagttgaactgtggtttttgtaaattattatttgtggctcttaaaaggtggagggtctcttttagaaaatctccttggcatgcttcgtaatactaattttaagtattttatctatatctattttacaaagatagtggaaagtgtgatctacccacacacacattttacaatatgttacttagtattttgtgaagtcatattgtcatttctaaagtttttaattgacgttgtgacattttttattacctgttgaaagatatttgttctttgaaacttttcatccattagatgttttcgttatcttcatttcagttgtaaatttggcaaatttagtacatagtctgttgagacttctcattaaataaattaattgtattaggtttatgaaagaataatggtagaaagggaaatatttagcagaagcatttttttgcttcattattttgaattattaagcacttgaaaatgagattatgataattaatgtaacatggatattctaattatacttttttttaaatcaggaaaatgagaacatatatgtatataaaataggctgtatgtggaaacattttatgttgaatattattgtccatctctaacaacaataactttgttcgaaactgtcttatgttgacttgacagaaatgaaagtcacatggtgtttggtgacctaaggtctagtttgaaatatttctgtgtctaattagttgtctacttgtattactatttatagaagagactagaggtaatatggtaatgagtaacatgaagcaaataaacaagtatctgctacttgaaaactagaaacaggatgtggtgcagatgtagaatttttttctaacagctttagtagtgattatacttgaagtcaatcttaccagttacatagcaggctcactatatctggaatatgtcactcttcacatacttttttctattttgaaagaagctgtttatcaaagcagcatactagttttacctgtaaaagctctacagaaacattactaggaaaataatgactacatgtatgtatagaatgtagaatcatatagattattccattggctactgaatatcgtattagttcgctacagctaatgtttgataccaaggtacttagctgaagatgataatccattacctaaattgtcactaataggggcatgaatgagaaaaaggtacaaatttttgggaaagggcatttttaaaaatcatatttttgctgtagtaatatacattttaattgcactaacctgttgatttgaaatcagtaagagatactggaacaaatataagactaggtactagagattagttaaaagactaattgtaaatgagaacatcaaaatattacagtaacaggtagggagtatttcagttattcataaatgaagtcattcaaagtattaaaaaaacaagcttgagccaagcagatgctactgtcataactctgcaattgtttaagcatttacttttttacattcttgaaacctgttctggtatattatgtgtcaatattattttctgaaaagcccatttattgataaggatatatacatattatatctgttttgagaatagatgtcattaagtaggcaaattactattaaatcctactaagtggaactgtatgttctgcctaacttagctgtttttttaatatgtgtttttaatattgatctatatgacttgaaaggaatcctatttcttgaaatagattgttattttgtgaattttttgttgaaagcaatgtattagagaattaaatgtttaggcaaagtaggaaaatgttaaattaatttctaatgaatatacttagtactattatcattggtcaaagacttgaaaaagtattagttgctatacaataagaattttaactatattaaaaacacatgtgacaatttgacttcaaagtgaatatacttaatactatcatcactggccaaggacttgaaaaagtattagttgctatacaataagagttttaaatacattaaaaacacatacaactatttgacttcaagcaggcatatagtggaaagtcaatagtatgtttttagggaggaagtgacgaataagagtctatttttaatcttgctagtgatagattcctggctaagttgaacagggtgtttttaaaaacaatcagtaaaatagataaaatctattactctgtttctgtaaataggattgaagaataatgaagcatatttggaatttgaaaggtattaaaaaaagatcctgaaaaagaaagtagtgaaaccacaaaggatttcttccttcacatctgggcagagaagataaataccaaggaagaagaaaagattgtttaacctacttaaaagtaattgggactgtagtcaatatgaatggcatctaatctcactttcattaaaaagtttttttgagtgacctctcaaaaaggaaatgtttaatgaagtattgctaggtagaagttctatccaggttctttaatgaatttataaactaaattgtttttaataaattaattttaactaagtagagcttcttgaaaattttgtgtttaaacaaccccaacaattttaacagtagctttgtcagtatttatacatttcgaaagagtgtaattaaatttaccatgctttaaaaagaattcttaatttgaaaaataaagcagcaaggaaatgaaatatgatgaaggaattgtcaccataatttggggcattcttctcaaactggagtacatgacattgtgtcaagggatacctataaggcttagaatctaagccacaggaacaaacataataattttttaagtaccaattttacttgatggtattaatttaaataactttaatattaagataagcataagtaaattaggcacaaagtatagaattcatatgaggctttaagatgaaattagaaacttcaaagaaatttcaagtgagcccattatatttcaagtgagctccagatctcgtcattcttctgcgttattgacacttcatggcaaaaaatttaaggagcactgaatcatagaaagaacactgtaagaactatgttctcatactattctggctagtaaagttttgtaaccttcagtatattgtgtaaccctctctcagcttttcttaccactaaaatgaagaaatcactctctaagatcacttcaaggctctcatggcagtatatgtttctatcttttagcattctgaccagcaggaaagagaaatataggatattagacctagttaatttttttctgtctttataatgggaatgattataggggagggtaggttatacataaaaatgcaagagaataagaaatagaataatgatcaaagaaggaaaatatttagattttttatttagaaatttttgtgacattaatctttctgttattagcaatcttacacttaggtttcagacacagctcaggactgactttgtcaataaaatatttcctaggaattattctcttcaatgatgtctttctttgttttccttacaacgtttataaatgttgtctataccctgtaatctatatgtgggaggctgcatggtgtagcttaaaaaggatagaactttggagtcagatagacttggacttcagaccctcatttgccctttattttgggaagtcatttcacctctctgaatttcagttttcttctccgaaatgaagatggcaatatctactttacaaagttttcagaactaatagaggtaacgcatatgaaaatgcctagcattttcagatgagatactcagttatttttggttccttcctctttgtatgttgctttgggagcaacttgccacagtttcgtgtatacatgtcttattcaaagtagattttaaagttcttgagatatatggttatgttctttacttcttttgtgcccttttgtcatagcatctgttaatgaagtaattggatagaaggtgtttaataaaaaaattgggtggtgtaaaatttatatagtaccttaagaaacatttaggtaaaccagaacttggctattattactaaaaggatagtttagggtagatggagtgaagttgattagtttttaaaaggtatgtttttctggtaataggatgatatttataacgatgtgtgtttgagatgttttatagcattaaattttgtatattgttttagttgggtgttgtttgtgtgaggataattttagactaatgaaatttgatatctaaaaactaaaaatttgaaattataggtaaaaaaattctgaaaatgctgttaatgttgattctggtgatcaaaataacactgttaggagtcaaaagttatgcctcttctcccactttcaagataagcacattttaccacagtttccttacctttaaatgggggtaagtgtgtttaccttgatgggttaatgtgagaaatgaaataatgtattcagtattcaacacctactatgtaccaaggccctgtgctaagtgaaggatacaatagtgattaagacagttcaatctttcttgtcttgaagcatatattctagcactactgtgaaaacattattcagtcaagttgaatattgacacattcatgcttcatttatgtttcaaggaataaggtgcttttatattttattttttaagtagataacaagtacaagcaccaaaactgtttttatgtcaagccatttttttgatacacatttttttttttttgagacggactcactctgtcgcccaggctggaatgcagtggtgcgatctcagcttgctgcaacctctgcctcccgggttcaagtgattctcctgcctcagcctcccgagtagctgggattacaggcgcctgccaccatgcctggctaattttttttttttttttgtatttttagtagagacagagttttaccatgttggccaggctggttttggactcctgacctcaagtgatctacctgccttagcctcccaaagtgctgggattacagatgtgagccaccgtgcctggccagcaattatatttctacattctattctgaatatctgttactgtgacatgatagtatgtttccataacgtatatgcttttcaggttttacccacttgcccttcctcttcctgccctgcccttctaatctactatatccttgggaaccacataaacttgctaagaattatttgtgatattacatccagttagatttgaagtgagggtctaaaggcacatattttcacttttgggttcagggcatcagaaaatgagtggatattactataataaatagctttatttctttgtatagtacttcacgatttcaggatcatggctaaatgtgtctgcctgatgctgtaaatgttaataaaaatccactctatgagtgaaagagattaagtgcaatttgaatgctaagtaaaaatgaaatgtttcttttaattatttcttgttcttttaaaaaacacattaatgtgcacttgaaattaataatctttaaagtctaattaatggttaagaactgttggatatcttataaataagaaactgagccaggcacaggggctcacgcctgtaatcccagcactttgggaggctgaggcgggcagatcacgaagtcaggagattgagaccatcctggccaacatggtgaaaccccacctctactaaaaatatgaaaattaggcaggcatggtggtgtgtgcctgtaatcccagctactcgggagtgaggcaggagaatcacttgaacccctgaggcagagattgtagtgagccaagactgtgccactgtactccagcctggccacacagtgagactccatctcaaaaaaaaaaaaaaaaaaaaaaaaaagaagaaactgaatagagtaaaaatactattttcagatgtaaaaagatgaaggaacatttacacggtggtgcccccctcttcactttcacctaagagtctatacagaacattttgattatagtctaaactttaaaaattatgctttcataaaattaacatccacattgtagaagttacgtttggattaaactgcaagtgggcactacccaaagcaatctacagattcaatgcagtcctatcaatgacattctataccaatgacattcttcacagaaatagggaaaaaaaagttaaaatttgtatggaaccataaaggacctggaatagccaaagcaatcctgaacaaaaaggacaaagctggagacatcatactatcagactttaaaatatactacagagtgatagtaaccaaaacagcatggtactggtgtaaaaacagacacatagaccaaaggaacagaatcgagaacccagaaattaatcctcatatctacagccaactgagttttgagaaaggtcccaggaacatttgctgatgaaaggacagtatcttcaagaaatgtttctgggaaaaaggatatccatatgcagaagaatgaaactagagccccacctcttattctgtacaaaaattaactcaaaatgaatcaaagacctacatgtaagacaggaaactatggaactgctagaagaaaacataggggaaatgtttcaggacattggtctgggaaaaaattttataaataagacctcaaaagcacaggcaaaaaaagcaaaaataaacaagtggattatagtaaactaaaaagcttttatacagcaaaggaaataaccaacagaatgaaaggcagcctatagaatgggagaaaatatttgcaaactgttcatctgacgggggattaatatctaggatatacaagaaactcaaacatcttaacagccaaataaataaataaataaataaataaataacccagaaaaaaacaaaacaaaaaaaaccctgcaaaaaatgcaatctgattaaaaaaagatgggatatttctcaaaagaagacatacaaatggccaaaaaatacattaaacaatgttcagcatcattaatcatcaggaaaatgcaaatcaaaaccacagtgaggtattctcttaccccagttaggatcactgttatcaaaaagacaaagaatgacaaatgctgccaaggatgtagagaaaagggacctcttatatactgttaataggaatgtaaacaagtacagccactatggagaacagtatagaggttctttaaaggactacagatagaactaccatatgatccatcaatttcaccactcggcacttacccaaagaaaaggaaatcagtatatggaagagacacgtgtaccatatttactgcagcactgttcacaatagctaagatatagactcaatctaggtgtccaacagcagattaatgggcaaagaaattatggtatatatgcataatggaatactgttcagccataaagaatgaaatcctatcattcatggcaacatggatggaactgaaggacattatattaagtgaaataagccaggaatggaaagttaaacactgcatgtcctcactattatgtggaaactaaaaaaagttggtttcatagaagtaaagtagaacagaggatactagagactgggaagaggcgggggaaggggatacagggagaaatgtgttataggatacaaaattacagctagattggagaaataaattctagtcttctgtagcattgtagggtgactatagttaacagtaatatatagtttcaaatagctagaaggaggatattgaatgttctcaacacaaagaaatgataaatgttcaagatgatggatatattaattatctaatctgatcaccatacattatatgtatggagacatcactatgtatctcataagtatgtataattattgtatgtcaatgtaaaatataaaagaaaattttaaaaattgcaaataagaaagctcctgaattcttatgtcattcttttaattagttaaatttattaaagtatatttatgtgttataaagaatgtaataatacagaaaggtaaaatgcgaaattaagcctcatcacattacttctctagtttctctctagtgttaaccacttaaaaaatctttttgtttattcttttgtatacagtcatatatttgatatatttgaatatgtgtatgtgtatcatacaatacatcagagcttgcaaattgatggaccactggccctaactaaccagtgtttcattagtcccctactgtattttagaaaaagtatttgtttctaacacttaaaaaaagatatttcatataaaatccatattttttttgcttcttaagattcagcaacacacaacatgtttctcacataatagttgtttagagttactgtctgcataagatagaacatgcgttcttcagtttcccacagtttctgtttaatacgtgttggctgcctgaccttgataggcatttgagattgtgattcttgctcatacatagtattttgcactttcttccttcactccctaactctgtagcatattttggacatcttttcatattagtgaaaataatagtggttaactttattgagagcctatgaagtgtaaaatactttctagagcctgttacagagcctattcatttaatcctcgtaataatatgttagtgttgtcaccattttacagctgaagaaattgtagcagagagagattaagtaacttgctcaagttagtgcagtaaatgaacaggctgcaaattgaatctatgtaatctgtccgtagagtgtaagctcttaactactacatgatactcctctttggcatgtcagaattatttcatagagatcttcaaagatgttcatatacatatttcactttaatgggtcttactgcattgtaggttatgctatatttaattagtccctaattgatggacatcgaggtttctgatttttcagagacagatgttgtagataataatattatacatttatcattacaagtttataagttttttataatgtaagattactatctgtagaattttggggtcaagggtatatgaacttaaaaattttaatagataatttactttccaataaggatgtattaattaatattcccaccttcattgggtattagctttttagctttacaagttcttttgaatatacttcttgagttacacaggatccttttattaggattctttattgcaaatgagagttactgagctcaaaattagcttaagtgaagagggaaacttacatagccatagattacagaggaggagctgacttaagggactcaaataatgtgatcgggaagaaatgtaatcatgaactcttactctccatttcagtgctctgttttctgagtatgttgcaggctgactttcttcttatagtcagaattgtgaggttatagaggaggggtagattgagaagttatagtaatagtttcatgtttccccttcccaattagtgagtccagaggaaatattttctttttttttttaaacttttattttagtttcaagggtacatgtgcaggtttgttatataggtaaactcatgtcagaggggttgttttacagattatttcatcacctagctactaagcctggtacccaatagttatttttcctgcttatccctcttcccaccccctaccctcaagcaggccccagtgtctgtcgttcccttctttgtgtccatgagttcttttagcccccacttataagtgagaacatctggtatttggttttctgttcctacattagtttgctgaggataatgacctccagctccatccatgttcccacaaaagacatgatctcattttttttatggctgcatagtattccatgatgtatgtatacaaaccacattttctttatccagtttgccattggtgggcatttaggttgattccatgtctttgctattatgaatagtgctacagtgaacattcatgtgtatgtgtctttatggtagaatgatttctatttctctgggtatatacccagtaatggaattgctgggttaaatggtggtcagaggaaattttttttttctcgtgacatttgtatataaacttccaggatgctcacctggcatgactcacatgtcaattttggagcccgtcattgtaaccaggaggttgaggcttgattggccaggtctgtatcacatatccatccttgggagtggggatactaaataggtaacctcaccagaatcacatagagagagtatcttagtgtgggctgctatagcaaaatacttagactgggtaatttataaataacagaaatttatttcttacagttctggaggccgggaagtcaaagatcaaggcactagcagatctggtctggtgagggcctgttcctcagggacaatgccttcttaactgtggctttctagctatgtccacatatgttggaagggcaagagggctccctcaagcctcttttatgagggcactaatcccatttatgagggtggaccccttgtgacctaatctcctccaaaggttctacttctttaagaccatcacagggtggggtgggatagggggtctggtttcaacattttggagggggacgcacacattcagaccacagcagagggaacaagggaagtctttaaaaggagaggagtttctgtcactaaaaggggaaaagtgtgctgagcaagcagacaactttttttttagagggtccctgaagtcttgatgcctttttgcttcattctttttttccctgagaatgtagttcattatatcagtcactgtttcttctttctcctgcttctgccatgaaaatgctcctctggcagatagtttcaaattggaattggaataagttagggtgtggcaatcaatggcttaaacctaggcccctgtgatgtgaagggtggttaatttgtatatcaggagaactcacaatgattgacctccactttttcatactctatataaaagagtggttctctaaagacattttagaatagtaatacacacataattgaaatattttacccattttttaaagagccctttatgttgctttattttgaatttatgatcacctatgggtcttagtctttttttctacaaatggtgcctcccagtgtttcctaaattttgttctagcaacacttgtccgggagatgttatagtatgtattatatgaaaatgcttttacatgatcaaataaatgtggaaagtgccatataatgcatccctccatttggagattcacagtatatgaaggcatattaaagatgtgagtaataattgtggaacctcttaacctgtatttagtctagtgcttccaaatttatttgaaaattaaacactttttcaagatacacctgagttctgttcaacacctttttaggaaatggtggtctttcccctgcagatgatctcttgaaaatctgtgtatgatttttatatgtattcttttactttttttgctgtaaaaataatggtttttctacaataatctttattgtgaaaattaattattttaccctggatttacctttaaaatatataatttttttttctaatcaccacctctttttttgtttgtccttttttttcctgttaaaatgttgactgaatatattcttatttgattctgaaaatctatgatagcaaagactagaaactgaccagtcttggttctgttaccactatgtggggaaagaacactggatgaaattctattttggattttttcagtgggagtttagtatcattatttgtaaaatggaaagttgagtagatgatctctaaaatccccttcagctctaaaattttattaatcctaaatctgaggaacatgcctcatgtttaccattccatcattgctgaaatctattagtgacggcaaaattattgatctaaagtgttttccttcaaacaggaaaaattactagaaaaagacacagacattcataacaagtgtaaatgaaaataaatgtctgttacttccactgcacaatatgtgcaattttatttcattcaatatcatgtgctacagaggttcaaattgctaaatatatagaccttagaaaaaattatatgaacttaagtgtaatgacagattcccacaatcaagcttagaagaataatagtgattaaggggtatttgaagtattactttttctttttaaatttaaaatgtattgctacactagagatctggaaaacaaaaaattagcactccctccaaaatagttattattttgctattgtaaatttaaaataaagctgttgtaaaataagacataatacctttgatgaacaatattatgttttaggttcacacagatactcagaatagtaggtgggctctggattagaccacctgggtttatacctaagtgaagtttttagagttacttctctaagctttagtttttttcatctgtcaaatggaaaataatactaatatgcctgccttagagggttgttgtggtaagtgagataatgaagtaaacctttaatgagtgtgcccacatactaaatattcatgaaatgtttgttgtgtattataatacatttgaatataattaccttaataaacagggcaacagaagcaacctgtacaacttttgggtatctgacctcaatcttggtgtatccccatgcccttttcccactattttatcttattttagcaacatcattaaggttcaatactgaactggggttctgcttgatctaaattcttgtcttccagcttaagttttgggcagttagagttagaagatgctatttgtagtgtagtaactaacagcaagaatttgagatttttgagatataggtttaaagtaaagtatgtatggaagactgcctctgatagtctctaaggcttgttaagacctgtggagaaaattcacatacatatatgtgggtactatggttatggaatactaagtgttctagttaaaaagttaaagtaccctagttaaaaaggtgtttttaaagtttgaaatattatgcaactggggcagtaatgcagggtggtaaagtgatagtaaaataaaatatttatatagatgattgttgatttgtagtagaggaactttaaattagtagatgaggaccttatatgtttgaggttaaataaacaatgatttggggcataagggaaataaatattatgtataaaagggaaaagatacttttagaactatcagatgctaaaagagaatctatcaaatttagagcattgccaaagataagttttggtagaaaagtttgggaatcattaatttagttttttaaaaaattattattatactttaagttctggggtacctgtgcagaacatgcaggtttgttacataggtatacacgtgccatggtggtttgctgtacccatcaacctgtcatctacattaggtatttctcctaatgctatccctcccgcagccccccacaccccgacaggccccagtgtatgatgttcccctccttgtgtccatgtgttctcattcttcaactcccacttatgagtgagaacatgtggtgtttggttttctgttctcgtgttagtttgctgagaatgatggtttccagcttcatcgatgtccctgcaaaggacctgaactcatcctttttttatggctgcatcatattctaccgtgtatatgtgccaacttctctttatccagtctatcattgatgggcatttgggttggttccaagtctttgctattgtgaacagtgccgcagtaaacatacctgtgcatgtgtctttacagtagaatgatttataatcctttgggtatatactcagtaataggattgctgggtcacgtggtatttctggttctagatccttgaggaatcaccacagtgtcttccctaatgattgaactaatttacactcccaagagtgtaaaagcgtgcctatttctctacatcctctccagcatctgttgtttcctgactttttaatgatcaccattctaactggcgtgagatggtatcacattgtggttttgatttgcatttctgtaatgaccagtgatgatgagctttttttcatatgtgtgttggctgcataaatgtcttcttttgagaagtgtctgttcatatccttcacccactttttggtggggttgtttttttcttgtaaatttgtttaagttctttgtagattctggatattagccctttgtcagatgagtagattgcaaaaactttctcccattctgtaggttgcctgttcactctgatggtagtttcttttgctgtgcagatgctctttagtttaattagatcccatttgtcaattttggcttttgttgccattgcttttggtgttttagacatgaagtctttgcccatgcctatgtcctgaatggtattgcctaggttttcttctagggtttttatggttttaggtcttacatttaagtatttaatctgtcttgagttaatttttgtgtaaggtgtaaggaaggggtccagtttcacttttatgcatatgggtagccagttttacgaacaccatttattaaatcctttccccatttcttgtttttgtcaggtttgtcaaaaataaaatggttgtagatgtgtgatgttatttctgaggcctctgttctgttccatcggtttatatatctgttttggtacctgtaccacgctggtttggttactgtagccttgtagtatagtttgaagtcagttagcatgatgcctccagctttgttctttttgcttaggattgtcttggctatgtgggctctttttggttccatatgaaatttaaagtagtttttttttttttaattctgtaaagaaagtcaatggtagcttgatgaggatagcattgaatctataaattactttgggcagcatggctcaccatactgattctccctatccattagcatggaatgtttttccatttcattgtgtcctctcttatttccttgagcagtggtttgtagttctccttaaagaggtccttcacatccgttgtaagttgtattcctaggtattttattctctttgtatcacttgtgaatgggagttcactcatgatttggttgtttgtctgttaatggtgtataggaatgtttgtgatttttgcacattgattttgtatcctgagagtttgctgaagttgcttatcagcttaaggagattttgggctgagacgatggggttttctaaatatacaatcatgttatctgcaaacagagacaatttgacttcctcttcctatttgaatacactttattgctttctcttgcctgattgccctggccagaactttcaatactatgttgaataggagtgtgagagagtgcatccttgtcttgtgctggttttcaaagggaatgcttctggtttttgcccattcagtatgatgttggctgtgggtttgtcataaatagctcttattattttgagatacattccatcaatacctagtttattagtttttagcatgaaggggtgttgaattttgtcgaaggccttttctgcatctactgagataatcatgtggtttttgtcattgcttcggttttgtggtagattacatttattgatttgtatatgttgaaccagcattgcatcccagggatgaagctgacttgatcatggtggaaaagctttctgatgtgctattggattcggtttgccaatattttatcgaggatttttgcactgatgttcatcagggatattggcctgaaattttctttttttgttgtgtctctgccaggttttggtatcaggatgatactgtcctcataaaatgagttagggaggattccctctttttctattgtttgcagtagttccaaaaggaatggtaccagctcctctttgtacttctggtagaattcagctgtgaatccttctggtcctggactttttttggttagtaggctattactgcctcaatttcagaacttgttactggtctattcaggaattccacttctttctggtttagacttgggaaagtgtatgtgtccaggaatttattagtttcttctagattttctagtttatttgcatagaggcgtttatagtattctctgatggtagtttgtatttctgtgggatcagtggtaatatcccctttatcccctatttgattcttctctcttttcttctttattagtctggctagtgttttatctattttgttgatcttttcaaaaaaaaaaaaacagctcctggattcattaatttttttgaggagattttcatgtctgtatctccttcagttctgcgctgaccttagttatttcgtgtcttctgctagcttttaaaattgtttgctctttcttctctagttcttttaattgtgatgttagggtatcgattttatatctttcctgctttctcttgtgggcctttggtgctataaattttgctctaaacaatgctttagctgtgtcccagagattctggtacgttgtgtctttgttctcattggtttcaaggaacttatttatttctgccttaatttcattatttacccagtagtcattcaggggcaggttgttcagtttccatgtagttgtgtggttttgagtgagtttcttaatcctgagttctaatttgattgcactgtggtctgaagactgtttgttatgatttccattcttttgcatttactgaggagtgttttacttccaattatatggtcaattttagagtaagtgtgatgtggtcctgagaagaatgtatattctgttggtttggggtggagagttctgaagatgtctattaggtctgcttggtccagagctgagttcaagtcctgaataaccttgttaattttctgtctcgttgatctgtctaatattgacagtggggtgttaaagtctcccactattattgtgtgggagtctaagtctctgtaggtctctatgaacttgcattatgaatctgggtgctccagtattgggtgcatatatatttaggatagttagctcttcttttgcattgatccctttaccattatgtaatgtccttctttgtctcttttgatctttgttggcttaaagtctgttttatcagaaactaggattgccacttctgctttttttgctttccatttgctgtgtaaatattccttcatccctttatttttagcctatgtgtgtctttgcatgtgagatgggtctcctgaatacagcacaccaatgggtcttgactctttatccaatgtggcagtctgtgtcttttaattggggcatttagcccatttacctttaaggtaaatattgttatgtgtgaatctgatcctgtcattatgatactagctggttattttgaccgttagttgatgcagcttcttcatagtgacgatggtttttacaatttggtgtgtttttgcagtggctggtactggttgttcctttccatgtttagtacttccttcaggagctcttgtaaggcaggcctcgtggtgacagaatctcagcatttgcgtgtctgtaaaggattttatttctccttcacttgtgaagcttagtttggctggatatgtggtaattctgggtttaaaattcttttctgtaagagtgtagactattggcccccactgtcttctggcttgtatgatttctgccgagagatctgctgttagtctgatggccttcctttgtggataacccgacctttctctctggctgccattaacattttttccttcatttcaacctcagtgaatctgtcgattatgtgtcttggggttgctcttctcaagtagtatctttgtggtgttctctgtatttcctgaatttgaatgttggcctgtcttgctaggttgaggaagttctcctggataatatcctgaagaatgttttccaactttgttccattctccccatcactttcatgtacaccaatcaaacgtaggtttggtctttgttaacatagtcccatatttcttggaggctttgtttgttccttttcatttttttttctaatcttgtcttcatgttttatttcattaagttgatgttcaatctctgatatcatttcttctgcttgatcaattcggctgttgatacttgtgtatgcttcacaaagttcttgtgctgtgtttttctgctccatcaggtcatttatgttcttctctaaactggttattctagttagcaatttgtctaaccttatttcaaggttcttagcttcttgcatttggttagaacatgctccttcagctcggaggagttcattactacccactttctgaagcctacttttgtcaattcattagactcattatccgtccagttttgttcccttgctggcgaggagttgtgatcctttggaggagaagagacgttctggtttttggaattttcagcatttttgtgctggtttctccctatctttgtggatttatctacctttgttctttgattttggtgacattcagaaggggtctgtgagtggacgtcctttttgttaatgttgatgctatccctttctgtttgttagttttccttctaacactcaggcctctctgctgaaggtctgctctagtttgctggaggtccactccagaccctctttgcataggtatcaccagtggaggctgcagaatggtaaagattgctacctgttccttcctctggaagcttcatcccagaggggcacctgccagatgccagccagagctctcctgtatgaggtgtctgtcgacccctgctgggaggcatgggggtcagggacccacttgaggccgtctgtcccttagcagagctcaagcactgtgctgggggatctgctcctgtcttcagagctggcaggcagggacgtttaagtctgctgaagctgtgctcacagccaccccttcccctaggtactctgtcccagggcgatggaggttttatctataagcccctgactggggctcccacctttttttcagagatgccctgcccagagtggaggattctagagaggcagtctggctacagcggcttggctgagctgcagagggttccgacgggttggaacttccctgggctttgtttacaccgtgaggggaaaactgcctactcaagcctcagtaatggtggacgtccctccttgcaccaagctggagtgtccctggtcaacttcagactgctgtgctggcagggagaatttcaagccagtcgatcttagcttgctgggctccttgggggtgggttcccctgagctagaccacttggctccctggcttaagccccctttccgggggagtgaatggctctgtcttgctggtgttccaggtaccactggggtatgaaaaaaaaacaaaacaaaaacctcctgcagctagctcgctgtctgtccaaacgaccactcagttttctgttgaaacccagggccctggtggcacaggcaccagagggaatctcctggtctatgggttgtgaagaccaagggagtgtacggtctactgagcctgagtgcacagttccttacagcacagtccctcagggcttcccttggctacggatgggaattccctgaccctttgtgcttcctgggtgaggcaatgccccaccctgcttctgctcgccctctgtgggctgcaaccactgtctaaccagtcccaatgagatgagccaggtacctcagttggaaacacacaaatcacctgccttctgcgttgatctcgctgggagctgcagatcgaagctgttcctattcggccatcttgccagcaactcagcccactgttttcttgtttgtttgttagattttttttttttttttttttgatacggagtctctctctgttccccagactggagtgcagtggtgctatctcagctcactgcagcctccgcctcccaggttcaagtaattctcttcccaaatagctgggattacaggcacctgccaccatacctggctgagttttgtacttttagtagagaaagggcttcgtcatgttggccaggctggtctttaattcctgacctcaggtgatccacccgccttagccccccaaagtgctgggattacaggcatgagacaccatgcttggccaaatttaggtttatactggacttggattttcaaattttcttttgcaggtgagtttgtgaagtgttaattttaaaaaattgccaggagtctgaggcaggagaatcacttgaacctgggaggcggaggttgcagtgagccaagatcacaccattgcactccagcctgggctacaagagttaaactccctctcaaaacaaacaaacaaaaaaattgtcaattatgcatcacaatgaaacattcatttctgatttttagcacaattcaggagtaggtcatataatacatgacaaactcaaagatgaataatgcagtcttcccaaatagtagaaacttttaagcagctgaatggtaatggatctaattttgttattttattgtttttctgtctatgagtgatatattggtctgaccatagcctgacttgttaacaaacaatacagctcaactcaatatgtagtgtatcatgtactttgcatggtgttaggctaaaactactaagtatttataatgttatgctttaagtatgattagttgattgtaaaatggttcacattttaaggtatttttatattgaaacccttgccaagtactgtatgacagggttttcaaaacttttttagtaaaagactagatagtgaatttttaggctttgtgagctgtatatgatttctctcacaactattcagctctgcccttgtagcatgaaagcagctgtagacagtgtataaatgaatgagcattatagtgtcccaccgaaattttagttataaaaagaaatggcaggccagaattggtctaagggctgtagtttgccaactcctactcaagacgtagcctgttgtaagggaaatataattccaagttacctgcatgtgaatcgaacttttatattagttaacatttgcattacaaaacatcacaaaatttagttacttgaaactacgatttagtatttttcacatttctgtgaactaatttggttctgcttccggtggcatttgttggggttctgatagagctgtgatatctggaggctcaactgggattgttggccagggctttggttctcctacatgtgggtctttctatatggctgattccttagcctcatggtgtgatagttgggttataagaagtattctaagagcaagcattgtgagacagaggaagcagaagatgccaggccaagggataggcctgaaactttcacagcatcacttctgccattattctgttggtcaaatagtcacaggctcagcccagagtctttgtgggaagagactacccaagggtgtaaatgctaggaagcatggttaattgaggatattcaaactatcctcagtatatcatgagattgttttggttgcaagtgacaactcaaattgaactagctttagtaaaagggaacaattattataagaatattggggtgtctgcctcacaaaacccaaacacaagattgggtcctaggaacattggacccagggttgaagattcccgaggactgtttctcatctttgctctaccctgtaagtagtcttcattttctcttatcacaaacttcccttctccactttgggaaaaacagtgtcaacacttccctaattatttacatattaccattttagccattcagaggactgactttatttttgcagtgtttctaaaatgtttgaggaagaatgctgattgtcctagatcagtcatctgtgatcagaggatagagcttaggttctacaaaccatgttggcaggaacaggatcagttaacatcaaagggatgctgagtgtgtagtcgccgaatagtcagtccacttgccttctccctagccatctatttgttaacaagttaataatttgttaattaataaatgtttttttccccattacaggcctaatttacttctttattcagctctctgcctatggctatttcattgttctactggtgtgtaagcaaaagtaagaactgaaattaattcagtatcttgaatatttattgtaatctcttcctgctttgagtagaggatggcagcttttagtatctgctatcttactttgccaccataaacatagaatagtatgtaaagatgatcttactctgttgccaccattgatttccaggtttgacttagctgatctggttggctgaatgggtatatccttcctttggaaagggaccacgtgcatacatgaaagcaagtagctaaaatacagaatgaaataaaagctgtaatagaagtacaagcaacatgccgtgggtgcacagaggaaggaacaattaattttgactgaatggctgtaggagggatggcattttaaggaaggtagtgtttcagtaaggcctggaagaatgaataacttatccttagaaaagaaagggaaggtaatctggctgtcaagtttctcatctgctgaaacggtggtaccagagtgtctaggctaaagtagatgaacttaaatataggtataggacattcaggataaatggcagcatgcagttgtctgattttagccatcttaaattggaattacaggagtgaacacagttttgttacagttacgccttaggtgactatctggtaatttgaaatttgagacttcagtttttaaaattaagcagtttatttcaaatactcagatttttggatataggaagaaatttaaggattatctatactaacacactctagtaggtaaagaaactaagacctagttagatgatttatttgagcttacgtatctaaatgactgagttggggctaaaatacctttctcctggtcttgggtatttttgaagaattatccagtgtatcctttattgtaagaagattttctccaagtatacatccatatgaattgcttgctgtagtagcaatttttaaatttgagatataacatgcatatagtaaaatgtacagatgttaattgtatagcatggtgagttttttatgtgtacaaactcttacaattaacactcagatcaagatgtagaacatctccagcactccagaagcctctccttcatggttttcacaggttaactaatatccacttctcctgtcactcccaagtaattattattctgatttttattatcatagattagtctttcctgttcttgcacttcatgtaaagggaatgacttctttcgtttattatggttatgacattcatccatgatgttggtataccttggttctttttattgctatgtagtgtttcattgaatgaatggatcattatttattcttctgttaatggacatttgaattgtttctaatttttgacttacaaagaaaacctgctatgaatattctcgtgtatttctttttatgaatatattgtttcatttttaagagtataattgttggatggttgtcttccaaagtggctgtaccattttacatccccaccagcaatgtaggagggtttgagtagttctacatttttgtcaatattgtgtattgtcagtctttttaatttcagtcattctggtcagtgtgcactggcttctccttttcatttcccaggcaaataatgatggtgatcaccttttaatattaatttttgacatattttaaagttattctgtctttgtcttatggatttataggaattccttatgtattctgaatatgagacctttgcatggcaaatttcttctcccagtctgaggctagtcatttcactctcttaatagtgtattataataaataaaagttttcaattctaatgaaccttaacttatcaagtttgctttttatggtttagttggtttgttaatgttttgtttaagaaatctttgcctattacaggatcatgaaaatattctccaaagttttctttttgaaattgtattactttcttttttactcaaagctctatgatgcatttcaaattatcttataatgaatgatgtgaggtaaaaaccaggaatttttaaaataaaacataggatattcaattgatttggccccattttttgaaaaaaaaattgcccttaaaccattggattatagaacacttttgatataaatcaggtgagtcttactagagtgtatatgctcttccactggtctatttatgtacaaatactaccctgtcttaattactgtagctctatactaaatcttggtatctggtggtataagttccttcaattttatttcttcttcaacatttttttttgtggtgggtatactctatcctttgtgtttccatatacatttagaatcatatttcagtgaaaacaaaactgttaatattatgattgggattgcattgaggctatagatcaatgtggggagaattggcatcttaacaatatagagtcttctagtccatgaacatggattatctatccatttacttgggtctttaagttctttcagcagtattttttggtttacaatgtagaggtttcgcatatcatttgttagcgttatggctagctattttaatgttttgaaagtgctattgtaaatggtattcgttatttaaatttcattttgaattgtttaatacatagaattacagttgtatttttatcttataagcagcaacccgctaaatttgcttatttttaatatttaatattttatagattttttgtatttcctatgcaaacaaccaaatcatctgagaatagtaactattttacttatttctttccagtctttataattgtttctttgttttcccttattgcaatggccaaggcttctagaacaatgtttaattgaaatagtctcactcctaaacttaggggaaaatgttcaatatttaccaattatgatgttagttgtaagttttataggtaacctttatcagattaaagaagttcttatctattcctagttttcttttcttttttgaaaaaaattttatagagagagggccttgctctgttgcccagactggccttgaactcctggctcaaatgatattcccacctcggcctcccaaagtgctgggattacaggtgtgagccactgcgcccagtctgatagttttctaaatcatgaataggtggtaaactttgtcaaattttttgcttttgttgagataaatcatatggttgtatccttaattctgtgatgtggtgaattacattgattgatttttaaatgttaaaccaactttatactcctaggataaacgttactttgtcataatgtattgtcccttttatgtaccattagattcaatttgttaatattctctttagaatttttacatctattcatgaaagatattggcctgtaatagtcctttattataatatttttgtcagattttgttatcaatgtttgttagccttgtaaaaagaattgggaagtctctctctgttttatttcaaagtgtttgtgatagattgatacgtttcatgtgtacttgaattgggaagtctctctcttttttattctctgaaagcatttgtgattgatagattcatacacttcatgtgtacttgaatgttgattctgcagtctttggtgttaatgttctttgtcagtaaggtcatattggttaatcaagttgttcaaatcttcaaatgactgatttcttttttcctgttctctcagttttgagagtagtgtcttaaaattataaactatgactgtagttttgttgacttttagttctttcagttttcccctcatgtagttggaagctcttactaggtgaattaaaacttggcattgttattttacggttgaaatgacctttttgtcattatgaaatgaccttctttatctctggtaatatttcttgccttcaagtctacttttaccttctattaatatagtcactctttcttttcatcaatacttccatggtatgattttttcttctttttagttcagccaatctatattcttgtatttacagtatatctcttggaaatgtcatatagtcaggtcatgtttgttttatctagtttgacaatctttgtgctttagttgtaataggtattctatttacatttaatgtggttactagtatagttgggcataaatcttttatcttactgtttcttttctatttgtcccatccatactttgggtgtttaaatttctttcctgcctgtattatttgtcaggttttctaaactccattttggctcattagcttttcagttatacattcttctgtggttattttttagttatcttagagattttaataaatcttgattttttttagtgtatcttaatgttttaccacttcccaaacaatgcaaaacttaggacagtttaactttgtttattccctcctgccctttgtgctatttttttcatattttatttcaatatatgatacaaaccacataatttttttgtaaacagttaatattcttttatatttatccacatgtgtaccctttctaatgctcataattcatttttacagttctttgctaccatccaggataattttcctttagcctgaaaaaattcctttaatatttcttgtagtgccagtctctttgaggcagattttctcagcttttgtctgaaatccctttattttgacttcttttttgaaggaaaaacttattggtacagaattctgggctggcatgtgttgctgttttgagacagggtctcgctctgttactgaggctggagtgcagtggtgtgatcatagctcactgcagcctctaactcctaggctcgagcgatcctcctaccttatcctctcaagtagctgggagtacaggtggcaccactgtgctcagctaaattttttgttttaggttttgtagagatggggtctcactatgttgaccaggctggtctcaaactcctggcctcaagctatcttcctgcctcagcctcccaaagtgttgggattacaggtgtgagccaccatgtccagcctgaatcttttattcttatagcacttcagatatgtaattcctttgtttttccttattgttgctcctttaaggagtgtgcgtttttttggctgcatttaagatttttatttttgtctttagttcattaatagtttgtatggtgcctaggcatgggtttctttgcatttatcatgtttggggtttgctgggttaatggttttttttttatcagccttggaaaaatttgtattttatatctttatattttgcttctaccccaatctctctctcctctaaactgtgttaggcgttttgactgtcccacatgtctcatgtggttattctgtcttttctctctgtggttcaattttgtattttttgttgagctattttttaaacttacaatttctctcctcttctgtgccaggttgaataacctatccaataagttttaatagcttattttctcagctctaggaagttttattatttttaaataggtttccttttttgttgattatctccatccttttataaattttattcattttttttccttccctttcattagcctatggataatggctattttaaagccattgtctcctaactccactatcagtgtcatctctagctttgcttttagtcttgattacaggtcattttttcttgttttttttttttcacatatattgtatgtgaaaaacatacaatatatgttttgaaatacaatatatgaaattaataaatttcacatttattatatgctgaaacttgtaataatttatgtagaggctgaaggtgatatcttccaccagagatgattcccctttttagttgttaggccaatttaattagagttttattagggtcagtctgcattgcagttttagtaagatttagtctatctctggtttgtctccattgacatactcagatttttgattgaaagactgtcagatttcttctccacagccctgaaagactgcaggagatctaattctgttctttagaggttttgagattagcccggtaatctcttggtttatttacagtgctttaaattcatgcaaatgtgggaggtctgtcatgtgttttttgcggtttgtcccctgtttctaggaaggctttttttctggtaagcactgtaatactgagggagatttcactctgcccttctagcacgtctcccagcctccttcattacttagaattcagcaaatgttcctttcaaccttgcatttggggctttctagttttcagactactgcatgaaaaagctcagctgctttctactttcttttttttttttttttttttttgagacagagtttcgctcttgttgcccaggctggagtgcaatggcgtgatctcggctcactgcaacctccgcctcccgggttcaagcgattctcctgcctcaggttcctgagtagctgggattacagccatgtgccactatggctggctaattttgtatttttggtagagacgggtgttggtcaggcttcgtgttggtcaggctggtttcgaactcctgacctcaggtgatctgctcacctcggcctcccaaagtgctgggattacaggtgtgagccaccacgcccagcctgctttctactttcaccagtggagtctttctgtctgggccaatctcagttctcagtctctgtccagaattttcaaatgctcccaggaaataaaataggagatggttatctgcacacctaggaagggctcttctctttctagaatttcagttcatctacttcttgttctttcataagcactctggtgtcttaaaaattggattgaaattcatctttttctagttgttgaagcattaaaataactgctgtccttaaagtttgaaacagcaaaatctatttgtttttctgattataaaagtaatacacaatgtattgtgtacttctgctaagttatgctgcataacaaatgacctctatttcagcagctcacaacaacaattgcttatttttgctcttgcttcatgttggctgaaggttggcagtggctctgctcgtgctccacatatcttctaattctgagatccaggctagagaacaacttctatttgggccatgctgttcttgtaacagagggaaaaaagaaaatgatttggcaggaatacacagtggctcttaaaacttctgcttggatgtttgtttatataccattggccaaagcaaaccagtggccaaggccaaagtcagtggagcagggatgttactcttatgggagtgctgtcagttacataggaacaggtgtggatgatgctccttttgaaggaaagtggagtgaataattacaaattgtgatagaatccaccacacatgctaattgaaaataaattaaatagagatgtataatgtttatagtagaattcttccttctgtcttccgtgataatcagtgatgatactttggtgtatgttcaggactgaaaccttcttattgtgctaacttgatggtttctttaaaaataatagtcttgacataaattatgaataagacttgtttttttagccatatactcagaagaacactagagttctccaactggctacgcttagttcttgctttgccaggtagtcccacgcttactataatgttcaatttagagttctaagtataaaatatttttacttatttatttatttttgtgacagagtcttgcactgttgtccaggctggagtgcagtggtgtgatctcggctcactgcagcctccacttcctgggttcaagtgatcctcacgcctcaacctcctgagtagctgggattacaggtgtgagccatggtgcctggctaatttttttttctttttttccttttctgagacggagtctcccactgtcacccagggtggagtgcagtggcacgatcttggctcactgcaacctctgcctcccgggttcaagtgattctcgtgcctcagcctcctgagtagctggaattacaggtgtgagccatcaagcctggctaatttttgtaattttaatagatacagggtttctccatgttggtcaggctggtcttgaattcctggcttcaagcgatccacccaccttggcctcccaaagtcctgggattgcaggtgtgagccgctgcacccagcctgaaatatctttaacacaagtttgggtctgatccatggcatgttagtgtcatcactttttcattctctgagagaaagataagaaaaatggaattctaagattttgtaaaggatatgtgtttttaagggagaaggtactagaaataataaaagtcaagaaccaaaagttcttaggtcaattattttgacctaaatatatttcacaatagaggttcaagtgggttaactagactccctgttagaacaaaaatacctatgaagaaggttaagtttatatagtcatttatttgtataaatatttttctattcagagcaattcttagtggttcagatttttatgaaggagatcgatctgcagagaaatgtgaaagtgattttgtacaaatggtgggatatggcaagattcagtatcatttggaagtttggacactgacaggctctgagcattggacactgagggagagggaggtacacgaggcctggtaaaatagtttaacttttagttttgcattaggttcatccttttggaggttagtatgccgatgaaaaacaaattcacagagcagcttggtgctgtcagtaccatggacagaatgatgtgaatgagacacatctggatttagattctgttccatttgtgtcattcatatgctttgtgatttgggcaacttaattaagtcttgtttatgacacagatgataattaacgtattgatcttagcatcttttaagtgttcctttgttccttgagtcatcactttctcttctgtccaacttaaattttatagtattttgttatctatgatttgcattctcaacttccttgcatataccctcagctttcttgtctcactctcacttaagtccagcttaaatccagccatttttaaactttaagttagtatctgttagtgtctaaattagcagctatatacgtcgagaggaaaatgcagaatcatgctgactagttttacttaaattcatggtcacaaatatcaagtatcaagtgagtccttaatactacctggcattcatattgtattttcctagattgtttattcttctattttcttagatgacttatttaatgttttctctcatcagaccttccaacatctcatcctcaatctctcagctgatgattttggttcctacctcactgagaaaattgaagccatcagaacagaacttgcatagactccttttactctgtctacccatctaccaccatctccatccatataacctatctttctacccattattctttacttttctataaccaatcccttcgtttgtgcattagaatctatttcctaatggcttcttagggacattgctccagcagttctccactctcactcctatgtcataaagttttttcatactgcatcactaccacatgaagacaaacctactgctacctctgtctttaaaccttcttttgtttgacactacttcccttaccagataacagttatttgctttccaattgcagcaaactccttgaaaggattatctgtgctcaatgactctaatttctttcttcctgtttccttttaaatccagtataattaggcttctgccattatcacttttgttagtccattctcgcattgctataaagaaatgcctgcgactaggtaatttataaagaaaagaggtttaattggctcacgattctgcaggccatacaggaagcatagtgactgaggcctcaggaaacttacaatcagggcggaaggcaaaaggaaaaaaggcacattttacatggccagagctggaggaagagagagagagtggggggagatggtacacacttttaaacaaccagatctccttacaactctgtcagtatacagtaccaaggggggttggtgctaaaattaattcatgagaactatacccctgtgatccaatcaccccctaccaggccccacccccagcattggggattacatttcaacatgagatttggatggggacacagatccaaaccatatcatcactgaattgaaactactcttgataaggtcaccaatgatcttcatattgctaaatctcaagttaatttctcaatagtcatcatttctcttgacttagcaacatttgatttagttgatcattccttcttatacatacttttttttcacatgacttctgggatgttatactttaaaaaaatcttctgcactcactttcttgatgatcgtgactgtaaataccaagtatgtgcttacaactcctaaatttatgtacctgtttaagaaactattcctgaattgtacacatatatacacctatgtctgtatctacttgacattactatttgggtgtcttagtgacttaattaatatattccaaatactgattccctgcctaacacttgctcttcctagagtatttgtcagttagtaaatgtctactctttttctagttggggctatccttgagacttctcttgctttctcccacagccaacttatcatcaaaatgacgatcaaaccatgaaaacatatcccagatgtgtcaattccccaccactttcactgccattaccctggttcaaaccaccattatctctcacctggattactatagtaacctcctatcttgtctctcagttacccttttacacatccttttgcagtcttttccaaacagcctgagtgatcccttcaaaaagtaagtgaaatattttactactttgctgaggactctccagtggctcttcatttcactcagtttaaaagccactggcctaaaagggcgtataggatctgaccacctgttagttttttctgtgttacctttctacttttattcttttctttagtctttccacttctattcttttctttagtctctccacttcagccacactgacctcattgctgttcctggtacatgcagatgggctttcaccttaggatttgtgcactgatgattctctctgcctagaatactctttcctcaggagtcacatgaccaaattccctcaaatgtcaccttctcaaacgactgtaattaaaattacagcctcttctccttttcacatacacccttcccctatatactcctaatcctctttgcctgttctgtttctttcctatagcatttattgctgtttaaggtaattcttaatttatgtattgtgttaacatttgtctttctcctcgtttgaataagtttcacttgttagaagggcaggattttcatctattaggtttgtttaccgatatatttcaagtacctagaatagtgccttgcacattgtaagtgcccaatgaatatttgttgaatgaaagaagaatgcaagcctttctttttttctttttttttttttaatttatttattttttattgatcattcttgggtgtttctcacagagggggatttggcagggtcacaggacaatagtggagggaaggtcagcagataaacaagtgaacaaaggtctctggttttcctaggcggaggaccctgtggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatatttcttagtacagaacaaaatgaaaagtctcctgtgtctacctcctactacacaaacacggcaaccatccgatttctcactcttttccccactttctactccacaaaaccgccattgtcatcatggcccgttctcaatgagctgccgggcacacctcccagacggggtggtggccgggcagaggggctcctcacttcccagtaggggcggccgggcagaggcgccccccacctcccggacggagcggctggccgggcggggggctgacccccccacctccctcccggacggggcggctggccgggcagaggggctcctcacttcccagtaggggcggccgggcagaggcgccccccacctcccagacggggcggctggccgggcagggggctgacccccccacctccctcccggacggggcgactggccaggcggggggctgacccccccacctccctcccggatggggcggctggccgggcagaggggctcctcactttccagtaggggtggctgggcagaggcgcccctcacctcccggacggggcggctggccgggcggggagctgacccccccacctccctcccggacggggcggctggccgggcggggggctgacccccccacctccctcccggacggggcggctggccgggcggggggctgacccccccacctccctcccggacagggtggctggccgggcagaggggctcctcacttcccagtaggggcggccgggcagaggcgcccctcacctcccggacggggtggctggccgggcggggggctgacccccccacctccctcccggacggggcagctggccgggcagaggggctcctcacttcccagtaggggcggctgggcggaggctcccctctcctcccggacggggtggctggccaggcggggggctgacccccccacctccctcctggacggggcggctggcctagcggtgggtgacctccacctccttcctggacggggtggctgccgggcggtgacgctcctcacttctcagacggggcggcttcgggggggaggggctcctcacttctcagacggggcggccgggcagagacgctcctcacctcccagacggggttgcggccgggtagaggtgctcctcacatcccagacggggcggcggggcagaggcgctccccacatctcagacgatgggcggccaggcagagacgctcctcacttcctagatgggatggcggccgggaagaggcgctcctcacttcctagatgggatggtggctgggaagaggtgctcctcactttctagatgggatggcggccgggcagagacgctcctcactttccagactgggcagccaggcagaggggctcctcacgtcccagatgatgggcggccaggcagagaggctcctcacttcccagacggggtggcggccgggcagaggctgcaatctcggcactttgggaggccaaggcaggcggctgggaggtggaggttgtagtgagccgagatcacgccactgcactccagcctgggcaacatcgagcactgagtgaaccagactccatctgcaatcccggcacctcgggaggccgaggctggccggatcactcacggttaggagctggagaccagcccgtccaacacagcgaaaccccgtctccaccaaaaaaatacgaaaaccagtcaggcgtggcggcgcgtgcctgcaatcgcaggcactcagcaagctgaggcaggagaatcaggcagggaggttgcagtgagccgagatggcagcagtacagtccagcttcagctcggtatcagagggagaccgtggaaagagagggagagggagaccgtggggagagggagagggggagggggagggggagggagagggccgcgtgtaacctttgtaacttcacttcagcctctgaatgcaagcctttcaagattgaatagatattaaatgtgataatgtacttgtatgggcctcaaacaatgactgacattttgtacatgttcagtaaatttgctctttttctttctctatttcttaattacttgggatatctggaagtgtacagagtgctgtagatttctagatagcttgttttattccagtgttcttggtggagcctttgtggctgaatccagcttttccctcatgcttctttttgccttcttcctctatccaacagaggtggtgggaagaattagaattaaagcaggaggaagggaaaagaaatcttagctttttgtagatgggtgaaaaattggttagacttcagcttttaatgatctttcagtttagtaggtctcatatttttcaccatatgttattttctgattcacagtttctggtatatagttgatgcttaacaaatttttggatgattgttttccatttgttttgtggaatcgatctttccaaacatagcaggtcttttctattgattaaaataagtaaaagagtctgaaaactagaggtttagttcagaatgctgagcaaaatctggtattgtcatatgacgcatgggccaaggggagaaaatatagttacacagtgaatcagaaatagacaagttttggcaaggacaaggtatttgaaaaagtatagccctttaggttttataaagctttttctgttgttgttttattcttataaaactcttttgttatgccagtattataatgggaagctgaggctcggtgtggtgatatatcctgtacaaggtcaaacagtaagtatcagttcgtcttaacagacaaatttcgtgttcattctggtaagacaaggaaacaggacaacaacaacaataacgaaacaatgttctgaggcatttatgctgggttcatgtactggtgtgcataccatacatcatatcctttctctgatcctgataacctttcacagggtgatggttatgatacttaaaaatgagataataaatataaaagtgccataaaacattgtgttgttggtattattattccatcataggatagcaagtaataatacaggcatactttgttttagttcacctcatggatattgcatttttcacaaattgaaggtttgtggcaaccttttatccagcagacttgttggtatcattttttttttaacaacgtgtactcacttcgtgtttctgtgtcatgtttttgtaattctcctagtatttcagcctttttcattatcatatctgttatggtgatctgtgatcagtgatttttgatgttactattgtaattttttttttttttttttttgagatggagtctcgctctgtcgcccagtctggagtgcaatggcacgatctcggctcactgcaacctcttcctcccaggttcaagagattcttctgcctcagcctcccatgtagctgggattacgggcgcccactaccatgcctggctaatttttgtatttttagtagagatggggtttcaccatgttggccaggctggtttcgaactcctgacctcagatgatccacctgcctcagcctcccaaagtgctgggattacaggcgtgagccattgcacccagcctactattgtaattgttttggggagccatgaactgtgtccatataatatggtgaacataatatgtgaattctgactcttccaccgacgagcagtttccccatctctctcgctgtctcctcaggcttccctattccctgagatacaaaatattccctgagtattgaaattaggccagataataatcctacagtggcctctaggtgttcaagatctagagatcctgatttaatgtgagacacatccctcagattaaatcaaaagctagaaatggttaagcttagtgaggaaggaatactaaaaactgagacaggtggaaaggtaggcctcttgtgccaaatagccaagttgtgaatacaaaggaaaaattattttaaaaaatagcagagaacatttattctgagagatttgtatattatacttctgaggatctaagagaaaataacaaattttcatatttcagttaaatttatggaaatacaaatggtagcatctgtattcctaccatttctgactttttacgtgctctcattttattggtttcactttttatactatatctctaaggataatgtatctaaatatatgtattatgtgttaatttatatataaataaaagttatcatatacttccatggtatgattatagagaaaaatttttacattagaatgtgtctaaagtttttttcttaacttttattttagttttggggtacatgtacagattcattatattggtaagttgtgtgtcacagggggttggtgaacagattattttgtcacctggaaaaattattgaaggaaatataaagtgctactccagtgaatacacaaatgataagaaagcaaaacagccatatcgctgatatgaagaaagtttgagtagcctggatagaagatcaaacaagccacaacattttgttaagccaaagcttaatccagagcaaggttctaactcttctcaattctgtgaaggtcaagagtggtatggaaattgcaggagaaacattgggagctggctagaggttgattcgtgaggtataagaaaagaagccatttccattacatgaaaatgcaaagtgaagcagaaagtgttgatgtgatacttgcagcaaattatatagaaaatctagttaagatcattgattaaggtggctacgaaactacagattttcaatatagatgaagcagccttatatattgaaagaagatgccatctagtgtcttcatagctagacaggaaaaaaaagcttcaaaggacatgctgagtctctcattaggggttaatggagctagtgactttaagttgaagccagtgcttatttcctattctgaaatcctgtgccattaaaaatgatgctaagtcattctgcctgtgctgtataaagggaacaacaaagcctgaatgatggcacatttgtttacggcatggtttactaaatattttaagcctattattgatacctactgctcagaaagaaagctttatttcaaagtattactacttattgataatgtacctagtcacccaagagctcagatagagatatacaaggagattaatgttttcatgcctgctaacccaacatccattttgcagcccatggatcaaggagtaatttcagctttcaattcatattaagaaatacattttgaaaggctatatagctaccatagatagtaattcctttgatggatctgagcaaagtaagtgaaaaaccttccggaaggaattcagcattcttgataccattcagaacaatcatgattcatgcgaggaggtcaaaatgtcaacattaacagtaatttggaagaagttgaatccacccatcaagacttcactgatggatgtggtggaaatagcaagagaactagaattagagatggagcctgaagatgtgactgaattgctgcagtctcatgataaaactggaatggatgaagagttgcttcttatggataagtaaagaaagtggtttcttgagatggaatctactcctggtgataatgctatagacattgttgaagtgacaacaaagggttttaattattacatgaacttagttgataaagcagtagcagggtttgagaggattgacagcaattttgaaagaagttcttctgtcagtaaaattctatcaaacagcattgcctgctacagataaatattttgtaaaaagaagagtcaactgatgcagcaacttcattgtggttttattttaagaaattgccacagccaccccaaccttcagcagccaccaccctgatcagtcagcagctatatacattgaggcaagactctccaccagcaaaaagattatgattcactgatggcttggaggatggttagcatttttttagcagtaaggtttttttttgttgttgttgtttttttttgagacggagtctcactctgtcgcccaggctggagtgcagtggcacgatctcggctcactgcaagctccacctcctgggttcacgccattctcttgcctcagcctcccgagtagctgggactacaggtgcccgccaccacgcctggctaattttttgtattttttagtagggatggagtttcaccgtgttagccaggatggtctcgatctcctgaccttgtgatccacccatctcggcctcccaaagtgctgggattacaggcgtgagccaccacgcccggccagcagtaaggtatttttaaattaaggtatgtgcattgtgtttttagatataatgcttttgcactcttaatagaatacagtattgtataaacaaacatttatatgcactggaaaagcagccagttggtctttaaaattcctttaccctgtctttcagtaacactactctttccttgtttatcactgatctttgtagccactcattctctacagaatttttcttcctctgtgtggtcttaaatatctgtgttttttgtagttcatccctggtccttagcccattttactctagatgtcattttgaggtaacctttcctatacttgatactgcctcctatatctaagtcttgagctagaaagtttgttgctcttcggatattcacattgtgttctccattcactttttgacttggttatcctctagacacctgtattagtccattcttgcacggctataaagaagttcttgggactgggtaattgataaagaaaagaggtttaattggctcagtgctccacaggctgtacaggaagcatagctggtgaggcttcaggaaaatttcagtcatggcggaagatgaaggggaagcaggcatgtcttacatggccagagcaggaggaagagaaagaaggaggaggtgctacacagttttaaacaaccagatctcgtgagaactcactaagtatcactagaacagcaagggggaatccatctccatgattcaatcacctcccaccaggccactcttccaacattggggattacaattctgcatgaaatttgggcagggatacaaatcaaaaccgtatcagcaccccttcatgccccaaagagaaaccaacctttatctttgaaaccttgtcactgaagctcccagcctggttaagagggacttctgattctataatctaaaaatcatgaagtcatcttagacacctccctttcatttttccccacatctacttactcattaatgtctggctccctagtatgcctggaaatctgtttactttcctggtttttattctgtataatcactatcatgagcaaaataagaacagtcccatctcatcagaaagttatttcatacctgacactttctacttcactgttcccatctcattttctaactcatcctgcttccagcttctaatttccaatgtaagaccttacaactaaataactgcatttactcactcccctagtgtgatttttaaatcacattttaaacttttatatacgttataagccctactttacagtgttttattttgctttaaacagttatttgatttttaagtgaattatgagaaaggaaacagtttttgtgtttaccaatttatttaccatttctgaagctcttttttcctttctgtaagtctacatatccatttgatagaatttgtctttggtctgaagaacactcttcagcatttcttacaatgtagattgactggcaagcattctctcagcttttgtttagctaaaaatgtctttattccaccctcatttctgaaggatatttattattgatgaatataaaattctaggtcgatagccttcaccccccaagtactttaaagatatcattttactgttttctgacttccagtgagaggctgggaataattcttatttctcccatacatgatgtctccctgcctccctttctttttgtcccttttctggctgctttcaagattttttcttacttttgtttttaatcaattgattaaaactgtattgattctaatgtatctcagtgtggttctctttatatttatcctgtttgggattggctaaacttctttttttttttcttttttcttttcttttcttttttctttttttagacaagagtttcgttgttgtttcccaggctggagtgcagtggcacgatcttggctcactgtaacctccgcctcccaggttcaagcgattccctgcctcagcctctcaagtagctgggattacaggtgcccgctaccatgcccggctaattttttctatttttattagagaaggggttttaccacattggccaggctggtctcgaacttttgacctcaggcaatctgcccgcctcggcctctcaaagtgctaggattataggcatgagctaccgcacctggccctaaacttcttaaaagttggtgtttttcatcatatttgagaactttctagtcactatttttaaaatattctgccccagtctcactcttttctcctctaggatcacagttacatatatttcaaacaatatgaaattgtcccaatggcctctgaagcttcatttatttctcttcagccttttatctctctgtcaggttagagaattttgattgattggtcttcaacttcacttttcctgccaacgtcaatatactgttaatcctctccaataatattttaattttaattattgtactttttttttttgagccagagtctcactctgtcaccaggctggagtgcagtggtgcgatctctgttcactgcaacttctgcctcccgggttcaagcaattctcctgcgtcagcctcctgagtagctgggactacaggcatgggccaccacgcccgcctaatttttgtagttttagtagagacggggtttcaccttgttggccaggatggtctccatctcttgacctcatgatcctcctgcctcggcttcccaaagtgctgggattacaggcatgagccaccacccccagcctcagttattgtactcttaagctctggaattttcatttagttcctctttatggtttccattttgttaatttctcagttaatctaaattattgatttttaacgtgatagtttctttgactctatcttctctttgtttaatttcatcaaaaatcctcttatttcatcttattatgaaatgattctagatacaatttaatataaattaacaatatttggctgcttatctgaaagtttatattttggaattttttttacttttctgaaccttctgtgggtttttatgcttgaaaatagcatggacttatttgtgccaggatgcatatgtgatcaagggcagagatagggatagaaataaaattaaggttaggttctatagaacaacagccagtgagacaagtaggactgtggcttcaataaagtcttaaattgagtataagtggcagtggattacattttgctcttatatttttgtattcgtccattctcacactgctataaaggatactacctgagactcggtaatttataaaggaaagagatttaattgactcacagttgcacatggctagggaggcctcaggaaacttataatcgtggcggaaggcaaaggggtagcaaggaccttcttcacatggtggcaggagagagtggaatgagagcacaggaaaaactatcatttataaaaccatcagatctcataagaattcattcgctatcacaagtacagcatggaggaaccaccctcataatccaatcacttcccaacagtttcctcccttaatacccggggattacaattcaagatgagacttggatacaaagctaaaccatatcagctgtcaattatatagtcagggaatcatagacttttagtacttgtacaaactttagaaatgatcctctaacaagctcattttcatactgataaaatgtgtgtgctaggatttcatacatgctgggttgaatgggtaggtgataggtacctccaatgtggactgttaggccaagaatgttacattatgaagggcattttaaattaggatgtgaagcaaatgcttgaagtagaagccttcatatattctagtacccaaagatactatgacagttgccatgaaggaaccttataaagctctcagccaatatatggcagataatattaatgtatagcttcagaatattggaactaaagtagattcataatttgcaggataaacaggtcaccagtttaaaaacagaaaaaaatccccacaaaaaaaacaaaagaagcgtaagtacttaacgtttattgtgtcacagaaatctgtagcagattctgaacatatggtaggttacatagatggtatattatgcatatggtatatatataacatacatatttacttatggacacatatttgcctaaattgcattaagttctataatattactgagtaataattttcctccttttctgtattgatacagcatctgtaaatgcttatcaataggcaaatgaagtgaatattttgcagatgtctacagtttatcactgtctccctcacatctatcacaatgtgtggcgtatggtaggtgcttaataaatatttgttgaatgagttaatgaatgtgtcctatgattgcccccccgcaacccacgctgccttttgaaagactcattgctttgaaagaatatgtagaaagatggatttcatttttatactgatggtactaccaaatacattatcattgtaaagttcagcgataagacaaaaaaagaaaaaaaatcctgtgaaatagaactgttatcccctaacctttaggtttgtcttagtgtttgggatttctcctgagtcatcttaggagaacactaacttatctgttagtgaacaagtaataactaaagcatttttatgtgatgggtaactaaagttttgagactttaaaaaaacccctactttaatggttttcatttattttggtaatcattttctaccttatattgtttattatttatgtgtttcatgtgcagtctttgcttagcaatggggatgtattctgagaaatacataatttggcgatttcatcattgtttgaacatcatagaatgtacttacacaaacctagatagtatagcctactacacacctaggctatatgttatagcctattgctcttagactacaaacctgtataaatgttactgtactgagtgctgtaggcagttgcaacacagtggtatttgtgtatctgaagattctaaatatagataagatacagtaaaaatatgatgttataatcttatgagaccaccatcatatatgtggtccatcattgaccaatatgtcattatgtggtacatgactgtatatgaatattattcaactagattgcatacttcttaagtataaagaccctcttttacacaattttttgccatatagcatagtattattcatgtagttgatggtcagtacatcataagatttaaaaggtggttgcagaacacaactattatccttgaaactctgttgatctttaagctttgactctaaagagatgtcgttaatggtttttccatccagttctctttctaagggaaacaacttctgtactcttggttcctgccaaagaggtatgcccaaaaaactaagggtatggaaatagaaacaactaggaatatccaaataatcctgctagatatttagttttaggtacacattctgatctataaaatgaaatgaaactatttatattcacatcagtgaattttgagaaatgagtgtaagtgatagagccaaaacttttggtcccataattatttatgcctgcatttaagaactagttttaaaaatatgtttatataattttatattaaatatatatcattgaattaattgaggatttacagaagtactttatattgacttatttcattataattttaaattggtgtttcttcatggcaactgttatagtatctttgggtcctagaatacacaaaggcttctacttcaagcatttgctacacatactaattaaaaaacaaaaacaaaaacaacctgataggctgagtgcagttgctcatgcctctaattcctgaactttgggagccaagacaggaggattgctgagcccaggagtttgagacctgcttggccaagatgacaagaccgtttctatacaaaaataaaactaaaaaataaaattagctgggcgtggtgacgtgtgcatgtagtcccagttactcaggaggctgaggctggaggatttctggagcccaggagtttgaggtggtagtaagctaagatatggccactgtactccagcctgggcaacaaagcatgaccctgtctgaaatagatagatagatagatacataggtaggtagatagatagatagatagatagatagatagatagatagatagatagaatgaatttaatgagcgctaagatataaaagagtattttcccaaattttgttgagaatataataataaaatgatggtttaatggaggggaacttataatttaagtgaaagaccagtcattatgaatttaagtgaacattcagtgagatactttgtacttacaagtagaatgcttatttgaattatctttagaaatcatatctttaagaatttgtcttcagttatattggcagaattctgatgattttaagaaatattcccttttaagggaaaataagttacttttttgcattaaatcataagttagaacatactacataattattaaaggtatatataactttttttctcagagccttcatgttttctcatgaataagaccaaagtgttaagttacaagaaaggtagttgagggctgtcacattatctgtatgttcccctctggattctgcttaaatgtggttaaacaaggctgccatcagaaatcaccttgacttttaaaagtgtgtctgatttcagaattatgcatggaatgaatttcttaaaagttatttattacttattatatgagttattaatacaatctagtagttgtagaattctaaattatgataaccttcttgcccttgattctcatttttgtttgagaatgtttctttgccctggctgcaatttataatatggtgctaattactattcacttgagacaacatttgatgtttttaagtatataattattattttaggagtagtttagtagctcctttgaaaagttacaaaaaccttctcaatgaaaatattttctctttaaaaacctgagaaaatgatttttttcctaaaacaaaactcctaaatcaaagtgggatgggtctccagttgaagagttggtagtctttaccacagtaggctagtaagcgtcagtgtataagatactgtataagcttatagcttcctgaggaactatagcatcatgatagtatatactcccagtcagaatttattttcaggaatgacataaataccttgttataactgatattttgtacaaagaatactgaaatacagtgaggaaaatacatagagaagacaacactgattactgaagatcaaaaatttttttatatgaaattctgtaatctgaacaaatgaagaggcaaggtgtcagaaagtgaaaaataatctgattttactatctgtatcttatataatgatattcatcaaacccctgtatatttttttatgtcataggcctccattcaataagtctttaatgtgctcttagtcttgatatgtaatcctactgttaaaggctttattacatgttttaagtcattcttactttactttttaattgcttatgtcatttaatatagagttcattctgtaaatgtaattaggtaatgctattcttactaagttaatcttgaattaacagcttttcttttttattattttattttattattattatactttaagttttagggtacctgtgcacaatgtgcaggttagttacatatgtatacatgtgccatgctggtgtgctgcacccattaacctgtcatttagcattaggtgtatctcctaatgctatccctcccccctcccccaaccccacaacagtccccagagtgtgttgttccccttcctgtgtccatgtgttctcattgttcaattcccacctatgagtgagaatatgtggtgtttggttttttgtccttgcgatagtttactgagaatgatgatttccaatttcatccatgtccctacaaaggacatgaactcatcattttttatggctgcatagtattccatggtgtatatattgccacattttcttaattcagtctatcattgttggacatttggcttggttccaagtctttgctattgtgaatagtaccgcaataaacatatgtgtgcatgtgtctttatagcagcatgatttatagtcctttgggtatatacccagtaatgggatggctgggtcaaatggtatttctatttctagatccctgaggaatcaccacactgacttccacaatggtggaactagtttacagtcccaccaacagtgtaaaagtgttcgtatttctccacatcctctccagcacctgttgtttcctgactttttaatgattgccattctaactggtgtgagatggtatctcattgtggttttgatttgcatttctctgatggtcagtgatgatgagcattttttcatgtgttttttggctgcataaatgtcttcttttgagaagtgtctgttcatgtcctacacccagtttttgatgtggttgtttgtttttttcttgtaaatttgtttgagttcattgaagattctggatattagccccttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgtctgtgtcctgaatggtaatgcctaggtttttttctagggtttttacagttttaggtctaacatgtaagtctttaatccatcttgaattaatttttgtataaggtgtaaggaagggatccagtttcagctttctccatatggctagctagttttcccagcagcatttattaaatagggaatcctttccccattgcttgtttttgtcaggtttgtcaaagatcagatagttgtagatatgcggcgttatttctgagggctccgttctgttccattggtctatatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttaatggggatggcattgaatctgtaaattaccttgggcagtttggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagccattgtgattgggagttcactcatgatttggctctctgtttgtctgttattggtgtataagaatgcttgtgattttttgcacattgattttgtgtcctgagactttgctgaagttgcttatcagcttaaggagattttgggctgagacaaaggggttttctagatatgcgatcatgtcatctgcaaacagggacaatttgacttcctcttttcctaattgaataccctttatttccttctcctgcctgattgttctggccagaacttccaacactatgttgaataggagtggtgagagagggcatccctatcttgtgccagttttcaaagggaatgcttccagtttttgcccattcggtatgatatcagctgtgggtttgtcatagatagctcttattattttgaaatacatcccatcattacctaatttattgagagtttttagtatgaaaggttgttgaattttgtcaaaggccttttctgcatctattgagataatcatgtggtttttgtctctggttctgtttatatgctggattacatttattgatttgcatatgttgaaccagccttgcatcccagggatgaagcccacttgatcatgatggataagctttttgatgtgctgctggattcggtttgccagtattttattgaggatttttgcatcaatgttcatcaaggatattggtctaaaatctcttttttggttgtgtctctgcccggctttggtatcaggatgatgctggcctcataaaatgaggtagggaggattccctctttttctattgattggaatagtttcagaaggaatggtaccagttcctccttgtacctctggtagaattcggctgaatccatctggtcctggactctttttggttgataagctattgattattgccacaatttcagagcctgttattggtctattctgtattctgtcgaatcctgaggtttcttgaatctgaggtagcatggactaaaattgccattttatttcctaacagttgcctcacagatttcattttacatataaggaaattggtgcccagatgttgaagaaatagggtacccaggtttacacaaatatttagctattggactgtaactagaatatagtttatcttatatctagttttaatctatatatgtgtattatttctagaattaggctgagtaaattgacattaatttaaaaaacaaaagttactatacttttagttttctattgttatacaaaattaccataaatgttgtgccttaagcaataaaaatttgttattatgtagttctgaagatcagaggtccaatacaggtctcagggctaaaatcaaggtgtcaatagggctgcatttctttctgggggctcgcagggagaatccagttccttgccatttccaccttctagaggctgcctgcataccttagctcatggcctcttttcttccttcttcaaagccaacaatgatgggttgagtccttctcacactgccatttgccctattctctttctttgaaaacaattgggaaagggtctctcttttaaggactcgtgatgagattgggccaacacagataatccaagataatctccacatctcaaaatccttagtattaattgtatttgctacatgaagggaagaaaaaatgtccttttttcctccctctactctcctaagttctgtctctggggtcctgtaaattagactgataagagacagattaagtttcagttagatgaataaattctgcggatctatttcagtgtgatgactctagtattgtatacttgaaaattattcagacagtaggtcttaaatgtacttaccacagaaaataagtttgtgaggtgatggatacattaattagcttgatttaatcatttttacaatatatacatatatcaaaacatcacattgtgcattataagtatatccaatttttatttgtcaattgtaccttaacaaaatttggggtgggggaaacagataagagaaaatgaaacaaatttattaacatgtggattgcttatacacaggagagtactcaatgattagtaactcaaagcgtttgttggaatttgggcttacgtatccttttaaccaaagaataattttgtagagggaagacaggacgaaggaaagggactttgagctactaagaacagcaaattgtaggataataaatatacgcgggaaatcaatggaagataagggatagtatggtttgctcagtagattcttctagtgctgtcttttggctgataaggttctggaattgtctttggtgataaagtatcaactaagaatcgaatagtcctgccctttctagtagagaggaggagggcagaggattttgtgtctgtgtgtgtgtgtgtttgtgtgtgtgtgtgcgcaaacttgccttttcttaattgacgttagctcaaaataatccttatgcgaaagtggcgtattttggggtggcatactctgaattccttgatgtgtaagatatattcacaggttctagagattaggacatcgacagctttcgtggggagatattctgcctacaaactatgcatttaaaattcattttctcctttaagggattttattggtataaatatataatctatgaagaacttatgaaataagttttaatgctctagacctctcaaataataacttttaattattagactaataaacgtagtttcttgaatgctagaaatatgattttcaaaaataatatggggtgtaacatctaatgtgactaacttttcacaatgtattaagatgtaatttaagcttcgtatcacatgtgtaggggttgctacatggtgggtttactatatatgtacctgattcttttttgataggtctactggtccaaaggcaagaatgaagagttctttctgtattatttttgaatactagatttcatcttaatgacttcactccttttccttttagctctctaaatttttcttgtggggctggttttatgctcatttgagcattcacatgttcattcagccagagcttaatttaggaccaatcctttctctaaaggaaatgtaagcaatcctaagctagtaactaagctggttgttatagtctcattttacattccaattctaatgtctttctttatttcttatgaccaaacctttttctagtagttcattttcagtatcccgtctgatttactaccatatctttgtgtagaaaaaactgctgctaaaacttaggcctcatggctggttttttatttttattttttttcttggccaacttaatcttgctaattctgattgcttgcatttccattcactggatgcttatcattctcttaagtgatggtaatttctagtctggcttttcttgcttactgacaaaaccttggttctgatattcagagtttaattcatagaccatagcaagtttttgtcttagtgttttgcattactattatggtaagtacacagtaagcgtttgatgaatacttgcatgtttcatttgaaacattcagagggcatgaacgtatatgactctctaatgatttctgaagttcccattcatcttcatacatctggggaattgatagctatctctatgtaaatgtgattccttattaaattatagggagattgggtttaaaaaaataactgtccttatctaccctggtggttcttagatttttggattttatggactagtaaaatgtatttaaaaatttggaggatgtacaaagaagtgtaactttttatatttctaaataagagcataataaaattaaactataatcagctctcaccatgatatcataaaggaacatttgaatatcaaaaaacttggaaagacaaagtcactgaataaaaaaattttataaattcaataaatttagctttatacaaaaactcaatatattatcttttacttttccatgtttacttagaatgactaaaacttgctttaaaaaatgggtcttgggtaatgctaatatagtcatcccttttatttaagtagggcctgagactttcctaaatcctaaaactagccaatgattgaaagcaaggagtaggaggtatttaaagtatagtcttttgcttaggatggtttcctttgaacacaaatccaacattttgatatatgtagcaaataacaatttatcatttctgcatcctttcttttccatttcttacaaaaatatcagtggttccaggtcactgtgaggtaggtatagtaagattttgtgtgtgtgcgtgtgcatgcatatgttcacgtgtttggtggtatgcataaaagtggttgtgtgtgcatgcatatttcagtgtgtcatacacaccctactatcaaataatattatcattaagcctcaattttaggtagccactatgaacctggatcttgggaatatggcctttactagtgttcttgtccttcttcctgttgtgatgctgggactagcatgtatttatgttcctccccaagaagtggagttacctctttgcccatgtttttctctcttagcttcagtgagtttccaccaagctatgatactgatgcacttcctcctaaaaataaaggattttgttgcttagaggacatgggccagatgggtcttggcagcatttctcacctagtttcaatgagatttcaccagtgccctcagatacaggtttgcaggttaaggattttgttttgtaggagagataggatagatggttctgagtggctttcaacactgactactattctcttttagccagcagtgagtagcttactcagaattgtcccctatctgtgtgtgtgtgtgtgtgttttgaggtggggtctcactctgttgcccaggccgcagcagtgtatggctggatcacagtttatggcagctttgacctcccaggctcaagtgattctctcatctcagcctcccgagtagccaggactacagacatgcaccaccacacccagctaattttataattttttggaagagacagggtctcgctttgttgcccaagctggtcttgaactcttgggctcaagtgatcctcctgccttggccccttaaagtactggaattataggtgtgagccaccgtgcctggcctttatatataatttgattacaaatttactgaccacatgtggttgttaggactaaaataatcaatgtaaaaggattatataaagtgataatgattattactgtcctaatcacagttattatggttccaatatttaaaaatcaagaaagcagtagcaaaggatattatgtaatatatgtgtgaactaacagatattaacttactttttgcaattttatctttgtcatttcaccacacttaacatgaataatctgatatttaaaataggtaagtatgtactggagacagagtttcagatttgaaaaattattttaagactttcaggaaaaagaaacaatataagagcaaaaccaaaagtaaaaagaaaattcttttttttttttgctttctatctattcattttaagatcttctgtttctttcttatactatcagtttatcaatcctaaatattcttcttaccttcatcaagagtgatgataattttagcacttactgaactcatcatttcatgtcatttttcaaaaagtctacttccatctccctactattaccttttatattactaggaatttagttaattcatcttattgccttggagaaccttaaacttaaagcatctttgatgtttgagtatctatagcctacttaaaaaaaacctaaaggaagaaatgccaccattttgctgtactctattcaggtgtttaacagccctaattgaatagatgtttcctttaatcaaataggcttactagaaacataaattctaggctctgagattttttgttttttttaattttgcagctgacatgagaggacagctgtgctgttttatgaaggaataaaataccgaggaattgtattgacagggtctgtaacacaaaggcagttggtaaatactttcttattgtctacattttttgtagtctgagttgtatgctttccctacaccatgttgacttactgtaagtgttttaaccccactagacttgaggctccttgagggacagaattttatcttcttcatctgttctttaattatacctagcactgggaggtaattacttaatttttgtttgttggtttgttttctgaactggaggaattgttttgcattttagtggcttaagagtgtttatttacacctaaatattttgcagaatagagcagagaacatcacagtttggggcaaatcactaggtttctcttggcaacacaaggctgttgacatttattaaggagcttgggacttatcagagagttagcttctttagagttctttggaactttggagtatagatttggctgtagatgctgactggaaattaaggtgaaaatgtaatacagtaaccaaaagacgtggcaggttaggttgtctttaaaacagtgtggttggcactatgttttaaaatggagctagcactgctcaggtaggcagggcgtatcaggaaattcatcaagagaaggaattaccatcttgcagcagaattctgtcatttaacatatttttggggcatggatggcatccagtccccagataaaggatgaataagaaaacagaagcaggtaccggagccaaatccatccctagaattttgagcatatagagttggagaaagtggagactccagagcaacagtagagcctagaggcattatcagtcttaggtctttttagcagcgtaggggactttggatggtggcgtagttttggcagcagtggctctaatgctaggccctacaagtagataaggctatttaatactgaattactttcatctgaagtcttccaggggcctgatcattctgtccagatgtggaacaagaaaatgatagatctaggattgttatgattctctttaaaattccctagggatttgtttggatctgggattgtaaagccatagagtacattgtgggttctcagtaaatcctttgagtgaatgaataaatgaaagcagccacttggatctcttatggccagtaatgcaacctggtttatttgtgaattatttccttagggaatgataatctcataacttcagcactcagatataaagtctacaggttaaattaccagtctgggttataggttttattggtattacttttgttgcttttgtttactgatatatgctccactcagtaactaattgtttaatacattttgttgtagaatattatgtttagtgtttaactttattttgtacctttgttaactaggtgtttttttgagtatattgtgggtatacttatgtaccaagtgctgcaagatctataaaaaaatataagatgtattccctgccattaacgagctcaagttagtgtagctaactcaaagaaaggtaggtaactatgccagtcagtaaatgaagagtacgatgagtgatagttaagaagaaaatgtttataagtgcacattcaaaactggatgatgtcagcctagtattttgaaaacattctcaaatattcaatttttaatgcactgttaaaaaataggaagtacttttatttcacattttaattagatgagaataactaatttatttttcattagtggtgttattagagcattaattttccaaaagaaaatttgtagaatgttaatgaagctacagtaggaaataaataaatgttctgtaaataatcattcaccatatttgatatttgattggtttagaacattaatacaaatgttcagaatattgttttgtgtttttggtaaaagcacattagtgttcttggttaggcctgcgtgccttgtttcctgttatggcattttaggccagattattagatctattttgatttaatggtaacagtgccatctactgagtcatcaacatgatataccgtctatatttccagaggaaaaaagaggagaaaatatatggttattcacttatttttgttttttattttatttttaaatttgattgctgctttattcagtctcagaagaaattttaatgaaaaagtatgagtaagcaggtgccttgattctaaaaatttccttggttggaaatagcaattgaactttaaatacattctctttctagtacattaaacagattgaattctatcaaaagcctacttgaactacttatagtatatctcactttatgcatcataatcccatgttttcctactttttatattctctattcctcaaacatatcttttctgcttcctagggcaaagcatttcaaatagattaaataataaataatatattgaatttttatattttcaactcagtgggataattaattatgaaaattattttgacagtccatcatttcttaagttcataagcatgtttataaatgtatgattagattttcccctgaaaagatgttttatagaaaagatatatttccaacaatgaggaatcttgagtaaaatgtattgtgttgtatactgtaactaaatataaatcatattcagcacatgaaatagtatatatttttatatttgtggttcttaattcattactactgagagattacctgtttaaatacttctgtttatagttacagaccttcactgatgaaagaactattctcccttaagaagttaccaaatctgtttttcatgcaaccttaaatcttttagtgttctagggactggattatatacaactgaaagggaaaactgtcactatcattgtgaagctgaattaaaatatagttaatattattttttgtagctcagcaactttttccatttgttaacagatacccttcctctttaacacacacaccattgtgctttctaaaaaaattaggccgaggcggtggctcatgcctgtaatcccagaactttgggaggcggaggcaggcagatcacttgaggtcaggagttcgagaccagcctggccaacatggtgaaaccccatctctactaaaaatataaaaatcagctgagcatggtggggggcccctgtaatcccagctactcaggaggctgaggcaagagaatcgcttgaacctgggaggcggaggttgcagtgagccaagatcatgccattgcacaccagcctaggtgacagagcaagactatctcaaaaaaaaaaaaattaaatttttgtttgacaaaattgtgtatatttatggtatacaacatgttttgttacatatatatatatagtggaatgtctaaatggagctaattaatgtatgcattacctcacatatttatttgttgtgaaaacagttaaatctgttagcaatttgaagtgtacaatatattgttattaactatagtcaccatgatatataatagatctcttgggcttattcttccttttagcagaaattttgtatctgatgaccaacacctcctcaatctcatcctccatccctagcccctgagaaccactattctattctctgcttctctgagtttcacttttttagatttcccatgagtgaaataatattctatttgtttttttgtgcttgttttatttcatttaacaacatggatgaatcttgaggatattatgttgtgaaggacaagatatatatattttttttaaggttgaatagtcttccaatgtatatgtatataccacattttctttatccattcacccattgatggacaattaggttgattccatatcttggctattgtgaataatgctgaaataaaacatgggagtgcagatatctatttgacatactgatttcatgtactttttttttttttttttttttgagatggagtttcgcttcgctctttttgcccaggcttgagtgcagtggtgcaatctctgctcactgcaatctctgcctcccgggttcaagcagttctgctgcttcagcctcccaggtagctgggattaccggtgcctaccaccacgcccagctaattttttgtatttttgggagggacagggtttcactatgttggccaggctggtcttgaactcctgatctcaggcgatccacctgcctcggcctcccaaagtgccgagattacaggcatgatcaccatgcctggcccaatttcatatacttttgatatatacccagaagtgggattattgactcaaagaattgttctatttttaattttttgaggaacccccttactgttttccattgtggctgtactaattcacattcccaccaacagtgtgaaaggatttcattttcttctcatcctcatttacacttattttccatctttttgataatagccattctaacaggtgtgaggtgatatcttattgtggttataatttgtatttccctgatgattagtgatgtggagcattttttcatatacctgttggccatttttatgtccttttttgagaaatgtctttttcaggtctttagcctgttttttaacctggttattttcttgctctttagtagtttgagttccttatatattctggatattaagctcatatcaaacgtatggggtgtattagtccgttttcacactgctataaagaaatacccaagactaggtaatttataaaggaaagaggtttaattgtctcacagttccacatggctagggaggcctcaggaaacttaacaatcatggcagaaggtaaaggggaagcaaagaccttcttcacgtggcaggagagcgaagagagggtgaagtgggaagagccccttagaaaaccatcaggccttatgagaactcactcactatcatgagaacagcatggggaaaactgccctcgtgatccagtcacctcctatcagatccctccattgacacatggggaattacaattcgaaatgagatttgggtggggacacagagccaaaccattatcatatggtttgcaataattttctctcattctgtaggctgtctcttcactctgttgatcatgtaccttgctgggcaaaagacttttagtttgctagaatcccatttgtctatttttgcttttgtttcctgtgcttttggggtcatattcaaaataccattccctactttgggaggctgagtcaggcgaatcacttgaggtcaggagtttgagaccagcctggccaacatggtgaaaccgcgtctctactaaaaatataaaaattagccaggcgtggtggcaggcacctctaatttcagctacttgggaggctgaggcaggagaatcgcttgaacctgggagtcggagcttacagtgagccgagatcgtgccactgcattctagtctgggcaacagagcaagactccgtctcaaaaatgaaaacaaaaaacaaacaaaataccattccctggaccaatgccaggaagcttttcccctaggatttctgccagtggtttcacagtttcaggttgtatatttgagtccttaagccattttgagttgatttgtatatgacgtgagataaaagtccagatttattctactgcatgtggattttcagttttcccaatatcatttgttgaagggactgttctttctccattgtgcattcttgacatctttgtcaaaaatcggttgacttatttctggtctctcttctattctatttgtctatgtgcctgtttttgtgccagtaccatgctgttttgattactgtaggcttgttggagattttcaaatcaggcaatatgatgcatctagctttgtgctttttgctcaagattgttttcctatttaaggtctttggtcgttccatgtgaattttaggatttttctaaatctgtgaaaaatgccattggaattttgacagtggttacgttgaatctgtagatcactttggatagtatggacattttaccagaatttttacaattcatgattactgggtatctctcaatttttctgtgtcttaaatttttttgtgtgcgtgtttcgtacttttcagtgtgcagatttttcaattccttggttaaatttattcctctgtgtgtgtgtgtgtgtgtgtgtgtatacgtctgtttttgtagctatggtaaatggtattgttttttgatttttttcagatattttgttgttagtgtatagaaatgctactgatatttgtacgtggttttggatcttaaaactttactgaatctttggttagttttaacttttttttttgtagagtttagggttttctatacataagatgctgtcagcaaccaaagacaatataacttcttcctttccaattttgatgttttcatttccttttttgcctaatttctctaacaaagacttccattaactacgttgaatagaagtcgtgagagtgggtatgcttgtctagttcctgatcagagaagaaaagctttcaactttctactgttgtgtatgatgttagctgcacacttttcatatatggtctttattgtgttgtggtgcatccttttataacgcattgttttattttccctttgccttcttctttgacacactggttattgaataacctgttgcttaatttccacatagttgtggtttcctaccacatttcatatcattgtggttggaaataataaatgataccatttggatcttcttaaatgtattgaaacttattttgtgggctaacatattacctattatggaatgtttggtgtgcacttgaaaagaatgtggattctgctgcttttggaaggaatattctgtgtatatctgtgaggtccaatttggtccatagtgctgtttgattctgttgtttcattattgattttctcactggatgttctctttattgctgaagctgggatatagatattttctactgttattgttttgctgtctatttctccatcagtcctggtagtatttgtttacatatttaggtggtctgatgttgggtgcatataaacttacaattgttatattttcttgatgaactgaccactttctaattatataataaccttttttttttttttttttctgagacggagtctcgctctgttgcccaggctggagcacagtggtgcgatcttggctcattgcaacctctgcctcttgggttcaagtgattctcctgcctcagccttctgagtagctgggactacaggcaggcgcctgccaccacgcacggctaatttttgtatttttggtagagacggggtttcaccatgttggccaggatggtctcgatatcttgaccttgtgatccacctgcattaccctcccaaagtgctgggattacaggcgtgagccaccatgcccagcctatataatgacttttttttttaatctcttgtgacttaaagtctactttattatgaatacagctactcctgccctcttttggtttccatttccctggggtaccttttgctatcctttcacattcaaccaatttgtgtccttatagacgaaatgaatctcttgtaggcagcatgtagttgagtcttgtttttaattttttttttaaatatccattcagccgctctgtcttttgattcaggaatcagtccatttacaatcaaggtatgtattgataggtaaagatatgctactactaactttgcattttctggtagtttgtagattctttgtttcttatattctggctggctttctttttgatttatttttctgtagtagtatgctttggctcctttctctttattctcttgtatctactacagggtttttctttgtggttactgtgaagcctgtataaaacatcttgtcactctaacagattatttttagctgataattgatttaactttaaccatttactaaaactatatgctaacttctcctttcccccacattttctgttattcatgtcacaatttacatcttttatatattgtgtatccattaacagattattgtatctatggttattttactgcttttcttataactttcatactgtagttaaaagtgatttatgtaccgccattatagtattagagtgttctctatttgagtatattcttagcttacagtgagttttatattttcatatgtttacatgttgctagttagcatcctttactttcaactagatttctctttagcatttcttgtaaggtaggtgtggtggataattttaggtgtcttattgactgcataaggaacatatagggaattggtaaagcattgttttggggcatatccatgaggatgttctagagaagatttgtttgtgtgtctgagtggactaagtgggcaaggtctgctgtcagtgtgggtaggcatcatcctatcgaccatgggctggtagagaacaaaaataagggaaagacaaattggtctctgtctctgtcccagatctgggatatactctcctgttcttgaacattagtactccaggctctctggcctttgtacttcaagagttacacccctcccctgtcctatgttttcaggctgttggacttaggagtcagccatgttaccagcatagagtctgtagcttgcagatgacctgttgtaggatttttcagcctccataattacatgagccaattgccttaataaatctcctctcatatgtctatatttatatctatctatatatacatcctattgattctgtctctgtagagaaccttgactaatacagtgagtctggtaattacgaactctcaaagcttctgtttgtctgagaagatctttatctctcctttattcctgaaggacagcttgctgagtatagtgttcttggttgacagattttttttccctctcactttcagcatttttcagtattctcacatgctctcctagcctgcgaggtttctgctgagaaatccactgatcatcttataatgtttccccttgtatgtggtaggcattttttctcttgcagcataaaaacatttatttttgtctttgccatttgagaatttaattttaatgtatcccaattattttgaattgtcagatggtttgtaaatataaatttctttagagtcatttagtagtacattattttgccagtttttacagactggctttgacagaagaagctctttaccagtcagcctgtccagtgtttctgagtgggcttgctactagaattcttgggaaggctggcttagtgcccatgtcagcagtttgtcaggcctggtgcctgagctcataggagcctgccgggtgcccagacacaaccaggttatgtctgctggagcaggcctggatcctgggtgcctgggggctgtcttggcatcagagtctaatcaagtgggcctgctaactggatttgtaggggcatggaacctgtgtctatggggggctggcctgtcactgggatctactggggtaggcctggtgtctgggtgtctgggatctactggagtggtcctagaggctgcatccgtgggatgggtctagagtctgaatccatgggaactggctggacactggggcaggcctggaactttaatctgcaggagtgggcctgggtttttgatctgtgggagacagactgaagcatgggtccacaggcgtggtcttgggagcctgggcctgttggagtgggcccagcactgggatctactaggcaggcctagatgttgggtctgctggaccctgcctggtgctagggttatcctggagcctggggcttcaggggccagtttggagcctgcagctgtggatgctggcctggtgccttgggttgtatgggccaggttggagtctcattctgtgggcatgggcctggatcctgcatctgtgctggctagcttggaggctggggccacaggagctggcctggtactggtcttgtggtactttttaaaggaagtgtaattcttttataacacaaatgtttggctcttttagctctttaaaaataaacctggatttttttttttcaagagggaaagagtatggcataatggaaggagaaagggactcagagtcagcccaatattaatcatgtctgagccacttattagtggaaagatcttcatcaatttactaatcctctctgtacttttttttttaaatcttggaaatgtgtataataatgccaataatatctctaataacaggggcttcaggattgcaatctgcttagaagagtaggaggctaacatacttatcttaaaaatttatggcaagcatattttctatgcacaatctaagtttatttgggggatttggtggggtaggaaattttggtggaagtaataggaagaaaataccttcacgtcaatcccttagtgctgccagcagaataatgtatttatgtaatcaagactattatgattaagagtagtatatttttagtgagtgctggctatcttctgtatttaattactgaaagagatgaactgtttcaaaatcctctttttctttctagaatgaattccaaccatttaaataattcataatttgaaataacattattcaatttgttcccctattctgatatttaagggtcatgaattgccatgttttccttttcttaaatcaatgtctgtgtcatttacttttactttccttttgataagcagttggacattgatgttataactgaaaaaaatagtctatagcagcgcatctgtaattttcatttcagtttaattgcctaggaatcttgttgactgacgattctgatttagtaggtctaaaggtgggacctgagattctgcatttctaactaactcccagatgctgctcttactagtctatagaccacacttaaaagtggcatgggacttgaaatagtgtaggttatcacaaaattttaaaggtggaaggaactgtacaaagttggtaattcttgggcatacagtgatttcagggtgaggacactaaaacttagagaatccaagggtcttgggataaggtcatgatagctaacagaaccataagaaattcaactcattctatagtttttgtgtgctttctaccacacaccagtgcttcttaagtttcagttatttacatatattatgtaagttcctagataaatctatacagtgaagctgaaatccctggaatgtgctatgttacaattattccttcttcaagtaactgaagacattattaaattatggcaagatttgtcaaccaaagtctcagtgatatctgtacacctacattaaaggaaaatgaatacatatgcaatctgctgtcagaattttaggaatcctgatctttactgttctgataagtctcttctaaaggtgttttagagactgatttttcaatttgattactaaataaagcaaaggaaagaactaaaggaattttgcatgaggagaggacgaatgagatttcactatggacagaattgtgactaaattttaccatatggcctacaatgtctctcccagtcaaggttatatataatgcctctgtactcttctatttcccagtatcatatctggaaccaagacacttggacaggaatcctattttagacagaggactgaaagtagtaaatgtaaatatttttaagacattgcatttgataaggaataaaggaagagtgaatctctgactcatttctcctcaaattattattttgttgtgatttatgaaaattaacaatctgaacaagagaaggaagttatgattaattttggaagattgtaaattgcataccagttttccaatgttagccatttttaatcaactcagtttttaaacaaaaatttataaatatggctgaaccgaagatatctatagagagcttcaacataagatttgatcaagcagaagaaaggatcagtaagctcacagactggttattagaaattacccagtcagaagaacaaaatgaaaaaagaatttaagagtgagaaagtctgtgagaattatggggcagtgaagcaaaccaatctttgcattataggagttccagaaggaacacagagagagaaaggagtagtgaatgtatttaaagaaataatgacagaaaacattcataaactagggacagatataaatgtccacacataggaagctcaaaggtctccagttatgttcagctgaaacaatgctacaataagacttagtaaaactctcagaagcgttaagacaaagagaggatcctgaaagcagcaagagaaaagaagcaaatctcatacgagagaactccattatggctatcattagatttttcaacagaaaccctgcaggtcagggatagagtgaaaaaaaaaaaaaaaaaaagcaaacaaaaatttcttgctcaaagaaagaaaaaaaaaaacaccaggaaccataaagttgtccctcagaaatgaaggagagataaggactttcccagacaaataagaactgaggaagttcactagacttgccttataagaaatgcaaaagggaattctttaagctgaaagaaaaggatggtaattggtaatatgaaaacatataaatgtaaaaaattcactggtgaaagtaagtatgtagtcagattcagaatgctgtatgtaaagctacaatggtggtgtgtaaatcaattatatctttagtaagaaggttaaatataaagtagttaaaataggtatatttacaataattaagtgatatacaatatataaaatgtaaattttgacatcagtaacaatatgttggtgggtaataaaattgtagaattcttgtgtgttattgaagttatcagcttaaaaatagcctgttacaaccgtaatatgttttatgtaagcctcatggtaaccacaaaagaaagagctacagtagatacataggagataagtaagaaatcaaagcataccacaacagagaatcattaaattacaaaggaagacaggtagagtggaagaaaggaacaaaaaatctgcaaagctaccagaaaacaatgaacaaaatggcagttgtatgtctttatctatcaaacaagtagtttaaatgtcaatggattaaattctcccatcaaaagatacagagcagctgaatggattaaaaaaaaaaaagtccaaactatatgctgttaataagagactcatttcatctttaaggacacaaatagactgaaagtgaagaaatgggaaaagatagtctatgaaaatggaaacgaaaagagagcagaggttgttatacttagatgaaatagacattaaataaaaaattgtgagaagaggcacagaagattattatataatgataaaagtgttggttaatcaagaagatacagcaattgtaaacagatatgcacccaatatcagaacacctaaatacataaagcaaatattaatagatctgaagggagagacaagactgcaagacaataatagtataggacttcaatatttcacattcatcaataaacacatcatcgacttagaaaatcaatatggaatttgatttataatttgatatgtggacttcaatcacacagtaaagcaactgtacctaacaaacgtatatcagaatagttcatccaacaacattggaacacacatccttcttaagcatatgctaaacattctccagggtataccacgttagtctagaaaacaaatcgtaacacatttaagaggatttaagtgatatcaagtatcttttttaaccacagtggtatgaaattataaatcattaataggaagaatttcaaaaaattgcaaatatatggaaattaaacaacatgcttctcaataatcagtgggtcaaagaagaaatttaaaggacaataaaacaataccttgacactaatgaaagtggacactcaacatatcaatttgtataggatgcagcaaatcataagagagaagtttatagcaacagatgcctacacataaaagaagaaaaatctcaatctagtgttacacttcaaggaactagaaaaataacacactaagcccatagttagttgaatgaatgaaatattaaaaatcagagcagaaataaatgaagtagaaattataaaagcaatagaagagatcaacaaagctaagagttgtttttttaaaagataaaattgacaaacctttagctagactgaaaaaatagtgaagagttaaagaaaatcagaaatgaaagaggagacattacatcttatatcactggaatatgaaggatcataagagacaactatgagcaatcatatgccaacaaattagataacctaaattcctggaaacatacatcttatcaagactgaatcatgaagaagttgaaaatctgtataaactactaattaaggaagttgaatcagcagtcatagactgcccaaaaaacaacccaggacctgatgcctttactggtgaattctaccaaatatttaaagaataaacaccagtgtttctcaagctctctcaaaaaattgaaaattgatgagagaaaacttcaaactcattttaagaggccatcattaccatgataccgaagtcaaagacactacaagaaaaaaaaatgcaggccaatattgttgatgaagatagatgcagaaattctcaatgaaatactagcaaaccaatacatgaaaaacatcatacaccatgatcaagcaggatttattcctgggatgcatttatgtctgtggttcaacatttacaagttgataaatgtcatacattaatagaataaattacaaaaaccatgtgattatctcaataaatgcagaaaaagcattagagaaactttaacattttttatgataaaaacccgcagcaagttaggtatagagggaatgtacctgaacacaataaaggtcatatatgataggcccaaaattaacgtcatactcaacagtaggaaggtgaagatgtaaaaaaaaaaaaaagatgtaaattactacatgaaatcataaaatattattgggtgatggaataacagtgtagagttactttatgcaatcaaaccaaagttatcagcttaaaatagtctaactgtaagatgtttcatgtaaacctcttgatcactataacgaaaaactatgctagatacacttaagataaaaagtgggaatcagagcatagcactagagaaaatcctctaaccataaaggaagacagcaagaaaggaagaaagaattacaaaacaaccggaaaacaatgaacaatatagcaatagtaaatccttacctataaataattaccttgaatattaatagattaaattcttcaaagaaaagatagtgactgaatcaatcagaaaataagacccaagtatgttctgcctataagagaatcactctcacctttaagggcacatacagattgaatgtgacaggatagaagtagataatccatgctgatggaaaccaaaagaaagcaggagtagctatacttatatcagatgaaatagaatttaaataaaaattataaaaagagacacagaaaaggtcatataatgtaaaggggtcaatttatgaagaagatataacaattgtaaatatatctgcacccaacatcagagtacctaaatatataaagtaaatgttaataaatctgaagaatgagatagactgcaatatagtgtagtagactttagtatgcctctttaaataatgaacagatcatccagacaaaaaatgatatagaacttgaactacatcttagaccaaatgtaacagacgtatatagagcatttcagccttctatccaacagtagcagaatccacatttttctcgagcattttggaaacttccccaggatagatcgtaagtcagaccagaaaataaatctcaacaaatttaagaagattgaaattatgccaaatatcatctccagtcacaatggtatgaaaatagaattcataacagaaggaatattgcaacatttataaatttgcacaaacttacttggccctaaacaaccaagagtaaaactgaaatgggaaattaaagggaaattaaaaatatcttgagacaaatgaaaatactacataacaaaaattatgggatgcaacaaaagcattttattttattttattttattttactttaagttttagggtacatgtgcacaatgtgcaggtttgtgacatatgtatacatgtgccatgttggtgtgctgcacccattaactcatcatttagcattaggtatatctcctaatgctatccctcccctctccccccaccccacaacagtccccagtgtgtgatgttccccttcctgtgtctatgtgttctcattgttcaattcccacctatgagtgagaacatgcagtgtttggttttttgtccttgcgatagtttgctgagaatgatggtttccagcttcatccatgtccctacaaaggacatgaactcatcattttttatggcagcatggtattccatggtgtatatgtgccacattttcttaatccagtctatcattgttggatatttgggttggttccaagtctttgctattgtgaatagtgccgcaataaacatacatgtgcatgtgtctttatagcagcatgatttataatcctttgggtatatacccagtaacgggatggctgggtcaaatggtatttctagttctaaatccctgaggaatcgccacactgacttccacaatggtggaactagtttacaatcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatattctttgcccactttttgatgtggttgtttgtttttttcttgtaaatttgtttgagttcattgaagattctggatattaaccctttgtcagataagcaggttgcaaaaattttctcccaatctgtaggttgcctgttcactctgatggtagtttcttttgctgtgcagaagctctttagtttaattagatcccatttgtcaattttggcttttgttgccattgcttttggtgttttagacatgaagtccttgcccatgtctgtgtcctgaatggtaatgcctaggtttttttctagggtttttacggttttaggtctaacatgtaagtctttaatccatcttgaattaatttttgtataaggtgtaaggaagggatccagtttcagctttctccatatggctagccagttttcccagcagcatttattaaatagggaatcctttccccattgcttgtttttgtcaggtttgtcaaagatcagatagttgtagatatgcggcattatttctgagggctgtgttctgttccagtggtctatatctctgttttggtaccagtaccatgctgttttggttactgtgtccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatactgattcttcctacccatgagcatggaatgttcttccatttgtttgtaacctcttttatttcattgagcagtggtttgtagttctccttgaagaggtccttcacatcccttgtaagttggattcctaggtattttattctctttgtagcaattgtgaatgggagttcactcatgatttggctctctgtttgtctgttattggtgtataagaatgcttgtgattttttgcacattgagtttgtatcctgagactttgctgaagttgcttatcagcttaaggagattttgggctgagacgatggggttttctagttatacaatcttgtcatctgcaaacagggacaatttgacttcctcttttcctaattgaataccctttatttccttctcctgcctgattgttctggccagaacttccaacactatgttgaataggagtggtgagagagggcatccctgtcttgtgccagttttcaaagggaatgcttccagtttctgtccattcagtataatattggctgtgggtttgtcatagatagctcttattattttgagatatgtcccatcaatatctaatttattgagagtttttagcatgaagggttgttgaattttgtggaaggccttttctgcatctattgagatgatcatgtggttttcgtctttggttttgtttatatgctggattacatttattgattttcgtatgttgagccagccttgcatccccgggatgaagcccacttgatcatggtggataagctttttgatgtgctgctggattcggtttgccagtattttattgaggatttttgcatcaatgttcatcaaggatattggtctgaaattctcttttttggttgtgtctctgcccggctttggtatcaggatgatgctggcctcttaaaatgaggtagggaggattccctctttttctattgattggaatagtttcagaaggaatggtaccagttcctccttgtacctctggtggaatttggctgtgaatccatctggtcctggactttttttggttggtaagctattaattattgcctcagtttcagagcctgttattggtctattcagagattcaacttcttcttgatttagtcttgggagggtgtatgtgtccaggaatttatccatttcttctagattttctagtttatttgtgtagaggtgtttatagtattctctgatggtagtttgtatttctgtgggatcggtgatgatatcccctttgttattttttgtcacgtctatttgattcttctctcttttcttctttattagtcttgctagcggtctatcaattttgttgatcttttcaaaaaaccagctcctggattcattgattttttgaagcgttttttgtgtctctatttccttcagttctgctctgatcttatttatttcttgcattctgctagcgtttgaatgtgtttgctcttgcttctctaggtcttttaattgtgatgttagggtgtcaattttagatctttcctgctttctcttgtgggcatttagtgctataaatttccctctacacactgctttaaatgtgtcccagagattctggtatgttttgtctttgttctcgttggtttcaaagaacatctttatttctgcctccatttcgttatgtacccagtagtcattcaggagcaggttgttcagtttccatgtagttgagcagttttgagtgaggttcttaatcctgagttctagtttgattgcactgtggtctgagagacagtttgttataatttctgttcttttacatttgctgaggagtgctttacttccaactatgtggtcaattttggaataggtgtggtgtggtgctgagaagaatatatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggattctaagtctctttgtaggtcactaagaacttgctttatgaatctgggtgctcctgtattgggtgcatatatatttagggtagttagctcttcttgttgaattgatccctttaccattatgtaatggccttctttgtctcttttgctctttgttggtttaaagtctgttttatcagagactaggattgcaaccccttcctttttttgttttccattggtttggtagatcttcctccatccctttattttgagcctatgtgtgtctgcatgtgagatggatttcctgaatacagcacactgatgggtcttgactctgtatccagtttaccagtctgtgtcttttaattggagcatttagcccatttacatttaaggttagtattgttatgtgtgaatttgatcctgtcattatgatgttagctggttattttgctcgttagttgatgcagtttcttcctagccttgatggtctttacagtttggcatgtgtttgcagtgggtggtaccagttgttcctttccatatttagtgcttccttcaggagctcttgtagggcaggcttggtggtgacaacatatctcagcatttgcttatctgtaaaggattttatttctccttcacttatgaagcttagtttggctggatatgaaattctgggttgaaaattcttttctttaagaatattgaatattggcccccactctcttctggcttgtagagtttctgcaacgaaagcatttctaagagaagtttatagcaataaacacacagatcaaaaataagaaagatcccactaaaacagtctaatgctgaacctcaaaggactagaaaaaacaacaatataaatccctagtttatagtagcaaagaaaaaaacaaaggtcagaacagaaataagtgaaatagagactgtaaaacaataggaaagatgaacaaaacagaattgattttttcagaagataaacagttgacaaacttttaactaagaaaaatgacagaagactgaaatatataaaataaaaaatgaaagagtaggcaatacaggagataccacagaaatacagatgacaagagactactgtgaacagttatacacaaacaaattacataacctaaaacacatggatgagatcctggaaatgtacaactaccaagaatgaatcatgaagaaatagaaaagctttacataataacaagtaaggagattaagtcaataataaaaaatagctcttatgtgaaaaagttcaggacttgatggtttcacatctgaactttacaaacatttaaagaagaagtaataccaatgcttctgaaattcttccaaaaaattgaggagtagataaatctttcaaactattttaagaggcctgtatgaccctgataccatagacaaacaagtatattataagaaaaaattaccagccaatattcctgataaacagatgcagatattctcaataaaatactagcaaattaaattcagtaacacattataaggatctgttgtcatgatcaagttggatttatttctgggatgcaagtttggttcaacttatgcaaatcagtggaggtcatacactacattaacaaaaagaaggacaaaaatatggctatctgaatagatgcagaagaggcatttgacaaaatctaaaatattaagtaaagaagattatattagtccattctgacattactataaagaactgtaggagagcagccccagtgcttatagataaaactcccatctccctaggacagagcacctgggggaatgggcggctctgggtgcagcttcggcagacttaaatgttcctgcctgccagctctgaagagagcagcagatcccccagcacagcattcgagctctgctaagggatggactgcctcctcaagtgggtccctgaccctcatgcctcctgactgggagacacctcccagcaagggttgacagacacctcatacaggagagctccgggtggcatctgccaggtgcccctctgggacgaagcttccagaggaaggaacaggtagcaatctttgctgttctgcagcctccgctggtgatacctaggcaaacagggtctggagtggacctccagcaaactagagcagaccttcagcagaggggcctgactgttagaaggaaaactaatgaacagaaaggaatagcatcaacatcaacaaaaaggatgtccaccaagagaccccatcctaaggtcaccaacatcaaagaacaaagatagagaaatccacgaagttgaggaggaaccagcacaaaagactgaaaattccaaaaaccagaatgcctcttctcctccaaagtatcacaactccttgccagcaagggaacaaaactggaatgagaattagtttgatgaattgacaaaattaggcttcagaaggtgggtaataacaaacttctctgagctaaaagagctgttctaacccaatgcaagaagctaagaaccttgaaaaaaagttagatgaattgctaactagagtaaccagtttagagaagaacataagtgaccttatggagctgaaaaacagcacaacaactttgtgaagcatacacaagtatcaataggcgaatcgatcaagcggaagaaatgatatcagagattgaagatcaacttaatgaaataaagtgtgaagacaagattagagaaaaaagaatgaaaaggaaacaagcctccaagaaatatgggactatgtgaaaagaccaaacctatgtttgattggtgtacctgaaagtgacagggagaatggaaccacactggaaatcactcttcaggatattatccaggagaactttcccaacctagcaagacaggccaacattcaaattcagggaatacagagaacaccacaaagatactactagagaagagcaaccccaagacacataatcgtcagattcatcaaggttgaaatgaaggagaaaatgttaagggcagccagagagaaaggtcaggttacccacaaagggaaggccatcagactaacagtggatctctcagtagaaatcctacaagccagaagagagtgggggccaatattcaaccttctgaaaaaaaagaagtttcaacccagaattgcatatccagccaaattaagcttcataagcaaaggagaaataaaatcctttacagacaagcaaatgctgagagattttgtcaccaccaggccttcctcacaagagctcctgatggaagcactaaatatgggaagaaaaaaccggtaccagccactgcaaaaacataccaaattgtaaagtctttcgacactatgaagaaaccgcatcagctaatgggcaaaataaccagctagcatcataatgacaggatcaaattcacacataatatttatataaccttaaatgtaaacaggctaaatgccccaattaaaatacacagactggtaaattggataaagagtcaggacccattgatgtgctgtatttaggagactgatctcaatcctagtctctgaaaaaacagactttaaaccaacaaagataaaaaaaaaagacaaagaagggctttttacatttttacaaagaagggctttaccattacataatggtaaagggatcaatgcaacaagagctaactatcctaaatacatatgcacccaatacaggagcacccagattcataaagcaagttcttagagacctacaaagagacttagactcccacacaataatagtgggagactttaacaccccactgtcaatattagacagctcaatgagacagaaaattaataaggatattcaggatttgaactcagctctggaccaagcggacctaatagacatctacagaactctccacccgaaaccaacagaatatacattcttctcagcaccacatttcacttattctaaaattgaccacatagtggaagtaaaacactcttcagcaaatgcaaaagaatggaaatcataatagtctctcagaccacagtacaatcaaattagaactcaggactaagaaactcactcaaaaccgcgtaactacgtggaaactgagcaacctgctcctgaatgactactgggtaaataacaaaattaaggcagaaatcagtaagttctttgattcctatgaaaacagacacaacatagaggaatctctgggacacagctaaagcagtgtttagagggaaatttatagcactaaatgcccacaggagaaagcgggcaagatctaacatcgacaccctaacatcacaataaaagaactagagaagcaagagcaaacaaattcgaaagctagcagaagacaagaaataactaagatgagagctagagacacaaaaatcccttcaaaaaatcaatgaatcaggagttgcttttttgaaaagattaacaaaatagatcgaaagccagactaataaagaagaaaagagagaagaattaaacagacattataaaaatgataaaggggatatcaccactgatcccacagaaatacaaactaccatcagagaatgatataaacatctctactcaaataaactgcaaaatctagaagaaatggataaattcctggacgcatacaccctcccaagactaaacctggaagaagttgaatccctgaatagaccaataacaagttctgaaattgaggcagtaattaatagcctaccaaccaaaaaatacccaggaccagacagattcacagccaaattctaccagaagtacaaagaggagctggtaccattccttctgaaactgttccaaacaagagaaagagaaggaatcctccctaactcattttttgagaccagtatcatcctgataccaaaacttggcagagacacaacaaaaaaagaaaatttcaggccaatatccctgatatgaacatcaatgcaaaaatcctcaataaaatactggcaaaccgaatccagcagcacatcaaaaatcttatccaccataatcaagtcggctttatctctgggatgcaaggctggtttaacctatgcaaatcaataaacacaatccattatgtaaaccgaagcaacgatgaaaaccacatgattatctcaatagatgcagaaaaggcctccgataaaattcaagagccttcatgctaaaaactctcaataaacttggtattgatgaaacatatctcaaaataataagtgctatttatgacaaacccgcagccaatataatactgaatgggcaaaagctggaagcattccctttgaaaactggcacaaggcaaggatgccctctctcaccactcctattcaacatagtattggaagttctggccagggcaatcaggcaagagaaagaaataaagggtattcaaataggaatagaagacgtcagattgtctctctttgcagataacatgactgtatattttgaaaaccccatcgtctcagcccaaaatctccttaagctgataagcaacttcagcaaactctcaggatacaaaatcaatgtgcaaaaatcacaagaatttctatacatcaataatagagaaacagagagtgaaatcttgagtgaactcccattcacaattgctacaaagagaataaaacactaagaatacaacttacaagggatgtgaaggacctcttcaagtacaactacaaaccactgctcaaggaaataagagaggacacaaagaaatggaaaaacattccaagctcatggataagaagaatcaatatcgtgaaaatgaccatactgcccaaagtaatttatagattaagtgctatcccaatcaagctaccattaactttcttcacagaattagaaaaaactactttaaatttcatatggaaccagaaaagaggctatatagccaagacaatcctaagcaaaaagaacaaagctggaggcatcatgctacctgaattcaaactgtactacaaaggctacagtaactaaaacagcatgttactggtaccaaaacagatatataggctaatggaacagaatggagtccttagacatatcaccacacatctacagccatcttatctttggcaaacttgacaaaagcaatggggaaacgattccctatttaataaatggtgttgggaaaactggctagccatatgcataaaagtgaaactagactccttccttacacctcatacaaaaattaactcaagatggattaaatacttaaatgtaagacctaaaaccataaaaactctagaagaaaacctaggcaataccattcaggacataggcatgggcaaggacttcatgtctaaaacaccaaaagcaatggcagcaaaagccaaaattgataaatgggatctaattaaagtaaagagcttctgcacagcaaaagaaactatcatcacagtgaacaggcagactacagaatgggagaaaatttttgcaatccatccatctgacaaagggccaatatccagaatctagaagaaacttaaacaaatatacaagaaaaaaaaaaaaaccccgtcaagaagtgggcgaaggatagaacagatatttcccagaagaagacatttgtgtggccaaaaaacatatgaaaaaagctcatcatctttcgtcactagagaaatgcaaatcaaaaccacaatgtgataccatctcatgccagttaaaatggctatcattaaaatgtcaggaaactacagatgctggagtggatgtggaacaataggaccacttttacactgttggtcagagtgtgaattagttcaaccattgtggaagacactggtgattcctcaaggatctagaaccagaaataccacttgacccagcagtcccattactgggtatatacccaaaggattataaatcattctactataaggacacatgcacacatacgtttattgcagcaatattcacaatagcaaagacttagaaccaacccaagtgtccatcagtgaaagactggataaatcaaatttggcacatgtacatcatggaatactatggagccataaaaacgatgagttcatgtcctttgcagggacgtggatgaagctggaaactatcattctcagataactaacacagaaagagaaaaccaaacactgcatgttctcactcataaatgggagtcaaacaatgagagcacatggacacagggcgtggaatatcacacactggggcctgtctgggggttgtgggctagggaaaggatagcattaggagaaatacctaatgtagatgacaggttgatgggtgcagcaaaccaccatagcatgtgtatgtatacctatgtaacaaacctgcacgttttgcacatgtatcccagaacttaaagtatttaaaaaaaaaaaaaaacaaacaactgtccgatactgggcaatttatcaataaaagaggtttagttgactcacagttctgcatgcttgtggagccctcaggaaacttacaattatggcagaaggggaagcaggcatgtcttacatggcatcaggcaagagagcatgtaatggaagcaaagggggaagagccccttataaaaccataagatcttatgagaactcactatcatgagaacagcataggggaatccatgcccaagatccagtcacctcccaccaggtctctttctcaacacccagggattacagggattacaatttgagatgagatttgggtggggacacaaagccaaatcatatcaaagatttacctctaaacataataaagacaatataccacaagcccatagtgagtattatgctcagcactgaaaagttgaaggcctttttcctaagatgaggaacaagacatgggtactcaccctcacttttgttcaacacagtactgaaagtactaaccagaacagttaggcaagtcaaagaaataaaaaggattcaaattggaaaggaagaagtaaaattgtctttccttatagataacataaccttatatatagaaaagcttaaagactccaccaaaaacctgttaaaattgattaataaattccataaagttgtagattacaaaatcaacatacaatttttagtagcatttctatacagtaacatcaaattgcctcaaaaggaaattgagaacacaatcctatttacagtagtttcaaaaataaattaggtataaatttacccaaagaggtaaaaactctgtaagcagaaaactataaaccatttatgaaagaaatttagggagataaaataaaaggaaagatatcccatgttcatgaattgaaaggatgaacattgttaaagtgtctctacttcccaaagttatctacagattccatgcaacccccgtcaaaaactccaatgacatattccccagaaatagaaaaaaaaaatcctaaaatttgtatgacatcacaaacacttcaaaatagctagagcaatgttgagtaaaaaggataaaactggaggcctcatagtgcgtgctttgaaaatctactacaaagctgtgttaatcaaaacagcatggtgctggcataaaagcagacacacagacttacaggatagaatggaaaagccagaaaaaaatccacacatttatcgccaattgattgttgataaaaacgccaagatcacacaatgggggaagggcagtctcatcaataaatggtcgtagggaaactgggtgttcacttgcagaagaataatattagactcccatctcacatcatatatatataaatcatctcaaaatggattaaatgcttaaatgtaagacctaaaactgtgaaagtagtaaataaatcataggagaaaagctctctgtcattggtatgatcacacgtactttggatataacccccaaagcacagacgacaaaagtacaaatagacaaataggatgacatcaaactaaaaagcttctgcacagcaaaggaaacagaatgaagagaaaacctgtggaaaaggagaaagtatgtgagaccatatgtctgataaggaattaatatccagaatatatgaggaacttgaaagtaagaaaacaatctgatataaaaacatgcaaaggacctatataaacatttttgaaaataagacatataattggccaacaggtttatgaaaaagtgatgaacattactgatcatcaggaaaatgcaaattataactctaatgagatactgtcttatagctgttagagtggctactttaaaaaagaccgaaggtaagtattagcaaggttatggagaaaagagaacccttgaagactgttggttgggttgtaaattagtattacagccataattgtaaacagtatggaggtatctcaaaaataagaagtagaactatcatgtcatccaacaattttactatttagtgtatgtccaaaggaaatcatatcagtatctcaaagagatgcctgtatttctgtcacggcatccttggagtgttacttttctagctgggaacctctgtggctggtattgcctttgtctgaattttgcttgggcctgcttggcttgttctgcctactctgcctggcaggatacactctgctcgcactaacagcctgccaagggtgagccaggtacggagtggtgaggggtgtgtgagttagcgtgtgatctggccactgcacacagccaggcacactagttgtggtgtggtggacagctccaggtgccggcaccctgcaaggctgtggctcaatgaggcttactgcaagcagcttccatggctgccactggggtaggcagtggtgcctggaagcttggagacttcaggaactgcagagccccattgagggtgtcacagctctggcttggggagctcttaagtctgggctccctgaagtgctacagctcttctctccttcttgtcacctgcaacgtggcaagcaaggggcgtgtttcagccctgtttgtgttactgctctttcagtcgtgccgttccgcaggtcctgagttcttgtcctgtgtccaggaagaatgagttatgtggacaagtggagggtgaacaaggtgaagagatcctttattgagtgacagaacagcttaaaggagacccacagtgggtagctcctctctgcaggcagggcatcctgacaagtgttcagctctcagcagagaggagacccatagtgggtagcttctctccacaggcaggttgtcccatcatctgctcagctctcagcagagaggagaccctcagtgggtggctcttttctgctggcagattgtcctgtcatctgcttgagtttggctgagtccagggtttctatgggcttcagaggggaggaagtgcatgctgattggtccatggaaagccatgggcaggcccagaaaaagcaccagaagttctccctccagtccatggcactggcagtccagtccccaaacctcaggctgtctctgacctgaagatgaggtttcaccaggtacctgcccctttccatctaggcctgtctgcctcctgctgccattaacctgccatccacggtgcccatggtgcccaggctgtttgtgctgaatgttgcctgcaggcctgcatcaagccactcttagccccctgtcagcctttctcccatcctctttggtacccaaagtctggagggggccaaggcatgagggggctggtgtgtcatagctgccctgaatgtgtgcacacctggctgattcatgacagtgcccaggcttggccacaactttgcttcaaaattggagcgggtgtttgtagtgggtgcttggagtggggagaggctaggcagcaggagcagtcacttacaagcttgtgggtcagcagggcttcctgggtccccaagagtgtagagatgcccgggtttgcagccacagcttgacggctacaactgcgcccggggggcggggctcccacctgtttaacttggaatgggctgggagcttccacctgttcttggttcctgctggctccgtggagtgcacagccccagctgtgcctcccccactgcatctggtgtcattgatgatgccagggattgattgacaccattccagacaggctgccgctgccttcagtccctgctctgaagaggtacatctgctgccattaggatagggacaatgactgctcttaactgcttcatgctgacagggggcattgtttatggggaaaatggcagttatgtcttcttagaggccctatctaagggtccctagtaaaagtaaaagggagccatcagccaagtttccatttgcatgaccatttggagtttgatggcccgaaggcgagaagagacaaaccgggttattggaagacatggatcaaaacaaaacaaaggggtaaggacagctcaaaaaccctgaggctactcacatgctcaaaattagaatattgatccagattttttatattacgcatcccttttgtctcttctgagccgtagtcagaaatcactggttggttcacaagagcaagctgggttagtctaaaatgcagaccaaaacttaaaaacaaagtccggagggggctgaggcagcatggagctggcgtatcagcactgccccaagcgtgcacatacccagctatgtcatgacagtgcccaggcttggccacaacgttgctccaaaattagagtgggtgccaggagtggggagaggccaggcagcaggagcagactcttgcgagactgcaggagtgtcttcctaggcccttgagagtgcagaaatgcctgggtctgcagctgtggctgggtggctgcagctgcacccaggagggtagggctcctgccccttcaacttggaagtgggcagggcttccacctgttcctggctcttgcagctttgtggagtccacaagctccagccttacctcccacactgcagctggcatcatggcagtggccactccagatgccccactactaccatcacttccatgttcattgtggcgttatttccaatagccaagatgtggaatcaatctaagtgtccattaatgggtgaatggatgaagaaaacatgttatatatacacagtgaaatatcattcacccttaacaaaagaaggaaatcctgtcattctcaacatcatggatcaacctgtaggacattatgttaagtgaaataagtcaggcacagaaagacatactcatgatcttacttattataagtgtagtgtaaaaatgttgacctcatagaaacagtgaaatgttgattatcagaggctagggtgtgggaggaattagggagatgttggttaaaagacagaaaaatttatttaaagtggaggaataaattcaaagacttgtaaatcatggtgactgcagttaataacaatatgttgtatatttgaaaattgctaagacagtagattttaagtgttcgtaccagaagaaatgataagtatgtaaggtaatgtatatgttaaatagcttgatttagccattctacaggtatcaaagcatcatgttttatattataaatatatataatcagttaaaaaaaagtactgagactctgagaaaggcattagttaatttgcccatagttttatatttagtgaatccagtggtcttacttcagatgtgtattcttagccaaaagatgcacttgctttcacctccacttctgtccctaaaaactgaaaagcaaaataaagaggtggaaagaggctgggtgcggtggctcatgcctgcaatcccagcactttgggaggccaacatgggcagatcacgaggtcaggagttcaagaccagcctgaccaacatggtgaaaccccatctctactaaaaatacaaaaattagctgggcgtggtggcgcatgcgtgtaatcccagctactcaggtggctgaggcaggagaatcgcttgaccacggaggttgcagtgagctgagatcagcgccactgcactccagcctgggctacagagtgagactctgtctcaaaaaaaaaaaaaaaaaggaaagaaattcagtagccatttcattcagccttgcagttgatgcagtctttagctaaacactgggatagtttgggagggaaggccgtagtttgggagggaaggccgttagtacaatttttttatacgttgtgcataagaagcttttgagtcatggatctttgataattactttcagtagtaacgtatcctcggtaattttttttactttcagtaataacatatcctagacaaattttatgcatttttttccatacttgaaagaaactttttattaaaaaatagtattaataacggagcataatctggtaggagtgttcattactactgttttattgtttttaagttttttccatgggtagagtaggaaacacgcatttttggagagaaaaacatgaatcccaaatttatcctcattccaatttaagataaagattttgagggattttatttaccactttggtcttaccctttttgtatatctttttcttttattatccttttacctctgttctctgattttacatttttttttgcattttttttttttttttgctagatgcaggcctaggtattttattttacttttcgttatacagtcttctcgattattttaactaagcaggtttttttggatggtgggaggagaaggagaaaacattaagttgtctgcttcttatttattttacatattgcttataattctcttgtgaattattttagggtttttattggttgtttttgtttttgccttcctgatataaaaattatattgcttgcaaataaagattactttccttctttttcttccatttttggcctctaatgttttctttacttgtgttgtttaagatattaaataatagaagagatagtggacatccttgtcttattccttattttaatgagaaagtacctaacatttccaatttagtaagttgctggctaattgggaagtacagacacatgtgtatatctatatatctgtatatctatatctatatctatatgtattcaggctaaaaaatacctcttaatttctatgtaaacgttaaaatttttattttggtaattatgtatgatgttgaattatgtcacttgaatttttagcagttatgaaaatgaacatataatcttctgttaatataatggattttattaatgcatttttaatattagaaacctttgaatttctggcatgtacccctctttcaaatgttttttagtgttttggattcttttgcatattatctcatttaaagtttttgcatcattattcttcagtgtgtttgatttgtacagttttctgtgcagttttgtgaagttttggggccaatgttatatatctgttatataaaaataatttggaaattttcttcctttttaaaacctagtccttatttttattttattcaggcactgttttaacagatgatcaagtacctaccatgtgctattaacaataaaattgtaatggtagttaatagttccttagctcttaactatatatttgtcagtattctaagtacagttgattctcactgcttgaagtagatttgttctgtgacgtagcagtgaataataaattagctcttactggaattacaatgttaggttcctgtaagcctctggtcacaacatttttgttcacctatcaatacgtaacttttaaaaaatgtgtatttctgtttaaagacaacttatttaaaatatgtattgttgattcattaatattgaactcatgtcccacagcagtatgactcatgcctgaaggaagcttttgtaacacacatattttctccttaaggcatatcacaggcgtcttgtgcttaggaacactagatagcacttgggcattctaaatagccaaatcatcaacaaaaagcacaaaaatgagaacattgttgcacttaatagactgtgaaaagaataatcctttatagtatgagagcagaaacaaagcagagcatttgttcagtttcagctgataggatgcaaatcaggtgactcaaaattctcctcctcctgcacatttccacaaattattgccaaagtgctacgaatattgatgttgggatacaaataaattttattgagtagacaaattcataaatgcggaatctgtggatgaggattgatcgtatttctttgtatttaatatgtgttcatttattggtcatagcaatcctatgaggtaggtattataacacatactatacaataaagaggttaagttccttgtacagtgttgaacaatcaatgagtgtttgaggacaccaccaaagtagtataactgataccaagacatgttgtttacccttaggagctatttctatctaaaagcgttaaaggtgttttgctcaaataactaaatttaaggtagtttgaaataagtagcataagtgtagtgctaccaagatgtagtggatattcagagggaagattattttggagaccacggaaaggctttaggtgatggtttctaaatggaggcttttagaatcaataagatttcatcaagttggcttatgaggatgtaggagatgaactatttcagaaggtactcattttttacatcaaatacgttcaatgattctagtcttttgggaataggaaagtgatggtgaaggggcaacctctttagttttcagttttcgggattcatatactcactctatgaccattttttccagtactatttaaaaatttattctgcctttgtaatactgggaactaaagcatagcaccattaattggaagtcttaaagatgaacaaggcaatgttttaatgtaaatgtatgattttcttattatggaagaagaaaaaccaataatagattgacatttgtgcaataggactgcaaatagtgggtgttttgtgggagaaaaaattgtttcccaattttttgggaaaaattcaagtaaatattaaaaattgctgaaatacaaagattttcccccatatacaatacttttgtaatatactcatcatgtttttcaatgcatctcattagccatacctcttaactgcattgtaaaaaccaaaaaattaagagggaatattttaaaccaaatattctaacttcaataggcatcatagtgattatcatttcagatttggtgtccttgtaactgggctgatttatcataggtggtggatgtgtaaacttacctgtgtatgatcttgttgagggcaagaattgtggcttttcattttttgcgtttctgataaccagcaaagttcctatcacatagaaagccctcaggaaatgttactgcctacctaaatgaatactccaaaaccctttatgactaataatttctatgtaaatattgtagattgtgttgatcagtgttcttccattctatgtattaatgttttattttcagtgcaacactgtgagagtgatcaaagtgcaaaaatcctgtccttatatttagctttataatcagaaaacaccatactaatccataattttttttcacaccattggcctgcttttctttttattgttagttttgtttttattgtcagagaatgttaggtaatttcccagcataactttctcaagaatatatttcctcattactgcagtgaataactcagtgatgtgaaattagaagataacctattctgtttcagcaccagtgctttgacacatataacttgaaatgtgaatacgaattttgttttttcatgttaaaggattcaatttttcatcagttacttagatcttcataaaatctgaagttaggaaggaactttactaattattaagtcctattccattttaatgcctgcaatagtaaatgtttatttatgataaaactctgattaggtagtagggaaaattcaaggtcaaaagtacaaatttctaccaaactaaagaaagaatatgttaatatgacttgcaagcttggattcatatatattaaggaggggggtggaagatgacagttttaagaatcacatagtgttcaacaaaaagccaataaaaagtcctctctgtgccaagagttattgaacattttgaaataagagttataaattaattcatatatttcaatattatcaacatttgctcttggtcaagttcccctcctctcccaagaagagattgttttttgatccagtgttcaattttggttctctccgttaaacatatcaagcttacaagactaagataggtgtcactgagaatgtattttattaaaaacaattgaaaaaattgtattcttaaacatgggatcatatttggagtcttggtgtctatgaaatcctcctggtacaaaatttatatatggataaaaactaaaacagtaggattttgaaatcttttaacttttagattacaaaaagaatatgggaaatacagaaacacacaagaagcaagttttaaaatccctgtaatccctctatccagaaatagtaatattttgatgtatacattttcagggtttttttgtgtgtgtgtggtgtatgcacacacatctatactattttacaaactttgaatcataccgtacgaacacttttgttccttgcttttttcaactttgtgaacattttcctatgccaccaaaaatttagttcaaagtcatttaaaatggttatataattttccactgaatgcctgtatcataagtgatcttcagcagtaggacattagatatatagatatatccagttttcaattatgaactgttatgctaagtatttttatgtagctttttatacacaattcctatttttgtatggtgaagggaatgggattttaattcttatattgaatgtaccttgcaactatacttctgttttatcttagatattatcaaatgatatatttaaatatttatcttggtaaataaatacttgataagttaggtcacttttgtcacaaacaaaatttttaattttttattctatttctacataggtcagttgtagttgtaatgaaggaatcataattcctcaaatctaaaaattagaaagatggaaactgatatttcttcacatttaatagtttgattatacatcttatgattaatgttagtattatctgagacaaatatttcactgtcctttatgtaaagttctttatgtacattgtccactatgacaaaatatgtctcttaatttaggtcttggggaatgaacacttgtttttaatattagcctatcagagtaagcactttaattggattagctcatttaattctcataacattgcatgaactataggtagcattttatcctattttatacatgaggaattctgactcatagagtcctcatgtgtcatagagtcctttgtagagctgcaaagtataggcagtaatataggtggtagtatcatgattgatttgtaggaactctgttactggcacctgcatttgtaaacatctacagcaggaatgtatgccatttaatgcttttgttttttttcttctactctaattgaagattattttccaaagttattctcttaacaaaaattgaaaaatatactatatagaatatgtatatagatatttgtatgcatatgtatgtgtacgcattcgggtatgaatagaaatccacaaacctaactgaatagttgctttgcagacacttggttatgaaacactatccactgaccgaaatattttttctggctataattttggagtataattaaaatataaacttgtaagttcctctttttaaaaagatactttagaaaaacagattttactcttttcattagaaaaatattccaatatgtaacagtatatatactcagaaatgcatatgtctgatttaaaatgatttattctttagttttaagcctatgtatatattttaaaaataatttcttattttaggttcgggggtacatgtacagatttgttacatgggtatattgcatgatgctgaggtttgggatatagatgatcctgtcacccaggtactgagcataatatctgataggtagtttttcagcccatttccccctccctcccccctccctcctttagacaactctaaatgtctattgttctcatctttctgtccatatgtattccgttatttaggtcacgcttacaagtgagaacatacagtatttggttttctgttcctgtgttaattaggataatggcctccagccacatccatgttgctgcaaaggacacatttcagtctttttatggctgcgtagtattccatggtgtatatgtgccacatttgctttatcgactctaccatcgatgggcacctaggttgattccatatctttgcgatcgtgaatagtgatgcagtgaacatatcggtgcatatgtctttttttaggataatttatttgcctttgggtatatacccagtaatgggatggctgggtcaaacagtagtcctgttgtaagtttttgagacatctctcaactgctttccacagtggctgaactaacttgcattcccaccaagagtgtatatgtgttcccttttctccccaggcttgtcagcatttattattttttgactttttaataatcaccattctgactggtgtaagatggtatattgttgtagttttgatttgcatttctctgatgattagtgatgatgaacatttttcatttatttcttggccacttacaatgtcttcttttgataagtgtctatatcctttgccgattttttttttttttttttttgagacggagtctcactctgtcgcccagactggagtgcagtggcaggatctcagcttactgcaatctctgccccccaggttaacaccattttcctgcctcagcctcccgagtagctgggagtataggtgcctgccaccaagcccggctaattttttctattttgtttagtagagacggggtttcactgtgttagccaggatggtctcgatctcctgacctcttgatctgcccgcctcggcctcccaaagtgctgggattacaggtgtgagccaccgcacctggccccattttttaaaggagttatttgttttttgcttgttgatttaagtttcttatagattctggatattagacctttgtcagatgcatagtttgtgaatattttctcccattctctaggctgtttactgttgataatttatttttctgtgcagagctatttagtttaattaggtcccacttgtcaattttcatttttgttgcaattgcttttggggacttagtcataaattctttgccaaacctgatgtcaagaagtgcatttcctaggttttcttgtaggatttttgtagtttgaggtcttatctttacatctttaatccatcttgggttaatttttgtatgcggtgaaaggtagagactagcttcattcttctgcatgtggctagacagttatcccagcaccatttattgaacagggagtcctttcctcattgcttccttttgttgactttgttgaaaatcagatggttatgggtgtatggctttatttctgggttctttgttctgttccattggtctatgtgtctgtttttgtaccagtcccgtgctattttggttactatagccttatagtatagtttgaagtcaggtagtgttctttttgcttagtattgccttggcgatttgggatctgcttttgttccatgtgaatattagaataggcttttctaattttgcaaaaaatgatgttggtagtttgatagaaatagcattgaatttataaattgctttgaccagtatggccattttaacaatattgattcttccaattcatgggcatggaatatatttccatttatttgtcttgtctctcatttatttcagcagtgttttgtagttcttgtagagatctttcacctctttggttagatgtatgcataggtttttgctattggaaattggtgtgtgttcttgatttggctctcaggtagaatgtttttggtgtatagaagtgctattgatttttgtacattgattttgtatccttatttatcagttccaggagccttttggcagcatctttaatgttttctaggtatggaatcatatcatcactgaagagaggtaatatgacttcctttcctatttgaatgtattttatttctttcttttgtctgattattctgactagcactttcagtactatgttgaataggagtgttgagagtgggcagccttgtctcattctagttctcaaggagaatgactccggcttttgcccattcagtatgatgttggctgtgggtttttcattgtgagaatgaataataagaatgaataaggtttttcattcttattattgtgaggtatgttccttcgaagccttgtttgttgagggtttttatcataaagagatgttggattttgtagaaagctttttcttgtctattgagatgatcatatgctttttgtttttgattctgtttatgtggtgaatcacatttattgatgtgcatatgttgaaccaaccctgcatccaagaatacagcctactcgatcatggtgaattaactttttaatgtgctgctggattcatttcgctagtttttttttgtatttttgtgtttttttttgtttttttagggttttgtgtttgtgttcatttgggatattggcctgaagttttcttttttgttgtgtctttgccagattttggtatcaggataattctggccttgtagaatgagttagggagcagggggagtccctcctcctcaatttttttgaatattttcagtaggattggtgccagttcttatttgtatgcctggtagaattcagtgtgaatccttctagtccatggctttttttttgttggtaggtttttaattactgactcaaatttggaacttgttattggtcttttcaggttttcactttcttcctggttcaatctttggaggttgtgtgttcccataaatttatttcctctagatttcttatttgtgttcatagagatgttcataatagtctctgaggatgttttgtatttctgtgggatcagttgtaatgtcatctttgtcatttctgtttgtgcttatttggatcttccctttttctcctttgttaatctaatgagaagtctgtcaatcttttttattcttccgataaacctactcttctttccattgatcttttgtatggatttttgtgtcttaatttaattcagttctgatcttaattatttcttttcttttattagctttgtggttttttttttttttctagttcctctaggtacaaagttagattgttaatttgagatctttctaatttttgatgaatgcatttggcaccgtaaactttcctcttaacatgctgtagttccatcccaaagattttgttaatatgtggttctgtttttgtgaatttcgaatagttttttggtttctgccttcatttcattatttccccaaaacttattcaagagcaaattccttccttttcatgtatatgtgtagctttgagagatcttcttggtgttggtttttgtttttattgcactgtgatgtgagaacgtgcttaatatgattttgatttttttgaatttattgagacttgctttatgaccaaaacatttggttgatcttagaatatgtttcttatgcagatgagagaaatgtatattatgtgattttgggtggactattctatagatgtctattaggtcccattggtggactgtcaagattaagtctggaatttctttgttagttttcttcctcagtgatctgtctaatcctgtcactggggagttgacatctcccagtattattatgtggctattgaggtctttttctaggtcaaaaaggacttgttttatgaatctggatgctccaatgttgggtgtgtatagacttaaggtagttaagtcttcttgttgaatggaaccctttgccactatgtaatacccttgtttgcccttcttaattgttttcagtttaaagtctgccttatctgatattagaattgcaactcctgctctttattgttttccatttgtatggcagttctttttccctttaattttgaggctttcggtattgttacatgtgagatgcatcttcttgaagacagcagacagttggatcttgtctttttgtccagcttgccatcctatgccttttaagtgggtctttattccattcacattctgggttggcattgatatgtgaagttttgatacagaaattgtgtttttagctggttgttttgtagagttgtttgcatagctgctttatagtgtctatgggctatatgcttaattgtgtttttgtggtatcagatactgttcttttactttcatgtttagcactcccttatggactttttataaggctggtctagtggttacaaattcttagcatttgaagcttactttggtgggatatgaaattcttcattggaatttattctttttaaggctactgaaaattggtttccgatctcttctggcttgtaagtttctgctgagtagcccgctactatcctgatggggtttcctttataagtgacctgactcatctctctagctgcctttaagattttttctttaacatcggccttggtgaatctgatgtctgtgtgtcttggggatggtcatcttgtataaaactcacaagagttttctgtatttcttgaatttgcatgttgatatctctagtgagattggggtatttttcataaactgtatcttcaaatatgttttcaaagttgttttctctctcaggaatgccaatgaatcctaggtttggtctctatataatcccatatttttcagaaatttttttcatttttaaaatattcttttttccttatttttgtctaagttgaattgaaagaactaaactggtcttcaagctctgagcttcttttctcagcttagtctattctgctgtaaatgcttctgattgtactatgaagttcttgtagtgaatttttcaattttagaagttcagttcggttctttttaaaaatggctattttgtctttcagctcttggatagttctactggattcctttgattccttgaattggtttcacctttctcgtaaagccattgaacttccttgttatctagattctgaattgtctgtcatttcagtcatttcaatctggttaagatctattgctggggagcttctgcactcttttggaaagaagaggacagtgactttttgaattgttagagttcttttgctgattctttttcatctgagtgggctggtgttcctttaactgtggtataagttgagtatactcaattggcttcttttctaagtgttttcagagggccaagactctgtacaggatttttatttgtgagtagattctttccctgggtttcacagatgatgtatattggcagaatatttttggtgttgtaatttggtctgtcaaccagtagatggtgcttaagtataatggccgatagataggctttggctctgacttgtcgctcttttgtatttcagcaagtttagagcaccgctgtcttccctaggagccattcagtggcaggaactagccctcacattcggaaaccccacacaggtttcccagtttcctctctcttcaccctcagtgtctatgttgcctttgaactcttggtgtttcctctctgaagatttgttcaaagtatgtttgtttacttgatattttggtctctcttggtggcataggcacttcctggctgtgtctagtcagccatcttgtcttctgtgccctctcaaatccttcttcaagccagtatttttgttattgccattgaaatagacaataattgtcctaatgttaaggaaaaatttattcagtgatacttgttaaagtacattaaggaagactttatttagggtcattgcgatagatgtaaggaccactgacatgggattttacagtgagggagagagactcacaatacaacatgggcaagtgggaatttatagccaatgagaagggatggagagttagtagatagaaaattactaaaaggaaatatcagacttaaaaggtgattctggctaaactcacctagaaggatttttttctgaagacaggccaagataatcagacatctcctggggatggtggggaatgaagaatgcaattagatatccagggtgatcagttatcaatgtttttgctgtactgacttagcagagttttttgctaaaactgaattttacaagaaagtgcacagatgggcctaggagaaggcttggtcaagcaaataatcttcatcagttataaagcccttcacataataaaagcggctttaataattgtgaatttaaccttgcatagaaatttttcaaataagaaactaatatacttcaagaatatgcaggggattttttactagtaatttagttacatgtttccctctttttgttcgttagaagttacatgagggcagttatgacttctgttcactaaggttaattccattgaatacatacaaagcattattttcaaggccaaggccattggtagtggtggtaggggctggaacaaagaaatttattagataagatacccttaacactgatatacgtccattttgttttaagagcatttctgtagagacaaaaaagcatagaaaatatactcattgctatttggagtactttgtggtaaatctggaatccttgcttttgcttttatagtagttccataacaaggttatttttaaaacatcatccaaaactgaaatttcaacattaattggattggcacttctagttgtaaatcagcacttccagtcataaatcttgaggaaattggtatcagacctcatgatattctgttttcagtaggttagttttctcagcattattttgtgctaaggagaagaatctctgtgttttaaaccttttcaaagctatgtaacttgatatttgctcttttaaaatcttagccatcaaataccagctctactgcctgtgtccgtggctttccattctccctatcattgccctgttagggcatcattatcagttagagagacttgtattgcttccatactattcttcactgctagatgaaagtttctaaagtttagctcttatcctgtcattacaaacttgaatatgtagaataattccccattgactaatgtgttttctgtggcctaacatttctatcctttttgtgtgatttcatcccccatctacttttttagttttatattccatcgttcttttttcttcgcctaatacttaaactgttctctaaatagcccaacaccaatatgtgtatttatcattttctttacattgttttatttctctgaaatggcctttcttcagttttgcatgcctaaactctaccaaatgagcccaattgtaatgacttttccatgaaggccttcaaaccaagttatcacttgtttttctttgcttttattattttttttaacttttaaaaatgttttcttctaacttctttttaatttttttgtatttatttatttattgccctcaaacattctcctatccagttattgttcttttataaagctcatctctccttccctcccacatagttgctctgcatactttctactcctcttatttaattttttgttttggaaaatttagggactatacaaaataaacacaatgaagtttatagtatgatgtatcaccatgtacccatcactcagaaacaagttatcgttatgacattcttgtttcgtttttgcattcctccacttctcaccatccactcagtcattggtaattctttaagataaaatttacataattcaaattcacaaatctgagctggacaattacgacaattaagtaaacacatgaaacccaatccccctttcaaagtatagatagaatgtttctttctctccagaaactttctattgcctctttccagtcagtcttcccaccctcataggacggctttaacttttcttcaccttttgttttacctttcttgttctttccatgtaaatggaattacactctgtgtaagtcttcttttgctcaacatgtttctgagatttatctcttattattgcttggaacaatagtccattccattttattacttagtactattccattctgtgactgttttataatttgtatatccatttggtttatggactttttgattattttcagtttttagctattatgagtaaagctgctgtgaatatatacatgtaagcctttttgtggatattactgattcttgttattcactctagttatgttctgtaaagtcaccgtggacactgaattattgaatactgaaccattgcttctaggggaaatatagggttaggttcttgtgatcctctggtcacaacatttttgtgaactgatcaacatataattttgttttatgtgtgtttctgtttaaaggcaccttatttactatatattgttgtttcattaacattgaattcacagccaacagcactagaactgatgtctgaataaactttatctaaaatgtattttctccttaaggcacaccacagccttcttgcactcaggaatactacacagcacttcagtattcttcatggcaccattctacacaacaaaatcaccaacaaaatgcatcacaacttgaaaaacatggcaaaaaatagatcatgaaaaggacgcttgtttacagtatgattgccaaaacaagagagagtattggtatgttccacatcagctgagaatgtacctgtctgctgactcaaatttttgctgctccgtacacatctacaaattattgtgaaagagcttcaagtattgattttggggttactaacaaattttagttaggaggtgaattcacaaatgtgcaatctgtgaataatgaagattgtatatgttcttatttttcttggatagatattagtattcacaaatgtgcaatctgtgaataatgaagattgtatatgttcttatttttcttggataaatattagtataattgatgggttaaatagcatccatactttataagatactgccaagcctttttctaattgtagttgcaccattttaaattcttattattaatgcataagcattccagttgtttcatatattcatcaacatttgatattatcagtctttcattttactcattgtagcactcatttgatttttccttgctgtagttatgtgtttatgtcttatctctcccggctggaaattttttggcggcagtatataatttgtatttgtatttgccaaactaatattttggagagatactatacctttgttgttatgtgcacaaacgttggagctagaatgcctgtggtcaaagctcaactctcccacttacaaattttgaggccgtagataatgaaaataacataacagtaaaataactttttataactatattaatttgggtctctcaacaaacaattattattagtagtttggaaatcaagcctttttgaggttagatagcttgtcccagatcaaacgagtaagaggtaccagaacaagatttcaaattcaggtctaacttactccaaagccagtgctcttaactactgcacaatacagtattgccgcctaaatcccactttaaaacctaccatatgtcattaaattaatgctcatcatcctctattaagatgtaaatgatattgaattaatttaaaacttattcacttattgtaatagattatatactttttgcttttctacatgcaaaatgatgttatttgatattaatagtaattatattctttcactccaaaactttagcttttttttttttttgcctattgtgatgtctagcaccaccagttcaaatttgaatagaaatgataatagtgcatattttttgtctcgtttccaatttaaaagggaaagtttttaatatttcatgattaaacttcaagatgttttatgtattcttttttatgatttttttctttatttcttgtaaaaaaatgggatacatatgcagaacctgcagatttgttacataggtatacatgtgccatggtggtttgctgcacatattgacccatcctctaagttccttcccctaaccgctcatcacccaacaggtcctggtgtttgttattctcctctctgggtccatgtgttctcactgttcaactcccacttatgagtgagaacgtgcagtgtttggtttctgttcctgtgttagtttgctgataattatggcttccagcttcattcatgtccctgcaaaagacatgatctcattcttttttatggctgcatagtgttccatggtgtatacgtatcacattttctttatccagtctatcattggcatttgggttggttccgtgtctttgctattgtaaatagtgctgcaataaacatacctgtgcatgtgtctttatagtagaatgatttataatcctttgggtatatacccagtgatgggattgctgggtcaaatggtatttctggttctagatccttgagaaatggccatactgccttccacaatggttgaactgatttacattcccaccagcagagtaaaagcgttcctatttctccacagcctcgccagcatctattgtttcttgactttttaataattgccgttctgactggcatgagatggtatctcattgtggttttgatttgcatttctctgatggtcagtggtgttgagcttttttttttttttttgtatgtttgttggccatgtaaatgtcttcttttgagaagtgtctgttcatatcttttgcctactttttgatggggttatttttttcttgtaaatttgtttaagttccttgtagattctggatattagacctttgtccaatgtgtagattgcaaaaattttctcccattctgtaggttgcctattcattctgatgatagtttcttttgctgtgcagaagctctttagtttaattagatcccatttgtcaattttgatttttgttgcagttgcttttggcattttcatcatgaagtctttgcccatgcctgtgtcctgaatgatattgcctaggttttcttgtaggttttttttttatggttttgggttttacatttaagtctttaatccatcttgagttaatttttgtgtaaggtgtaaggaagggtccagtttcagttttctgcatatggctagcctttttcccaggaccatttattgaatagggaatcctttccccattgcttgtttttgtcaggtttgttgaagatcagatggttgtagatgtgtggtgttatttctgagatctctgttctgttccatatatgcctgttttggtaccagtaccatgctgttttgattactgtagtatagcttgaactcaagtagtatgatgcctccagctttgttctttttgctcaggattgtcttggctatatgggttcttctttgattccatatgaaatttaaagattttctaattctatgaagaatgtcaatgatagtttgatgggaataacattgaatctataaattacttcgggcagtctgtcctttcgggttttcagcattttttcattgattctttctcatctttgtgagtttgtccagtttgatctttgaggctgctgacccatggatgggtcagctgttgttgttgctttctgtttctttgtgttttgttgttgttgttgttgttgttgtttcagttgtcaggtccctcttctgtagggccactgcaatttgctgggggttcacttcaggccctatacatgtggtttgctcccgtgcctggagatgtcactcaaggaggctgcagaacagcaaagatgggtgcctgctccttcttctgggatctctgaccttgaggggcaccagcctatgccagtaggattgctcctgtatagggtgtctgacaacccctgttggagggtctcacccagttaggggcatggggaacaggaccccttttttttttagacggagtctcgctatgttgtcaccaggctggagtgcagtggtgccatcttggctcactgcaacctctgcctcccaggttcaagcaattcttctgccgcagtctcccaagtagctgggattacaagcgtgtgccaccacgcccagctaatttttgtatttttagtagagacagggtttcaccatgttggccagaatggtcttgatctcctgacctcgtgatctgcctgcctcggcctcccaaagtgctgggattacaggcgtgagccaccatctgcgcccggctgaacaggacccatttaacgaagcactttgactgtccattggtggaggggttatgctttacttgggggaagcacgttgtctgggcttcccggattcctcagaaccaccaggaggaaaggctaagtttgctggtctgcagagactgctgccacccttttctctaggggctcaggcccctaccccaaggagctgaaatggcttagacagcagacagctgtagctgtggtgctggttgcccctcctgtagggagctcagtaggcttcagcagattccagctgaaaggctattgagaatctgcagagctctggggttgggacgctagggcccagtggcatgggttcgcaagttggatcttctgatccatgggttgcgcagttctgtggaaaaaccacggtttccccagctgggtggaatgctcactcactgcctcccttggctatggggagggtgttcccctgcccctgtggctctcaggtgggctgccataccacactgttcttccttcctcttcatggaccacacaagctttctggtcagttctgatgagataacctggataccttaattgctggtgagggattcacagtcttattatgattcttttcaatgggagcctccgaacatggctgtttctactctgccatctagatagtcttaatcagattaaggaatttccctttttcctaggtcgctgagagttttttttcataaatggatattgaattttattatttttttaattattgaaattatagtttattttcttctttgaaagagaaatacatgtgtagtgaattacattgattgcattcttgaaatattaaaccttccatgtattcatttcaatcacttagctgagatatattttgtaataactggctttaatgtgctaattttgtgcttgggactttcacataagtgattatgaaagagattatcttctaattttgtttttggcttgtgttgatatcaaggttattttgggagggctaacatttttctgttttctggaagagtttctaaaagcttggttttatttcttcagtatatataactggtggtatttttattcttttcaatcttacatttttttcttgtgttattgtagtggctaggatctctagtacaatattgaatagaagtggtttgagtgaatatccttggttagttgagaattattaggatgatagccttcagtactgtaatgtcataagcattttaagtgctaggtgttatttattggctacttttattcataaaagttccacatgttgtccaggctggtctcgaactcctgacctcaggtgatccacctgtgtctacctcccaaagtgctaggattactggtgtgagctactgcgcccggccgagtttattttttaatcatacatttgtgttgaatttttaaatcaaatttatctattgaaaaggttatatagttttatccatcagtctgtgtagagatggtaaaatgttaatccaatattgcatttgagggatagtatcctttctgtatattgctgtattcattttctgtttttaaaaggatttttgcatctctactcatggaaaatactggtcagggtctatacttctgttttcatttaatgtccttggtcatttggtttcaggattagctcacttcataaagtaagttgagaatttaaatagttgacagagtttaccagtcatattatctgtggctagaatcctgggttggagtgtgttatttatgtttctgttggtggtgggagggtagacatgacatgcaataaacggcacattttaaatttatggttttatgtattattcattgtgaaattgtaactacatggaagatggtgaacctatccatcacactctacaagtttcccctcaatttttttgtgattctgggtaatctttcccttttgttctcccttatctccatctatcaccaaactgtattttctttttcccataatgatcagtttgcattttctagagctttatgtaaatagatagttacaagagaaagtcatttttttctggcttccttcactcagcgtaagtatttggaggtttttcatataaagtttattcttttttgttgttcattcatattccattatatgaatatattcacttgatcatagacatttggttgtttctagcttttggctattacaaataaaatgtacatgtgtaagtctttgtatagacatttacttttttattcatttcagtaaatacctgtgaatgaaatggctagatcattgggtagctgtatgtttaactttttaagaaactgctaaattgtttcccaaagtggttgttctcattaacagtgtaggaaggttcagttttttcagatccttacccacatttgttatgtttggtcttttaaattttaaccactgtaaaaggtatctagttgtatcttattataattttaatttgcattttcctgttgactagtaatgttgaagatattctcaggtttttttttttttaccatatgtatatcttttttttggtgaactgtctattcaaacgttttatccttttatgaaattgagttttttccttattgttgagatttgagagttctttatatattcagaatgcaagtaagacatatgcttgtaaatatttacacacagtctttgacatcttttcattctcatagcagtgtctttcacatctatcttgagacttattcctaagcatttttatattttacatgttattttaattggcattttaaaatgtttcatttaattttattttccatttgttcattggtagtatgtagaaatacaattgatttttgtatattgacctggtattctgcaactatgctaaacatacttatagttctagcagcttttgtgtagttttggggagcaaatagggtcctgatagagagatggctttatggaagaagtacaaggacccttacgggccaggttaggagatgtaaggagattcctcaggatttgatcgccagtgtttttgtctaagtgttggatatatggagtgggtgtggagggaattaccccactgccctacctgttaatgaatgtttagaggttaggcagagggttcaggcaagctgcctaaatggttctcggttgttgttcacacttacccatgtgatagaaaaagtgaaggttatcctgacagtgtggtaataagtcctgtgcctctactcaaaaggcagtattgctatggctgcataaaggatccctgaggctgaagtaacatatgtcagcaatgaggatacaggcctttaggtaaactaatgtattagtccattttcaaactgctgataaagacatacctgagactgggcaatttacaaaagaaagagatttaatggacttacagtttgatatggctggagaggcctcacaatgatggcagaaggcaaggaggagcaagtcacatggatcatggcaggcaaagagtgaacctgtgtagaaaaactcccatttttaaaaccatcagacctcatgagaactcattcattatcatgagaacagcacgggaaataccttcctccccaataattctgtcacctcccaccaggttcttcccatgacacgtgggaattgtaggagttacaattcaagatgagatttggcagaggggacacagccaaaccatatcagtctatctctgaccgctctcaaatctcatatcctcacatttcaaaaccagtcatgccttcccaacagtcccccaaagttttaactcatttcagctttaactcaaaagtccacagtccaaagtctcacctgagacaaggcaagtcccttctgcctataagcctgtaaaatcagaagcaacttagttacttcctagatacaatggaggtacaggcattgggtaaatacaaccattccaaatgggagaaattggccaaaacaaaggggctacaggccccatgccagtcccaaatccagcagggctatcaaatctttttttttgagagagagagtctaactctgtcgcccaggctggagtgcactggcgtgatcttggctcactgcaagctctgcctcccgggttcacgccattctcctgcctcagcctcctgagcagctgggactacaagcatccaccaccaagcccagccaatttttttttttttttttgtatttttagtagagatggggtttcactgtgttagccagggtggtctcgatttcctgacctcatgatccgcctgcctcggcctcccaaagtgctgggattacaggcatgagccactgcacccagccaatttttttttttcgtatttgtagtagagatgggatttcaccatgttagccaggatggtctctatctcctgacctcgtgatccacctgcctcggcctcccaaagtgctgggattacagatgtgagccacagtgcctggccagggctgtcaaatcttttttttttttttgagacagagtctccctctgtcgcccaggctagagtgcaatggcacgatctcagctcactgccagctccaccccctgggttcacaccattctcctgcctcagtctcctgagtagctgggactacaggcacccgccaccatgcccagctaattttttgtattttagtagagacggggtttcaccatgttagccaggatggtctcgatctcctgaccttgtgatccaccgcctcggcctcccaaaatgctgggattacaggcgtgagccaccgcacccagccggctgtgaaatcttaaagctccaaaatgatctcctttgactccatatctcatgtccgggtcatgctgatgcaagaggtgggttctcatggtctgggcagctccacccctgtgtctctgcaggatacagcctccatcccagctgctttcattggctagtagtgactgtctgtggcttttccaggcacacagtgctgtcggtggatctgccattatggggtctggaggatggtggccctttctcacagttccactaggttggagccccagtaggaactccatgtgggtgattcaaccccacatttcttttctgcactgccctagcagaggttcttcatgagcgccccacccctgcagcaaacttctgcctggacatccaggtatttacgtacatcctgtgaaatccaggtggaggctcccaaacctcagttcttgacttctatgcacttgcaggctcaacaccacatgaaagctgccaaggcctggggcttgaaccctctgaacgcatggcctgagcttatactggcccctttcagtcatggctggagcagctgggatgcagggcaccacctttctggactgcacacaccatggggacccttggcccggcccacaaaaccatgttttcctcctaggcctttgagcctgtgatgggaggggctgccatgaagacctgtgacatgtcctggagacattttccccattgtctaggggattaacattcagctcctcattacttttgcaaatttctgcatccggcttgaatttctcctcagaaaatgggattttcttttctttcgcattgtcaggctacaagttttccaaacttttatgctctgtttcccttttaaaactgaatgcctttaacagcacccaagtcatgtcttgaatgctttactgcttagaaatttcttccatcagataccctaaatcatctctctcaagttcaaagttccacagatctctggggcaggggcaaaaagctgccagtctctttgccaaaacatagcaagagtcacctttgctccagtttccaacaagttcctcatctccttgtgagaccacctcagcctgtacctttttgttcatatcactatcagcatttttgtcaaagccattcaacaaatctctaggaagttccaaactttcccagattttcctgtcttcttctgagccctccaaactgtcccaatctctgcctgttatccagttccaaactcgcttccacattttcatgtatgttttcagcagcaccccattctactggtaccaatttactgtattaatccattttcatgctgctgataaagacatacctgagactgggcaatttataaaagaaagaggtttaatggacttacagttcttcatgactggggaggcctcacaatcatggcagaaggcaaagaggagcttgtatggcagtggacaaagtcacctcttatatggcagtggacaaagagagaacttgtgcagggaaactcccatttttaaaacaatcagatttcatgagactcattcactataatgaggacagcacacgaaagacccacccccataattcaatcacctccgaccaggttcctcccaagacatgtgggaattgtaggagttacaattgaggatgagatttgggtggggacacagccaaaccatatcagccagcaaccttggaagttagtttgcttgatcatgtgactggctgctcaaagctgaaagcaaatacaaagcctactaaaaatacaaaaattggctgggtgtggtgatgtgcacctgtagtcccagttacttgggatgctgaggcacgagaatcacttgaacccaggagatggaggttgcaataagctgagattgtgccactgtgctccagcctgtgtgttggagtgagactctgtttcaaaaaaaaaaaaaaaaaaaaagcaaagtcatgcttattggtgtatgtgccactttctcagtttgtgtcctctcatcctgccatcccccctttaccctgacatcagctgcctcaaggagaaaactaagtgccctggagaaattttaaagaagaggagggacctgaactttcatggctttattggatacgggttaccagatcaccatccttggtcccatgtgggaagggaaagctgaacccagggcttgccaaaagggctgaagatgaaggggaagagctaccgtaatatttcacctccttgagcgaggttgctttccaaatatcagaagctacatgagggaggaaacaactgcagggtttggacaccaaccctggagcgagcagccaaaggagagaaaaagtctacacagtgctcctcatgtccttatcgtccttttccactcccagtactctctgctccccagattttcagcctggagatattacaggcattttgtggccattgtaagctgtcacataccaacactctgtagattgtcaaatttatgaatgtaccatttcataatttctggaaacatgttttctcttagtacagttcattaatatggcataagacatgtttactggcagactcaaatatctttatttcctctgtaataagaagaactaaattactatagcccttgacatgtgcctgtgagacaccttggtccgtgttttagtataggatctgtatctgaattcaactgctagatttgaggaaagtttaccaagggatatgatgttaaattgaccttgtgggtaaagcccttgggctgatttcatgtacaaagtttactctattaaataaacggttgggtctggttctctgatagcttaagtgaaaagctaatggtgtccactgggtggcagccaccctccagctccaaggacagtctaaaagattaactggtaagggctgatccagcacaatgggctgaattaaaagccattttcttggaccaggggttgagagacttcagtctgtgtgccaaatttggctacaatctgtttttctattgctcttagcttgggaggatttttacattttttaaagcattgggggaaaaagaatacacacttgagactgtatggggcttgcaaagccaaaactatttactatctgctcttttcagaaaacaagttttctaactcctaccttagacagtattcctaaggattaagttatgatatctttttcctgagtgttgggctcttgccagttacttcacttgggtagtaatagtagattacagagacacccctccatggagacataagctatgaactgccatttggaagggctgggtcactcatgttgatgcctagagtaagtgcctgtttttacaattagtctgaatggaatcaagctgctggtcaagcctgcacttgttagtgcctttcaatctggaaacttgtctttttttttcttcttcttctttttgaggcagggtcttgccctgtcaccaggttgcagtgccgtggtacgagatggtcactatagccttgacctcccagtctcaagcaatcctctctccttagcctcccatgtaactggaactacaaacacgcaccaccacacctaattttataatttttttgtagagacagggtctcactatgttgccaagggtctcgaactcctgggctcaagtgatcctcctgccttggtctcccagagtgctaggattacactcatgggccaccatgcccggccattgtctttcatttttggaaaattttcatatattatttacttgatcagcccctcccttcttttttcttgttttgtttttctggaatttctgtttggatgttagagtttctcaatttcccccccaattttcttaacttttctttcctattgtctgccttttgtcctacttcttggtagtttcttttccctacctttgttttcaaaccttctaatacagtttatgtttcatttacatttttaaattccaagaattcttcctccaatgcctgtttgtaataataccctgttcttatgtcaagtacacaatttgtcagtctccatctaataaaatcacagtgtggttttttaaagactattctgtttcttgcattgtttattcccaaatcctttttgtttgttactgcgtttagtttaatctgtgctatttatgatgcaagctttcttcacatatcttgtgattcttatatgcagatttatatttaatagggaggcaataaatatgagttggcttttctatgtaataggacaggccttataacccagtggacttcattgtagggttattaggtaggtatccagaggtactcataaatgtcactatcatagggcattttctcttgggctgtttagttccttctgagaaaaacttttaacttcctacctgaatggtgtaaacttgtctggcagtgttattttagccatgtgatggagaagtctgggattctcaccatttagtatgttaactttcaattaatacccctgtttttcataaggtgcttctcctctaccatctattatgcttagataattatagagaaccagaatctgtttagcaagggctgaaatttatgttctatcttatagataggaaaagtaaatggagcctaaaatgcagatataagtgcataaaagttattctgttaattcttttctctatattaaatatgatgtttctccaaattttgatgttttatttgaagccataataaactttgttctaaggcattcacattcatttaagtaattggatttattttatgaaacattctcattctgatcaaaattttcaccgaaggatgaagatttaacagaagtgctaatagtaatatatttgagttgaactttaggtaacatgttagaaagaagataacttaatattttgaggatattttccatttaaataaaaacagcaagaaccaatgtattaaattgaatgctgtggttctagttattgttttttggatgtatttaataatttctaatgtctttttggcttaacactggacctcacagttaggtaatgaggatggaagtagtatatttgcctttctatgaatgccataccataagatttttcaggatatttttgtagttaagaagatagcatatgagtagaatgatagataattcaatttgaggtacttgtaactgaattggattcatgtctactggagatgagattctcatggaaaatcaacagctgataatgtaaatgaagaactttgtgatcctacaaattataaaacagtgcagttatcatttaggttttaggttttgactgccagagatttgctttatagagatttgctttattgagatttgctttattgggaatgcctatatttcagtgttagaattattataattgactatagatcttttatataaaatattctcatttgggggaatagaggatagatagcaatatatgactcttaccttaaaattggtataaatctaatgaatacccatataattactattgaacttaagaaataaaacattacagataaaatggaagtcatctgtgaatctcttacctataccattcacctttatcattctcttcccagtagtaacccttattctgaatttgttgttttatattccctgcttgtttcacaattttactctttttctcacatccagaataaatgtagtcttgttttacgtatcttaaactatatttgaatagtatcaaactggaacatgcttccccccgcccccaacattgtttctcagatacattcgttgatggatctagttctttatttcaactgttgaagagtatttcattgcatgaatgtatcataatttattattaattcctctattgcttgtttcataatttttactcttgtgaacagtgcttcaaagaatcatgaataggtgaaaatttccttgaggtatgtatctaggtatagaatggccagcatatagtatataaacttttaaacattttactaatttttttgaatcgttctttaaagtagtcccatcagtttactgtttcatgagaaatgtatgaggtttcacaaagacttgatattgttagacttaaagtactgataatctgatgtacgtagattatattacagtgaattattttgcgttttttggtattaggatatttttaaaatgaagagcaaattatttgttctctctttgtctgctttcactaataatggtgtgcttctaattacctagtctgttttcccattagttcatagttttattaaagaaatctctcttctacctactgttagatacaccaccccattatataaagttcatttggttaggtttattttgtgctaagcaactaaatagaaaatggaatgtttttattgtctttttgtgccctaaaaagagtcagtcagctcttggtaggggaaagaattaagcctgttgtctaggtgataacagtagaataatgcagtgagggagtgaaaaatcagggatctaagttgcagaaaattcagttactaacagcaattaattgaataaagaaaatgcaaagttatgaaaaacaccagtactttgattatattatccttgtagaatacagtcattcattgcttaatgatggggatgtgttctgagaaatgcattgttaggcaattttgtcatttacaaacatcatgaaatatgcttacacaaacctaggtggtatagcctactacccacctaggctgtatggcataggctattgctgtcaggctacaaactatacaggatgttactgtactgaatgaatattgtaggcagttataacacaatggcaaatatttatatatctaaacatagaaaaatgctgtaaatatgtggtataaaagataaaaagtgatataaggcacttaccatgaatggagcttgcaggactggaggttgcttcgggtaggtgagtgagtgaatggtgaaggcctaggactttaccatacaccactgtagagtttttaaacaatgtatacttaactacactaattatattaaaagatatttttctttcttcaataataaatttactttagcttactttaatttttttagtttataaacttcttgactcttttgtaataatgcttagcttaaaacataaacatattgtacaaaaatgttttatttctggcaggcatgtggctcacagctgcaatcccagtgctttgggagggtgaagcaggaagattgcttaatcccaggagtttaaaaccagcatggggaagataattacaccttatctatacaaaaaaataatttaaaaaatgagccaggtgtgttggtgtacccctatagtcccagccactctggaggctaaggaggaaagattgcttgagcacaggagtttcaggttgcagtgaactctgatctcaccactgcactccatccagcctgggagacagagtaagaccccatctcaaaaaaaaatacatatatatatatataaatatatatttatatacatatataaatatgtatataaatatatatttatatacatatataaatatgtatataaatatatatatacatatataaatatgtatataaatatatatttatatacatatataaatatgtatataaatataaaacacacgtgtgtgtttcttatcttcagtctgtaagtttcttttctattttatccttttactttgtaaacttctttgttaaaaattaagacacaaacattcattagtctaggcctacacagggtcaggatcatcagtatcactgtcttccacctccttatcttgtctcactaaataacacctgtggagctgtcatcttctatgttaacaacacctttttctgaaatactgcctgaaggaactgcctgaggctgttttagtgtcaacttttttttaataagtaggggtacaccctaaaataatgatgtaaagcatagtatagtaaatgcaaaaaccagtaacataatcatttattatcattatcaagtgttatgtagtgtacataattgtgctatagtttttttatatgattgccactgcagtaggtttgtttatcccagcatcaccacagtcatgtaggaatgccttttactgctactttatgatggctatgacatcactatttgataggaatttttcagctccattataatgttatggactcaccatcatatatgcagtttattattgactgaaatatcattatgcagtgcatgacttcaattatactctatttaatctcccttctaggtcctgatttttaaggtaatttgaaatcattttttctgcctttctctgttactatctgaattgcttcctaagaagattaaataagagtaaggactttttcctggatgttaaccgtaacattagcatgttattttaattaaattggtttattaaatataatgacatagttaaatattgatgggggaagggagtagtctgtattacatccagaggagggatggttctactggaacttactggacagctagatgacaatatgaagatctaaggaatggggaagagaagaaagggataagataagagatgctgaaaggtattcttaatagacttaagtattttacttgggttatgctcttttctataattttcactggctcattagaagtagaaaagtttataagtagagaatttaatagaagaaaggcaggtaatgttgttgagatgtgtggggtcagatctatcctgaaataaaaagaatctgatcacatttccttagtgatttaaaatagaaaaacagggtgatagaaataaatgtcagaagcagaaattggaagaaataaagaatggcaagtttaatgttggcaattggtcatcagaatcctattgttgttgttgttattttttttttaagatggagtcgcccaggctgtggtgcagtggcgcgatctcagctcactggaagctccacctccctggttcatgccattctcctgcatcagtctcctgagtagctgggactacaggtgcccatcaccacacctggctaattttttgtattttttagtggaaacggagtttcactgtgttagccaggatggtctcgatctcctgacctcgtgatccgcctgcctcggcctcccaaagtgctgagattacaggcgtgagccactgcgcccagccatcagaatcctattttaacttatatttgtagattttcttgtcatgccagttaattacatagtctgtttctggtatttcctatgttgacttgatcatagctgtcactaacaaatacttttatcttcgacctatttaatgtgttttttttttcttacattttatggagtgtttacatgatcccctcttacttaactttagtggactgtcaggattattgtcccatgcccattttgcctgtagtttttctttaattgcagtcgttctttttttttgtttttgtttttgtttgttttttttgagacggagtcttgctctgtcgcccaggctggagtgcagtggtgctgtcggctcactgtaacctccacctcttgggttcaagcgagtcttcgtcctcagcctcctgagtagctgggataacaggcactcaccaccatgcctggctaatttttgtattttcaatagagacgaggtttcaccatgttggtcgggctggtcttgaactcctgacctcatgatccacccacctcggcctcccaaagtgctgggattacaggcatgagccactgcgcccggccggcacagtcgtcctttttaacagtgtttattttagctcaaaacaaatgtatttattattcttgagtttcctttattattgctgaataacttcaagtaatttttgttttttcctcactaggtctttctttgcaaatattacttttagataagtttgtatgagtcttaaaaagctctttctatgtataattaaaacaagatagcacctttattttgactatgtaaataattgtatctcatagattcaaagctagcttgtgtttgcagaagacagtattgccatagtgaagtaattttaaagtaaaatttgacaacaactagactaggtctgtaggaggattttttattgtattaaggctcatactgtgctaagtataatattttttattttttgatgaattatattagaaactaatttttatttgtagttctactttatatattttctatattagagaaatttcccactaaagaatcttcattaacatttttctgcaagtgatttccgaatgtttctaaccctaaacagtttcctatcattgcttctaaacatttttttctttttaaatcttgctattgcttcgaattcaggttgtttgaactctttattatccttctcttctgctaccttgttcccaatccaactaccctacctaatttcctattcgtatcattggtattattatttttctggtcaataaaataaatgtttgttgaaatttacattttaatcctgctagctctgagatctttgggaaataatgtcttcaagtttcattatcttgtctataaagaggggagagcaatgtttcatgacatgagattggcaaaatgattagattaaatgagatagtgtaagtgatgcacttggtacagtgcctgtctcttagcaaatgatagttcccctgtaggtatatgggatcaaaagctcatagttgtttttgacacctttcttctctaaaccctctgtattgcattttccatcaaattttgataatcccagctttataatgttcacatatatttgattttattgtattctcttagctgaaatattgatccaggcgcagatttgctgtacattaatgtaaaggttgacttccttacagatttgtctccatactttcctttcttacaatacattcttttttttttttttttttttttgggatggagttttgccctgtcacccaggcagagtgcagtggtgtgctctcggctcactgcaacctcctcctcccaggttcaagtgattcttctgcctcagcctcctgagtagctgggactgcaggtctgcgccaccacaccctgctaatttttgtatttttagtagagacggggtttcaccttgttggccaggctggtctccaacttctgacctcgtgatccgcctgcctgggcctaccaaagtgctggaattacaggtgtgagccaccgcacccggccccttataatacattctgcgtattccagtcagatgactttttctaacattccacgtttgttatgccatgtatctgctaagaaagaacaacaacaaaaaaggaattgttccttattgtcttacttcacttagtggaaccatccattccatccagtttggtctgcttactcaaagactattaccattcttctttctgtgcccttgctcaggccaggccttcttcacaacgtcattcgaagtgtacaatgtttcttgcacttatttccaatttaattgtgtactgccttgtgtagttcttatattactgtcttctgtcaatattaaatttaatcatatactgtcacatcatagttttgttttattttctactgtaatttaactttctgattaggccattttcttttctaaggtataaattctcctatacttcttatcttctttgaattcattctgttattctatgtatgtacttcaatttcttataagaaaaacagcacaatttgagtttgaaatttacttttaaaattataattaatgaacatagtactttattaaggaatcaacaaaaagtgttttattcaactggcaggcaaacttttctatttccataaattagttttaccaaacttcaaccttatataaatggaattttgcattttactgtatactctttctgtttggcttcattttagttttttgagatttatctatattgtgctgtataaaataagtactgcattcttttttattgctgaatagtattccagtgtatgaggattttacaattttatacattctcagtttaagggacagctagatttttaatgattttttgctgttattaatagggttgcagtgaatatgcctgtacatatatttttgggtacgtatgttttcatttcttttgaataaatacttaagtgtgacttgctggattgtatggtaagttaaacgtctttgtccagactgtcacaaaggtggtgctgtactcttcccattgtatcccatcagattgcttattattttgggtttctctcattactaatgatgtttaaagatttaaatgtatgacttgagactgtcaaactactaaaagaaaacattgcaggatgctttaagacattggtttgggaaaagatttagtttctgggttttctttctgttttttttttttttaataatatctatctctgtttaatttctcattcaggtcatgaattgttttcctggttttaaaattatttatatgtgttcttttgtatcttgtagagtttccttaggatcattattataaactcattttcaggcatttgacatattttcttttctttggggtctgttactggagaattattgtgttgttttggaggtgtcatgtttccctgccttttcatatttcttgttcccttacattgatatttgcacatctggtgtaactgtcacttctaattttatggagtagcttctgtaaggaaagactttttcctgtagatgtagctgtaatgtttgttgggtagaatgttttcgcattggttctcggtgattgcaatggtgtagtttttgtatgatacttcacctgtaatcaacaactgcagtgtctgtgattcccttaatggcttagcctgcagttgtttgtggagattgtggtgagactttggtggggaaggggtcatcagccagactgatcctcaggcctctaggtgtcacgtgggggcaccaacagtggtggttgtgtgtcctgggtgagccaatcttaaggtcctaggtggggagccagtggtagcagtgtcaggcccttcctgattggccctcgcatccctgggccgggctacacagattctggtagtggcactggtgggttggtcttcaggtgcccaggcatcagtgtgtgttggtgactggccagtctggctggtccccaggctcctgggtgaggcgcacaggaaccagctataagattgctttttttaaaattaaatattaagagcctttcttaagctgtgtggtgtggctttcttcactcctgctgctgatttaccaccattgtttattagattgggacaagatcactaactactattagacatgtaccccatttttactgtatattgctgtataacaatggtggcttaaaatagcaaaagtttattatctctttcagttatgtaggtggactggatgtaggttgatagatttgtttccatctctgatgtggtgtctgctggatagctggggcatctaaaatagccttactcacatggttagcagttggtgcttgttgccagctagaactcagctggagctgttgacaatgttcacatgttctcttgaacatggactttgtatgattgtttgggctgtctcactgcatgggacctagattctaaacagaagtgttataggtgaccaattggtagctgcagttttcttaagacaaatccttagatgttacactgccacattccattggtcaaaagaggtcatagagccaattcagatttaacagataggggaaagtcatgctgaaaaagaacacgtgggatgagataatgttgtggcccttttaagaaatataatttacttaatttgaaatttcctgtgaaattttgaaacttactttgaaactttgaaagattattagcaattttccaaatagtttaacttcattattaagtgtattcaaacttcacagaagccagtatacaaagggaaatcccagatttaagtgatgagtttatataccattgtttaactggtcctctgagtgatcctgcatgattgataatccacactactgtctctctagacagaagacagactcagtaaggaaatgttttaagtgggtgtaattctgatatctgccattacaaaaacaacgacgaaaaagcaaatatttcttcttatttcttatcagcaaaagaaaggaatgaggtgtactggaattcctagcactgtgatactcaaaatgtcagtttttaaggcttttgtgttttagggaaacactcaaagaaaaaatttatgtgagttttcaggctgtttacttacattcttaagaaaaagtgattttaggccgggcacggtggctcacacctgtaatcccagcactttgggaggctgaggcaggcagatcataaggtcaggagatcgagaccatcctggctaacacggtgaaactccgtctctactaaagaaaaaaaaagaaaaagaaaaagtgattttagatcttttcaaagatttgtttaatgtgtatttgttcatattttaatttttaaatgtaatttctcactggtaaattttccttaaaatataaattgctccctggatatttgttcattattttgcaaagtacaaaactccattagagtttcatttaataaatattaagtacaatattgggaccccttattggcttatataaatcatataaacaggtgactgtttataggattcctttattttagctgccagtaagaagcctgccatgatttttttatgtctttggattccccatcttacctgccagctctagtatctattattggtagccataaaaaatactgacaatatagaccagtttgaattttcttaaatttatcacataggtataccatatcacctaaaaaagttaatgtgattacaaagatagctaatttatactcagtcagcagattcctttatttggctgtgtctccaagataaattaaaaataaaataataaaaataaaaaactatagttgagttataatattttactgactgaaatttaacttcagccaagctttaaaaaaattacacagtttatatcagtacatctttattttatgttctatacatgactccatgataagtgttcaatgtggatttcagaggatcccaaatgacacacacacatacacaatattgtattaaaaagtcagattggtaaggaccctgtagaaatcaggatgcttgcaacatggatttcagcaaagtttctgaaaagataattaacaagcaggctggtttatagaatatataataaggctctaaaaacacaattgggttttaacatggcaagttgatgtagcccaaacagtaaataatctggataatctattatcttgatttttaactgttttgattcagatatttctttgtaatgaaatttttggcaaattaaaatttcacaacgctactcttagaacaggatataggaatctcctcagttaacacccggactcctttgtcagatctaactgtagttgtaagtatttgccttgcttactttgatgctgcagtccttggtatgtatgatttccaaagaattgaagagtaagtttaataatcttgtcactttatttagcttggctcttcaattcattggttattgatattaagattttggtctttagaatatagggtgtgatttgacttatagttaataggttatacatggccatacttaaatctctaatgatatgcctttgcacttaggataaaatacaaaatctttgcagttatgtaacccggatttttaaatttcaagttagttatctttacaaatttttatatctttccaccttataataaacatgaaacattaatagattcagggaatgaaatccttttcttaagaagataagattaaaattttatgtcatcagaaaatataattttagggtactaaccagtaagatatagataaggaatgagacaacctatagataagctttacctgctttattaagtctaatgcatactagagacttttttattctttgagtttcaggaagttaaatttgttcctctgtctcataagatagtattatagtttgtgagaaagttctaatttaacaaacacttaaaaggactaccatgtttaaggcattttcttaagttccagaaatatagtctagctgaaaaatcaaaatcatgtgtattatatattatgaatatgtataatacagtgtaatgggtagaataatgggagcatgtttaaatacagtggggaaactggtaagtatgaggttaattttgtttgttgctctctgacaaaaatcttagaaagtcagtggcctttaaccctcagtacaacaccaaggtccattggattctgttttacttttgagtttctgtttttgagcaattctgagaatttataaggattgatattttatgacttttattattttctagggctcttccaaagagcaaagagaaaaagtgtttatttctgtacatatatatatatttaaattttatatttaccacctggatctattgggcctttttataaatctgtgatatatttttgtatcatagtgttcttgtatttcctccatcttgaaacattttgctgttctattattattagaattatttcatcattacttatcagctagctttcttcaactgcccttaaatagggggctgaggtgggtgaatcacttgagatcgggagttcgagaccagcctggccaacatagtggaaccctatctctactaaaaatacaaaaattagctgggcatggtggcacatgcctgtaatcttagctactcaggaggctgaggcagaagaattgcttgaaccagggaggcagatgttgcagtgagctgagatggcaccattgcaatccagcctgggggataagagggaaacactatctcaaaacaacaagaacaacaacgacaacaacaacaacaaacaaacaatgaaataaaaggaaaatgggagaatgatgaagtcatctagaagagtagtgcagtagttgaataaatggtcactattgctttatcctttagttttatcaagttgtccaaaatattgcatgatctttcatgaatatataaataaaagaagatcagagaccccatctttgtagtctccttttccagttgagaattcagaatttttaatttttttttcaaactttttttttgcttgggggtaaattttccctttaattcttcttttccataatgaaaaagttatgaaaattgagaagagactttaatatttactagtcaaatcagatatcagggctctaatgttaatggcaaaattggtcttagaagcagatcctcatactgagtcatcagatgacacattccaagatgcatttcttcagacaactatcaatgtgtgaataatgcatttctcaaaacaaaaagcagataacgtattcacattcagttagtgaagaacaggaaggaccttatcacacagtattttgcagcaagaacctggaccatctcattttgctaaaaggataggtaacatattctttaatcttttatgatttcgtgctcagattcattatatatggttcctaagtggacaaatactgaaggtaaatatatatatatatatgcataggtgactagaaggaaacagataatgtagaaatgaaaaaattattaattggtaattataagtggtgttataagtgtaaaaatgaaacttttgcaattatcgaacaaagaagatggccattttctcttcatcaaaactataagctaaaggtttaaaaaaaattcatcaggtgtgctgtattttgatgatgtcagttcaagaagaacaagaataatgataagttagatccaattagagatgtatttgacatctggaatcaatatgtacaagatggatgtgtctctggttcatacatgacaattgatgaagcgttagttgcatttagaagacattgaatacatatacattcaaaaccaaaactttctgatgaaatttcactgctcctttatttttacttctgcaatataaaatgacttgaacataaaaataaaattacatagtccatctgacccagctggtgaatggtgatgattatttttttttttggcatttgaaaagttaagctagaccttgaagcttattttaaagtttggcaaataaaaggcagaggcaagagaatagctagaaatatgtatgtgtgtacccccacatacacatatatatgtgtatatatgtaacatataaactatagatgatattttataaaatttatatatctaaattgatttataagtttatacatctacaaattttaacagatatatacatatgaaattttgtctgaaattaaagcttgccattgggagattttatatgtaaatgtaagtagtgcttatcgtatttctgtttagaaagtaactgggtattcattggagattaggttagagaagatattaaatgtagggatttaatgaaggatcacagatgacatagactggagttaaggcatttataataaagaagctgaaacacctaggtgcaatggatcatattcttttgttcattcctgaattgatttgtgtgtgagataattttttgtggcctaagaaatggttttgggctgagcatggtggctcatgcctgtaatcccagcactttgggaggctgagacacgcggatcacttgaggtcgtgagttcaagaccagcctggccaacatggtgaaactccattcctactaaaaatacaaaaaattggctgggcgtggtggcacgtgcctgtaatcccagctgttcaggaggctgaggcaggagcatcacttgaaccttggaggcaaaggttgcagtgagccaagactgcaccattgcactccagcccaggcagcagaatgagactctgcctcaacaaaacaacaacaaaaaaatgaaatggttttggaagacatttacaatagtttatttcctaggtcacattaaaaatgaacatgaaatgatattaattacttaacagtttttttatcctttggggttttttaactataccactctcttattgttatactatgaaatgtccaaagtgctactagtacttttgtttgaggcaaatattattcagagactaagtttgaccttgaacatcaccttggatttaatacaggctttcaagtaaatatttgattttaggaaaacctatgtgttgaggctttccttccaagtagaatggagtagctggtagcaaattagtacttctgcttagagcaatgagaaaatcaagataaaatatacatgtaaccattctgtatcagagttgaccttggggatgtatttcaagtctcagttgtatctgtagtaaagcttattcttcctctgttttgtcctaattatattggtaatcacattcaatataaattgactaattattaaaattgaatcactaagcttgtcaggctgtataaaacaagtaaaccccaattatatgctgcattcaagagccacatcttaaattaaatgggaggatgaagctaaaaggatgaatagatacactgtcctaacactgaaaggcaaactggtgtagctactatatccaataaggtagactataagataaagactaaatataggtggtccataacgtatgatggttcaacttacaattgtttgacgtaacggtggtgcaaaaatgatacacattcagtagaagctatgctttgaattttgatctttctctaggctagtgatatgtaatagaatactctattgcagtgttgggcagtagcagcaagctgcagtttccactcagccaagcagtcatgagggtaaataaccaacactctatagtatatgaaatgtatttttgacttaacaatatttttcacttacagtgggtttctcaggatatagcctcattataaagttaggagaatttgtataaaagatggatgttttataataataaaagggtaattgtatcaggaagttttcactatcctaaatctgcatgcacatagtgagatagtatatataaagcaaaaattgatagaagcaaaagaactggacaaatccccaaatatactgggagaatttatgatgctgtcagtagtaccaaccatcaatagctgatagaacaagtagatgacaaaaaaaaaaaaagagagaggtagagcacatttttacagcaagagtaataagtgacttaatttacaactatataacatttcactggaaaatatgagagtacacattcttttgaagttcagatggaagattaatcaaaattggccaaataggggatatagatcaataggtataaagatttagtgcaattaaaatgtcaaataggttttgggttttttaaagtaaaaaaatgactatctcttctgaaatttgtttagaaattcaaaggatcaaggataatcaaggcaatcttaaggagtaacaaaataagtgtaagagagagtaccaattgtcatcattttctgtaacacaatactagagttattaaaaacagtggtattgatgcaagaataggctggtgcaagaataggctagtgtaacaggagagagtatccagtgtggtaggcagaataatggccttcaaagatatccagccctaattcgtggtacctgtgaatatgtcacattataaggcaaaaggaactttgcaaatacagttaaggttacagacaattaagatagtaaaatgatcctgggttttctgagtgggcccagtctaatcacatgaacccttaagagcagagaagtttttccagctgaaagcagaatagagatgcagcagaagggggagtcattgattccaagcatgagaaagattctgtgcactattattgatgagatttaagggcctatgtaaaagactggagagaggcctctggttgctaaacatagcctctagcttaagtcagcaaggaaatagggacatcaatcctgtaaccaaaggaactgaaggaactggactgtgtgaagtagaatctttactgagccttaagagtacgagctcagcaggcagacattttgatttttgttttttttttttttgaaactgggagtagaaaaattagctgagctaacctggatttctgacttgtaaattgtgaatagtaaaattgtgttgttttgagctgcaaagtttgttctaatttgttacagaagtaaaagaaaactattacttccaggaacaggtctgcatatatgcttctacctgatttatgactgatttttttaagtataatggagaaaagaattttatttcaattcaatatccttatagaaaatatgcttattgacatacataaaaatccattttaggtacatcatagatccaactatgaaagatttaaaaaataaagcttttagatggaaacatggcagaatatcttcgtgatcttgggttagggaaagatttcttaataataggaaaaattgatacattggatcacattaaaaataagaactttagaaatctaaaaactgaaaggtaaatcatagaatgaaagaagatacttgtaatacatatatccaacaaaggactcatattccataacccaattttaaaaatgaataaaagacttgaaaaggcacttcacaaatagtatatgttcaatatgaacatgaaaagatactcaacataaaaaatcattagggaaatgcaagctaaaaccacagcaaaatatttctacacacccaccagagtggctaagtaaaaaagatgccttttccaagtgtttgtaaggaagttgtatagttggatatctgatacacaaattggtactaccactttgggaaactgggagtgtttactaaacctgaacatatatgttatctattacccaggaattttagttgtaggtatatatctaaaaggaaagtttgcttaagtttaccaaaggacatgtgcaggaatgttgatactatttgtaatgacctaaattggaaacaatccaaatgtctacttatagtagaatggataactaaatcatggtacattcatagcatggtatactgtacaatgagaatgaacagcatacaattaaatttaaacatagatgaatctcataaacttaatgttctgcagaggcatcagatacaaaaggaatgcctatggtatgattcatttttataaagttcagaaacagacaaaattaatatatagtgttagaagtcagtatttccttctgttgtgggtagagcaatgactgggagaaagtatgaggggagttttttttttttttaatcaaagatttagacactgctttcaagctctatatgtgtttgaggaattggtgttttcactctttttattctttttcttatgtagataataactatagttaattcactgttttacttcgatcagtttaataatactgattatgttcacgtttatttgagtcttgtacctgtaccaaccaggtagataggagaagtatatgcataatcaaagacagccaactgagccagctgagatttatttacaagtgatagcttaattatttgggggctttacattagttctttcaattaatcagttttttgctttcttgtctattcattggagtttacttctaaagctacctgtcctttgttgacatttggatttctctgtttaattatttagatttgggattagttctgtaaaattcacagaacgccttgggttacacttgagtttgggaacaagtaattacaagttatattaagattgtaaatgatctgtatactgcagacatcattcttctcaaatttctctttaagtatgtctaaattataacataaaccagtggtttagtatgcttttttagatactgatgatgctttgtgagactaattttattctctacccacatcagtatcttttctgattgccttgatgaaattagataaacctttatctatgccacccactaccaaagatgtttcacttttccttctatccttttaagggtatttatcacaatgtcaaagcaggaaaaatagtaataaacatagttatagaaataataacagcaaatggttataacatgtcaatcagtatttaaagcactttattgacttatttaacatatgaaacaactgagagaggtgtgattgttagcttaattttaaacatgagaaagaaagtctcagaccacaggttaactaacttgctgaaggtcacacatctattaaatgtatgtgtcagaattaaatccagattacctagtctttgtccttaaccactgtgccagtaaaagacagataaggagattttcaaagttaaaattcagtcactaactaaacaaatctgggattataagtttttcaaagttttgaataagctaatgattatatttaaatagtaataatttttaggtaaatttttttataattgcatatttaaaatactaatttaaattttgtagtaaggcatgtaaatgttgtttgccatactgtttcatgtttggaagtctgtttatgtttatcctttctttcccaatatataggaaaaggtaattcatgggccatcctaaaggagtgtgttaggttgttctgtagctttttgtagtagtatatttgtatgtaatgaagtgcatttttaaattgcacttgtaatttttaattgcttcttagaaattcctgaatatttaggaacttcataaaaatattctggaagcaagcattacctggataacatggtacttaaaaacctttcattatcaaggaaataaaaaatagaaaagaatgttggtatgaattataagaatggaaataatctaacagatatttatctaattacatttatccagatgagtttttctgatttgcttataatacatcacaacaacatctcagcctgtctccaggttggtacatctttatttaaaaatttgggccaggtgctgtggctcacgtgtgtaatcccagcgctttgggaggctgaggcagatgtattacctgaggtaaggagttcaagaccagcctggccaacaaggcgaaatccctcctcagtatactaaaaatacaaaaagttagccagccgtggtggtgggcacttgcaatcccagctacttgagaggctgaggcacaagaattgcttgaatctgggaggcggaggttgcagtgagccaagatcatgccattatactccagcttgggcgacagagtgagactccatttcaaaaaaaaaaaaaaagaaaattttttttaaagttatttaaactgattttatatgcaccatttatttataacaattttattttattttataatgttttacatttgtgtctctcattagatactcagactaaccctatgatctcataggggagatataattgtcccattgtttttacaaggggcctgatgaccagaggttaaaatgtatgtacagagtcactctacaaatatgccatataattatcatttgaaaccacatcttccgttctctgatacaatgcttttcccattgctccaggtcacttctcatatgatttgaaaaccaaccaaccaataacaactttacctatgattagaatcccatcatttaaagagtgacaatttagttacaaaagattaaaaagaattcaacagcaacaaaaaaaaactagattaaaattgggcaaggacttgaatacacatttgtattatacaaagaagatactcaatggccaacaagtatttgaaaagatgctcaacatctctaatcattaggcaaatgcaaatcaaaaccacagtgagatattacctcacacacctaagaatggctgctgtaaaaaaagaaaacaaaaccagaagaatcctgaaataacaaatgttggtgaggatatatagaaattggaacctttgtgtattgttggtggggatgtaaaatggtacatccattatgaaaaacagtataatggttcctcaaaaagttaaaaatagaattatgattgtacaattccaagaattgaaggtagggtctcaaagagatactgatatgcccatgttcatagcagcattatgcagaacagccaaaaggtggaaggaatgaatagataaaacaatatatatataaaatagataaaacaatatatatcttgagggcgttattctaaatgaaataagccagcaagaagaagacaaatattgtataattccacttacatgagatatttattgttgtcaaattcataaaaacagaatgtagaatggtggttaccaggggttcagtggagtaggaaatggggagctgttgtttaatgggtatagagtttcagttttacaagatggtgtttggtcacacaacagggtaattatatttaacagtaccaaactgtattcttaagagggattaaggtggtgaattttattttgtgtgtcttttaccacaattattatttttaaaattttatttttacagtgacacggtctcactctgtcacccaggctggagtgcaatggctctatcatggctcactgtagccttgagctcccaggctgaagcaatcctctttccacagcctcccaagcaactgggaccacaggcacatgccaccatacctggctttttttttttttttaatatttttttttaaagtcagggtctcactatgttgcccaggctggtcttgaattcctggtctcaggtcatcttcctgccttggccccccaaagttctgggattacaggcataagccaccacacccagccaaatgttttttaattttaaaaataaaataaattgtataggtagaattaaaaatacataaatcagatcatgccaaccctttaaagtcatctagtgtgcttaagataaaatttaaaatccttttaaaaaagatttaaaaatgtatagtaaatgcccacatgattctcacagttaggtgtgcttctttcattgtattaaggatgtataaattttataagactaaatatcgtgagatatttattattgaatatatagcaattcaaaatacagtagtccctccttttctgcaagggatacattccaagaaccctagttgatccctgaaatcacagatgttactgagccctgtatataccttgttttttcatttatatacatacctatgataaagtttaacttataagttaggcacagtatgagattaacaataactaataataaaatagaataattataataatataagttatgtgaatgtgttctctgtcaccctctctcataatattatattgtacagtactcacctggttttagacatcagttgatcataagtaactgaaactctgtaaagagaaaccacacataagggagactactgtattttatgaaatatgtatgtgcatattaaatggaaaatgttttaaaaatattcaaatgttaaaacattgcaaactgatttaaagatccactcacaaaggcaatcagcttgcaaattcaaaggaagttgctattacctgtattttctcagttataccacagtggagctattcataatgtatcagaaagctaggcgtcacagttggatattatgtatataaatcagttgatttttgactcaaataactgaagtgtgttttggagataagttttatgattggaattggaaatgactgaattttgtggagcaaagcttttaactgtgttcacttggagatattctatagtgctttgactctggtttactactgtgcccagtggggtagatatttttttaaaaagacacgtattcaggaaaaaattttatttataaagattacaatatttgctcttgaaaataagaaataatgttagtcaaagaagccctgaatattactgtaaatcattgtacatgtattagtccttatggatttctttgcactagtaaaaatataattattcattttatttatataaggtctttgtgctgctgtaagaaaataccaccaatggtaatttacagtcaggcactgcatatttcaatcagtggtggacaacatgtgcaaaggtggttgtagaagattataatacagtgtatttactgtattttctgtgtttagataggtatttaccactgtgttacagctgcctacagtaacatcttctataggtttgtagcctaggatcaataggctatactatatagcctagctgtgtagtaggctatactatttagatttgtgtaagaatagactgtgaggttcacacaatgatgagatcacctaatgtcatatttctgagaacatatccctgttgttaagcaatgcatgactgtataagaaacactcaataaataatgtatggtagaaggtgattaaataccaaaataaatgaaaaccattaaagtgggcttaaaaacaaagtctcataattttagttactcatcacataaaaatgctttagttgttgcctgttccctaacagataagtgaatgttcacctaaggagactcaggagaaatccccaatactgagacaaacccagagattgagggataactgttctgattcagagggttttgtttgatcttacccctaaactttacaatgaaagtatgtttggtaatacagttaatataaaaatcagggttggctgggtgtggtggctcacgcctgtaatcctagcactttgggaggccgaggccggtggattgcctgagctcaggagttcgagaccagcctaggcaacatggtgaaaccctgtgtctactaaaatacaatcgaaattagcagggcgtggtggcgtgcgcctgtagtcccagctactcgggaggatgaggcaggagaatcgcttgaacctgggaggtggaggttgcagtgagccaagatcacgccactgcactccaacctgagcaacagagtgagactccatctcttaaaaaaaaaaacaaaaacaagcaggggtccccgacccccggaccatggaccagtagcagtccgtgacctgttgagaactgggctgcacagcaagaggtgagcagcagatgagcaagtgaagcttcatctgtatttacagccactccccactgctcacattagcacctgagccctgccttctgttagatcagaggcagcattagattcttattggagtgtgaaccctattgtgaactacacatgtgagagatctaggttgtgcactccttatgagaatgtaatgcctgatgatctgaagtggagctgaggcaatgatgctagcgctggggaacagctgcaaatacagattaacattagcagagaggtttgactgcacagagaccatagtaaatcaattacttgcagactcatttcaaaacccaatcagtgagtggcaggtggcaagctgcatctgacgtcaagctttatagtggcaagtgaggtgatgtacttcaattgtacagctgcatctggtggtaacgctttaagtcagaatccagcacttcttttaattcatgagtggcctgcttattattttatttaccactttcatctgcttctctttcctgcattacacacttttcttagtcagagttttggtaaacccaccagctaaccctacccaaaataagtaaaagccaaacatcactggagagcttctttgaaaagggagacagacccaatgatgagatagcagaagactctaagactgccaaccaaaaaaaaaaaaaagctgcatttaaaagaaaataccgagagtcttacataagttatgggttcattgcagtaggtgatttcacattctcagagcctgctttgtgtaatatgtggtgactggctgtccaaagccatgaaaccttcaaaactgcttcaccacatggagactacacgccctgcattagaagacaagcctttggagtttttcaaaagaaaagaacatgaacataaagaacagaagcaattactaaaggccactatttcatcaaatgtgtctccactgagaccatcattcttagtggctaaccacattgctaaagctaaggagccctttacatgaagagttgatcctgcctgctgctaaggacatatttcatgaacttttaggagaggctgcaattcaaaaggtggcatatcttcccctttgagctagcaccctaactagacgaatcaatgaaatagcagagtacatggaggcacaactgttagagaggattaatgaatcactgtggtatgcaatccaggttgatgggtctaccagtgttgacaacaagggaacaatgcttgtttttgtatgatgtatttttcaggaggatatacatgaggaaatgttttgtgtgcttttgttgccaaccagcaccacagctgcagaactattcaagtctttgaatgattacatatcaggaaaacgaaactggtcattttctgtcagcatatgcacagatggagcagctaccattacttgacagctttttggtttcactacttgggtcaaagaggtcgcttctgaatgtgagcctacacaccctgttatccttagagaaatgctggctagccaaaaaatgtcacctgaacttaacagcattttacaggatgtgattaaaattatcaaccacattaaaatacatgcccttaactcacatctgtttgcgcagctctgtgaggagatggacacagagcacacacatcttctctaatacacaggagtgagatggttttctaaaggtagatcactggccagagtttgagttacaagagccgcttcagagatttcttttaggagaatagttcttttcttttagaaaaacaatcaccactggcagcacatttcagtgacacagaaagggtcccaaaacttgcttacttgtgtgacctattcaacctgcacagagaactcgatctgtcgcttcaggggagaacaacaagtgtgttcaagtcggcagataaaatggctccattcaaaaccaaactggaattatgggggtgatgaaggaacattgggatttctgacatgtttcaagcattagcagagattttgagagactgagccagggctgcctttctctcagctagtgtatgatcacctatctcggctttcaaaagagttgagtattacctcccaaccacaaaagacccccgaactggaaggaatggatttgtgacccattcctgaataagtcaggtgaattgcctttgtccttgctagaagaggatccactgcttgacttcaaattatggtggccttaaaagtatgtttgagacaacttcaaatctccatatgttctagactaaagtcaaggcggaatatcctgagattgccacaaaagcactaaaaagcctgcttccattgccaacatcctgtctttgtgaagcagggtttcctgcagtgacagcaaccaaaatgagattatggagcagactgaatataagcaacacattttgggcgtcactatctcccatcaccccgagatgggaccatctagttgcaggaaaacaagctcagggctctcactgattcaacattatggtgagttgtataattatttcataatatattacaatgtaataatagaaataaagtacacaataaatataatgtgcttgaatcatcctgaaaccacttccccacccccagttcacggaaacattgtcttccatgaaactagtccctggcgccaaaaaggttggggaatgctgaaaaatgaaatccatctttctttgcattctttcaaaagattgagtctttcagaatatagaggggggcctataatgggatatattcattaactcatgcaacaaatatttattaaacacctatcatatgccaaacattgtggttaccagggagatagagtgataaacaatatagacatttgcaaaatattcacttcattcccctattgataagcattgatgcatcctgtgtcatatagaaaaggaggaaaattattattcggtaatattatagaacttaatgcaatttaagcaaatgcgtgtatacaaatgtgtatattttgtatatatttgatataatataccatatatatataatatcattctatgtaacctaccacatgttcagaatctgctgcagagattttttctgtgacacaaagaaacattaaatgcttatgcttcttttgttttttgtgggtttttttttctgtttttaaactagggatttggttatcctgcaaattatgaatttacttttgttttaatattctaaagctatacattaatattatttgccacatattggctgagagctattgaatcctttatagtgtaacattcttggcctaacagtctgcatttcccaggctgccagcaaagcaattcggtggggcaattgtggtcatgcaggggccttgtgagcggttggcagagagagaagcatacagatcagacagactcctatcctgcaggaaaggtagccctcctttctcccatcccagcagtcagcaggaggtagagccgctcagagctatatgaagagcctttgggaataggtgcctatggttatgttttgctgcagctgccctatattcacaacctcctgcattccatgcaggcttgacctctgcctctgcctattctctgggcagttctccctgtcaattcagctgtctgggggtcatgggatcccagaggtagctaggatgccagtgtgtttctctgcagttccttcacttacacctttcttaggaactgttgagggctgggagctggtcctggtactcggcaatgttttgcagtgttcccagcatcctccctcttctacctcagtgtcagtagtacctttctatcaactttcagtgttttctttaaaaagaaagtgtgatggtttactggatattttgggttcagtgaagtgggagaggcactttctggctgcatttagtcagccatcctgctccatagtcattggaattatctttctaaattttattttctgattgttgttcctggtatataaaattataattgattttttaattaaactttttagatagttgtagaattacatgtggttaaaatattttctaaagagagatcctctgtaccctctatccagtttcctcaaatggtaatatttagcaaaacagtacagtgtcacaatcaggagtttgacactgacccagtgaagataaaggacattttcatcaacacaaggatccctcaatttgcctatttgtaaaatacccacttccctttccccatctcccacctgaactccttgtaaacactaatttgttctccatttctataatattgttaaatcaagaaacttatataagtggaatcacaccacatgtaatcttttggggttgtgtactttctattagcataattatctagatatttatccatactgtatatcaggcgttggccacattgtatgacagagaagtattccatggtatggatgtgccacagtctaacattcactgattaagggaaatctaggttgctttcaattgtgggtaaatacaaaactactgtaaccccctatacaggttttgggtattaacacagttttcttttctctgggataaatgtccaggggtgcaatagcagagttggcatggtaattgcctatttaattcttaaaataactgctaaaatgtatgcagaatgactgtaaaattgtgcattccaaccagtgaactatgaatgatccaattctttccatcttcaccagcattttttagtcactattttaaaaaatgtagctattgttatagatgtgtgatgatatctcattacatttttttgtttgtttttgtttttttgagacagtcttgctctgtcacccaggctggagtgcagtggcacgtgtgactcagtctcccaagtagctgggattacagatgtgcgccaccatgcccagctaattttcatattttaagtagaggtgaggtttcagcatctatggtctcgaacccctggcctcaagtgatccgcctgcctcagcctcccaaagtgctggaattacaggtgtgagccaccacgcctgttcttattatgattttaatttacattttcctaatgcctaagatgttgaatgtattttccatctgcaaatcctcttgaatgaaatgtctctttataccttttgctcattttctgctttttttgttattgtcatgttcgagggttctttatattgtctgcatgccagtgttttcttggatacattgtttgcaaaatgttcttgtttcgtagcctcttctttcactttcttaccagggtttttcacacggtgaaagttttaaattttgataaagtacagtttatctatacttccttttatggatggtgctttttgtgtcaagtataaaaattccttgtctagcactactccagaagattttctcctatttttcctaaaacttttatagttttacacttcatatttaagtacaatgtccattttgagttattttttatgtaaggcatgagataggtcgaggtttttgcctatggatatgcacttgctccagcaccatttgttgagttgcttttttacttatgtgtaaaatcggttgggcatatttgtgtggggtctattcctggtttctctattctgtttcactgatttatatgtttatctttctggctaataccacacagtctttattattatatctgtatatgtcttgacattgagaagactgatacctcacacttaattctttttcaaaattgttttagctattataattcctttgcctttccatgtaagttgtagaataatattgtctatgtatactaaaaatactcactgtaattttgattggtaacaagctaagcttttgttattaatttggggagaattaatatttttaaatgttgagtctaacaatctgttattctgtatatttatttattagatctttgatacctttcaccaacattttgtagttttcagcacgcaagccctacaacgttttgtagatgtacacctacctatttcattttttttaagcaatgataagtggcattatattttaatttaaagattcatgtgtccatggctaatatatacaaatgtaattgattttcatatatcagtcttgtatcttgtggccttgaagaactcccttattctaggagttttttctaggttccttgggattttctatgttgacaaatgtgccatttgcaaatagggacagtttatctccttctttccagtctgtttgcttcttatttccttttattgccttactgcacttgctaaatattatttacttcattgaataagagtagtgagagcatatatctttttttttttgttcctggtctttggggaaagcattcagtctttttatcattaagaatgatgttagtagatttttaaacaatgctattttttaccaagttgaggaatttcctttttcttctcatctttttgagaatttttatcatgaattggttgaattttgtgaaatgctttcccgcattgattctataatcatgtgattgtgtttcttcaaactgttaatatgatgttttacattgattgatttttgaatattgaaccagccttgcatacatggaataagcaccatttagtcacgatatatagttctttttatatgtaattctgaattcttttactaatattttgttaaggatcttttggatatatattcacatgagaaatatttgtctttgggttttgttttattatactgtctttgtttgctttttgcatctgcgtaatattcccttcataatatccatttggatattccctcctttgattttctgatagagatggtttagaattggtgtaaattttgtgagtatttgtttggattttccagtgaaagaattattgcctagacagtttttggaggagttttaaaatacaaatccaatgatcttaatagttgtaggtctattcaaattactgatttcacattgggtgagtatttggtagcctgttgttcttttgaggaattgcctgtgtctcttaggttaacaaactgatgtgtgtagagtggtttgtagtatttccttactatccttttgattcctacagagtcggtagtgatatctctcctgtttctttcgtgatgtgggaataggtgtactttattttattgggctttacattttgactctgctcaaagattgtgctttttacatatcaaaggtttatggcaatcctgcatcaagcgagtctgtcagtgccattttttcaacagcatgttttcattttgtctctgtgtcacattttggtaattctcacaatattttaaactttttaataatgactgtatctatgatggtgatctctgatcagtgatgtttgatgttactcatacaattgttttggcttaccatgaaccacatccatagaacatggtgaacttaatcaataaatgttgtgtgtgttctgtttgttccacttaatgaccatttccccatctctttctctctccatgggttttcttattcactgagacacatcaatactgaaattaggccaaataattaccctacagtgccctttaagtgttaaagtgaaaggaagagctacatatctctcactttaagtgaaaagctaaaagtgagcaaatttactgagaaaggcatgtcacaagccaaaacaggtcaaaagctaggcctctcgcaccaaacacttagccaaggtgtgaatggaaactaaaagtttttgaaaaaaggtaaaagtgctgtttcagataacacatgaatgataagaaagtaaaacagcttaattgctaataaagagataattttagcagtctggctagattggactagccacaaaattttcttcagccaaaacctaatccagggcaaggcccgaattctcttcagccctacaaaggctaagtgaggtgcagaagttgcacaagaaaagttggaagctagcagaggttgcttcctgaggtttgaggaaataagtcatctctgtaacataaaagtacaaggtaaagctgcaagtggtgatttaaaagttgcagcaagtcatccataatctagctaaaatcattgatgaatctttagtggctacactcaacaacaggttatcaatatagatgaaatagccttctgctgtaagaagatgccatctaagactttcatagctagagataagatatcaatgcctggcttcaaagcttaggctgactcatgagttagtggctaatgcagctggtaactttaaattgaagccattgctcatttaccattttgtaaatcataggtcccttaagaattatgctgaatttactcttcctatgctctataaatgaaacaacaaagctaaatcacaatacatctgtttacagcatgatttactaaatactttaagtccactgttgagacctactgctcagaaaaatagattaaaaaaaatactgctgctcactgacagtgcccctcgtcagccaagagctctgatgaaaatgtacaaagagaataatgttgttttcatggctgctaacacaacatccattctgcagcctatggattagggagtaattttgagtttcaagtcttattatttaagaaatacattttgtcaggctatagctgccatagatagggattgctgtgatagacctgggcaaagtaatttgaaaacattttggaaaggctcaccattctagatgccattcataacattaatgattcatggagggagttcaaaataccagcattaataaaactttagaaattgattcgaccctttatggatcagttcgaggggtttatgacttcattggtggaaagtagctgcagatgtggtaaaaatagcaagagaaatagaattagaaggagagccggaagatgtgactgaatttctgcaatctcatgataaaattttcacagatgaggagctttttcttatggataatcaaagaaaggtgttccttgaggtggaatctactcctggtgaagatgctgtgaatattattggaatgacaaaaaaggatttagaatatgacataaacttacttgataaaacagtggcaggatctgtgaggattgactcttccaattttgaaaaaaattctgtgaataaaatgctattaaatagcattacatggtacagagaagtattttgtcaaaggaagagtcaacctgtggggcaacttcattgttatctttctgttgcaaccaccaccatgatgagttagcagccatcagcatcaaagtaggaccctccactaacaaaaactttacatctcattgaagggttagatggtcattagcattttttgcaataagatcttttaaaatcaaggtatgtacattttgaaaacgtaatcctattgtacatttaataaactgtagtatagcataaacataactttatatatgcactggaaaaccaaaaagttgtgagacttattttgtcataatattcattgtattgtggtggcctagtactgaacatgcagtacctccaaggtgtgcttgtaatttgtttcttttctgtttttctctttgtcagtcttagaggcagctttttttttttaagatccagctttttgtttcattgttttattattttgctgtttttaatgttattggtttgtgctctttattatttccttctttctgcttgatttagttttattatgcttgtcaatttctagattttatgcttatattattgatttgagacttttactgttttcaaaaaaatgcacttattgctatattgtccgtatagcactacttttcctctattccaaaatttttgatatatcttattttcatattttttttcagtttacagagtgtgtgtgtgtgtttgtgtgcacgcgtttaatttctcttgagatgtgctttttgtttcatggattatttagaagtctcttgtttagatttcaaatctgtgccttgtctggtatgtttctgttgtttccattctggtcaaataatattttgggtattatttcaattattttacaataattgatttttcttttaagatacagaacatggtctatattgaaataagttctgcaggcatgtatttgctggttttgactagagtgttctttaaatgtcagttatgtcctggtggttgatactgttgagttcttctgtatctttgttgattatataactagttctttctaattttgtgaggcttcttgatgtctccaactatgtttatgtcttttctttcattttttcaggtatatcagttttgcatcacatgttttgcagctttgttgtttgttatatacacctttaggattgttttgtcttcccgatggattaatttttttatcattatgtattgtgcctctctgtctctggtaatttcttttcttttgaagcctactttacctggtattaatacagccactcctgctttcttatgtctacttggtagatctttttccatgtttttatagtcaacattcttgtatctttatatttttagtgagtttcagatggagagcatatttttgagtctgcctttaaattcactctgctaatctctttcagttggtgtatttacaccatttacatttatataattaattatctgtaggagcttaagtctcccactgtatttcttgtattttgtttgttctcacttgtttctctttttcctttttcctttcttcttgggagttatttgaatatttttaggagtttcatttttatttataaatatttttaatgatatctcttttctagtggttgtttattggttactctagtgtatgtgtgtgtgtgtgtataaaattttatcaattttatcaattcatgtgaagtgtaggaaacttaaatttatatctcattaccctctcaatacaattgcctgaaatatttcttgtacgtacatatagactcacattagacagtgagtctgtgagagtctataatagtttcctgaaatattttgtacatacatatagactcacattagacaatgttacagtttttgcttcagcattcaaacataaaagcccaagatgagaattttgtctgttgtatttacccatatatttgcctactattataatgtttttcttcctgatgttccaagagttcttatttttttgcttactttatgtttagaaatctttcattgaccattatattagggttggtatgctggtaaaaagttttcttagtttttcttcatcaaagaatgtcgtaattttttttttcatgtctgaagagtatttttactggatataggatgtgggttcacagttcttttatttaagcacttcaaaaagtacttccagtggggcgccaagatggccaactaaaagcagctatggtgtgtggctcttacagagaggaacgaaagggacgagtaaatgcagcacctttaactgaaacatccaggtacttgcattgggactgatcagggaaacaactcaacccacagagaatggagaagagcaggacagggcagggcagggcaacagcttacctgggagcaacatggatacaagagaacctacccctgcccagggaagcagtgagtgaatatgtgaccctgggaaaccatgcccctcccacagatctttacaagtccggtcaggagatccccttgtgaatccattccaccagggccttcggtctgacacacagaactgtgtatagtctcaacagaaaagctgctcaggcatgcatggagacccgggaactttacatactctggctctagtatccctaacaaaggtgattgcaacttaggcagggcgggagcttggacatccatatttacccctaggaagggatctgaatccagggggctaagaagcattgatctgtgggccccatttccacagcttctcacaggataagacccactggcttggaatttcagccagcccccagcaacagagttgtacctacctgggacaaaacagagttgctggcgggaggggcagactaccatctttgctgcttggataactcagccattccagcctgtgggcttaggcgagtccaaaccaactgggcatggaagggatcacctagcacagcaaagctgctctaccaaaatgtggccagactgcttctttaagagggaccctcaatccaaatcctcttcttgggtgttacctcccaactgacagagttttgatttctctttgggactgagtgcctgcggggaggggcaggctaccatctctgctgtttggacagctcaacctttccagcctgtgggctttggagagtccaaaccgaccagggcagaagggatcccccaacacaacacagctgctctaatacaacatggccgactacttctttaagcagaaccctgatccgttcttcatctctgagcaggacctcccgactggaccctccagccaccctcacttgtattctctggttcacaatgttttgatttcaccctgggactgagttcgagggggaggtgggcgggcgccatcgttgctgtttgggcaactcagcattctgtcctgtgggctttggagagcccacgcccaccagggcagaagcagtaccccagcacggcacagctgctctatgaaaccatggccatcctgcttccttaagcagtccccgatctattcctccttgcagggcgggacttcccaactgtgtcctccagtcactcccatggatgttctgtggctaagaggtttgaaaacttcctgggacagagctcctagagggaggagtgggctgccattttttctgtctcagcaacttccgtagtttacagactttggagagcccaagctaactaggggcagaagtggtacacccacacagcacagctgctttataaaagtgtggctagactgcttctttaagcagatccctgatcccactcttcctgactgggtgacacctcccaaccagtgtctccagccaccacctaccacctggttgtttgggccagcaaccaggtctgtacccctctgggacagagctcccagaggaaggggcaggctgccatctttgcagttttgcagccttcactggtgataccctcaggtactggaaaacctaaggcgactagggactagagcagatgcccagcaaaccacagcagccctgtgaaaagtggccagactgtaaaaaggaaaaaaaaaaaatccaaagatcagcctcaaagattgaaggtagatgtgcccacaaagataaagaatcagcacaagaacgctgaaaactcaaaaagccacagtgccctcttctgttcagatgaccacatcacctctccagcaagggtttggaattgggcagaggctgagatggccgaaatgacagaagtagacttcggaatgtggataaaattgatgttcattctgctacagctgcaccttctaactcaatgcaggaagctacagatcatgataaaacatttcagcaactgacaaggtaaaatagccagtatggagaataacgtaagcaacctgatagcgctgaagaaaacaacagaagaagttcataatgtaattccaagtattaatagcagaatagaccaagtggaggaaagaatcccagagcttgaagactgtctttctgaaataagacaggcatacaggaatagagaaaaaagaatgaaaaagaatggacaaaacctctgagaaatatgagattatgtaaagagactgaatatatgactgattggtgtacctgaaagagatgagaagaatggaaccaacttggaaaatatatttcaggatatcttccatgaggacttccccaacctagctagacagaccaacattcgatttcaggaaatgggagaacccctgtaaaatattccacaagaagatcatccccaagacacataatcatcagattctccaaggtcaaaatgaaagaaaaaatgttaaggacagccagagagaaaggccaggcaacctacaaagggaagaccatctgactaacagcagacctctcagcggaaaccctacatgtcagaagagattggaggccaatattcaacatgctgaaaaaagaaaaattccagcccagaatttcatatgtgcccaatctaagcttcataagcaaaggagaaataagatactttccagacaagcaaatgttgaggaaatttgttaccaccacacctgccttacaatagctcccaaaagaagcactaaatatggaaaggaaaaatcgttaccagccactacaaaagcacactggagtacacagacaaatgacactataaagtaaccacaagttattttaaacaagtctccaaaataaccagctaacatcataatgacaggatcaaatctgcacataacaatactaacctcaaatgaaaatgggataaatgccccaattaaaagacacagagtggccagctggataaagaaacaagacccaatggtctgctgtcttcaagagacccatctcatgtggaatgacacacataggctcaaaaaaggatggaggaaaatttacaaagcaaatggaaaacagaaaaaagcaggggttgcaatcctgttctgacaaaacagactttaaccaacaaagatcaataaagacaaagaagaagggcattacataatggtaaagggttcaattcaacaagaagaactagctatcgtaaatatatatgcacccaacactggagcacccagattcataaaccaagttattagagaccttcaaagagacttagactcccacacaataatagtgggagactttaacaccgcactgacaatattagacagactgagacagaaaattaacaaagatattcaggatctgaactcagatctggattaaatggacctgatatatatctacagaactctccactcaaaaacaacagactatacattcttctcatcaccatgtggcacttactctaaaaaagatcacataatcggaagtaaaacactgctcagctcagcaaatacaaaagaactgaaatcataaccaacagtctcttggaccagagcacaatcaaattagaactaaagtctgaagaaattcactcaaaaccacacgattgcatgaaaattaaataacctgcccctgaatgacttttgggtaaataatgaaattaagatggaaatcaagttctttcaaactaataaggacaaagatacaatgtaccagattctcagggacacagctaaagtagtgttaagaaggaaatctatagcagtaaatgcccacatcagaaagctagcaagatctcaagttaacaacctaatgtcacaatgaaaagaactagaaaatcaaaatcaaacaaatcccaaagctagaagaagacaagaaataaccagaatcagagctgaactgaaggaggtagagacaagaaaagccattaaaaacatcagtaaatccaggagttgtttttttgaaaagattaataaaataggccactagatagactcatgaagagagaatcaaataaacacaatcagaaatgataaggtggatattacgattgtccccacaggaatacaagcaaccatcagagaatattataaacacctctatctgtatcaactagaaaatctagaataaatggataaattcctggacatatacaccctaccaaaagtgaaccaggaagaaattgaatccctgaacagaccaataacaagttctgaaattgaggcagcaataaatagcctaccaaccaaaaaaaaaaaaaaaaaaaaaagcccaggaccagacggcttcacagctgaattctaccaaatgtacaaagaagagctggtaccattcctactgaaactattccaacaaattgaagaggagaaactcctccctaactcattctatgaggctaacatcatcctgacaccaaaactttgcagagatacaaaaacaaaagaaaacttcaggccaatatccttgatgaatactgatgcaaaaatcctctgcaaaattctagcaaactgaatccagcttatccaaaaagataaatcgagctttatctcaaaaaactgagtgaacaggcaacctacagaatgggagaaaatttttgcaatctactcatctgacaaagggctaatatccagaatctacaaagaactcaaacaaatttacaagaagaaaacaaacagcaccatcaacaagtgagcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaagagtcaggaaacaacaagtgctggaggggatgtggagaaataggaacacttttacactgttggtgggactgtagactagttcaaccattgtggaagacagtgtggcgattcctcagggatctagaactagaaataccatgtgacccagccatcccattactgggtatatacccaaaggattataaatcatgctgctataaagacacatggcacacatatgtttattgtggcactattcacaatagtaaagacttggaacctccccaaatgtccatcagtgatagactggattgagaaaatgtggcacatgtacatcatggaatactatgcagccataaaaaaggatgagttcacgtcctttgtaggggcatggatgaagctggaaaccatcattctcagtaaactatcgcaaggacaaaaaaccaaacaccgcatgttctcactcataggtgggaattgaacaataacaacacttgaacacaggaagggggacatcacacaccggggcctgtcgtggggtagggggaggggggagggatagccttaggagatatacctaatgtaaatgacgagttaatgggtgcagcacagcaacatggcacacgtatacatatgtaacaaacctgcacgttgtgcacatgtaccctagaacttaaagtataataaaaatatatatatataaaatattaataaatattgaatcttccaaccacccaaaaaaggaaaagaatgcacaatatcttattaataattttatatggtttacattttgaaatgataacattatgaacttactgtattggattaaataaaaacattttttaataaaaaaaaaagcttgtccaccagagttaaataggctttatccctgggatgcaaacttggttcatcattgcaaatcaataaatgtgatttatcacataaacagaactaaagaccaaaaccacttgattatctcaagagattcagaaaagatttttgataaaattcaacatccctttacttgaaaaactctgaccaaactagatactgaagaaatgaatatacctcaaactaataagagccatagaagacaaactcacagccaacatcatactgaatgggtaaaagctggaagcattctccttgaaaaccggcacaagacaaggacgccctctctcaccgctcctgttcaacatagtattggaatttctggccagagcaatcaggcaaaagaatgaaataaagggcattcaaataagaagagaggaagtcaacctatccctgtttccagatgacatgattctgtatctagaaaaccccagtcgtctcagcccaaaagcttcttaagctgataagcaactttagcaaagtctcaggatacgcaattaatgtgtaaaaatcactagcattcctatacatgaacaacagtacaagtgagagccagatcataaacgtactccccttttcagttgccacaaaaagaataaaatacctaggaatatagctaacaacaaagcgaaagatctctgcaaggagaactataaatcactgctcaaacaaatcagaaattacacaaagaaatggagaaacattccatgctcatggataggaagaatcagtattggtaaaatggccaaaatgcccaaagcaatttataaattcattgctattctgattaaactaccattgacatctagttctgtaaactaccattcacagaactagagaaaactattttaaaatttgtactgaaccaaaaaagagcctgaatagcccaagcaatcgtaagcctaaaaaacaaagctggaggcatcacactacccaacttcaaactatactatggggctacagtgaccaaaatagcatggtagtggtacaagaatagacacataaccaaaggaacagaatagagaatccaaaaataagactgcacatgtacaactatctgatcttgaagaaacctgacaaaaacaagcaatggggaaaggattccctattcaataaatggtgctgggataactggctagccataggtcgaaaattgaaactagacccttcctgacaccatacacaagaattaattcaaggtggattaaagacttaagtgtaaaacccgaaactataaaaaccctggaagacagcctaggcaactacattcaggacattaggtactggcaaagatttcatgacaaaagtgtcgaaagcaattacagtcaaaccaaaaattgacaaatgggatctaagcttctgcacagctaaagaaactatcaacagagtaaatagacaacctacacaatggcagaaaatttttgcaaactatgcatctgacaaaggtctaatatctagcatctataaggaacttaaatacatttagaagaaaaaccaccccattaagacatgtgcaaaggacgtggatacttctcaaaagaagatgtacatacagccaacaaacatatttagaaaagctcaacatcactgatcattagagaaatgcaaatcaaaaccacagtgagatatcatatcctaccagtcagaatggctattattaaagagctgaaaaataacaagacgcttgtgaggttgtggataaaaggaaggcttatacactcttggtaggagtgtaaattagttcagccattgtggaagacagtgtggcaattcctcaaagacctaaaatcagaaatagcatttgacccagcaatcccattactgggtatatacccaaaggaatataagttgctctgttataaagacacatgcacccatatgttcattgcagtacttatgacaatagcaaacatatggaatcaacccaagtgcccatcaatgatagactggataaagaaatgtggtacacatacaccatggaatataaggcagccacaaaagagaatgaagatatgtcctttgcagggacacggatggagctggaagtcattatccttagcaaagtaacacaggagcagaaaaccaaatattacatgttcttacttaggaatgggaactgaatggtgagaatacatggacacgtatagaggaagaacacacaccagggcctacttgagggtagaaggtgggacgagggacagtatcaggaaaaataactagtggatactagtcttaatacctgggtaatgaaataattgttacaacaaacccccatgacacacgtttacctgtgtaacaaaccttcacatcctgcacttgtacccgtgaacttaaaaaagaaaaagtgcttccttctagcctttctggtttctggtaagaaattgattgtcatttgtattacctttcccactttcctgctgttttttttttttttctttttttgagacagagtgtcgcactgtcgcccaggctggagtacaatggcgttatctcggctccctgcaacctctgcctcccaggttcaagcaattctcctacctcagcctcctgagtagcagggattacaggcagggtttggctatgttagctaggccggtcctttcctgctgtttttaaggtatttccagccgggcatggtggctcacgcctgtaatcccagcactttgcaaggccaagacgggtggatcagctgaggtcgggagttcgaggccagcctggccaacatggagaaaccccatctctactaaaaccacaaaaattagctgggcgtggtggcgcatgcctgtaatcccagctactcaggaggctgaggcgggagaatcgcttgaacccaggaggcggaggttgtggtgagccgagatcgtgccattgcactccagtctgggcaacaagagtgaaactctgtctcaaaaaaaaaaaaaaaaagatatttcctttgtctttagttttcgaatatttggccatcataaatcttggtgtggatttcattaactgtaccctctttcaggttttttaaactcttgaatctctatattgagttgttatttttttttaaatgtatcctatccttttatccctcttctttgacactcagatgatattaactttagttcttttgttattgtttgacaattcttggggactttatttttttttccaaaccgttttcttcttttccagattggatgacttctagtgtgttatctcctagcttgctgattgttttcgcatgtttctttcattctagtattgagcacatccattaagttttgtatttcagttattgtgtttttcaggtataaaatttctatttggtcttcctgtgtatcttctacttcttgattaagattctttttctttgctgtgactttttgctcataaaatttgtttcatgtgtttttataattcctttttgaataatttttatcatgacaagactaaaattttttcaggcaactctagcatctctgctgccttggtcttagcacctgtcattagccttttttcattcagtttgagatcttcctggttctttgtatgacaacttattttttaataaaacctgaacattttgggtcttatgagaatgtagtctttatttaaattatctggtgtagctgtctcattctgacacttcatctgagagtagtccctctacctctttgctccaaggttgaggtgggagtcgggttttttacttggcctccttggtaggtaaggcggaaggttttccatgttactgctgtgtaggcatgttagttttggctccctggtaggtctccagtgaaccccttttggctaggattggtaggagtatctttgtggggttggttgaagatgtttggaagatttcatgtagaacttgagttttaatatgctttcaccagaaatataaagcagtggaggagatcataaatcaatttgcatcctctctggaaagccataggcatatgctatattcatgcatgtatcagaaattacaatattaactggctctctataatgcctcgtaattttactggttcttgtcaaaaagtggttagtaaacgttttctgccaggtacagtggctcatgtctgtaatcccagcactttgggaggccgaggtgggtggattgcttgagcttagaagttcaaaccagcctgagcaacagcgaaacccagtcttaacaaaaatacaaaaaaatttagctgggcatggtggcgaacgcctgtggtcccagctacttgggaagctgagggagaaggatcatttgagcctaggcggtggaggttgcagtgagccgagatcgcaccactgcgttctagcctgggcgacagagcaacactccatctcaaaaaataaataaataaataaaaagaggccatatgttaaatattttagattttgtgggccaagaggcaaaattgagaattgtacctaggtacttataagaaagaaaacaaattttctcagatttttttgatttatgaaatcaaaatttactaatagtaatggagtacaatgtttataatttgtgtttactaatatgaagaatgaaagatggtggaaataacagtttagagtttatgtttagtagggtttatagtttgtgttccctgtcatcaaaattagttgcacatgttcatctgttaatgctaatctgtatggagtattttatccttgcaaatgtcttttcatgaaaattgttattggcacatactaatcttgatccattatcttgatttaacttggcatattaatcatttggaatacatttttagaattctgttaggttttcgtgcctttgagcgtgtcattgcattacagattaatcacttaatgaagataagaagtggaaagttctcagttgtagagttaaatagacttatggaaatttcctttcagtttgcatgaggtcaaaaatatttggctggaaatgtaatttgaaaatttatctgctgcccgtttgtcaggaaaggagattttgcttctttaacttttgtcagaaaaagaatgtgttaactttcaacagcataaaacagcttgaaagtacttagaattcaaacaatgtttgcagttgttaaatgactatcgtaatataagttttgcatataatcattgttttggcttataattttagattgattacattaataccatgaaatctttacatcagtttctctttttgaatttttaaatgtatatgtaaaggctttattaattattgattcaaactgtttcttcttttgtgaactttgatggtgtctttaaggaattggtttattccatcaagattatcagattcttgattcatgtcttgttcataatattcctttattatccctttaatgtctatgacatctgcagtgatgtttcctctttgtttctgatattcatgatttgtgctttcagtgaacttggcgagaggtgtattgattttatcaaagaatcaccttttggtttcattcatttttctctttagatttcccattttcagttgcattgatttctgctcaaatttttgttatttatttgcttctgcttaatttggatttaagttgctgtcatatagctagtttgataaggtggaggcttagattattaattttaaatctttcttcttttctaatatatgcattcaatgttataaatttccctctaaacactgcttttactgcctcccttacattttgataaattatggtatcattatttaaataaaaatatttctaaatatattttgagatttatttttgacatgttctttagaagtgttttgtttaatctataggtatttggggatacttcttttattctcctgttattgatttctagtttaattccgttatggtctgagagccaacactataattttgtggtaagatgtgaacgtggtccttttggtgaatgttccatgttagtttgagaagagtgtctattctgcttttattggatgaagtcatcaatagatgagagtatatcaaattgattattagtgctgttgaattcagctatatccttattgatttttttcttgtgagatttgttcatttatgatagaggattgttagtctccaactgtaacaggggtttcatctattactccttgcacttctatcagtttttgcctcatgtattttaatgttccgttgttaggtgtatatatgctaaggactgttatgtattcttggaaaattcatccctttatcataatatattgcccctctttattcctgaaaacttttcttgctttgaaatctgctctgtctgaaattaatacgctaccttcactttcttttgatcagtgttagcatggcatttctttctccatcctttcacttttatctgtaagtatttttaaatttgaagtggattttttggtagaaaatgtataattggaccttatttttttaatctaccctgacaatctctgttttttaattggtgcattcggaccattgacattcaacatcgttattgatgtaggtgaattaatatctaccatattttaaacttttttatttgttgcctttgacctttgttcttgttttgtctcccactcttctaccttttgtgtttctaattgaacattttatgtaatttgaatttctcttttgtcatagcattatcagttaggcctctgtttttaatttttatttttattatttttttgagacagagtctggctctgtctcccgggctggagtacagtggcgcgatctctgctcactgcaacctccgcctcctgggttcaagcgattctcctgcctcagcctccctagtagctgggactaccagtgcgtgccaccacgcccgggtaattttttgtatttttagtagagatggggtttcaccgtgttaaccaggatggtcttgatctcctgacctcatgatccgcccacctcggcctcccaaagtgccggaaatacaggtgtgagccaccacgccctgcctgtttttattttttaatggtcatcctagagtttttaatacacgtttcaactaaacgaagtccaataacactatattcacaagcagtgtgagaaaataatcctaattcctctcttccacgcagtgtatgcttactggaattcatttaactttataaaagcatgcagaagaatacatgtgtatataagcctacataatcatatacattgttgctattattattttgaacaaactattatgttagataaatcaggaaaaagaaaaatttttactttaccttcatttatttcttctctaacgcactttatttaagaagatctcagtttctgactgataatcatttttcttctttctgaagaaattcttttaacatttcttgtatgtcagggctcctggcagcaaattagccaatttttttactgcccgagaaagtctttatttcaccttcacattttttcctttatttttagctgacatgtagtaattgtacatatttatagtctacagagtgatatttcaatacatttacacaatgtgtaattataaaatcagggtatttcgcatatccgtaatctcaaacacttaacaattctttttactgtgaacattcaaaagcttctcttctagttttttgaaaatatacaataaattctagtcatccatatttatactacagtgctgtaaagactagagcttactcctatttttcttttctttttttttttttgagatggaatctcgctctgtcccccaggctggagtgcagtggtgcgatctcggctcactgcaacctctgcctcccgggttcatgccattctcctgcctcagcctcccgagtagctgggactacagacgcccaccaccactcctggctaattttttgtatttttagtagagacggggtttcaccatgttagccaggatggtattgatctcctgatctcgtgatccacccgcctcagcctcccaaagtgctgggttacaggcatgagccactgcgcctggtccttactcctattatctacctttaagtttgtgttcattaaccagcctcttcccatccttccctacccactccccttctaagcctctagcaaccacaattctactctctacgtctatgacctctttttttgtttttaatggatactacatatgcatgagaacatgcagtatttatctctctgacttatttcacataacataatgtcctccagggtgatccatattgctgtgtatgaatgcatttaattctctctctcttttttatgactgaatagcaatcaattatgtatatacgacacatcattctctttatccattcatctgttgatggatgtttagtttgattccatatcttggatattgtgaatcatgcttcagtaaacatgggaatgtaagtatccctttgacataattgatttccttgctttttgataaatgcccattcctgtgattgctggatcagatggtaattaaatttttactttttgaggaacctccatactgtttttcataatggccgtactaatttacatatccacaaacagtgcataagttcctgtttctcttcgtcgtcaccagcatatgttatctttgatcttttataatagccattctgactggggtgagatgatatctcattgcagttttgatttatgtttccctgatgactagggatgttgagcattcattcatatatttgttggctatttgtttgtcttcttttgagatgtctattcagattctttttccagttttttttttttttttgacggagttttacgcttgttgcccatgctgaagtcgaatggcacgatctcggctcactgcaacctctgcctcccgaattcaagcgattctcctgcctcagcctcctgagtagctggggactataggcacgtaccaccacgcccggctaatttttgtatttttagtagagatggggtttcacccatgttggccaggatggtctcgatctcttgacctcatgatctgcccgcctcggcctcccaaagtgctgggatgacaggtgtgaaccaccgctcccggcccctttttccagtttttaatcagattttttgatgggttgtgtgagttccatatatattctggacattattcccttgtcaggtaaataatttgcaaatattttctttcattcaacagactatatttctttactctgttgatcttctttttttgctctacagaagctttttagtttggtatagttccgtttgtctatttttgtttttattgcctgtgcctttgaaatctttaaaatctttgcttagacagatgtcctgaagcatttcttatatgttttcttgtagttattttgtaatttcaggtcacaggtttaaatctttaatccattttgagttgatttttgtggtgagaaggatgtactttcattcttctgcatataaatatccaattttccaacaccatttagatattttattctttttagcaggtattgactgcaaatgggcttgctttcctgatttttttttcagctagttggttattctataaaaacatcactgattcttgcatgttgattttgtatcctgcaactttactgaatttgtttagaagttcaaagatattttatccttttatagattcaggagggatatgtgcaggtttgttacacacacatatatatatatatagcataatggtgggatttgggtttctagtttagtcatcatctgactagtgaatattgtacccaataggtaatttttcaaccccaacctcccctcttttggaatccccagtttctattatttttcttcctagagttttttgaagagtcttcaggattttttatatgtaagattatgtcatctgcaaagagggacaacttgcctttctcctttctaatttagatgaactttatttccttttgtggcctaatttttcttacaaggaattccagttctatcttaaatacaagttgtaaaagtatacattcttttcttgttctagttcttaaaggcttttagcttttctccattcagtgtgatattgtctgagtgtttttcatatttggactttattgtgtttaggtataatctttctatacttaattttttagagtgtttattatgaagggagttgaattttatcagatgctttctttggatttgagatgatcatatgatttgcttttcatctatcattctgttgatgtgatgtagcacatctattgatttttatatgttgaaccatcctcgcatacctgggataaattccactcaatcgtagtgtattttttttttttttttgatgtgcctttggattcagattcctagtattttgttcaggatttttgcatctatgctaatcatggatactgacctctagttttttttgtgattgttgttgcatccttctttagttttggtatctgggtactactgacctcgtagaatgaattaggaagaatttccacctttttaattttttggaagagtttcagcaaaatagatgttcttcttttaaagctttttggtcctgggctttttgttgggagacttttttattgccagtttaatctcgttactcattattgatctgctcaggttttctatttcttcctgatttaatttgtgagattatatgtgtccaggaatgtatccatttaatataagttttctaatttcttagtgtgcagttgttcataataatttctagtggtcctttgtatttctgttgtatcagttgtaatgtctcattttttatttctgattttacttatttgagtcttccttttttcttgattagtctagctactggtttgtaaatatagtttatctttcgataaaaccagtgtttcttgtgatcctttgtgggtttttgtctctatttacttctgctctgatgtttccttcttcttattttaggtttggcttgttcttccttttctggtttcttgaggtgctttgtcagattgattaagtgaaattgttcaaatggtttaagtgtttattgctgtaaacttcccttttagtactgtttctcagtacactataagtttttggtatgctgtttctatattaatttgtttcaagacttctttggtgtctttaaatttcttaattgaaccataagtttctcagggtcttttctctttttttcttgattaatcttattaatttttgattttcatgtatttgtagaatttccaaagttcctcttgttactaatttctagttttactccattatggtttgagaagacacttgatataatactgatttttgaaaatttcttgaggccagtcttgtggcctaacatgtggtctgtcttgtagaatgttctatgtgctgatgtcaaaaaatggatctaaaatggtttacaggccatatttggtccaacagctgcagttggaccaaatatgttctgtaagccatctttagatccatttggacacacatttttgaaggataactttgttgggtatagtgttattaatcagtaggtattttttgttttagtactttgcttaaaccattttttttctctcttggcttataatggttctgctgagaaatttactgttagtctgaaggggattcccttatatgtaacttgatgccttttgctgtttttagaattatttctttgtctttgactcttggcagtttgagagatatatgtctcagggatgacatttttgggttgagtattttggggacatttgacctttccagatcttgatgtctgtctctcaagatttgggaagttgtcagccattattttacgaaataagttttctatgccttttctacactcatttccttctataattcacaaaatgtgaatatttatttacttgatggtttcccatgtcatgtaggtttattcattcttttttaaatttttttttccttttgtctgggttatttttaaaaacctatcttcaagtactaaaattatcttctgcttgatctagtcgattgttgaagctttcaattgtatttttttaattttaatcattgaattcttgagttccgggatttctgtttagttgttttttatgacattctatttaatttctcatttagatcaccagttgttttttttttctgatttatgtatattttctatctgtgttcttttgtatctactaagttttaaaagattattatttaaatttgttaaggtatttcatagattttcttttggggctctgttattggagaattattgtgtttctatggcagtgtcatatttcctttttcatgtgtcttgcatccctacattgataactgtgtatatggttagcaatttcgtctttcagttttctggattagcttttttaggtaaacttttttctgtagacatatctatagtgtcatttgggtagagtgttttggctttggttcaggtggttgcattagtgtagtctctgtatggttactttggctgtaaataatgttaacagtgtctgcagtttccctagggcgttcaggtgaggttgttcatggagtcagcgacaagactttcctggcaacatggatatttggtgggcttgttctttggctcctaagggttgtgcacaggcactggcagtgttagcagtgggttgttcttgggctcctgggtggtgattggaggcacatggtggccttaccactggagttcatgaggtcatcatttgtggtacgcactaggtgggccagccctcaggcccgaagtctccctgtttacacattgactgtagttgtagcaggccctggttgagccagtctttgagttcacaggtggcacacatgggtgccttcatttttagatggatattttatcaaggtacaaacttttggattcaatttatctcaagtattttaaacatattgtcccattgtcttctggatttgatagtttctgttaaaaattcagctttaagttttcttgtttttcttttgaaagtgatatgtcttttttctccctctgactgttgttaaagtgttcttgttatctttgattttcagcattttgagtgttggttgtggtttttttcacctttgccagtgtggtgtttgccatacttcttaagtcagaacattaatatattgtatcagttttgggctagtctcagcaatttttaactttttctgaaagtattgtttctcctcactttctgtctgctttattctaactggaattatatttgtgttgaagtgtttaattcccacatatctcttatgctctgttcatttcatttctttcttgctgtgcttcagtgtggatatttcctgctgacctatattcaaattcactaatctgtgctttgctgtattcagtcagttataaaacccacccaccaactgcttaattgcagatagtgtgtttttcagatataaaatcactatttaatttttaaaatagattttcattctttgttgaagttttccttttttcatctactttgaagatcttttttaaagtccttgtcttctaactctatatcatctgtgggtctgtttatatttattctcttttcccttgattgttagtcacattttgtgcccctttccataccttgtaattttcatcatataccaaatattgtttataatagagcagcagaaattgaactaaatattatttttcttcaattctgtattagaaagataagatcaagtgctaatcacctcaactcaattatgaatcttactgcatcaagtctgggtggcagctttcgatacacttagaatgcctttgattttaaatgtcctaatgacaacaactgttgtgttgcagactcttctgtctggtgactttgtatttatatactgtaaaattgttggagattttactctacctttctggtcctgctccttttactcatttcctctggctccccacccactaaggggatgcttttggttgagagcaaatatcttgtgggaagacctattaaaattttatcctcacagtggtaggctacatctgttctagtgtgactttgtcttctaatcaccacaacattacagggattattatttgccccatggcctgttctcccaactgctgccccaaatcctcttaggtaattctggcactcagcaaatttttcagggagaaaactgtctgtaattttggacttcatcagattccagtttttcatgccagcttacaaattatcaagagctgtgctgttttttcttttccttagtagtgtccttctttcttagctagtctgtctaactggcaaatccttccagaaattaaaataatcagcaggattagctgacttaagagatattaatcatcctgcaaatttagtttctcctttctatttcccttgctcgccaatatttttaaaaatatgattttgtagtttgtctctttttttcctagttgttgtgggggcagtgacttgctactgtgtactagtaaattaatcttgtaacagtaagaacaacatttagaccgacatgtttattattttatgtaatgtatttatatagagttggtgtgcttaaagtagtggattgttattgaaatgttggcttgtttagaatattaatatttgttgctaaattcaccaggcctataaataaatcaatagtaatgtttggggaaaaatgaaaaaaaaaaagctatttttcatttcaaaatgtcttttggtcagcaatagcttaaatgaaatgtagacaaaaattaatttttttttcttttccccatttctatttagtgagtgatagttgcttcaggaatcttgcagaagaccgcagtgggataaatctcaaagatctcgtacaagatccttctttgtgagtattgtgctttcagtattaagtataaattaaaactttattattagtgttccttttctcaaaagagttttatgtgaaaacttatttaaggtacaacaattttttcttttctaataatgcgttttacacatattgaagtctgacagaacagttcagaaatagaatagattttagaaggaatgatgtcatgattaatgattgattttcaaggaggaatcctgatggctgatgatatcttgccaatgtggcagtagctactagccaagaaagatgattagtagttgatttccttgggaaagagagattgaatttgtttacaacaatttgaagttttttgaatatattgtttatagtaattatttgtaattataattagaaatataaagtagttatttgttataacaatatacatttgaatatgttagatatatttctgatgttttacatatggcacaagaattttggagagtttgatagatttcagtttttaatttttttgctcatcagtcagtcccattctttattggcatatctttctaatacatatactctacaataatgtcactttctatttcataaattttttttacacttttatatttactggtaaatatgcatactatctatgaacataccttcccaataagatcactgtttattaaaaaaaaataattaaaactagttaagcctgcgaagcagagtaaagaaaattgaatactgccaggtgccttctataatgatacatataatgcatacaattaaatatgtcctaataggaaattcatctcccagatcacatgtaatataccctcccacgggagtcactaataagtcattgagaattttgtgaggaataaacacaagaatatcttgaacttgaagattattgattctttaatgattgactagtcatgttaaaaaatatgagagtgctgaaaatgtatcgaatattgaagtttatatatgatgtcgtgagttcagaatgcatttccaagtctacctctctccatttttttcttttctccatctttctttttctaactcaaaaggattgcaaatattcctcctccttgatttttatccctactatgaagattgacagttgtcctttgagtcctgtgaaaatttaaccaacaatgtaattattctgttaggatgtaaatatacctagtgaataacatttaattgcattaagagttctactatccttatggatatgggtggaaactttacaatttcctcaaaagactttgcttatttgaatgaataaaataaattactggccaggcgtggtggctcatgcctgtaatcccagaactttgggaggctgaggtgggtagatcacaaggtcaggagatcaagaccatcctggccaacatggtgaaaccccgtccctacaaaaaatacaaaaattagctaggcgtggtggcatgtgcctgtagtcccagctacttgggaggctgaggcaggagaatctctcgaacccgggtggcggaggtttcagtgagctgagattgcaccactgcactccagcctgggcgacagagcgaggctccatctcaaaaaaaaaattattattgtattatttgtaagatatgttttagtaaaataagaatgtatgtctgtttaatgcagcaatatgatgaaaatatttgctcatatgaactccaattatataaaagatttgaagaactacacttgaataatggattataataatcaattgccatgttttggaaaaacttgttgcttcttcctggaatgtagaataacattcatcatttaacctaccactaaattctatatttaattttagtattctaaaaaaaaaattcatctcagactacttcattggaaggacaaaataattctcagtgtacctgtcttaaaacagccggaaatatcttaatatagcatcattctcctaacctgccattatcctcttggattagtctagtatgtaagaatgtcagcattcatggagaaagagtttgtttttactcctgcctgcttggctttctaaggaattttttctttattaagaactgtcaggatatactattgatgacttgaattcatattttaaagatatatttctcattaggtaaaatcttttagagaaagaaatgcccaatgtggaaatatatatatatatatatatatatatatatatatatatatatatatatatgttcatatatatatgttcatatatatatatgttcatatatatatattcatattcttgtgttgttatgatgggaaatattttattctgagttcctgtctgattgcagtattcatttagtatgtacattgtaggtgagtattttttttttttaagctaggtgcctcttttctgtctcagactcttggcataaatgttcactacttttcattgattcaggtatactagatggtcctacaaggagttgaattgttaatggtgcaacattgaataggaagtatatcagaaattttttttgtgtttttacaaaaatctcttcggccaggcacagtttctcacgcctgtaatcccagcactttgggaggccgaggtgggcggatcatgaggtcaggagatcgagaccatcctggctaacacggtgaaaccccgtctccactaaaagtacaaaaaattagccaggcgtggtggcgggcacctgtagtcccagctactcaggaggccaaggcaggagaatggcatgaacccagaggcagagcttgcagtgagcagagatcgccccaccacactccagcgtgggcaacagagcaagactccgtctcaaaaaaaaaaaaaaactcctcctcaaaaaatcactgtcatttgataactactccagactagtctgatggttattaaaattgtatacatgtcattttaatacatgttccaaataaaaattattagaataagatgtgtgttgagtgaatgctatgtatgttgatgtgcctggcagatttttattatgactcacccatttgagctgctgatactgaaaggagttgatggtaaataagaattaagaattttagcctcaatactgttagaaaggaagacagaataatagagcaagaaaaattaggctaaggaaaacccaggcttatctagtcaatattgatactcagagtagtgtattatatgtcttaattggataaatgagcagatacagaatttctgtggacaaagtacagaaataaaactgtaatgagttttattaagaatatatgatataaaacaatgtttaaaccaagagtagtcagagctagatgaggggcttactgcatcagagattgaaagtgcagaacctaaactgactaattcatactctgaatctgtgtcaagctaatggaacaatgataggtactctgtaatttactttaactgtatagtacatactccagtattttactgccattgtagtaaaacttgttactgggcttgaatgaaccaagtgagctattgtgtgaacatggcagagagatgccatgggagaaaaaaattttgagaaagttatgaatctctaagcaagactttctggtcttgctactaacttttcttttttttttttcttcttatactttaagttctagggtgcatgtgcacaaagtgcagatttgttacatatgtgtacatgtgccatgttggtgtgctgcactcattaactcgtcatttacattaggtatatctcctaatgctgtccctcccctctcaccccaccccacaacaggccccagtgtgtgatgttcccttcctgtgtccaagtgttctcattgttcaattcccacctatgagtgagaacatgcggtgtttgtttttttgtacttgggatggtttgctgagaatgatggtttccaacttcattcatgtccctacaaaggacgtgaactcatccttttttatggctgcatagtattccatggtgtatatgtaccacattttcttaatccagtctatcattgatggacatttgggttggttccaagtctttgctattgtgaatagtgccgcaataaacatatgtgtgccatgtgtctttatagcagcatgacttataatcctttgggtatatacccagtaatgggatggctgggtcacatggtatttctagttctagatccctgaggaatcgccacactgtcttccacaacagttgaactagtttacagtcccaccaacagtgtaaaagtgttcctatttctccacatcctctccagcacctgttatttcctgactttttaatgattgccattctaactggtgtgagatggtatctcattgtggttttgatttgcatttctctgatggccagtgatgatgagcattttttcatgtatctatttgctgcataaatgtcttcttctgagaagtgtctgttcatatccttcacccactttttgatggggttgtttttttcttgtaaatttgtttgagtgctttgtagattctggatattagccctttgtcagatgagtagattgcaaaaattttctcccattctgtaggttgcctgttcactctgatggtagtttcttttgctgtgcagaagctctttagtttaattagatcccatttgtcaattttgcttatgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaacggatccagtttcagctttctacatttggctagccagttttcccagcaccatttattaaatagggaatcctttccccattgcttgtttttgtcaggtttgtcaaagatcagatggttgtagatgtgtggcattatttctgagggctctgttctgttccagtggtctatatctctgttttgataccagtaccatgctggtttggttactgtagccttgtagtatagtttgaagtcaggtagcatgatgcctccagctttgttcttttggcttaggattgacttggcaatgtgggctcttttttggttccatatgaactttaaagtagttatttccaattctgtgaagaaagtcatggtagcttgatagggatggcattgaatctataaattaccttgggcagtatggccattttcatgatattgattcttcctatccatgagcatggaataaatgttcttccatttgtttatgttctcttttattttgttgagcagtggtttgtagttctccttgaagaggtccttcacatcccttgtaagttggattcctaggtattttattctctttgtagcaattgtgaatgggagttcactcatgatttggctctctatttgtctgttattggtgtataagaatgcttgtgatttttgcacattgattttatgtcctgagactttgctgaatttgcttaccagcttaaggagaatttggactgagacggtggggttttctaaatacacaatcatgtcatgtgcaaacagggacaatttgagttcttcttttcctaattgaataccctttatttctttctcctgcctgattgccctggccagaacttccaacattatgttgaataggagtggtgagagagggcatccctgtcttgtgccagtttttaaagagaatgcttccagtttttgcccattcagtatgatattggctgtgggtttgtcataaatagctattattgttttgagatacgtcccatcaatacctaatttgttgagagtttttagcatgaggggcagttgaattttgccaaaggccttttctgcatctattgagatgatcatgtggtttttgtctttggttctgtttatatgctggattacgtttattgatttgcgtatgttgaaccagccttgtatcccagggatgaagcccacttgatcatgttggataagctttttgatgtgctgctggactcccacacaataataatgggagactctaacaccccactgtcaacattggacagatcaacgagacagaaagttaacaaagatatccaggaattgaactcagctctgcaccaagaagacctaatagacatctacagaactctccaccccagctttgttctttttgctcaggattgctttggctattcagggtcttttatggtttcataccaattttaggattattttttctatttttgtgatgaatgtcattggtattttgatagagattgcgttgaatctatagatcactgttggtagcatgttcatttttacaatattacttctttttctttattttatttggtttttttttttttttttttgagacggagtttcgctcttgttgctcaggctggagtgcaatggcacaatctcggctcaccgcaacctctcgcctcctgggttcaagcggttctcctgcctcagcctcttgagtagctgggattacaggcatgtgccaccatgcccggctaattttgtgtttttagtagagacagggtttctccatgttgttcaggctggtctctaactcctgacctcaggtgatccgcccacctcggcctcccaaagtgctgggattacaggcatgagccactgtgcctggccaatattatttctttcaattcataaacataggatgtgtttccatttgtttgtgtcctcttcaatttctttcatcagttttttagcttgtttgtgtagagatctttcacccacttggttaaatttatttctaggtacagttgatccttgaacagtatgagtatttggtgtattgctcctgcatgctgttgaacatttaggtgtaacttttgacttgccaaaaacttaattactaactaataagctactgttgactggaatccttaacaatgacataaacagttgactaacacatattttacatacgtattacatactgtattcttgaaataaagtaaactagagaaaagaaagtattattaagaataacaaaattaagaaaaagaaaaatatttactattcactaagtcaaagtagatcaagatataagtctttatgcttttcatcttcacattgaataggctgatgaggaggcggaggaagaggaaaaggagttggttttgctgtctcaggagtggcagaggcagagaagagttgtcagggaggtagaagaggcaggcacactcaagtgtaacatttatggaaaaaagtctgcatgcatgtaagtagacccatgcagttcaagtctgtattgttcaagggtctaactgaattttatttttgtatgtagctgccataaaatggattgctttttcagtttctttttccactagtttattgctgatgtttagaaatggtacttattttttaccttgattttctgtcctgcaaaagtactcaacttgttcatcagttctaagagtctttgaggggagtctttactgttttctatatgtcgtctacaacatgggagatgaacgggaacaaatttggatagtcctttccaatttggatgccctttaattctttctcttgcctaattgttatgactgggacttccagtactgtgttgaatgaaagttgtgaaagtcctttgcagggacatggatgaagctggaaaccatcattatcagcaaaatatcacaaggacagaaaaccaaacaccgcatgttctcactcataagtgggagtttaacaatgagaacacatggacgcagggagtggaacatcacacaccggggcctgtcggggggtggggggctgggggagggatagcattagtaaaaatacttaatgtaaatgaccagttgatgggtgcagcaaaccaacatggcacatgtatacctgtgtaacacacctgcatattgtgcacatgtaccctagaacttaaagtataattttttaaaaaaagaaaaagaaagtggtaaaagtgagcatcttttttttgttccagaacttagaggaaaagcttttaacttttcccaagtcagtgtgatgttggctgtgggtttactgtatatggcttttgttgtgttgaagtacattccttctgtatctaacttggtgagagtttttatcaggaagggatgttgaattttattacatgctttttctatgtttattgaaatgattatattgtttttgtccttcattccattgatgtgatgtgtcatatttattgatttgcatatgctaaaccatcccatttatctcacccatttatgcctgggataaatcctacttgatgatggtgaattatctttttaatatgctgctggattctgtttgctagtatgtggttggtaatttttgcttctatgttcatcagggatgttggtctgtagtttttgcatttgagtccttggtctagttttagtatcagggtaatgctggcctcttagaatgagttttgaagaattgcctccttctcaattttctggaagttttagacatattgattttaattctgctttaaatgtttgatagaattcaacagtgaagccatagggtcccaggcttttttaaaattacaaatttagtcacgttaattttcaattggtttgttggggtttttcatttcttcttggctcagttgtggtaggttgtttgtgtccaggaccatttctgctaggttttctaatttgttggcgtatagttgttcataatagtctttaatgatttttatttatgtggtatcaattttttgtgtcatttttccattctgattttatttatttgagtctttttttatcttggtttatttgggtcttttctctttttgtcttcgttggtctagctagtagtttggcaattttattgatcttttcataaaaccaactttttgactttttttatatgttgtatttttttctcaattttacttatttcagcttggatattttttattttttctactaattcttacagtttgttcttgattttcttgttccttaagttagcttgttaggctatttgaaaattttctacttaatgttgaggtttattgctataaacttctctcttactatagtttgtgatgtatctcatattttttggtatgttgtgtttctcttttcatttgtttcaagaaatttgaaatttttttcttaatttttttattgacccacgttcattgtagaacatgttcttcaatttccctatattctcacagtttcagtagttccttttgttgatttctagttttatttaattttggccagaaaagatacttaatatgacttcaattcttttagatttgttgagccttgttttgtgacctaatatgtggtctgttctggagaatattccatgtgctgatgaaaagtatgtgtattctgctgcatttgggtgatattttctctaaaggtttgttaggttcatttggtctgaagaacagtttaaattaaatgacctctgtcacatgttgagagtggagtgttgaagtccccatctattattgtatcagaatttattccttcctttaaatctaacaatatttgcttcatatatctgggtgctccaatgttgggtgcatattatatttacatttgttatctcctttactgaattaatatctttatcattatgtaatgaccttctttgtttctttttagttgttttttgtttttatgtttgtttgagacacagcctcactccctcggtttgtgtaagtacactctatgaaggtcacataaggttgaaataacctgaggatgcatttctcagaatgtatccctgtggttcagtgacatttgactgtaatgagtggcaaagcagtaaaccttggtctgtattattcgaactcctatatgctgactcacttacgtatttcagtgaaaacccaaagatttttatttagtgttgaaggcctaaacctcatttaaaattaagtataggctgggtacagtggctcacacctataatcctggcactttgggagactgaggtgggaggatcagttgagcccagtaatttgagaccaggctaggcaacatagtgagacactgtctctacaatttttattttttttttttatttttagatggagtctcactctgtcaccaggctgaagtgcagtggcgcaatctcggctcactgcaacgaccgcctcctgggttcaagcgattctcctgcctcagcctcccgagtagctgggattacaggcactccccaccacacccagctaatttttgtattttcggtagagacaaggtttcaccgtgatggccaggatggtctcgatctcctgaccctgtgattcacctgccttggcctcccaaagtgctgggattacaggtgtgagccactgcacctgacccatgaacatttttaagtgattaaaaaaaatttttaatgaatattttatagtacatgaaaattatatttcagtgtctataaatagttttgttagggaacacagccatgcatagtgtttacctactattcatggctgcttttgaattataatagcagagatgataagttgtaacaaggatcatttggcccactaagctgaaaatgtttattatccagtcgtttacagaaaacgttgctgacaatcagatatagaggatagactacaaagtgagctaaataatttatcagtattctgttcaagatagtgtacactgggagattttcagaactttctctgattgacatagaatggaagccaaaattaagatatagggtctgcagaaaacaaaactaaacaaacaatagcaaaaactatccagtactttggttagcaacctctaatccaaaaaagataataaaagctagatagcatttttctttttctatgtttgacaataaaatcaaattcggatttgtccataaaactcctgaaattctatgcaaaatatatttgtgagcaaatgtttgtttttctggggcgaaagtccttagttttcctttgattttctgtgggttttgcagatgcaaataggttaaggattactaatatatatagttaactcccaaataaagaggtttgaatatatctttactttacctgctaaccttcttatagtcctgggtgctttctgttatttacctcctgactgtaaaacatgcaatttttattactattttctgacacacttcattgtcatatgctctggtcattaggtataagtttacatggaaggagtgaggagtatgatgaggtactaacatttatcaactacctgctaggaactaaacaggtgctttatgcctagtttttaatatgatgtttcataattctgttagacatgctgagtaatttgaaattcagagaagttaaatatctgcagatacactatctgtagattctctagtagtaggcctgggactccaacctacgtctctctaataagtcctaaattatcctggctcctctatacaaccaggagagagaacacagaaagcaagtggggaacacagatgtctacctttttttcttatcgaacagttttctataatatttgctatttctaattaccatttttatatgaccattggtgcatataaactatatgacattttggtctctatgagcattaaaaggataaagacattgtattagattgcttgaattgaatggcttgtattgttgttatgaaataccaaagaaatctttataatatttggaattaaaatattaccaaggaagtaaccctgaactgaagcttatatagagcacttgtttgaattatagtgttatattttttatgtttattcatactaggtagtaattctctaaccttatgatttcatagcttcattgcactttaaaaaattataagcatggcattgaactattgtttatgtgggtaacatctattgatatttactatgttaaagaataaaattatttaattcacataaaatataaataagcccactacatattaaaataaataatataatgaaaaatagctgtatatttcaaaactcccaaaatagtcaaaatattaacagtttttttacattttataaatctctataatctctggcttaataaaagatagctaaattttcaaataactgtttctacgtttaatctgttgtaatatgtttttgttgaaatttgtgaggaaaattatgcttggaacaattatgtaacttggaaggaatattttaataactttttctaatgaatatggatattatttgttttgctattttactcaaactggacaataatgatagacagtttcttaaaggtaagtgtagtagtcagagttctccaagaaacagaaccaatgattgattgattgatagatagataggtagatacatacatacatatatacatacgggatttattaggagaattgactcatgcagttatggaggctgaggactttcctgactggccatctgtaagctggaattctgatgtcttaggacaagagaaatttatatcccagctccagaagagagaggaaatagcctatttgctctatttcggtcccctctaattgggtaggtctgcccacattgagggcagatcttacttactcagcctatggactcacttgtgaatctcctctggaaacattctcacaagcatacacagaaataatgctttatcagtactctgtataatccttcaaccagtcaaggtggcaccaaaaattaatcatcataataagtaacattgtggaattcaaagccatattaaggacattttcataatactctgttaagttaaaatctattggtccaccagagtagccaatacaatattgaagaataagaaaaaagttggaggacttgacactatacagcttcaagatttattataaagctgtggtgataggggcagtgtagtattggcaaaatagacaaatagatcaaggaaaaagaatagagagcccagaaatagacccatataaatatagttgctgtggtctgaatgtatatatctgcccagaattcatatgttgaagcttaacccccgatgtgagggcgtttgaaggatgaggcctttgggaggtgatttagtcatgagggcagagacctcatgaattggattagtgtccctaataaaagaggcctgagacaggcccctttcccctaccaccatatgcgattatagccagaagacagacatctatcaatcaggaagtaggccttcacctgaatttcttggcaccttgatcttggacttccagacctgcagaacagtgagaaataaacttcttttgtttatcagccacccagtccatggtattttttaaatagcagctcaaatagacttaagacaatgttcaactggtctttgaaaaaggaataaacaaaatacaatggagcaaagatagtttttttaacaaatggtgctggaacacctggacatctgcatgctttaaaaaattgaatctggacgtagaccttacacccttaaaaaagttaattcaaagtggatcataggactacatataaaacacaaaactataaaactgccagacaataatataggagaaagcctaggtaaccttgggtatggcagtgattttcagctctaaaggtaccatccacaaaagaaaatattggtaagctgggcttcattaaaaactctgctctacaaacacaatgccatgaaatgaaaagagaagccacagactgggagaaatattttcaaaagacgcatctgataatgtactattacttaaaaatatacaagaactcctaaaactcagcaataagaaaatgaacaaccctaggccgagcgcagtggctcacgcctgtaatcccaacactttgggaggccaaggcaggtggatcacttaaggtcaggagttcatgaccaagcctggccaacttggtgaaaccccatctctaccaaaaatacaaaaattagccatgcgcggtggtgcacgactgtaatcccaactactcaggaggctgaggcaggagaatggcttgaacccaggaggcggaggtttcagtgagccgagaacatgccacactgcactgcagcctgggcaacagagcaagactctgtcttaaaaaaataaataaataaaaataaaaataaaaataaactctattgaaaagtgggccaaagaccttaacaaacacctcaccaaagaagatatacagatgtcaaataagtatataaaaagatgttctacattttatgtcatcatggaaatgcaaattaaaacaacagtgaaatattactacatatctattagaatggtcataatctggaatactgacaataccaagtgctgatgaggatgtggggcaagaaactctcattaattgctggtgggaatgcaagatggcatagccactttggaggacagttcagtggttttttaacatgcattccagcagttttgccccttggtatttatccaaatgtgttgaaaatgtacatccacacaaaaatctgcacatagatttttatagaaactttataaatgacaaaacttggaagcaaccaagataaccttcagtgggtgaatggataagtaaactgtggtacatccagataatggaatattattcagtgccaaaaagaaatgagctatcaaactatgagaagataagaaggaaacttaaatgcatattactacatcaaagcagccaatctgcaaaagctacacattgtaagtatccagctatatgactttctggaaaaggcaaaactatgaagatagtaaaagaatcagtgcttgccagaggttagagaggaggaagggatgagcaggcagagtacagaggatttttagggcagtaaaactactctgaatgatactacaatgaaggaaacatgttatgatgcattgtctaaaccatagaatatacaacactgaaaatgaaccctaatgtaaactgtggactttgggtgataatgatgtgtcagtggaggtttatcagtggtaataaatgtgccacttcgttggggtatgttgataatgggagaagctatgcatattgcagtacaagggatatatgggaaattatatggaaaaatttctcacttcctaaagatgctatgaatttctttttcctttaaagaagtttatgcagatttgtggttatctcataaacaaaattaaccataaaagagtaatcctcattagaaaaatatttaagtcacgtttttaaagtctgctcaattttgctgtaaacctgaaactaatctaaaaatgtaaagttttgttttactatccattagccttgagtcttccaattctggaaagatggagtaaatgtactttggtctattcctcatgctaagtacaactgaaagtcctaagaaataatgtggtggtgtgttcttgtttttgtgtgtgtgcctcatatattttatacttggagctgaagcagctgacaacctagaaatatcgaaagacactgacaaatagcttcaacaaaagctttctctgtttagccaaagggcgtagaaaccataccaagtcagaaagcttatactataaccaccctactcctgccaaacactacagaaaaactgtggtcctacaccaacccatgccagcaaaagttgagtggggagcctggattctcaccctcactagactgtgatgaagtaccccaatttgtggtcccctgaaagggtctcagaacctctggtattcaagatcacagctttgagactttaagctttactactaaatgagttaaatttctcacttcctaaagatgctatgaatttattttgtttttccttttaagaaatgtatgtagatttgtggtttatcacgtaaaattaaccataaaagagtagtcctcattagaaaaatatttaagtcactttttaaaaaagtctgaatagttgaagtttatttttcaccaagtgataatttatttttgtcaattttgtgggaaagtaatgacttattatctgtttataaacaaaatttctacacactaatattttacatttgaatacatgtgtaaatttctttactcctatatttgtccctcacaggaatccacatcttcacctcatcttttaataagtattagtatgttttgttgactactgaggcattttatagttaatctacttaaatattagttggatttataccaaaaagttatctaaaataatattgtcaatgatgaattgtattaaacaaatgtgtttgactactctgtaattcagcatttataatttgccttagttatgtagtacgttgtgtgacttcacagtatcaggttttgtgaacttctgtaagcatcctttctgagaaagccaatgggaaaagtataattttttactacttgtaattttggataattgttgtatataagaatgtttactattaaaggcacaagatgaaatgtagactcaacagtattgaatgatgttaagaacaaattagattggagatactggtgtagtgtttttctctggcttctgtcatgtgaactttcattcttatattggatagatggtggatatttaaaagtatggtctaatctaggggttggcaaactatgatccacaggtcaaatctggcctgctacttgccttttttttttttcttttttcttttttcttttcttttttttttgagatgaggtctacctctttcactcaggctggagtgcagtggtgcaatcatggcttactgctgcttctgcctcccaggttccagtgatcatctcacttcagcttcccaagtagctgggactacaggcatgtgccaccacagctggctactttttacaattattatttattgtagagagaggatctctccatgttgcccaggctggtctcaaactcctgggcataagagatcctcctgcctcagcctcccaaagtgctgggaatgagccactgtgcccagcctgctgcctggttttataaataatattttcatcttatgaaattgaaaaatatgacccattcgaaagcactttggaaattgtgaaataaatatttattaaatgactaatttcaagtatcacaaatagttatttaaataataatacattatacagaaaatatatggattttgcctgaaatttcatcacaagttaaaaaatacattttgaaaagggatatgatgaattttgttaatgttagtctttaaactgagtcattctgcttgagcatttcaaaatggagaaaaaggttaaatacttgctgaataagatttgtcctctgatttgcttctggtctgtcactattttgtagataacttgaaatctgtgtgaaattacagaattcataggtaaaaaggggatgtaatattttttggagaaaattgaactatatgttcagtgaatgtaaactcttcttactgatgttgtcatactcttttaaaagtagcagatacctgggactaattattcaggatttattctgaatcagggaaatccagtgcttatgtttactcaataaaactgctattttaaaagaaatatttttatctttggaaagacaatgatacatgaaaattgaagttttgttagaacacagtcttactcattcacctatgtattacctatgggtggtttcactgtacaacagcagagttgagtagtttcatatgtcactcaaagccagaaatacagtcatccatcctttggtatgtgttggggattgttccaggacctctgcatataccaaaatctgcatatactcagtccctccattcggctctggggaacctgcatgtatacaaaacattggccctccatatatgcgggttttgcatttcattaatttgatctatgtttggttgaaaaaaatctgcagataagtggaaccaaggagttcaaacttgtgttgttcaagggtaaactgcattttgactgtctttacagaaaaagtttattgacccgtggtgtagataagaaatcattgtgacctgagtgagaatattagtcaatgtaactcttcaaggtaatgaaaagagtactgagctatgatttaaacttaactgcagagaagtctagcatattccagttatcagcagtgtagcatgataactaaattacttgacctttcagaatcttagttttctcaattgttaaatgaacatactgatactattctactcacttcacagtcttaaaagggatagcattaggagatatatctaatgctaaatgatgagttaatgggtgcagcacaccaacatggcacatgtatacatatgtaacaaacctgcacattgtgcacatgtaccctaaaacttaaagtataataataattaaaataaataaataaaagaaaataatttaaaaataataaaaggtaagtgatgataatattatattaaatatggtgatagaattgctggataatttaatcagggaatgctaaaaagatagtgactcgatgttgataatttcataagcttttcattatgtctttgtgagtatatagttcattagaattgttataagaagttgttgttgaataatttcaggtcaatgtggaagatgtctggtattttaaagtattctgttttagaacaaaatccagctttttaatagcgcatgcaagaccagtaatgatctgattacttcctggctcttcaacttcacctctcactatttgctgtttttatactatttgtataaatgatggaattagagagagaaaggctaagataataggagtgaaagaaacatctatgccagacagaagtaaactatggctgtgtttgccatgatttgtttttacaatctggttgtttacagaaacaaagcaacaaaaactaaatatgaaattaaataatgaagaagctatgccgaaggatgtttaaaatttgaaaaaacaactttataagaacctttatgttttcttatgactggataactactatttttttaaactaatcttaattttagagactataaaaggagagagattacatataggaacttttccttttggaaacaattaaaattgtgtgtcttatacgggctattcaacatgatataaatgtggaaaatctacttacagaaaaatttctgaggttatagtgttaaatgttttctatttctgtagaggatattcaaagaaaaattggtatcagtaaaatggacaactgcacaaaaccctatttgtttttaggggaggaggtgagagattgaggtgggactatacattttcaaagagagaggcacttagctactagaaatttaacgaatattttatttttgacacacatactggaatttctaaactgtgtgagagaagtaaaataattttacagttaaaattatatgaaagaagtagatttgtgatttagatttagagggaaaacctaacagtaatacatgtacgcatgttggctgttgctgttttgaatttatttctcccttatgatctaatttaaatttgtatttttttacttagtaaattattggtctgggacaactcggggatgaaggattttacttaatttttctaaattagcacttctgctattgtctttgcatttattattcatcctagaatagaacaaatatccagttaaaaatctttattatgaccggatgcagtggctcactcctgtaatcccagcaccttgggggccgaggcgggtggatcatgaggtcaagagatcgagaccatcctggccaacatggtgaaaccccgtctctactaaaaatacaaaaattagctgggcgtggtggcgtgcgcctatagtcccagctacttgggaagctgaggcaggagaatcgcttgaatccggagacaggggttgcagtgagccaagattgcaccactgcactccagcctggcaacagagcaagacaccatctaaaaaaaaaaactatattatttctcaattatttttatttcagttatatcacaactatttgaaatttgcttatgaagctaccaaagagtacatgcacagaaaggaaaccttatgcttgccctgccctgccatccagttttccttccctaaaagcaacctctgttacagaggttatctgtgcatgcgcacatgtgcacacacacaaatgtgaatgtacagatacatatatacatatgtatatatgcatatttacatatgcatgtaagtgcaatatgtacatattacacatttgaataaaaatacatcttacaaaaatgtatactgttgtgcatatttctcttttttttacaatatctcaaatatgtttcatatctaaacagacatcactttttaatagctgcatagcatcttgtttatttataactaatacataataactgtacatttgggtgcggccatgatggctgactagaaacagtagcaattggatgctcccatcaaaaagaaccataataagtgtgtgaaaccttcacctgcaaccaaggtattcaggctgtctaatcagaaatgactaggtggctggtgtgatccacggagagaaaggaagagcaatgtggtgtggcagcccacttgggagccacacagggcagggtagcccctaccccgcagccaagggaagacagtgagtgagcctgctaaccagctggggaaactgctttttccacggaactgtgccacccatggatcagaagatcacactcgtgaacctacgctaccagggcctaacatttcaaccccagagccatgtagattctcaacagcctctcagctagaatctacttaagcctaccaagctcctggggggaggggcgaccaacaccacagctatggctgcctactgtctaagccatttgagatccttggggtaggggcagcagccagcactgagactcacgactgcctagcatgctaagctccctgggcgggggaagggtggcatccatctctatagctccaggctgtacttctcccctcctggagccagggaggctggacagcttggtcccaagacatgtcctccacagcccaacacaccagctgtggcagactgcggccacagtgcctcttcaggtgtgaccatgactcatccttcctcactgggtggggcttccctgcaggaactccaaaaactccagccagaggctcagggacagaacccagatctccctgggcttgaacccctaggggaaggagtcgccacagtctctgtggaccagcagactttgcctttcctcctggtagttttggggaatccaggcagcccagacgagtgggttttcccccagtgaagcacagcccttcccccaagggacaatctaagtacttcattaaacaggtcctgttccctgtgccacccaactgggtgagaccctccaaaagggattgtcaaaaaccctatacaggagcgatcctactggcatcagattggtgtcccttgagatcagagatcccagaagaaggagcaggcacccatctttgctgttctccagcctccttgagacatctccagatgtgagagcgaaccaaatgaatagggcctgaagtgaacccccagcaaaccacagcagccatatagaagagggacctgaccattgaaaaacaattaaagagaaaacaacaacaacagcatcgacaacaacaacaaaaagccgtcatgaaaaccccatccaagggtcagcatcctcaaagattgaaattagacaaactcatgaagatgagaaagaatcaatgaaaaaatgctgaaaacccaaaaggccagagtgcatcttctccaaatgattataacaacagcaaggaacctgatagaggatgagatggacaaactaacaggagtagtcttcagaagatgggtaataaaaaactacatggagctaaaggagcatgttctaacccaatgcaacaaagataagaacgttgataaaaggttagaggagctgccaactagaataaccaatttagaaaggagcataaatgaccctatggagctaaaaaacacagcatgagaacttcatgaagcatacacaagaatcaatagccgaatcgaccaagtggaagaagggatatcagtttgaagaccacgttgctgaaataaggcatgcagacaagagtagagataaaagaatgaaaaggaatgaacaaaacctccaagaaatatgggacttcagcgtttaaaaagaccaaatctatgattaactggaatacctgaaggagatggggagaacagaaagaagctggaaaacacacttcaggataatatccaggagaacctccccaacttaacaagacaggccaacatgcaaattcaggaaatacagagaacaccactaagatactccacaagatcaacccaaagacacataatcatcagattctccaaggacaaaatgaaggaaaaagtattaaggacagccagagagaaaggccaggtcacctacaaaggaagcccgttggaataatagcgtaactctcagcagaaaccctacaagccagaagagattgggggccaatattcaacattcttaaagaaaataattttaaacgcagaatttcatatctagccaaactaaacttcataagcaaaggagatcctttccagagaagcaaatgctgagggattttgttaccaccaggactgccttgcaagagctcctgaaagaagcactaaatacggaaaggaaaaaccggtatcagccactgcacaaacactccaaaatgtaaggaccaatgacactatcaagaaactgcatcaactagtgtgcaaaataaccaggtagcatcatgatgacaggatcaaattcacacataataatactgaccttaaatgtaaatgggctaaatgccccaattaaaaacacagattggcaaattaataaattttcaagacctattggtgtgctgtattcaggaggcctatctcaagtgcaaagacccacataggttcaaaataaaaggatggaggaaaatacaccaagcaaatggaaagccaaaaaaaaaaagaaagaaagaaaaaaagaaaaaaaaaagggcaggagttgcaatcctagactctgacaaaacagagtttaaaccaacaaagatcaaaaaaagacaaagaagggcattacataatggtaaagggaccaattcaacaagaagagctgactattctaaatatatatgcacccaatacaggtgcactcagatttattaaacaagttgctagagacctgaaaaaaacttagactcgcacacaataatagtgggagactttaacaccccactgtcaatattagatcaacaagagagaaaattaacaaggatgttcaggacttgaactcatatctggatcaaatggacctaatagacatctacagaattctccaccctaaatcaacagaatatacgttcatctcggtgccgcatagcacttattctaaaatcagccacataattggaagtaaaacgctcctcagcaaatgcaaaagaactgaaatcataacagtctctcacaccacaaggtaatcaagttagaactcaggattaagaaactcactcaaaaccacacaattgcatggaggttgaacaacctgctccagaatgactcctgggtaaataatgaaattaaggcagaattcaagatgttctttgaatccattgagaacaaagacacaacgtaccagaagctctggtacacagctaaagaagtgtgagagagagaaacttacggcactaaatgcccacatcagaaagctagaaaaatctcagatcgacaccctatcgtcacaatttaaaagagctagagacgcaagagcaaactaatccgaaagctagtagaagacaagaaataactaagatcagagcagaattgaaggagatagagacacaaaaacccctccaaaaaaatcagttaatccaggagctggtcatttgaaaagattaacacagtagatagactgctagccagactagtaaagaagaaaagagagaagaatcaaatagacacaataaaaaatgataaaggggatatcaccactgatccaacagagatacaaactaccattagagaatactataaacacctctaggcaaataaactagaaaatctagaagaaatggataaattcctggacatgtacaccctcccaagactaaaccaggaagaagttgaatccctgaattgaccaataacaagttctgaaattgaggcagcaattaatagcatactaaccaaaaaaagcccaggaccagatgaattcacagtggaattctaccagaagtacaaagaggagatggtaccattccttctgaaattattccaaacagttgaaaaggagggactcctccctaactcattcagtgaagccagcatcatcctgataccaaaaccgggaagagacacaacaaaaaaagaaaacttcaggccaatatccctgttgaacattgatgcaaaaatcatcgataaaatactggcaaaccaaatccagcagcacatcaaaaatgttatccaccattattaagttggcttcatccctgggatgcaaggctggttcaacatacccaaatcaatgaatgtaacccatcacataaacagaaccaaagacaaaacgcacataattatctgaatagatgcagaaaaggcctctgataaaagtcaaaatcccttcatattaaaaactctaaataaactatgtattgatggaacatatctcaaaataataagagctatttatgacagacccacagccaatagcatactgaatgggcaaaagctagaagcattctttttaaaaactggtacaagacaaggatgccctatctcaccacttctattcaagatagtattgtaagttctggccagggcaatcaggcaagagaaaaataaagtgtattcacataggaagagaggaagtcaaattgtctctgtttgcagacaatatgattttgtgtttagaaaatcccattgtctcagcctaaaaactctttaaattattaagcaacttcagcagagtctcaggatacaaatcaatgtgcaaaaatcacaagcatttttatacaccatcaatatacaagcaaagagccaaatcatgaataaactcccattcataatcgctacaaagaataaaatacctaggaatacagctaacaagggatgtgaaggacctcttcagggagaactacaaaccactgttcaaggaaataagagaggacacaaagaaatggaaaaacattccatgctcatggataggaagaaacaatatcgtgaaaatggtcatactacccaaagtaatgtatagattcaatgctgttcccatcaaactaccattgacattatttacagaattagaaaataactactttaaacttcatattgaatcaaggaagatcccatatagccaagacaatcctaaccaaaaagaacaaagctagagacatcatgctacctgacttcaaactatactacaaggctacaataatcaaaacagcatggtagtggtaccaaaacaggcatataggccaatgggatagaacagagacctcagaaataacaccacacatctgcaaccatctgatctttgacaaagctgaaaaaaacaagcaatggggaaaggactccctatttaataaatggtgctaggagaactgggtagccacatgcagaaaactgaaactcgaccctttccttacaccttattcaaaaattaactcaagatgtgttaaagacttaaatgtaaaacccaaaactataaaaaccctagaagaaaacctaggtaataccattcaggacacaggcatgggcaaagacttcttgacaaaaatgccaaaagcaattgcaacaaaacccaaaattgacaaatgggatctaattaaactaaagagcttctgcacagcaaaagaaactatcctcagagtgaacaggcaacctacagaatgggagaaaattttgcaatctacacatctgacaaaggtctaatatccagaattcataaggaatttaaacagatttaccagaaacatacaaccccatcaaaaagtgggcaaaggatattaacagacacttctcaaaagaagacatacatgcagccaacaaacatttgaaaaaaaaaaaaaacaacatcactgatcattagagaaatgcaaatcaaaaccacaatgagataccatctcacgccagtcagaatggcgattattaaaaagtcaataaacaatagatgctggtgaggctgtggagaaataggaatggttttacactgttggtgggaatgttaattagttcaaccattgtgaaagacagtatgtagatttctcaaggatctagaaccagaaataccatttgacacagcaattccattactgggtatatacccagaggaatataaatcattctactataaagacacatgcacgtgtttgtttattgcagcactcttgacaatagcaaagacatggaaccaacccaaatgcccgtcagtgatagattggataaagaaaatgtggtacatatgcaccatggaacactatgcagtcacaaacagagaatgcgatcatgtcctttgaagggacatgggtgaagctggaagtcatcatcctcagcaaacttaacgtgggaacagaaaaccaaacaccccatgttctcactcttaagtgggtgttgaacaatgagaacacatggacacacggaggagaacaacacacaccagggcctgttgggcggcggcagcgaggttagggaacttaaaggatgggtcaataggtgcagtaaatcactgtggcacatgtatacctatgtaacaaatgtgcacgttctgtataggtatcctagaacttaaaataatgtaattttaaaggtcaaaaaaccctgtacatttattttatacaaagtgatgtttcaatgtaggtatacattgtataatggtcaaatcaggcagttactatatctaacagtttaaacatttatcatttctgtgtggtgataatattcaaaatcctctcttctgcctatcttgaaatatacattgcattcttattagctatagtcaccctataaagtttcaaaagctggaggttttggtgctcaattgattgaacagtttgactaaagatttccaagtgaatttttaaaacatgcacccaagtttagatgatttattcataaaagtgctcagtatcattgcagggtacttatgttgatttaaaaaatagttcttcaaaggctcaagcaattttgctcatcttagtttagagacatctaaaaacttcaaaaaaaaaaatggcgagcttaacaaactgttaagtccctttcggcatatcttcttacatccttctttgccttccaacaattgtgaataataggactagaaagagaaaaatgagagaaaacctcataaggtattcaatctccatgcttccacaaatgttttggaaatatttggagacagttatgtattagttaaatattatctcaatatgtgctgtagctgaaaatcctgttatcagtataaaactttcttcctgtatttcacaagaattgagccacatttagaggcatccaccaaccattttctggacatgaatttacaagataaataactcccctttagggaaattaaatatttatatattttaagcatttcagtatttaacacaacatgataaggaaagaatataaaaagatttcaatctagagcagtaatttactgagtctgagagattgccagatttgcttggatttgccagatcctgttttagaagtatgccaaagtgtgaatattttatatttttaaatataaaataagtatttctagttacatagttttcacatgacatgctggactgtagattatatggttgcatgtttttcttccactaaacttgcatttagcagcaagtacggagctcaaaagtccctatcatcaatattttatattgtaaaactaattttagtagaatattaagcttttaaattattaaacatgtgaagaactcttaatagtctattatacataagtattaaaacataagagttcagaccagtctgggtatttagaaaaatgagtaatttaaaaaatggatccaaagatattaaaaagaagataatacagtattataatgtgtcaggagatattcaggttaaaataatcatatcttagataatttgccaatgagattaatataatgcctctttctgatgaccacgtttttgttagggcctttatttgaacagtgttcctacagctttcaataactaaaagattagcagccttttctaaacaaccattcttttaaacataaaatagcactattaaacaggattagaactctgtattagattgaaagcaccctgaaatgaagagccccatctatcacattaagcctgtactgtagtccccttttatccacaggggataaattccaaaactgccagtgaatggctgaaaccacagatactactgaacccaagtactgcgataccacaatagctgatctgataacccagatggctggtaagtgaataacaagtgggtagcctatacaatgtgaattcactggacaaagggatgattcatgtcccagtgggatggagtgggaaggtgtaaaatttcatcatactcctcagactggcacataatttaaaacctaagtattatttatgtctggaagtctttatttaatatttcagatcacagttgaccttggaaagcaaaactgaagataaggaaagactactctattctcattgctgggcaaagtccctcatacttagtaagtgatgtctttccttaatgaagtcacagacctaattttatgttttagcccttccacttataagatatacatccaaaaaaaggacaaagcactccaaaggggaaatgtatctttttgtcaagtcagggaatacttagtaaggagaagacaatttgagttatcagtgtcaagagagaagttggattgcaggaacaaagttgatgccattaaaaaaaaaaaagaatagaagttgtttgtgaaataatgagtgtccactgcattagttatatgaagggaagtaatggaaagctatgttggagggaggggaattttttagccagaaaagcacatttgtagttgtacttataaagatgattaacagtagtgcttataaaatggactggatcagagatcctttatacaactgtaaatgctttatatattatttctataaatcaccctgggttcttagttattcatattttaaaagttcattgataactgtatattaagatgctaaaataatagaattgcttttgcaaatacaaatatatgccaaatagattccagttatcaatcatttggtaatttactcctctgtttataaatttcaaaatatgttccaaggcgtggaatctgagaattcttttttccaaaacattgtacatattatatgagctgtgttaaagtgaatctaatcttagtctatgcatcatcatatttcagaagctgttacccaggtcgtgatatgtcttttttcacatacatgtgaatatgaaaatagcactatatgtataaaatttctttttatggtaactcacaaatattatttctctgcatgtttattttatactgttttattttttctgtagccaacttcattagatctgcttgtttgccctcaggtagaacatctgttaagggaataaatgattgatggttgagtagaatctagggaaataatcgagatgaaagaagcagtgttgtacaaaagttaagagctgcagatttgggcttgacaatttggaatgaaatattaggttttccactaaatagggctttttaacctatgtgcctcactttctacatctgtaaacttgggagagtaattcaagatgctacctacttcttaggattatcatgaggcttaaattaggtaatacatgtaaaagctcatagaacatagtctgataagtggaaaggactaatagatgttagctataaatcattattttcataatttgagttacatactctaagaaaggtccacatataccttactagaatagttatcaaactttattatgcaaattttattgtacaaatttgtttttttatgtattttgttttgtttgtttttccataggttattgggggtacaggtggtgtttggttacgtgagtaagttctttagtggtgatttgtgagattttggtgcacccatcacctgagcagtatacactgcaccctatttgtagtcttaaccctccccctccacccttactcccaagtcattaaagtctgttgtatcattcttatgcctttgtgtcctcatagcttagaccccacatatcagtgagaatatacaatgtttggttttccattcctgagttacttcacttagaataatagtctctaacctcatccaggtcgctatgaatgccgttaattcataccttcttttggctgagtagtattcctttgtatatatatgccacagtttctttatccacttgttgattgatgggcacttgggttcgttccatgattttgcagttgtgaattgtgctgccataaacatgcgtgtccaagtgtctttttcatataatgacttcttttcctctgggtagatacccagtagtgggtttgctggatcaaatggtagttcttttttttttttttttttaaattatactttaagttctagggtacatgtgcacaatgtgcaggtttgttacataggtatacatgtgccatgttggtttgctgcatcaacttgtcatttacattaagtatttctcctaatgctatccctcccccagccccctacccccccacaggccccagtgtgtgatgttccccgccctgggtctgtgtgttctcgttgttcaattcccacctatcagtgagaacatatggtgtttggttttctgtccttgtggtggtttgctgagaatgatggcttccagcttcatccatgtccctgcaaaggacatgaactcatccttttttatggctgcatagtattccatgatgtatatgtgccacattttcttaatccagtctatcattgatggacatttgggttggttccaagtctttgctattgtgaatagtgccgcaataaacatacatgtgcatatgtctttatagtagcatgatttataatcctttgggtatatacccagtaatgggatggctgggtgaaatggtatttctagttctagatccttgaggaatcgccacactgtcttccacaatggttgaactaatttacactcccaccaacagtgtaaaagcattactatttctccacatcttctccagcacctgttgtttcctgactttttaatgatcgccattctaactggcatgagatggtatctccttgtggttttgatttgcatttctctgatgaccagttatgagtattttttcatgtgtctgtgggttgcataaatgtcttcttctgagaagtgtctgttcatatcctttgcccgcttgttgatggggttggttttttctgtaaatttgtttaagttctttgtagattctggatgttagccctttgtcagatgggtagattgcaaaaattttctcccattctggagatattagccctttgtcagatggataaattgcaaaaattttctcctgttctgtaggttgcctgttcactctgatggtagtttcttttgccttgcagaagctctttagtttaattagatcccatttgtccattttggcttttgttgccaatcaaatggtagttctacttttagttctttaaggaatctccacactgttttccatagtggttctactagtttacattcctaccagcagtgtagaagtgtcctctgatcactgcatccacaccaacatctaatggtttttggttttttgattatggccattcttgcaggagtgaggtggtatcacactgtggttttgatttacatttctctgatcattggtgatgttgagcattttttcatgtgtttgttgcccattggtatatcttcttttgagaattgtctatttatgcccttagcccacttttagatgggattttttattttctattttttgctaatttttttgagtttgttgtatattttggatatatattagttctttgtcagatgtatagattgtgaagattttctcccactctgtgggttgtctgtttactctgctgactgttccttttgccatgcaaaagctctttaccagctatgtatctttgcttttattgcatatgttttgggatcttggtcatgaaatccttgcctaagccaacgtgtagaagggtttttctgatgttatcgtctagaatttttatagtttcttagatttaagtccataatccatgttgatttgatttttgtgtaaggtgagagatgaggatccagtttcattctcttacatgtggctagccaattatcctagcaccatttcttgaaaagggtgtcctttccccactttatgtttttgtttgcttgttgaagatcagttggctaagtatttgggtttattcctggtttctctattctgttgcattggcccgtgtgcctatttttataccagtaccatgctgttttggtgattgtggccttatagtatagtttcaaatcaggtagtgtgatgcctccaggtttgttctttttgcttagtcttgctttggctatgcgggctcttttttggtttcatatgaatgttagaattttttttttctaatttggtgaagaatgatggtggtattttgaatggggattgggttgaatttgtagattgcttttggcactatgtcattttctttgttgttttttttttatttgtttgtttgtttgtttattttgtttttgagacggagtctctctctgttgcccagactggagtgcagtgacgtgatcttggctcactgcaacctccacctcccaggttcaagtgattctcctgtctcctcctcccaagtagctggtactacaggcatgtgccaccacacctggctaatttttgtatttttagtagagacagggtttcaccatgttggccaggctggtttcacaatcctcacctcaagtgatctgcccgccttggcctcccaaagtgctgggattacaggtgtgaaccaccatgccaggcccagtatggtcattttcacaatattgattctacccatccacgagtgtgggatgtatttaatcataaagggatgctggattgtgtcatctgtgattttgttcagcagtgttttgtagttttccttgtagaggtctttcacctccttggttaggtggattcctaagtattttattttattttttttgcagctattttaaaaggagttgagttttttatttgattctctgtttggttgctgtttgtgtgtagaagagctactgatttgtgtacattaattttgtatccagatactttgctgaattcttttatcagttctaggagctttctggaggagtctttagggtttttgaggtaaacgatcatatcatcagcaaacagtgacattttgacttcctcttcaactatttggattccgttttttactttctcttgtctgattaatgtggctaggacttcgtggtgagagtgggtatccttgtcttgttccagttcttagagggaatgctttcaacttttccccattcagtgttatgtcggctgtgggtttgtcatagatggcttttattacattgaggtgtgtcccttgtatgcccattttgctgagagttttaatcataaaagttgctggattttgtcaaatgctttttttgcatctattgagatgataatgtgatttttgtttttaattctttttatgtgaggtatcacatttattgacttgtgtatgttaaaccatccctgcatccctggtatgaaacccacttgatcatggtggattatgtttttgataatgttgttggatttggttagctagtatttcgttagggattttagcatcgatgttcttcagggatattggtctgtagttttcttttatggttatgtcctttcctggttttggtattagggtgatgttggcttcatagaatgaattagggttggttcccggtttctctatcttgtggaatagtatcaataggataggtataaattcttctttgaatgtctggtagaattcagctgtgaatctgtctggtcctggacttttttctgttgttaatttttaaattactgtttcagtcttgctgcttgttattggtctgttcagggtatgtattttttcctgatttaaggtaggagggttgtatctttccagggaattatccatctcttctaggtgttctagtttatgcacattaaggtgtccgtagtagccttgaatgatcttttatatttctgtggtgtcagttgtagtatctcccgtttcatttcttattaagcttatttggattttttgtctccttttcttggttaatcttgctaatggtctatcaattttatttatcttttcaaagaatcagctttttgtttcatttatcttttgtatttttttgtttgtttcaatttcatttagttctgctctgatcgtggttatttcctttcttctgctggttttaggtttggtttctctttgtttgtctagttccttgaggtgtgacatgagattgtcagtttgtgctcattcagtctttttgatgtaggtgtttagggctatgaactttcctgttagcactgcctttgctgtattccagaggttttgataggttgtgtcactattgtagttcagttcaaataatttttaaatttccatcttgattatatttttgacccagtgatcattcaggagcaggttatttaatttccatggatttgcatggttttgaatgtttcttttggagttgatttccagttttattctgctgtggtctgagagagtgcttgatataatttcagttttcttaaatgtattgaggcttgttgttttgtggcatatcatatggtctatcttggagaaagttccatgtgctgttgaatagaatgtgtattctgcagttgtagaatggaatgttctatatatctatatatatatagatatatctgttaagtctgtttgttccaaggtatagtttaaattgattgtttctttgttgactttctgtcttgatgacctgtctagtgctgtcagtggagtattaaagttccccactattattgtgttgctgtgtatttcatttcttaggtctattagtaattgttttataaatttgggacctccagtgttaggtgcatatatgtttaggactgtgatgttttcctgttggacaaggccttttaccattatataatgtccctctttgtcttttttaattgctgttgctttgaagtttgttttgtctgatacaagaatagctactcctgctggcttttggtgtgcatttgcatgaaatgcccttttccaaccttttacttcatgtgagtccttaagtgttagatgagtctctggaaggcagcagatggttggtgaattcttatccattctgcagttctttctgtctttcagatggagcatttaagctatttacattcagtgttagtagtgagatgtgaggtaccatttgattcatcatgctatttgttgcctgtgtaccttggttttttgttttgttttgttttgtttgctttttaaattgtattttttataggtcatgtgagatttatgctttaaataagttctgttttgatatttttccaggaattgtttcaagatttagaacttcttttagcagttcttgtagtggtggcttggtagtgacgaattttctcggcagttgtttgtctgaaaaagattatatcttcatgtatgttgcttagtttcagtggatacaaacttcttggctgagaattgttttgtttgaggaggctgaagataggaccccaatcccttctagcttgtagggtttctgctgagaaatctgtggttaatctaagtttccctttataggttacctggtgcttttgtctcacagctcttaagattctttccttcgtcttaactttggctaacctggtgacaatatgcctaggcgatgatctttttgtgataaattttccaggtgttctttgtgcctaggtctctagcaagactggggaagttttccttgattattccccaaaatatgttttccaagcttttagaattctcttcttcctcaggaacaccgattattcttaggtttggtcgttgagcataatcccagacttctctgaggctttgttcatattgtcttattattttttctttgtctttgtaggattgagttcatttgaagaccttgtcttcgagccctgaatttctttcttctacttgttccattctattgctgagactttccggagcattttgcatttctataagtgtgtcgtatgtttcctgaagttttgattgtttttttatttatgctgtctatttcattgaatatttcttcttcacttcttatatcatttttttttatttccttgcattgggcttcgcctttctctggtgcttccctgattagcttaataactaatcaataatcttcagaattctttttcaggtaaatcagggattttttcttggtttgtatcaattgatggtgagctagtgtgatttttggggggtgttaaataagcttgttttgtcatagtaccagagttggttttctggttccttctcatttgggtaggctctgacagagggaagatctagggctgaagtctgttattcagattctttggcccacaggggtttcccttgatatagtactcttccccttttccaatggctgtggcttcctgagagccaagctgcagtgatggttatctctcttcttggtctagccatctaccgcgcctacccggctccaggcttgtactaggggttgtctgcacagagtcctgtgatgtgaaccgtctatgggtctctcagccgtggataccagcagctgttccagtggagatgacaagggggtaaaatgaactctgtgaggggtcttagctttggtggtttaatgctctatttttgtgctggttggccccctgccaggaggtggtgctttccagagagtatcagctgtggtagtatggggaggaaccagaggtgggtggggccctagaatgcccgagtgtacaccctttgtgttcagctaccagggtgggtagggaagtgtgtccggaattggttccttccagtgggttcttggtctcactgacttcaagaatgaagctgtggaccctcgcagtgagtgttacagttcttaaagatggtgtgtctggagtttgttccttcagatgttcagatgtgtctggagtttcttccttctggtgggtctcgctgacttcaggaatgaagccgcagacctttgtagtgagtgttacagttcttaaaggtggcacgtccggagttgtttgttcctcccgatgggttcgtggtctcgctgacttcaggaataagccacagaccctcgtaatgagtgttacagctcataaaggtagtgcggacccaaacagtgagcagcagcaagatttactgtgaagagcaaaagaacaaagcttccacagcgtggaaggggaccccagtgggttgctgctgctggctcaggtggccagcttttattcccttagttggccctgcccatgtcctgctgattggtccattttacagagtgctgattggtgcgtttacaatcctttagctagacacagagtgctgattggtgtgtttttacagtgtgctgattggtgcgtttacaatcctttagctagacacagagtgctgattggtgcacttacaatcctctagctagacagaaaagttctccaagtccccactcgacccaggaagtccagctggcttcacctctcagaaggaccatcaggtgggggcagggcccaggatgtctgagctcagactctccttgggcaggtcttgctgcagctgctgtgggggatgggggtgaggttcccaggtcaatggagttgtgtacctaggaggattatggctgcctctcacacgtccttcaggttgtcagggaatttggggaaagccggcagtcacaggcctcacccagctcccacgcaatccacaggggtggtctctcccaccatgcccctgctagcagcaccaagtctgtttccaggcagtgggcaagcagggctgagaacttgcaccaggctacctgcttcccatctgtgaaagaaagtagggctttaattttcctgttcaagttgttaccaagatcagctggagatttccttctccctgtggcattttcccagtgcctctggccgccctccagaaagatccctgtaatgccagacaggaatggcttgcttgtggacccagaaagctcacaggactttttcctctgatgcctctatccgtgtatttcgcttggctgtctaaattgactcagctccaggtaaggtcagaatcttttcccataaactagacattaagtttccccagtgaggatgtgtgttcgggggctgagaatctccctttcccactttctcagtttgggcagtcacattatctcaggtgtctcctgggtcctgcaggagcggtcctctttcttcagagggtctgtgggtcctctcgggtttcctgatttattcctgcagtcgttctgtagccaaaattcaccgtgtgaacctccacacgctgctctgttcatcccagtcagagctgccatgtagtcctgcctcccatccaccatgacagccaatctccctgctgcacaaatttgtgaaaaacgtatattcccatgtcatggtgaagagattctgattcattaacataaggatgagacccagaaatagatgtttttaggaaacatcatagataacctgataaataacatattttcagaaattttctatgggtttcaaaaagtgtaatagttgcactatggtggtaataactgatacattcaggtactactagtgaccatgtaaatcataaaactttggaaacaaatttgccattttctaaagagttattaaaatgttatataatttgattcaattatcttattttttattgttttttgtaaggcagtaatctagaaggttattttaatttatacattatttccaagattttgatattaaaagtgacatagaatctaaattattgtttatctgctcaatggatcattatataaccattaaattttataattatgaatactgtagtatcagggaaataaaaggtagataaaaagcataaatctcatttatttgtacagtacattttcaattgtctaaagattgtctaaaaataaagagtaaaggaatatgttcaaatttaaagtagttggttttggccaagtgtggcagctcactcctgtaatcccagcaaaatgagaagctgagatgggcagatcacatgagaccaagagttcgagaccagcctggccaacacggcgaaaccccgtctctactgaaaatacaaaaatttgctgggggtggttgtgcacatctaaaatttcagctacttgggaggctaaggcatgagaatcacttgaacatacttcttgaataaagaagtcacttcctggactctaagccaagagtctaagccaaatatcagaccagtttttccagggggccttattagcattcatttgttaaagtcaaccttagtttcttaaagctgaccatcatatctaattttgcacatcatactcactaatggtttccagattctggaggaatcaagtagagagaaaaagtaattatttcaattttatttataaaaatataatctaggccaggcatggtggcttatgcctgtaatctcagcatttttggagtccaacgcaagtggatagcttgagcctaagagttcaaggctgcagtgagctatgatcacaccgctgcactcttgccttattgatggagagagatgctgtctctttgtaaaaaacagaaaaacataacctaccacattgcggtaaactataaatatcctaagagaaaatgcttttcttaaatctggaagccaaagcacaaaagagccagcaaaattttgaagaaaaggttattaaataattataatcacccttttcagtttatttagtcaaatctaattaagtcttattctgctgtatcttggcttggcaattttatgagctcatcagttgctttattagagttgtggaaattcttacccagtccaatggtatgatcttaaagttatcagaaacctttattctgtagcacttttcagagccttttccattagacactttggcctatatcagattgtaaatgctttcagagaagaatcaaagtaaaacaataaattgagaatgacaaaaggcttaaaatcaccataaagatctgatgagagtttatttgctaaggaaatttatttattgctgtggctaatgatattttaacataataattggaattgtgactggtaacattatgccaaacctatcatgaataacatattgacaaatttctatcaactttatataactcctgaaacacttatattaataacatatatctatatacatataacctaaagaagatatagcatcagttcttatttgacagtacttcctctgtaatttaacaaatcaaactaattaacataacatctctcttttacaaggcaagagacaaatcctttgatattttccaggaaccctctgggaactctcaatgttaatttaaagtcaaagatacgttatgtagaatttgatttgggccgggcacagtgcctcatgcctgtaatctcaacactttggaaggccgaggcaggcgaatcacctgaggtcaggagtttgagaccagtctggccaacatgatgaaacctcgtttctatcaaaaatacaaaaattagctgggcatgttagtgcccgcctgtaatcccagctactcgggaggctgaggcaggagaattgcttgaacctgggaggcggagcttgcagtgagctgagattatgccattgtactccagcctgggcagtaagagcgaaactctgtctcaaaaaaaaaaaaaaaaaaaaggaaaaaaaagaatttgatttaatttgggaaagtttgtcaaaaatgtcagaaggttttaaacactagaatcacacatcattataaaacaatacttatatataagtattgtttattactttattacttataaacaaagtaataaaatattttataagcacatatagaagttacatagttgtaaataaaactgagtacttttaacattgaaaggattccgcttttttaagtaatcaaaataactgataaaggtaacatgaaattgttcaaaataactgataaaggtaacatgaaattgttctaacatacaaaaccttgattttctaggcagattacttaaaaactgggggaaaaccctttcacgatatcgttatcaagagcagacaggtaatccaagaaaagtatgtcattttaacagagaacacagaattctaatatggcatgtgttctattaatactaaggctttgtttgtttgttttttgtttttaagagacaaggtctcactctctgttgtccaggctggagtgcagtgtagctatcatagctcactgcagcctcaaactcctgggctcaagtgatcctcccacctcatccttttgagtagctaggactacaaggatatgccgccatgcacagctaatttgcctaatttttgtggagatggggtctcactgtgttgcccagcctggcttgaactcctggcttcaagtgatccccccacctctaatgctcaaattgctgggattacaggagtgagccaccatgcctggccactaaagcttattaaaaaacaacaacaacaaaatacttttgactaaatctgtccaatcttagccaactctaccacacaaaataagatcctgtttccaagattacttttccacaaacctgtagttttaaaaaatatattcagtttttgtcctgttcttttttctctttctctttggcacaaccagtcattcttactttaggacaaagtgacactctttttcccttaacaaacccacatccttcattcttttcctcatcaaaaaacacattctacttcccttgaatactttgcatatagggttttttcctgattagatttttttgtgtgtgtgacagggtctcactctgtcgcccaggcttgattgcagtggcacaatcgtagatcactgtaactttgcactgctgggcttaagcatacctccacaaccaactaattttttaattttttgtaaagagttctctgttgtaaagactcatctacttgtaaagacgagttataaaaagtttataaccttttatgaatataatttataaaagtttataactttataaatataaacttttataaattatatttataaaaggttataaccttttggttataaaaggttaaccttttggttataaccttttataaatattatttatgaaagtttataagttaacgtgctttcatctatttaattcacttttaataattatgcttggattgctcatgaaaatttcatgagacactgctcaaaggtagatattctcttaaattttgttgttgacaaatcagacaagtatctaaaatatcacagaagcaaaaatcctaataaacaaaaaccttgtttttgcctttttaaagtgtatacatcaattcatttttattgtacatttgattcttaggttgcatttatagttttattctcataaatatctggtagagatagcataagtttgtttgatgagtaaacctaagtggaaaacaattatatgtcgtattatgtttaatgctgacaactctgacaacattcctgtttttattttaccaacaatctttaaaccagttttatttaccaaagattatcccagatcacatgaacctaaaataattaggttagttttcatatttttgagagttttaggaatacctagtttatacaagcactgatttttctttacatcaattaaatggagcccttttgtataattttctatctggagatagaaaaatatcacaaatctatgtcatgcatacatacacacacacacacacacacacacacacacacacaaacagattcaaataaagatcttacaggtttcatttgaaaatttctgcaatgagtcaataaaacatagtaatgtgaactcaactggtttatataaaatcttgtcttttcgccagcttatacttttattcaatttgtgattctggcatatgggacaaatcgaggttagctactcaatatgaggaccagtgcttttcaccaatatttggggagggtttttttttaagattttaattgcccttctgataggtaattttttttatttttctttttccacaacaaattcagatcttccaatcataagtagtataatggcagctgtggacaaaacttcagacaagtgactaaggagacatctagcagctgttcagttttctccaaactctgtctgagaaaatacaatacccaatctatttccaattagcctttcttttttatttttcagcagaccccctgaagcccttgagaactgagattcctaaagttcaagttactgaggggctggagtgggaagggaaaatgtctaacaggggtagatagagggatgcaggaggtaggggcttggagagaggaatatcaaggattcaagggatgtgcctttccttcaggtataggtagggtacctcttacatgagagtcttaaaatctgcttcagaggaatgccattaagtccttcctacacgtgatttctcacatgccttcagcttagaatattcagtataccaactgaatattttgtgatagcatgtactgaactcttcattagttaaaagttgctaaagtttaaggaagagagcatttaattctcaccctatcatattaaaaattgtatttgaataccctgaacgtagagaaaaagctgggcccagaactaaaataatatcagggtacctgatattggaattttgaactgaattgtgtctcctccaaatttatatgttgatgcactgattgccagtgtgactgtgtctggtctttaggaggtaattaaggttacatgagatcataaaagtgtggctcttcttatagggccacagtcttaatgcaataggacggtggccttataacaagaatacagactcacctccttctcttcctcatgacaacactgcaagaagatggctgtctttgagccaggaagaaagccctcatcaaaacctggccatgctggcaccctgatattggacttttgttatgtaatccacccagtgtatgtattttattacagcagccctacctgattaacacatctgccaagctgaaatgttggacacctgtcaagtttaaggtgtatgtaattgctttcttcagtcttgatatagataggtctttatttagttctaatctttttttcccttcatatttgttgccctcactggaaaacagtatgttttatgtagcagtaagagccttgtaaataatgtttttcaagtgaggacaggacagatagtgtttttgtttgtttgtttgttttgtttgttttttgacagtgtcttgctctgttgcccagtctggagtgcagtggcacaatctcggctcactgaaacctccgcctcctgggttcaagcaattctcctgcctcagcctcctgagtagctgggattacaggtgcacgccaccacgcctggctaatttttgtatttttcatagagacagggttttaccatgttggtcaagctggtgacagatagttttagttgcccccttcctatgaaaatacagaatactgaatccagtttttgtgtattcaattaaaattccactaatgcttcagcttttttaacaagaaaatatttctgttttgaatgtttaacacagagtcacaagatagtcatgtatgcatgcctggtattgaaaaaatcagtaaaaaactgataacttactgactatccaaattgttactatactttgatgtttgtattgtaccatgatgataaatctggtccttagcatagtaattgttattttcataatctctaaatcagtttcttctgggttctgagatccaaaaagatgaaacaaagactaattgttgactgaaagaaatataagtaacagctactgctaacacattttaaaattagaatgcataaattaacaaatagtgccaaaaagtaaacacttttttgcaaggcaaatcatatgccttatctactcccgttcaaattaataaaaatacactatttataaacatgtactactgtactttccttttagctttatttcagaaaaatgtggaataatttacacttccacctctcaggatgctgtcagcagtagcataatagcaaaagtagaagcattttgaaatttaaaaaaggcagaaattaattaaatttaaaacaaattaaaattaaaatatggtggcattataaagatgtgttctgataaaagtctagtatattttactattttgagaagcaaatcaactcatttatgaatccttttaatatttttctgtatttaattgcatttgctagagcagtcttcttctagggatgtttaagatccctttactattaatagctggaaaatgaatagtcagagtactgattgatgatatgatgattttagactattattattttgcatttatatagcatattgcctcatatgtattcaaatatttcataaaagcagttatcagaataacaaagtctgtatttgcacacaagtattacaaacaatttaaagatacacagattgaccctccctcatctgaaaatctgaaatctgaaattctctaaaatctgaaatttttgagtgctgccatgatgccacaggtgaaaaattgcacacctgacctcatgcagtgaattgcaatcaaaactttatttcaagcacaaaattattttaaaatattgtataaaaatcatctttatgctacgaatataaggtatatatgaaacataaatgaattttgtgtttagactttagtcttatatgatttggctgtgtcccccctcaaatctcatcttgaattgtaactcccacaattcccacatgtcataggaggaacctggtgagacataattgaatcatggtggctggtctctcccatgctgttctagtgaaagtagataagtctcacaagatctgatggtttttaaaacgggaatttccctgcacaagctcactcttggcctgctgccatcttagtaagacgtgacttgctcctccatgccttctaccatgattgtgaggcctccccagccacgtggaactcttaagtccattaaatctctttcttttgtaaattgcccagtctcaggtatgtctttatcaacagcatgaaaatggactaatgcagtaaattggtaccagtagtgtggggtgctgctgaaaagatacccaaaaatgtggaagtgactttggaactgggtaacaggcagaggttggaacagtttggagggctcagaagaagacaggaaaatgtgggaaagtttggaagtccctagagactcgttgagtggctttcaccaaaatactgataatgatatggacaatgaaatccagactgagttggtctcagatggagatgaagtacttgttgggaactggagaaaaggtgacacttgttatgttttagcaaagagacttgcccctgccctagagatttgtggaactttgaacttgagaaagatgattagggtatctggcacaattgatttctaaacagtaaagcattcaagaggtgacttgggtgctgttaaaggcattcagttttaaaagggaaacagaacataaaagtttggaaaatttatagcctgacaatgcgatagaaaagaaaatcccattttctgaggagaaattcaagctggctgcagatacatgcataagtaataaggagccaaatgttaatccccaatacaatggggaaaatgtcaccagggcatgtaggaggtcttcgaggcagcccctttcatcacaggcccagaggcataggaggaaaaatggtttcacgggctaggcccatggtccctgtattgtgtgcagtctagggacttggtgccctgtgttccaaccactttagccatggctaacaggggccaaggtaaagcttgggatgtggcttcagagggtgcaagccccaagccttggcagcttctacatgatgttgagcctgcgagtgcacagaagtcaagaattggggtttgggaacctctgcctagatttcagaggatggatggaaatgcctggatgtccaagcagaagtttgctgcaggggtggggctctcatggagaatctctgctagggcagtgcagaagagaaatgaggggttggagcccccacacagagtccctactggggcacggcctagtggagctgtgagaagaggatcattgtcctccagacttcagaatagtagatccactgatagcttatactgtgcacctggaaaagcagtgcacactcaatgccagcccatggcagcagccaggagggaggctgtaccctgcaaagccacagggtcggagctacccaagaccataggaacccaccttttgcatcagcattacctgaatgtgagacctggagtcaaaggagatcatttgatttgacgtaagatttgactgccttgctggctttcagacttgcgtgggggctttagcccctttgttttggccaatttctcccatttgtaagggctgtatttacctgtaccctcattgtatctaggaagtaactaaattgcttttgattttactggctcataggtaaaagggacttgccttatctcagatgagactttgggctgtgaacttttgagttaatgctgaagtgagttaagactttgggtgactgttgggaaggcatgattagttttgaaatgtgaggacatgagatttaggaggggtcggggtggaatgatatggtttggctgtgtccccacccagatctcatcttgaattttaactccctcaattcccacatattgtgggaggaacctggtgggaggtaattgaataatggggttgagtctttccaatgctgttcttgtgatagtgaataagtctcagctgatctgatggttttaaaaacaggagtttccctgcacaggctctctcttggcctgctcccatccacatataaaacatggcttgctcctccttgccttccaccatgattgtgaggcctccccagccacatcaaactgtaagtccattaaacctctttattttgtaaattgccctgtctcgggtatgtctttatcagcagcgtgaaaatggactaatacatatccccaggatatctcattatatatgtatgcatatattccaaaatccaaaaaaagttgaaatttggaaaaacttctagtccaaagtatttcagataagggatgttcaccctctgtctgtccaaaaatcatgaacgaagatctagtttgtgtgtagaaagttgcagtttcaccctaaaaagcaaaacaagctggataagtcatataattcaaagattatataatcaaaattttggttatagcgatctacgagtagttgcctgaggtagagggaatttactagaaagggaaatttgagatctttcttggatgatggaaatagtctatatgttgcttgggtggcagtttcacaattacataaaattgtcaaaatccatcaaacataacatcagagatcattattttttgtatatatattaacttgatatgaaaatctgaatgtggtttaatatgattcaatttgcatttaatttaaaatagattaatttagcaacagtagcaacagtgaaggtggaatacgttgaaaataaaggttatgacttttgtgggcactgatagtcaatgggttgtcagaaagaagagtagtaattcccattttttgtgtggaaccatggatactggtagaaaattttttcagttacactagttctgatctgatctcccactatgattgtataaagcagtgaaaactcatttaatattcttccaggactttcatttatcaatgcctaccaggcagtgataatcaggatagccatatgctttgtctactcttggttaaattaatggaaacaacaacaactttatataatatggtaactatactgtattgtggtagtcaaagttagattcatttagcttgctgcaatgcatagggaggctgtgcaaggagctaaggtattttggtacaagaagttactaggaattcatcataggattcagggttgtgcttaaacgtggtttccgtggactcagtgtccttagagtctgctaggctccatgtgggttcttccttttgtgtcagcctccaggaaactcactcaagcctttgaaaatcaggctcacctatttgtttcctgtctctctggaatcactatctttactcttgagtttaatcgtttgaataccaagctgttgatatatatatcttctgacttttttaggtgttttagaaaatagggaaaatccagtatctttattccttcttggtcagaaataaaagttctcatattttttttactaaaatgttggggtagggtgatatgtggatagacaaaaaagttaatatgccagtgcttatttgtaaaacataaagcttaaatgaagaaaagtaatattaaaatagttatacatcgttttttaaacactatgttcaaggcatcttgatctgtggaattatgtattttagctaagttgtactaaatagtactgattcagatatacaaatcataatacttatcagctaattgaaagctccttgagaggaatatttaatggtttaattttgaacatactacatattttaagtatcaaatgttcagtaaatatatatgtggaatacatgttttctgtgtcagacactgatatggtttggctctgtgcccctacctaaatcttacctcaaattgtaatccccatgtgtcaagggaaggacctgtaatcttcatgtgtcaagggatggaggtgattggataatgtgggtggtttcccatgctgttctcgtgatagtgagttctcacgagatctgatggtttgataaggcagttttgcctgctcttgctggctctctcttgcctaccgccatgtaagacatgccagcttccccttctgccatgattttaagtttcttgaggcctccccagccacatggacatgtgagtcaattaaacctcttttctttataaattacccagtcttgggtagttctttatagcagtgtgagaacagactaatacagtaaactggtaaagtggtgagtgaggtactgctatagagatacccaaaaaggtggttgtgactttggaactgggtaacaggcagggattggaatagtttgtagggctcaaaagaagacaggaaaatgtgggaaagtttggaacttcccggagacttgctgaatggtttttactaaaatgctgacaatgaggtggccaatgaagtccaggctgaggtgatctcagatggagatgaggaacttcttggtaactggagcaaaggtcactcctgccttgctttagcaaagagactagtggcattttgcccctgccctagaaatctgtggaactttgaacttgagggagatgatctgaaattggaacttatgtttaaaagggaagcagagcataaaagtttggaaaatttgcagcctgacaatgtgatagaaaagaaaaatcaattttatggggagaaattgaagcccattgtagaaattttcataagtaatgaggagtggaatgtgaatagccaagacagtggggaaaaatgtcaccagggcatgtcagagatcttggtggccacccctcccatcacaggcccagtggcctaggaagaaaaaatggtttcgtgggctgggccctgagcccctctgctctgtgcagccttgggacatggtgccttgtgttccagctgcttcagctccagccatggctaaaaggggccaaggtacagtttggtccattgcttcagagggtgcaagccccaagccttagtggcttccatgtggtgttgggcctgagggtgcacagaagtcaagaattgagttttaggaacctccacctagatttcagaggatgtatggaaacacctggatgtccaggcagaagtcgggtttaggggcagagccctcacagagaacttgtacaagggcagtgcagaagggaaatgtggctttggagcccccacacagagtccccactggggcactgcctagtggagctatgtgagaagaggaccaccaccctccagaccccagaatggtagaacactgacaaccagtaccatgagcctagaaaagccacaggtactcaatgccagcccattcaccaaagctgcccaaggctgtgggagcccacccattgcatcagcgtaccctggatatgagacttggagtcagaggagataagctttcaaattgagtgactgccccaatggatttagaacttgcatggggcctgtagcccctttgttttggccagtttctcccatttagaatcggtgtagttaccaaatgcctgtgccaccattgtaacttaaaagtaactagcttgggtcctttttgagatgcagtgttgctctttcgcccaggctggagtgcaatggcacaatctcgactcactgcaacctccgcctccccggttcaagcgattcttctgcctcagcctcccatgtagctggtactacaggcacgcactaccacacctggctaatttttgtatttttagtagagacggggattcaccacattggccaggctgctcttgaactcctgacctcgtgatccacccccctcggcctcccaaattgctggggttacaggaatgagccaccgcatctggccttgttttttattttacctgcttataggcagaagggacttgcctgtctcagatgacactttggactgtagacttttgaattaatgctgaaatgagttaagactttgggggactgttgggaaggcatgattggttttgaaatgtgaaaagagatgagatttgggtgaggccaggggtggaatgatacagttcggctctgggtccccacccatatcacatcttgaattgtgatccccatgagtcaagggagggagctgtaatctccatgtgtccagggaaggagatgattggatcatgggggcagttttcctcatgctattcagtaataatcagtgagttctcatgagatctgatggtttaaggcagttttccctgcttgtgctaggtctctcttgcttgtcgccacataagacatgcctgcctccccctccaccatgattgtaagtttcctgaggcttccccaaccatgcggaaatgtgagttaattaaacctctttttttttttttgtaaattaccctgtctcaagtatatctttataacagtctgaaaacagactaatacagacacctagcatttcttattagaattcataatatttattccttccctgagcttaagagccattttcaggtaagatgagaactaacatctatttatataaatccaataaaatatatgaattttgattacaaatgctaattttcactcagttttaagcttctatttcttatgctagtttctcttcattatgttgctatagatctactgattatccactttatgtctttctaaatattcctttatttactgatatattaaaatttttgaacaattaactttatttatcaaagactaacataattcctgatctcttggtagttaagtggggaaggcacatatctatcaaataagcactctaatttgtatataattaaggctgaaataactataccagaattaaggataaagttttgtaaagactgaaataatctattaagtctcatgcacagaagagacatagttcaggaggtattttggatgaaaattgccaaagatattgtagctgaatcccaaacctgagaaatattcttggttttttagtatttttccttcatcaccaccgccattgccaccatccctcttcagtctagtccattaccaaatcccattagctccttctccaaaataacatcaaatccaactatattatctattctaccatcaccctggtttaagccaacatcatctctaacttgaacttgcagtatttctaaatatctgtttccattcctgtcatcctttaatccattctctatatagcagccagagaaaccttttattaaccgtaaatcagaccatgacatttttcttcttaaaaccttggtggctctctataacattcagaatgaagtccagtttattcaggataggctactagaccctggttcctgaccttctctccaatctcatctcatcaccattttattatttatttatttttctcctcactctcttcctacaagctatgctggctgccttttcattgcaagaataaaccaagctccatactattttggtgcctttcagtttttgctgtcctgtacctagaatgtttttctccagttttttacttatttggctcatcgatgttaaaatcagatcacctcttcagataggccttctccaataaccttgtctaaagtgacctcaagttattgtattaacttattttctccctcatttaattttatctccttaagttctgtgaaagctatgaattcattccatttatctttgttgtagctatctttgttggcacttaggtgctcagtaaaaatactttttatgtggatatttccccagtcttcttagtaaagtctgaactataatgaaggatcataatcatagcaaacatttatgtagtctccatataaattaataattgacagttgatgatttctgaaaaccataatccgtattcactcagtaagtgagtattttatattatagctgaaaatagcttacttttaaaggtataaagtaaaggataaggactcatacacacttataaagtctaaagttgttaattcagttcaacagataatttacatttaatactgaaattcactatttactatgttcagtgttgtgttaggcaagctgtctagcttaaaggacactaatgttcaacatgaattctaaatggagtaagtaattggagatctggtatagaaattgagtgaaatgcattattaaaatccatgaaaaccaacaagtcttagtagttattctttacaaaagccataattaagacccacacctcccaaactgtgcaccagggtaccccagactgccatagaaaactcttagggataccataggctttttttaaattttgagggaaaccagcaacatctgtcagatactatgtaaagtactatctcaaggtagttcgcagtttcagtgttagattgtacctttgatgatgtcacatctttatgaagctgggttttgcacagttaactgtgagaaaaagcaagtactacaggaaaattattgtggaagaggaaaggagggcaacagtatccaatatgattcaaaggtttaggatatgtacagggcccaatagttgtacccatcccattagtaagtaattgtagttactattaataattatttaaaattaatatgtttttactttcaatttgtatctattatttaacagctactaatttgttaggatataaaacttaagttgtttggaccttactacttaataaacagaactattagatacttcttttactgggtgccatgaaaacattattgagacacccagagcaccttgaactgagaaagtttgagaacttctgatatagccaaattttattttattttatttttatgattcaaatatcattttattgttaatagcatctttctggagatctggtcttcaacagactctctagaagaaatttatgtttatgataagtgggagactatactatagaagcatagagaaagagaaataatatttactgggtacctactatgttatagacattatttttatttcttgtttaatacttatagcaatcttaagatatataatgatgatcttcccattttatagacagggaaccaaaggtcaaaaaaattagatattttgctaggttacacagctaactggatggtgcctgaagaagctaaaggctttttatggcaatgactaatgtattattttcaacttaagaaagttagttggatggagtgacaaaggaacaaagatctactatattgtggattttattactgtaaataaacactgaaggttacttttttttttaaattcttagtccctattattcatgcaagtttttcatgtcatttgctggatcattaaatttgagtatatttggtagtcttatttccataatagagaatcagtgaagattgttttagtgtttcacatagttaaaattgtattttggtcacctacaacttgataatctatagaagttaagtactaccgagttagattttcattgaattttttattttaactgttttctttcttttttttttctttttttttttttgagatggagttttgctcttgttgcccgggctggagtgcagtggtgcaatctcggctcactgcagcttccgcctcctgggttcaagtgattctcctgcctcagcctcctgagtagctgggattacaggtgagcaccaccacacccagctaattttttgtatttttagtacagacggggtttcatcatgttgtacaggctgatgataacctgaactcctgacctcaggttatccacccgcctcggcctcctaaagtgcagggattacatacgtgagccactgtgcctggcctattttgactgttttcttgcctgtgtgccttgtaattataaagaaatttctggaacccatacaaagatattttctatttgcacttcattttctgttagcctcttctgaaacttctgcagtgttttgaattatctcaaccattctccacatctcttaacctctgtttcttattttctttctttttatctctctttgctgaattctatatcacttcttgagacctgtcttccagtttatgaattttcctttcatctgtatctgatctcctacagtcttctgagtttgtttctccagtcctaaaattattatatgtttcattcatgggaaccctggttggttattttcaaatctgcctagtaagttttcttacattttgtacttttctaggcatattaaacatattaatgttttctaataattctaatatttacagtatttttaggtctggttctgtagttcgtcgtttctacatatactttttgtggtagtatcccctttcccttccccttcctcttcctgttctcccttcctctttctttttccccttccctttcccctctttcgggcttttgagtgaatggagttcattccttcatggagaaatttgattctcccatgcacatgggatactgtcaatgtgaaaccactttcaattttggggtggtgtggattcaggccataaccctgcacaaatgtggatttgtggttattaattctcagggaagcccctttttctttttttttcttttcatattctacccaatccaaggtagacaggcatgtatctctttcaactccctttttggagttttggttgtttttcttagtttatccttttgggtgttactgactgcatctgaattttatgtgatatgacttcacatccatattgaactctgaaagcctggcttttaagcactgggctctttaataccaaggctgtaggccacacatcagcagataccaccagagtccagcaaatactggccccagaactctttccttttctggatttatgattcttttttgcttacagcctttatgaattcttttagtttccaaccagccaaccgtgtgcttaaataagtctttaaaaatgtgtattatattcacactttttagatgtggtatgctagaagtgaccttaactgaatatgttggtctgctatagtacaaaaaaaagcaattcattaaatattttgaatgacagcacaggattctgtgctgactcaagttagagcaagttacacactttagaactcttctctgaatttgctgtcactttacccaaaagtagaattagaactctttggctgccctcaccatagccaagtgactcctaatcctccagggaacatgtaaaatggtaaaatttgcctgaaaaatacagctgactttcataagactacagcaaattttgaaaggtacattggagcagtagtagtgataggaaaccaattgttaggctttctatattcattcttgaacggttaccccaaaagagtatcctaaaattcaagttaaaaattaaaacactgttaatttaaaactgtcttttctgtttcagtttaaaatgttaaatcaaaacagactttcttcttaccctaaaatagttacataagaacagtctgttgtcacagaagtcattctattataaagttactttattataaagggtatagtctctatttaaaatgttaagctacaaatatttatccttttgagccatctgtactgctaaatacccataagtattttagactaagatctgaaaaatggaaatactttaaaacctttgcattgttgattcttgattttttttatggcgtgtgtcttgctttgagcagaaatagattgatgcagacagcttacttgtaaaacattatgttactgtcatttaaaaaaatagttttaaaccctctgatggaaaggggcatctttagatgaagtaatttcattaaaatatccaattcagaatctaagtaaataaacttaaatatataaaaattcttcacttaatgtatttattcccataataaatatgttaatttcataaatttagagctctgttaggtgaatttattttattattttaaatcattaccttagctaacccagaaagtttctattgagaatgtttgttccccactttctcctcatgaaatcattttaatactgtataataccaggaaattgattaatgtcattaatcaactattattatggatatatattttattggatgcttatttcatatttcctttttgggtggcgttctattgaaacatgtgagaaaatattagtaacttgtctactctgcttacccccatcttatataaaccccatttccagaggactggaaactggaaagaagaatacctcagggctgaacatgacaggggcttaagaaaagtatctgagaaattataaccaaaaactgagcctagaatgaatttgcaattcaaattcatattgtctgcactgtataaaaaaatttacattttttcttacagcttttttttttttttttgagacagagtctcgctctgtcacccaggctggagtgcagtggcacaatctcggcgtactgcaagctctgcctcccaggttcatgccattctcctgcctcagcctcccgagtagctaggacaacaggcacccgccaccacgcccggctaattttttgtatttttagtaaagatggggtttcactgtgttagccagaatggtctcgatctcctgacctcgtgatctgcccgcctcagcctcccaaagtgctgggattacaggcgtgagccaccacccccggcccctgcttttttttttttttttttaaacaaaaccatcaatggaaggaaaaacactttaagtgtatgaatttagtttaaagtagtctatgatggatagtgcgttcggacaactgaccaaaacaaatgcagattctctggtgaattcactttgtcctaaaattcaaagaaataccatacattatttaccactgaacacgaaaagctacaaggaaatgaagtactatgaataagaatcatcagaaacactaagcagctgaatcaaccctacatagacattaaatattggaatgattggatatagagtaaaaaacaactatgcttacttaatatgttaaacaaaataaaactaaaaagcaaaagcctaaaaaaaatcaatagggaacagcaaactgtaaaaatgtcctagcaaatttggaaaataatcaattagaaattctagaattggaaacaaataatctaaatttaaaatcacatggagtataacagcagaacagatacaattgaagagagaaatagcaaagtgaataataggctaaaagaaattattgagaatttatcacaaagagcaaaaattcaaaaacaagaaagaggttcaaaactacactgtttcatgcacactggtgtatttatgatatatctcacaaaaatgtctaaaatataatcaaatatatggtcaaatatgctcattcatctttagagctttctataagaagaaaacaaaaggaaaaacattatgtgcaacagtaggggaaggatcagagagttaatagttcatccattacaaattatgttactataaatacttaacgtcatgagggaaatatttaccttaagagtattacatttatacattgatctcaaattcaaagaatagtaagatatgttatttatttaacgatacatataaaaagaaagaatatcttatttaatagtagagcttacttctgaatactagggatacaggtactttaaaattttctttgtaggctctttgtatttcccagttgttttaaactgaacatttagtacttaaaaaaaaaaaaagccagaaagctgctaataagtattaaaaagtggtacttagtgatgtattctagaacttttctgtgctatatctgtgcttttcctgtggtaagtgcttatcatatttttaaaatgactgatatttggctcttatagattcttaatgtatatttaaatgaagtggatgaataataaaagttagtggaaaatttataaagagtaaggccttgaatatttgcaacacactgaactgttgattactggggatttaagctgagagtcttcatttaggtgcaatttagtaagtgtcttagttccttttgtgctgttataacagaataccagagattaggtaatttataaagaaaaaatttatttcttacagttctggaaagccgggaagtccagtatcaaggtgctagcatctggtgagggccttcttgtggcatctcatggcagaaggaagaagggcaagagagcatgtgtgtgagagaggaagaaattaaacttgcagcttcaagcccttttataattgacattaatccattcatgagggtggagtcctcatgtcctaaacacatcccatcaggtcccagctcccaacattagggattcagtttccaacacatgctttttggggaacacattcaaactatagcagtaagcaactttgaagacgttcttgatttgcttattcaatatgtgtaagatctagcaatatttatgagataaatataatatgcaaataattttgttttaatttattcatatgataaatatttattgaatgtcttttgtgtgctacacgttgcactagattttggagatgacttgtgaaaccatatacagtctttgatgagatttagagcatagtagaggatatatatgtatgtatgttacatgcatatatgatttattcaggagtataaggcaattcaatattaggaagtccattaatataaaaggttgggggaaatgtggagagtaataccagagacaaacaactataaaagacatgtaagttgttgtctttgggcagaatcactatgaaatgatggttggataggtggcagctgttgttacatcatatatattttatcactgtcttatgttttcaagtttgtacatatgttactttactaaaaataaaagttaattttctagctgacatcaaattatttcttcctctcaagtcctttgtagctactgtcaccagcagaatatcccatagcctccttctaatatctcctcaccctggcagcctctgatacagggataaagtcctttgagttggctttggctcagttaccttcagtattgtccaattgattcatgataaaaacccgttgtctttatcatgctaaatgaccaaagtgtaaacttccaccttactgtcctttctccttgccttgctatcttcattggttccagtgagtctttcttttttagtcctcttgagcaaaaacaagcttttccacaattccaagggatacatgtcaaacgctcagaatgctttattgaacgctcttccttgacaccatctccctaaaaatgtcaaaacactctaacaacacttttccaaaaggaactcttttgccttgttagatttcaacattcttatatcccccagggtggtgtcacaagtgtcaaaaacagttttgagtctcattgtttacagttccttcatagacaatataataaatacctcactttggccttaacattctgatacatgttaattgttacactattttatccattataaagcataccacaaaattagaaactaaagagaattagattttttatgtatatatatatgatatcttcttttaatggataattatgcacattcctagtatgtgtgcagtttgatttggagaccattatattgaagattccgtcctgtttgggcaggattgcatatgcccctgagcctatatagctcttgttatagaaatttattgtgttgatttttttcactgttcaatatcccacccccatagtagaattgatttttagaagaaacggtgacagtttttagcagccatgatggtggcctagggttgaagaaatatgtgatgtattgttagagtccaagccatgctgttctattaaaatactatttttcttcctgctctttttgaagttgattttatttctgcttattttctaagcctgaatttctggccttcatttgtttttgttcttcttgtttttgtttttgttttgttttgtttttgagacggagtctcgctctgtcacccaggctggagtgcagtggcgcgatctctgcttactgcaagcccggccttctgggttcacgccattctcctgcctcagcctcccgagtagttgggaccacaggcgcacaccgccatgcttggctaatttttttttgtatttttagtagagacggggtttcaccatgttagccaggatgcatttctttttttttaatacttaagtttctttttcttgtttaagaaagttggagttaggactgttgttcattcacaacaaattgacaccactgccttaatatcataaagactctgtattgtttcagttgtttgctcattgggaaaatactccagggtgaggcctcccttacatctgagggacctgattccctgtgtagagagttctttttttttttaattgttccagtttatacttctggtagacttttaatcttcccccccactttaaagtcccagtatgccccactataaattgaaacattgtgttctagtctttatctacaaacttagagaaaattaattacttttcaaggtaacatattcaattttattttcttttttcttagatcactccagtatatccagcaaactcccttaaactaagcccaaactggtgttgttgcctgttgcaatttccttcactagagcatccagaaaagcttacttgcctttgcatataaaatctcttactttgggaggccgaggcgggcggatcacgaggtgaggagatcgagaccatcctggctaacacggtgaagccccttctctagtaaaaaaaaatacaaaaaaaattagccaggcgtggtggctggtgcctgcagtcccagctacttgggaggctgaggcgggagaatggcgtggaaacgggaggcggtgcttgcagtgagcggagatcgcgccactgcactccagcctggacgacagagcgagactccatctcaaaaaacaacaacaacaacaaaaaaactctttaattgctttaaaacagctaaccaagtcttatttcctttatcttcttgtatttttcttatattaccttggcaaaatgaaaaatttggggatttagtgtttgccaagtcaccatatggataaatcaccactagtgaagaataaactatatccatattatgttactttaaatgaaacgattacatttcatcattaccctcagaattaaacctgttatttacactactacttctcatcctttcttctaataggctccaagctttctcctttttcatctttcatctatcccaataaaaacataacttccaattttaattagaatagctatatataataggttgaccaactgtgtatcttctgtagccttctgcctataacctgattataaaattgctttaactaaagtaagttactgcctattctgagttactctattacacaaaatttaattttattacgctactttcttttccatattattttcctcctagcctcttccaattctttgtcttcttgatctcccttattaatccttttctcagggaaggaagatctgatcagccaattcactccaagatttaagtgactagtggttggaaatctgttcctcttcagcattacctgtaatttaaacaaggaattaagttgtattggctttggtgaggcacaacgtgtgtttgtatatgagaatgagttctttatagcacccattcagtcacacaaggctacctacttgtaagtctaatgtttagagtaaacagtgaattatctaatacattttgcatttcttacaccttgaaagaatgttgataaatttccttatacaagtagtctgatctgatgttagacaaatagtgaatactcagttttattgattaattgagtgcattttcagaatactgaaagattaggaattgtggttgactgagcattttgttaagatgttattagagacaaatacaaaaaaattctggctctctggattggactctgtgtagattgattccatctgtaaaaggtgcctcatctttgacagtagatattttagtcactgttacttgttagagattcaatatagcaatgcaatttttttttatttacttataaggatttatgataccaagttgtatttgacatttggattaaatcctgaggggtaaggaagattcgtccctgtggtagaagtttctaaagtcttaagtcaaatgaattctacttacactttagttagaaggccatttaagacaaacgtgccttaaaagatcaagtttttcagtgttaaaattctacatctcaatataggttatgaatactacattaagttcatttggttatgaattcattattttcaccttttgctgctattgttatacttcaactctcttatttttacaactttttattttgaaaactttcaaactttaaaaaaatgttgggacaacagtataatgaacagctgcactctgcacacctagattctcatgattgagaatacatgctgtatctatttatatctctgtcttgccttctctctatatataacttaaaaactgtttcagacatagtgacactttacccctgaatacttcagcatgtttccctaaaattaaggacattgttcaccgtactcttatcatatgctggaaatgttaacattgagacaataatatcataaaatataacatacaaacctatttttagatttctccaattatctcaaaatattatttatagattttttgattcagtattctgtgagggattataaatgataatttgatagtgatatgtcttcaccattttgttatatattgtcagaaatttgatgtagaataattcatatgttagcaactgtggaaagtgttgccaattatgaaaaaaatgtaaatttagataatttagaaatagtccactaagacttttattatatagttgattatattaattaaagtaacttgaattccttgacagtttacttatgtataatgagtgttcatgatgccctaattgaatttttatttttttaaaatttaatttttaaaaataataataatacagtaaaaaaccctttgtgatctttcttaatagtcacatcatcactctaccctgcctatcacagatctgttttacatcactatagtttgtgtttttaagaatgtcaaataaatagaatcagaaagtatgaccagcttctctcagagtagagtctctgagatatatccaagttgtgtatgtcaataatttattcatttttatggtagatagtattccattgtacatatataccatagtttgtttatctactaacccattgaaagacatttgggttgcttccagcttttggctgtcacaaataaatctactgttaatatttgtatataagttttggtatgaacataagttttcatttctctataaatacccagatgtacaattgctggctcatatgataaatgtatacttaacattataaaaacccgccaaactgttttccaacatctgcatcatttcagtattaggctcaatcaattgtcttatcccatgtgaatttgtatcctgtattactttataagactctgagtcttatttagatcctgtggaaaatattgatatttttgttttggccttctgtggattgtgtggttctaaccttggctctattttacaagactttggtgtgcaatttggatctgtcatgaatgtgtaccctctagtggtcactctgggaccagcttgtagatctgttcttagctaaggcctttaaatatttgatatgctaattagtatcaaatccataaatgggcagatccagggtgagtaaaagttcaaaacaactttatgtagttgctttcctggtctcccttccctaagtactttctacttcccttggggctgttttttttgttattgttgttcttcaaaaaagaaattgtttctttctgcagttttacgacatcctcacaccatttagcactggtgataagatgccaccaaggctacatggtgggaagacagggacatagggaaaaaattctacagggtttggtgctgcccttttggcattgctgcttctctgaaaggtaggtcgacctccctcagagttttgactcctgcagtctctcatttctgtcttcttttattttagctgccatgggactgttcagggtttggggcatagaaaaatgaggaagaggagagggggaaacaaaataacctggagatttctcctactctttctctgtctgcactgtaagtgttcagaaaatttctcctggacctcactcacaccacatagtgctcagttctgggtttctggcttcagaggtagtggaggaaaataaatgttaaactcaacattggtattcttccctcatctgtctactagtgttaacttttcagagttttcagataagtctctagccaggttttttagttgaattagcatgagataaagagagtctggtcttatttcatcttactggaatcaggacccctaattgatttttaaatggtattgttgatacaattgtcaggccatttatttcagtatttcactaagtaacttctaaactgtgaaaaaagtaattataaaataaacatcaggtatttttgttcttatttgtatctttgacatgagataaagtttgtggaagatttaacaagaacatcataagaagttgactataaattagatgttaattcattaatttattcactccacagaaattaaacgagtactgactcttggcctgggattgcagatattataatgaacaagataggcagagctccttctcaggacgggttaatagatttgagacagtcatttatagtacattgtaaaaaaaaaaaacaaaactgccccagagttaatgttaaaaattgttttattattttttctttaagataaaacttttaaggggtcaggactctggtaatgttgaatgtacattaatgcatttatgtatggacatagctgaggattttgttaaaatgtgccttaaatgattacataaattaaataagcaatttgttcagcaggttaaaaggaagatatttcatatttttgtaaatgaacacatgaaattttttcctttaagattttaaatgccaaattatttacttaggtagtgaactatagtgttaacattaaataaaaagagatctacatatctactcctatttctgtattaataaactgtgatgatgtatcaataagtaggatcatgtgccattaggacttgaaataatggaatatggtacgtcctaaagcttattttgtcattcatctagccaataatattaattacttaatatcactgctcaagctatcatctttgagaaatactgatttaacaatagtttacactaaatatgtaaaaaataattttaaagtcaagcaaaccataggttaattaccccattacttgagaatgcaaaaaaaatacttttactatagtacttattaataaactcatttttaaatttaaattgcaaaagttatcacaggctttctatggtatatggaattataataacatacttttaattgatgtttgttggaattcacagcatttatagactttttaaatagactttattttttggcagttttaggttcatagcaaaattgagcagacagctcagagattttcccatataccccctgcacccttacatgcatagcctcccccattatcaacattctttaccagagtggtatatttgttgccattgaagctacattgacgtatcattattacccgatccatactttatagtaggattcactgttggtgttgtatattccatgggtgtggacaaatgtattatggcaccattatacaggttgaatatcccttatccaaaatgtttgagaccaaattgtttctgattttggattttggaatatgtgtatatatgtagtgagagatattagagatgggacccaaatctaaacattaaatttatttatgtttcatctacacatggcctcaaggtaattttatccaatattttaaataattttaggcatgaagcaaagtttgcctaaaacgaactataagaaagcaaagatgtcaagtgtggaattttccacttgtagtgtcatgttggtgcttaaagtttttcaggttttggagcatttcagatttcagattttcagcttcagaatactcaaactgtagtataatctagagtagttccactgccctaaaaatcctctgtattctacctattcatccctttctcctcacaagccaccagcaaccatggatatttttaatgtctctatagttttgctttttccaaaatgtcatatagttggattcttatagtgtgtgtccttttcagataggcttcttttagttagtaatatgtgtttaagtttcctccatgtcttttcatggtttgatagcttatttctttttaccattgagcaaaaagaaatgagttgtttatcatccactcacctactgaaggacatcttcgttgtttacaagttttggccattatgaataaagtctgtataaatatccacatacaggcttttgtgtggacatagttttcaattcctttgagtaaataccatggattatgattgctgcatcatgtggtacagtgtgtttagttttgtaagaaaccaccagactgtcttccaaagtagctataccattttgcattctcaccagcaataaatgagacttcttgttgtttcacattcttgccagcctttggtattatcagtgttctgaatattgaacattctaataggcttatagtcatatctccttgttttattaatttgcattttactgatgatatatgatgtggagtatcttttcacattattatttgtcatctgtgtatcttctttggtgatgtgtttgttaaggtccttggctcatttttcaatagagttgttcattttcttattgttgagttttaaaatctctttgtatattttgtataacaattcattatcagatttgccatttgaaaatattttcttccagtctgtggcttgtcttttcgttcccttcacagtgccttttacaaagcagggttttttttttaatttttaatttttgtgagcatatagtaggtctgtgtatttgtaggattcatgagatatttagatataggcatacaatgcgtaattgtcacatcagggtaaatggagtatccatcacctcatgcatttatcctttctttgtgttacaaacaatccatttatactcttttagttatttttatatgtacaataaattactgttgactatagtcacccagttttgctgtcaacagagttgttaattttaatgaaatctaacctactgtttctttcttccaaggatgttgcctttgctgtcatatctaaaaagttattaccaacccaaggtcatctaaatattcttctattctaggagttttatatttttatgttttacatttaggtctgattcattttgaattaatttttgtgaaggctgtcaggtctgtgtttagattcattttttttgcacatcatgtcttttaagattctgagttctttcggaagacattccttggctgggattccaattttggctctgcaaggacatatcactactctcatactaaaaatcagacttataattgtagtctctgttttccaagtcaggaaataaggaaaggaccaggacaccagtagtagccatggtcttaaggctccaaaaagatgtagagaggaaaatacataaatacattaacttagtggaggtgagggaggaggatgaccttggtgccccctcacttttttaagcacaggtaaagttgattcataataatgtcaacatgtacttctttaattttttggtagcaggaaaaaggtaaattaaagcttaccaatgttttgtaaaattctaagtatcactggccctcttgtattttatcaatgctgaaaatgtgatgcttgaatccaaaaacaaatgaaatcaaggtttgattaaaccggttctaagacttcattactttgctacttctgacttactgccacatattactattactcctaattgtactaggttgctttggtttggattccagcaaacgaggtaagttggcacaagtgacctaaaaataaagtttttgtactgctgggatatcatttggctggttttctaattttgttgggcttggatcagaattaattatgtgttattttcatatcaatgtcaagtctgtatttatagcattctttttttttagaagtcacagaatttttaaaagtagcagaaaaacaataaatgatattgaaaaaattttagtacttacattttcgtcatgatcttctaaagcctcctaaaagaaacattgctcttgtgaatggtgctgcagtgaacctacacattcacgtgtctttataatagaatgatttatattactttggatatatacccaataatgggattgctgggttgaatggtatttctgtctccacgtctttgtggaatcaccacactgtctttcagaatggttgaaccaattatattcccactaacagtctataagcattctgttttctctgcaacctcaccagcatctgttatttttggactttttaatagccattctgatggctatgagatgatatttcattgtggtttttatttgcatttctccaatgatcagtgatgttgagcttttgtttatatgcttgttggctgcatgtatgtcttcttttgagaagtgtctgttcatgtcgtttgcccacttattaatggggttgtttggatttttcttttaaatttgtttaagttccttatagatgctggatactagacttttgtcagatgcatagtttgcaaaaattttctcccgttctgtaggttgtctgtttattctgttgatagtttcttttgctgtgcagaaactctccatttgtagagccctgcaggatagatttagcataattcttgaagaccctagtattttcagaatggtcaatgagcattggcttcaacttaaagtcactagctgcactagtccctaccaagagagtcaacctgtcctgtgaagctttgaagccaggcattgacttttcctctctctatgtgaaagtcctagatggtatcttcttccagtatttaaggttgtcttatctacattgaaattctgttatatagaatagccaccttcatcaatgatcttagctagatcttctggataacttactgcagcttctacactagcacttgctgctttacctcgtatgtttttgttacagatatagcttcttaaacctcatgaagcaacttctgctagcttccaacttttcttctgcagtttcctcacctctctcagccttcatagaatcgaagagaattagggccttgttctgaattaggctttggcttaaggaaatgttgtggcttctatcaagaccactcagactttctccatattagcaataaggctttctctctcttgtcatttgtgtattcactggagtagcacttttaatttttttcaaaaactttccctttgtatgcactacttggctttttgccataagagaaggttatctcagcttttgacatgctttcttctctagcttattcatttctagcttttgatttaaagtgagagatatgtgactcttcctttcacttgaatagaaaccactgtagggttattaattggcctaacgatgttgtttctcaaggaataaggagacccaagaagagggagagagacaggaaaatggccagctggtcgagcagtcagaacacacacatttactgattaagtcccctgtcttatatgggctcaattgatgttgactccaaacaattacaagagtaatatcaaaggttaattattacagtttacaatagcagacatgatattaatgaaaaagttttaaatactacgagaattactaaaacgtgacacagacgtgaagtgagcacatgcacttggaaaaatggccccagcagacttccttgacatgggttgccagaaaccttcaggttgtgaaaagcacaataaagcgaagcacaataaaaaaatgtgtttcttaaacaacaagactataatggacaagaaagagctgagactagagacaggagaccaacatgttaatcttaagtcaggaatcctaaagtgaagcaataggagtggttaaaaaaaaaaaaaaaagagaagagagattgatttaataaataattgtaatatagaattagtagcattgaatcctgatacacccacagaaaatatatacaaacgtgtttaaataatgaaaatttatggtagattctgttattggccctgattttcaaccatgtccgtcaaagccctttgccatataattttttaggaacccactgttgggggtggagtggacttccttgccttatgaatttgtatttgaccacttaacttgttgttaccaatggatagagcccctgggtatatacttactctcttgtacatccaccatgcaataagaatatgtgtgacagtattttggtgtcaggagaaggatgagagatacatgggggagagctactcccaggcctggaccagataattcttcagttagccatgtactcatgaatgaacccagctgagcccagcctggagcagccattttttaagcagtgcacagatttaggataaataataagttatgattgttttaagcccctgagttttagggtggcagtcatagctaactgatataaagtttctattctgccaaaaaaaaaaaattttaaagaaagttatattctattctattttcacacatcaattgatgtgaaaacaaaatataatctactgatccaacaggaaaactgcttgcattattggttttatttattagactgccttaatgcagcaatcacgcagctagaaagggaaaaataaaacgaatataatttataaaaatagctttattgagatataccttatatatcataaaatttacttattttaagtgcacaattcagtgatttttagtatacttatttttgccactgtcaccacaatgtaatttcaaacatttccatcatcccaaaagaaatctctgtgcccattaccagtcactttttttctctcccacctccagcttaagactatgtaaccacaaatctacttcctatcactatagatttgcctattctagacttttcatagcaatagaattatacaacatatagggatttttgtgtttagcttttttcactgagcattttttaaggtgcttctatattgaagcatgttttagtagttcttttttatttctggatagtaatccattatctgagtttatcacattttgtttatttattcatcagttaatggatatttgagttttccactttttgtctattatcaataatggtatgaacattcatttacaagtgtttgtacaaacattatgtttttatttctcttagataagtacttagttgtagtagaatttctgggtcatatggtgactctgtcttcagcattctgagaaacttaaagttttccaaagtgactgtgccattttacactcccaccagaaatttatgagggaaaactgatagtaatttaattatactgaatattcaatttatactactagtgactttcatatcataatacagaatgataactatatataaaagataataatcagataatctgaaaataataaaactgtgaaatgtacttctctctatagtgagtcatatgtgtaagttatgcagcaggtgaagaaatgtgtaagataggccttttaaaacacaatcttaaatcttattaaggttttctagagtaatataaataatgcgataatagaaataagatctacttattttctactattctgtaaaattattaaataattaaattttctttctatagtaatcttgttacaccaagctcactttgtactattgtgcctatacagaaattacactaatttttcctccattaaaacattaaaatagccttttgacttttatagacttcagagaagttgtcattatatctcaagtgctatgaatgtgaactgtgggaatgtgaactttactaagaatcaattatatagcctaagttggtgttttatatttgtttttcctgcactgttatggaaacctgtaaaatatgttaacattgaactatttggtcttatttagacagtattttatcttacaatgctgtatgatgaaatcctgcactcaaataaaacattaatcagcagaacttaaataaaaatatatgactgttaattttgtagtcttcctacttgcttagaaattaaatttctaataaatctttgtctctgattttgtgcaaaacaatgctattggctggtgacttcactgtctaagaatatggatttataaaggtatagagagtatcggttatatagaggtatcaggtaaagttcatgcaagccaaatatttttaagcattcaatggtgttttcttgtaggaattaaatgtatttattagcttgactttactgactatgtttgcttaatattaatctattagagcataactgcataacatgggttttaaatgaagcttgctgttactctaaatttatgtcacaaatgtggctctgggaaatttttcaagtttgtctcagtgctttaagccttataaaaatgagcaagtaactcataaataatagacagttcctcagaagtcatttaaagtgcactccttttattggcaaaatttccatatgttctttggctctttgagatgtagactctgtagagctatttaactaccattattttctggtgatttttttcaggtacctttctttatgatttatggttctgtaaaatcttacctcagtgtgtagctagaattatttagtcacatatttttaaataattttaaaatttcgtaaaaattcctgtgacccatgaacatcatcaaccaatgttatgagataaaatacttccctccccaaattagaatgcttttctttcatatatttcaagcgtgagtcagaattggaaaggtactaatttaaatgcattgtgctttctctaaagtggacaaaaggaaaataatagttaataagagagctttctagcatggtaccaaataaatatttgggctggtgaatgagcaagagaagtacaacaatccacttgtcctgactttcaagagttttctccttgccaacttatcacatttgtaattaattaatatttgtgcatttatctgcttaatgtcttcctctctttattataagttgtataaacacaaagattgtctatcttattctctcctttacctctaaccccaggatattgtggggcacatggtagaagttgctcaaaaaagtttttgttgaatatattcatgaatttgaatgttttgccctacaaattaactttaaaagtacttatggagtacatgccgatttaatatacctataataaatatgaatattcattgcatgtgtacatgtcaatatttaacagctatcatttatttaatgctttttttcaactttacaaagtgccctaacatatttttttaaatgtttgttgctcacagtaatcctgtgaggcatatgatgatattgctgtcattcctccatatccacaggtttcttatctaaacctgtggttgtgtaggcaggggcacaactgtgctttgcatccacagatgtggagggccaacagaactcgagcatcctctgcattttgtatccacggtggtcctggaaccaatcctccatggatatggagagtcaactgcatttccattttataggcaagcaatatggagtttagattaaaaaaaattgtttgctccaagaacacataagtttttaagtgatcaatcctggacttgaatcatttgtttttactgtcttttggatggcaacattaactttgtaccatatacctagttcttcattaattaagagatggttacaaaattaagatacatataattgtcataagatcctcaaataaataaatgctttcagttattttacatgtgctgagaatagtagtcacctttgataatgagaatgaagtataataaatctaggttatgatgtttatttaagtctgaatcatgtaaaacagaacaggcatacttctaaactaattctgttagacagaaatagaaatccctgacaattaatgaagtagcacatagtggtctttgaattacctgaattagttattttcttacatatgccacagatacttgagttcagctcattaaattttctattatttcattaaaaccaatgcagttagcggtaataggggagtgaaaggagaaggaaattgtgtagagcaagatactttatttgagagtggttatgtatgaggtggaggtggggaatccaggaaaaccatggagttatgaaaaaattaaaactcattggtatattttatttgaactaaagttgatacaatctccaagaactagaagtatttattacataaaatcatctttttcaaaagtatatgtaaaccttaattgctgtcagaaaaatatgcacaatagtgtgtatacttgcattaaaaagggatatatatatatatacacgcacacacacacacacaaatataaatgggagatataagtgcaattgcatttattgattgattgagaccaattctcactctgtcacccaggctggagtgctgtggcactatctcagctcagtgcagcctccacctcctgggttcaagcgattctcctgccttagcctcccgagtagctgggataacaagcgcgtaccaccctgtccagctaacttttgtatttttagtagagacagggtttcaccatgttggccaggctggtctcaaactcctggcctcaagtaatctgcccacctcagcctcccaaagtgttgggattacaggcgtgagccaccacacctggctgcaattgcttttatatgcatagagggacacataaaaatctggttggcagggtagggaggaaaactttttactgtatgcacttccctaacattatagttatttttaccatgtgaatgtgttgtggtctttctgctccttaattcagctaggtccaagtctttttctcacaaccaggaagaattaggcaggcatgtggacactgtacagtgagtggaatagaatttattaagtgaaaggaaaaattctcagccaagaggggatgtggtggggaggggtgtttcccccacccaaaggtgggaaaattccccgtgtagctggtcctgggccttttatggacttagaatggggagtatgtgctgattggtttgtgattatgcaaaaaaggttaaagtgaagacaccactcaaaggtgggcacgacagtgtagaaaaccaattaggaaagggtaggtatatataaagtaggtgaaggtggggatcagtcagaggaaaggctgccacacaggaagacaagttatcgatccagtccaaaggttaaacttgtagcttggctttcaggctttaaactgtctttggcttgaaagtgggatttcacaggggacccaccccctatctgcctaggcatttggctgcctcctatcactctaattttccccctctgaaaaggtacctctaactgccattagaataggaatgaagacgatcttaactgctttctgctgatagagggcactgtttggggaaaatagcagtcaaatctccctcagaggcttgtctaaggatccccagtaaaagggagccatcgtttgaagctacagttgcgtgaccattttgagtttgatggcctgaaggcgagaagagagaaactgggttattagaagacatgtatcaaaatgaaaaaagggggtaaggacagcttagaaatcctgaggctgccaccatgccaggataactggtggctgtagttgtacctgctaaggtttgggtgcatggggcttggctttggttagctcccttggccttattttcccaaagaaacctccgggttatgggtaccccatttatttctatcacctggcaggatttgcaggataattgcccagaactagaatattgatccagaattttactttacccatccctctgtttcttgtgagctgcagccagagaccactgtttggttcacagggttagtctaaaacgtaggcaaaaacttaaaaacaaataatgagattagaatttaatggcaagtgtatgataagttttgaaacataatttttctctctctagtcctcatttttgtcaaaaacaaatcatgataggactgagttgtttgcaaaataaattttaatcttatacttggcttgaatatttgcataaagtgcagcaagaataattatttttcacgtaggcttttaaaattggctttgatggaactctgttccacaaggaatctcagataagactttcttaaagccgagcccagccatgggtttctaccctcaaatgcctgtgatttgggtaaattccactcttgaggtcccaagataacttggggttcctgggtctattagaaagtgacattctttactcaccacaggttaggaaccctgtatagggactgtgtagacaaggtatgaggccagttttcccaaggggctctgcaagtcaaacttgactccttaaaggaaggcataaccttctactcaaagccttggtaaaacaaccagtttctctaattgtgtcctgttgcaaaagaaaatggattcttattgcactgatgcaaataacaatattaccataagttaaacatacttactgttgttggtttaaagtcttttttatctgaggtaagaatagcaacccctgctcttttttgttttccatttgcatagtatttctccagctctttactttaagcctgttggtgtaacgtgaaatgggtctgttgaagatagcagagggatgaatctggttttattatccaacttgcaactctgttacttttaagtgcagcatttagactgtttacattcaaggttaatattgatatatgaggctgctttgatcatatggtgaagttgttagctggttgttttgtagtttccattgtgtgactgctttatagggtctgtgcactgtatacataagtgaaatatgtaatataactaattaaaatcaaatattgaaaatttaaattagagaaacttctgaattatagtttttgtatatttttagaatagatttattattttacatgtatacaattactaagataatcacaggcctctgtttaaattattgctttctcagaggttaaatagcaccacccaatctaaagttgttttcatgcattatgtcacatcatcctctttataatgttttctttacagcacttacaatatttgaaattttctacttattcatttactacccatttcccccggtagaatgtaagatccatgaatacaattactatatgtgttttgttaactttctatctagcacatgaaataatgcctagcacataataagttctcagtgaatattcagtgaaagaacaaaagtgtttagaagtattattttaataaatagataaaattttagtagtgtatcaagagtctttataatctttagagagccacagtgtttcttgtgtagtttaaaaattactctgtaatctcatttaattatgttttgcacgctttgtatattgtaagaggttaatttatatgaggtctgtcaaattgtcatataatctataagtttttaatgaatgtttattgtatccatattatatgaaataattacaatgggttggtgggggcccacgcgggttcaacatgcatatcgagaagtgttatttctgttcagggcccatctaccctggccacagcatgatgttcatccacaatgattgcaaggtgttcagattttgtaaatctaaatgttataaaaacgttaaaaagaagcataatcctcgcaaagttaggtgaaccaaagcattccataaagcagctggcaaagcacttatagtggataattcatttgaatttgaaaaacatagaaatgaacctatcaaatacagagagagctatggaataaaagtattgatgcaatgaagagagttgaagagatcaagcagaaatgccaagcgaaatttataatgaacagattgaagaaaaagagcgacagaaagttcaggatatcaaagaagtcaagcaaaacatccatcttatccgagcctcttttgcaggcaaagggaagcagttggaagagaaaatggtatagcagttaccagaggatgtggatatggaagatgcttcttaaaaatctctgtaaccatttcttttatgtatatttgaagatgccctttggagacttggaactgctaaattattagtttattttttacataggtcacttaaatgaaaagtgattaatatatctttcctacatttccatctacaaaacatcagatattacggatattagattgcatctcagtgctaaattttcactgatagatatacttaatgtaaatcatgaaaattctacttataactatagaagtgaattgtggatgtaaaatggttatgccatttggataatggcactaggcagcatttgtataataactagtgacaaaaattcatggctagtgataaaatattatttacagtaaaatattccctttattaatattatagaaggggggatacaacaagaaactaacaatttgtatgacagtgtcaaatattattttgattttagtacttcctgttttcgtttatttgcatcttagaagagcataatgacattgtttgatgaagcttaattatgctgcactgctttgacctggtttaacccttctgataggtagttgtggatgttggggatgagaactgaataatctttgcctggagtgacactacactctagaatttccactttggagaaatactcagttcttttttttttttttttttgagatggagtctctttctgtggcccaggctggagtgtagtggcgtgatcttggctcactgcaagctccgcctcctgggttcacgccattctcctgccttagcctccccagtagctgggactacaggcacccaccaccactcccagctaatttctttgtatttttagtagagactgggtttcaccgtgttagccaggatggtcttgatctcctgacctcgtgatccacccgtctcggccttccagagtactggggagaatactcagttttaacttgcgattcctggtagagcatactttatttttctagcctagcaatgatgtagaagcagaggaatcccagtgccttttaaaagttattatgtggttttcttttaaaaagctcctgtttttggaaagtagaatttatgggtacgccatctgttcattatttgcacataaaataaaaccttttgaaaggttaaaaaaaaaaaagaattacaatggaattttactagtgttcattaaaaatatgaccactaaataaaactgcaaataagagaaatggcatatttctaaataaaggcttctaattaatatactaattaccaatggttcatgtcagaatgttaaagctcttgaaagatttcctaatttgcttctttgtaaactactttctctttaagaattatgtaaggcataataatacaaactgattatattccactggccaacctatgtgaaagttctttaaaatgaggaatatattatggtcgatatctttaatgataattacctttccatggtgtaaaatctgaagaacaatcttgtctttatgacagcatttatatatgaaaatttaattctaagaaatatatggatttgcagagaagtgtcacatagtaaaaaaaaaaaaaaaaaaatctgggctctgggatgacattgttctaagtagcagactgttttctgttcataaccttgagcaagttaacttttctgaacctcaggtatagtgctgaaacagtatatgtaaaaatgcctaacacaatgcctattagaaatgctcagtagattctaattctcttttcttcccgagtaaagtggaagcaaagactcttctcaaaagtatggtggccacatttaccaaaatagtagaaaaaaagaatggtgaggtaaaaaggtacccatttaacctcactaaggatgactgtatttaccagtgttaaacaggggagtttctaatcaaaggcttttaggaatcaattttgaccatattttaaaacaatagctacatttattttccaaaattattttggtctttaagtcatagattatatggtaatataaatcagaatgtcttctatcttcaattttggctaaaggcaaatagtaatacctaatacttatttacatgcatactatatactgtcagccgtccacatctgtgggttcctccacatccatgggctccacatctgtgaattcaaacaactgcagttcaaaaatatttagagaaagacaataaaagtaataaaaaataccatattacaactattttttttttaatctttttttttttttctttttttattattattattatactttaagttttagggtacatgtgcacattgtgcaggttagttacatatgtatacatgtgccatgctggtgcactgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaataggcggtgtttggttttttgttcttgcgatggtttactgagaatgatggtttccaatttcatccatgtccctacaaaggacatgaactcatcattttttatggctgcatagtattccatggtgtatatgtgccacattttcttaatccagtctatcattgttggacattttatataatattcatattgtattaggtatcatgagtaatctagagatgatttcaagcagggttccccaaaccctgggccattgaacagtagtggtccatggctggttgggaaccaggtcacacagcaggacgtgagcggcagacgtgagcaaaacttcatctgtatttacaaccactcccattaccgcctgagctccaccttttgtcagatcagtggcagcattagattctcatagaagcacaaaccctattgtgaactgcacatgtgagggacctacattgtgtgcgccttatgagaatcgaatgcctgaagatctgccactgtctcccatcacccccagatgggactgtctagctgcagcaaaacaagctcagggttcccactgattttacattgtgatgacatgtataattattgcattatatattacaatgtaataagaatagaaataacgtgcacaataaatgtaatgcatttgaatcatcacaaaaccatgcccccaaccccccaatccttggaaaaattgtcttccatgaaaccagttcctggtgccaaaaagtttgggaaccactgatttaaagtatatgatgggaggatgttcgtgggtcacacacaaatactgtgtctttctatataagggacttgagcattagtgtatgttgttatctgcagggggagggaaggtgttctgaaaccagtccctcaaggatacccagggaggactgtaccaagtactgttctgtaaacttggcctagattaactcatatagttaatcctatatggtaggtttttttttttaatcattttacggatcaggaaactgatgcaagatgaattaagaaaacgtgcctaaacttacacaacaaatacgtgccaggtcagggctgagattctgatctaggtaaactgactctagattttatgcttttaattttcacacagtattctgagataaatccagagaagtggtacaaacttgaaacaggtctaaaaagttaagcacagaatggattgagacctttaaaaagctgaaggaaaaatatagagaataacttctgtagctatatatcatcaagaaaaatcagtaaatctattgtatagaaataatagcacaaatttaaaatataaagataatataattacttattgtacatgattagtattctaagtttaaaatataataaaaattaaagaattacttgactttttaaaaacttttttcttttgccctcctgtgaggacagtcattattattttaaaaaagaagataatcatatttaatagttaagcatgtatgcacttagttgctttaaatgatttaaaaatactatcaacctgaactactatatatccagataataaaaaaatgaaaaataacatgtgatgtcagaaccactgttaatcttttagaaatctgttgattatctttgagtaaaaagaacagaagggtgaaccttgattgaccacttcccattctttctgatgtgagagggtatctcaagtcaaaaaagaacaggtactgacaaggttgcacagaaaagggaacacttattcactgctgatgggagtgtaaattaatttgcccattgtgaaaagcagtgtggcaatatttgaaagaaaaaaacagaattaccatttgacccagcaattccattattggatacataaccaaaggaatataaattcttctgccataaacacacatgtatatgtaagttcattgcagtactattgacaataacaaagacatggaatcatttaaatgcccatcagtggtagactggataaaggaatgagagcatgtcttttgcagcagcctttggagccagaggctattatgttaagtgaactaatgcaggaacagaaaaccaaatgccgtatgttctcacttataagtggaaaacatggagtacacatggattcaaagacaggagcaacagacagtggggcctacttgagggtagagggtgggaggagggagtggaacgaaaaactacctattgggtactctgcgtattacctgggtgacaaaataatctgtacaccaaactcccatgacgcacaatttacctatatgacaaacctgcacatgtactactgaaacagaaaaaaaaaagaatgactgaatgtacactatgatggaaaagctgtataatttattatctacatatagtcatctatttagaatgaaatatatatctggataattaacttcagctgatatgtactagttcttcatttcaatctttcttattcaggaattgattaaatagagactccagttccacctgtggtggagtagcttctatgaaaactagctagaatacataaaacaattgtttgaaggaattggagaacaaccagtttaagcaggacttgagggataatggttcttgggagaacagaatagaagcactggaaatgaactccacatttaccctaactttttccctgagagcatttttcaattcctagtgtggaagactggaatccaagtggaaaatgacaatctttctgtcattagccaactttagccagctcttaagatgcatatgtatatgtacaagttgaaattccaggaaattcatcaataaacagaatttgagtgtctgaacaagttagcagagatttcaggaggtgcatgggactaagaagaaaggctgaattttaagccctgccaaggcagaagggccttggtaaacttagttggaaccctagaaggactacactttaggagtgaaggcaaaatactgaaaaaaagagaaaaactatagttttagatatttactagttactcattgcatttagatatattgaatgaaacactagactcacaaaaacagtaaatgaacagacagttcattagaaaatgccacattgaaatacacacagaaaaatgaaaggtaaaaccaaaggaacctaagatacgtatggcacatggtaaaaataactgacatttgtgcaatattcccaaaagaaggatggatagacagaatgatatagaaacaatatttgaaaaaatactgattgagaattttgtaaaattgaaagcatcaaagcaaaaatttaggaagcaagataaattttatatgcacatgtgtttgtatatgtatatatacacatacatacatatgtgcaaacacacacaaagccaggtatactgtagtcaagctgctgcaaaacaaagaaaaaatttcattaatcttgcctctgcttccagtctttttagaacagtgattttaccaactatagttttctttcctaagtccattatttccccccatttttaaaaaaacttagcgtccctgttgatggctttcaatatagttagcttctcaacttccttggtcctaatcctctcctcaaattccacctttgtctttataagtagagttacttcatataagcttttaatttttcaaactatgtgttgaaaaagaaaagtaatatgaaagaaaagatttatttaaaatatttcaagatgcctattacgcatttctactcattatattcactctctgtagtaagtatataagactaaagacttgaatctataattcccttagttagtcccctcagacttctaatgggaagaggctccctaggacttctaaggaaggacaatgggctgtccttcccctgaatttctttaatttttacattgctagtcactagccctgtatatctttccctggtactttttcagtttctaatccaggctgccaaggagtactagagagattatcatcctttctatttgttctattgcagactcgctttttgaacagaaaaaaaaaaaaaaaaagaaaagagggaaaatgaagagtgaaaatagtgaataattctgggattgagcctagagaagtagaaagtgttttatcagtaacttctgtcttcttagtaagacagagggcaaatttatctgatatgggtatgtgttataagcttagggggaaaatggaaatttggaattgctatcagaatacatagagtaattgctttcagaataaacggaatagttgctactcatgccagtagatgtgtgagccagctacaaagataatcagaagagttgtcaagtatcagtcatgtccaagccacagttaaatagcatacatttataataaattatatcactgattcccagcaacatacaacaatgtttgtatgtagtaagtgttcaaaggattattaaataattgcagttatcaatagtgtatctgagatgactaaacagactaaagaagagaatacttgcacatatcaggaaaagatctaatagtcataatgaatagtgttttacgaattgccaacaaaagttcaaaacaatataaataatagtacacaaatgaaaattattcataaatatatggatctatttgaagaatttggagataactcagaggaaaacctctaaaatatacaaagatttagaaaatcaaatttatgaggaagattaaagttaactgggaatttttaagttactaaagataaaactgagtaatgatctaaccaactagtatacagagttggtatatatggagaggagtatggccatctgtttggtatatacatgcaagacagagcaaaataacatcaatataaattgcaaaatgagggagttttaaaattatttatcctaatggaaaaaaagtatatggcatgagaaattagaatagattaccagatgattatagagaagataatctctcttttaagttattgaaaactaaaattgatttttaaaaattctatttcatacctgctttattctaaacactaggccaagttttggaacacagaaatgaatagctgacactattcctgacttttcaatattctgcaggaaaagagctatatgagcagtgactttgaaagcaggactttttatgatgataaaaggatcaatccattaggcatacatgacaattataaacatacatgtacccaaaaacagagtttcaaaatacattaagcaaaaactggcagaattaaagggacagacagacaattaaacaataatagttgggggctttagtaccccactttcaataatggatagaacaactttgcagaagaggaagacattatagtccagagttatacagtaaaaccatagaaataggtactcagtaaaggtagaatataggagtttatttctaagcattcatggggtgaaggatgcattaagggaatagaagatgaatgtttgaaacaactcaagataattgactagtcgtctagattttaaaagatacgtatactatatatataatatacatatatacttgtctgctaggatcattagagaagaacattttagacagtgtgtagaaaaatgtggatatgtgtaaaaatttgtatctttgggcagctatttgtgactttgaattgttgaaactttaataagtatactgaagtggaataagggacgattgtaatactgggacatgaggctgaagaggtatgattctgtctcaagacagtgaagcatatagataatgctagagtacctacaataattaccaatcatctatgaaatataccaaattttaattctaatctttcacttcttaaagtgtatgttagtcaggatcttatctgatatagttttaaaaagtatttttaaatatttgagcctatgtagagtttttaaaaattatgttaccttttttaacttttattttatgttcaagggtacatgttcagatttgttatacaggtaaactcatgtcataggggtttgttgtacagattattttgtcacccaggtattaagcctagtacccattaattatttttcttgatcctctccctcctcccgtcttccaccctccaatagaccccggtgtgtgttgttcccttctatgtgttcatgtgttctcatcatttagctcctgcttataaattagaacatgtggtatttggctttctgttcttgcattagttcacttaagataatggcctccagctccatccaagtccctgcaaaggacattatcttgttcttttttgtggctgcatagtatttcatggtgtatatgtatatgtacattttctttattcagtctaccattgatgggcatttaggttgattctgtgtctttgctattgtggatagtgttgtgatgaacatatacgttgcatgtgtctttatgatataacgatttatatttctttgggtatatacccagtagtgggattgctggatcaaatgagagttctgtttcagctctttgaggaattgccacggtgctttccgcaatgcttgaattaatttatactcccaccaacagtgtatacatgttcctttttctctgcaacctcaccagcatctgttatttttggactttttaataatagccattctaattggtgtgagatggtatctcattatggttttgatttgcatctctctaatgatcagtgatgttgagctttttctcatgattgttggctgtatgtatgtcttcttttgaaaagcatctatttatatcctttgcccactttttaatagagttgttcattttcttcttgtacatttgttgaagttccttatagatgctggctattagacctttgtcagatgcatagcttgcaaaaattttctcctattctgtaggttgcctgtttaatctgttgatagtttattttgctctgcagaagttttttagtttaattagatcccatttgtcaatttttgcttttgttgcaattccttttggcatctttgtcactaactctgctcattcctgcatccagaatggtattgcctaggttgtctggaccagagtttctatagttttggattttactataatggtacctttaatattaatgaaacctataaaccatgaaagttactgtagaaaattgtaacaagaatctatttcaacccttctattgtgcaatatgttatatacacatatcacagctttttacctttagtagtaactaaaatgtgcatgtttattgattctgcatttgccacactatgttccatgaaacactgatattccaaaaatattaataccgtagtagtccccccatccacagtttcactttctgtcgtttcagttatgtgcagtcaagtgccatccaaaaatattaatattgagagaaagttattataaaaataataacttatagtatattgttatcattgttttattttattattgttcttaatctattactgttaataattaagtaaagtttatcataggtgtgtgtgtgtaggaaaaaacagtatgtagagagtttagtacattttcagtttcaggcatccagtatagatcttggaacatatcccgtatagataagaaaggactgctggaaagattcaaatgggatgaataaaaggattctcaggcctctcagttctttcaccatctttcacccaatgatgtccttcatccttcctaagccactggctccaatggtcacaccctagctcctttcattactaataactatcactcctctataactttcatttcagttatcactctcttcagttgtcacttctttctatttaactccctctagtaattgaactgtgataaatctttgatcaccgtggacctccaattctttttgattggctccttacctctttcatttccctccttacctagcttacattatgtaatcaatcgaatactctattaaatatacctttaattttcatgtccttctcgtcatattgtcttttcttgggtgaatagtagccacccagagataacagataaccctgaattaacaagacattcttgaagaagttaacctgcgagaactcgctcgaccagttaccgcactggcacaagggcaggtaaattgcccagtagaatagaatatagccagaaagagatcaaggcatatgtggatgctggacttacggccaaggtggcattgcaaaattgcaatttttttttatcatatattaagttttagggtacatgtgcacattgtgcaggttagttacatatgtatacatgtgccatgctcgtgtgctgcacccactaactcgtcatctagcattaggtatatctcccaatgctatccctcccccctccccccaccccacaacagtccccagagtgtgatgttccccttcctgtgtccatgtgatctcattgttcaattcgcacctatgagtgagaatatgcggtgtttggttttttgattgggtgtcttcaaacagaaacacacataactcaagtttatatatctatctattgatgaaaatgttgtgaccacaggcttgcagcaatctaaacttttatttctcctaggagcagtggttcagtattagctctttcagagtgtgtggcaattttatagaaataactattacaactactgagaattgactatttgatattttgtaaactattgtaaacgttatcttttgaaaattccacttttgtgaaacaaaaaaataaacctttgtcctttaggaaaaaaaaaaaaaagacagataaccctgtgttgacccttgactcctcttttgtccaaattctcaatgtgtatgtaatccatcattaattcctgttaattctaacctctagaatatatcttgaaattatttactttctccatctccactgctaccattctgggagaagccacagttaaccataggtgggccacagtcccatctgattacttagatagcaggccctgcttttaatctttgacctcgtggtaggcagaattttggactcatgactttcacctgcttttgttactcctgtgaataagttaggttatatagcaaaagtgacattgcagatgaccttaaaatagggaggttatcccgcattatttggttgagcccaatataatcacatgagccttaaaagcagagagaagggcaaaagaggaagtcagagagattggaaacatcatttcttcttgtcagattatttcaaagatgtattcgaataatgaataatggccaaattcacaggtacacgtttagcactatttcttcctgaatagagtattccccatcctaatgaccaatttcatattcttctttaaaataatgaaatttatcacctcagccctgttatttctgatatatgtttttaaaaatcaaagaatttttagaagaatcagatatagtgtgaaaatgaaaataaatttttaaacaaaaagcaataacgtatactttcaaataaatttggtctttaaaaccgtccccttggtatgtgtacaattatacagataccgtttgccccaatgttgaagtttatcctagatatgatttaatatatgagcactttagaaaaattaatgccttgcccttgaaatcacaggacttttttttcccccttcttcctttacttccttcattgctgtttaatccagaccatttccttcctctaccatttggctcagtagcctaggttttctggtctccccagagaagactgccgctgtgcagactgagtggcatgtaaagagcagagctactcctactttgggaagtgcaatcgggcagacttgtcccatgaagtgtatgtcaggaaaaagatggcaggtaataagttcttttgcgtgcttttcacaggctgaaggctgataacatggggatagttgagtaccagaaatattagacacaagaaaataaatcactgccaataatagacttgctttctaacaaatcttaggaatttttgatttggggaaatctttttttttttttttttttgagacggagcctcgctctattgctcaggctgggtttcaatggcgcaatctcagctcactgcaacctctgtctcccgggttcaagctattcttctgcctcagcctcctgagtagctgggattacgggtgctcgccaccacgcccagctaatttttgtatttttagtagagacggggtttcaccatgttggtcaggctggtcttgaactcctgacctcgtgatcctcccatctcggcctcccaaagtgctgggattacaggcatgagccaccgcaccagatgatttggggaaatctttaataatatctttcctaggtcgtgactctcttttgctttagaacttacacatcactgatgtaagagttcttttttttgtttgttttaaagaagtggactctcactgtgttgcataggctggtctcaaactcctggcctcaagaaatcctctcaccttggattccagaagtgctgggattattggcgtgagccagtgaacctagccctgaagtcagttctaaatattgtcaaacatagagtattttactatcattgggccctagataatctttatattttgtcatcttgactgctgacataaggtaattgagcatcatatctagaaagttttttttttttttttttttttttttttgagatggagtctcgccctgtcgcccaggttggagtgcagtggctcaatctcggctcactgcaactccgcctcccgggttcatgccattctcctgcctcagcctcccgagtagctgggactgcaggcgcccaccaccacacccggctacttttttgtatttttagtagagatagggtttcaccatgttagccaggatggtctcgatctcctgacctcgtgatccgcccgcctcgggctcccaaagtgctgggattacaggcatgagccaccgcgcccggccatatctacaaggttttaatgtagatatcattcagactaatttctgtaatcttgtcattgttatttcctcaaagtgctgtaccacaaataagaaaataatttgaatgcaattagaaaaaaaaatttacttttatcccaaagcattagtaagacatggttagcaataatgcatatattttaccttacttattaaacttgtcgtgcttctcaacgcatttcttcctgaggttggacatttttataatataatttagcatttttaaacctatgtatattttttctctcaaaaagtcttgtattccacttatattgtttaatgacctgttcagtcagtgtgtgattctcagttgggaactttcaaagtaattgaacataatttttctctaacccaacttttatttctatctgattttatatatgatttccataattatattattgttcaaatagagcaaatcaaaggtccctcctttgtaccattaacatgtatccacttttcaactattttttctctgttaaaacattttaaaaatatagctacatttggaaatgatataaaagtatactttatttaaaatactgtaggaaaatttcaaacattgttgtcttgtgtaaaattgtaactccaggtctgctcagatactacacctttgctttaaaacatgccttttctctgaatgccactgaaattgtgagattaaaacctatacgttcttttttttttctttccaacttttattttagttcagggtgtacatttgcaggtttgttacatgggtaaattgcatgtcccgagggtttggtgtacagattattttgtcacccaagtaataagcatagtttttggatcatttggttgggtatctttttttttaatggaaaccagaatggtatttattattttacatttgggagaggagatatcctaaagggtccagaatacataagtctcttacgtatgatactcctttttttgttactgaggtatacttataagtgcagataagtaatcagaaggttccttggtaagcgctgaattagaacaaaggcagttaggtaatttggagtttaatagcctagagtacctgatagagatgtgctgggggccacaaccctgtatgtaattttaaagtttctaagtagccacattttaaaaagtaaaaacagatgaaattaactttaataatatatttaacccaatatatcaaaatgttattttaacatgtagtcaatatattaaaattattctgtttttcatactaagtattcaaaatctggtgtgtattttacacttttgtacatctcaactcattcatttcctagttccttcagttgcttaagaaaaattactgaatgtttctgtctcaattttcccatttttataatagagataattgcaaggattaaattagataatatatgatacacagttggcacatgatcttatataaagcttagttgctttctaaaaaatatttcaaacagttgaatatgacgtataatggcatcactgtctcaaggcaaagaacattttaaggattaaattatctgtaactcccgaattctcatctcttccccttggacagtgctgggcacacacgtctctctgactccctattcaaattacgtaaaaaaagaagcagaatcaatgttcgttcaccagttgtagcacatgtgtcacactaatgcaagatgttaataacaagggaaacaaggtcatggggaaggaagggcagaaatatgtgaatgctctaatttctgctctatttttctgtaaacctaaagctactataaaaagtaaaaagctatgatttctttcttaaaaaagtcaaacatgtttgctgtcagttcctgatgcatgttagctgtgacagaatacggcagtaaaagtgacagtttcagcattattaaaatcatcaataagaggagcttagttatgggtaaaaaatctaacaatattttctctgtcaatagtcattcattatctacctcttttaaactaatacatggaaaatatatgcacaaaatggttgtttttcctccatggttgttggggtgaatactgggagttattggtagcattctgatggtaatggcagaaatctttcatacattttaaacactattgctggttttgagaatattttcttctcctaatttcaggttgggtgggactatatcagcatacaagatagtaccagatgaaatagaagaaatcaaggtatagtatggcatttttcacctctacaaacatttagcatcttggtgaggggtggggaagagttgctttttctttatgccattgatatttggctatgttagaatattatttaattctcagttatcatagtgaattaaaaatttatatgtatcagataatcaccatcagatttatctgccatttgcaatgaatttctgactacaatattaggagaatcgaaaaggaaccctttcctgtgtagttcattaaaaatctacataagaaaacactgtgtataagcattggtgtgcatagtggattatctttttatcttgttgcaatttcttttccctataagccttcaccacttttaaatatcagtcttttttttaaattattattatactttaagttttagggtacatgtgcacaatgtgcaggttagttacatatgtatacatgtgacatgctggtgcattgcacccactaactcgtcatctagcttaggtatatctcccaatgctatcccgagctggttttttgaaaggatcaacaaaattgatagaccgctagcaagactaataaaaaaaaaaaaagagagaagaatcaaatagacgcaataaaaaatgataaaggggatatcaccaccgatcccgcagaaatacaaactaccatcagagaatactacaaacacctctacgcaaataaactagaaaatctagaagaaatggataaattcctcgacaaatacactctcccaagactaaaccaggaagaagttgaatctctgaatagaccaataacaggagctgaaattctggcaataatcagtagcctaccaaccaaaaagagtccaggaccagatggattcacagctgaattctacctgaggtacaaggaggaactggtaccattccttctgaaactatcccaatcaatagaaagagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccacgatcaagtgggcttcatccctgggatgcaaggctggttcaatttacgcaaatcaataaatgtaatccagcatataaacagagccaaagacaaaaaccacatgattatctcaatacatgaagaaaaggcctttgacaaaattcaacaacccttcatgctaaaaactctcaataaattaggtattgatgggacgtatctcaaaataataagagctatctatgacaaaccaacagccaatatcatactgaatggacaaaaactggaagcattccctttgaaaactggcacaagacagggatgccctctctcaccactcctattcaacatagtgttggaagttctggccagggcaatcaggcaggagaaggaaataaagggtattcatttaggaaaagaggaagtcacattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaggagaataaaatacctaggaatccaacttacaagggacatgaaggacctcttcaaggagaactacaaaccactgctcagtgaaatagtaacagtcttttagtacatatttttctgggttcctttgaaaacacgatatgccaattgcaattaaaaatttacattacagtaatgaaaaattgacttactctttaaaaattagagcattatgacattattctgtctctaacattttactaagtcttatggaatattaattttctaacataatatgttgttctttttcaaaagcaagattgaataattggatattaataatgaagaataaacaatactggttaaattgttaacaatgacatgtaaagatctcaacaaatcactaagcttgatttgattaaacttttcaatatcaagttcactaaattcaaatctttcaataaattcaaattcaattcaaaataattatttaattctatgactcaagactcaaggggcttttttttttttttttttttttttttttgagacagtctcgctctgtcacccaggctgcagtgcagtggcatgatctcagctcactgcagcctccaacctcctgggttcaagtgattttcctgcctcagcctcccgagtagcttggattataggcacatgacaccacacccagctaattttttttttaattttattttagtagagataaattttcttcaagttggccaggctggtcttgaacccctgacctcaggtgatccatctgcctcggcctcccaaagtgctgggattaaggcatgagccactgcgcccagcctcaagggacatttttgaaaagaaaaaaatcttgtaatttgtttgcattatttttaaatcaagtaagcccattgatctattatatgatacactattagcttcagtatgtcaagtgttctaatgtatggtcaacatcagaaattaatgtggtaattctagcttcaaaaaaaatttcaagaaatttattccaactttgtgtgaacttgtaaaatattttagctaggaggaactttaggtctaatccagatctctcatttttcatatgaggaaattgaataaatattttatttgacattcaataatgacttctaaaaatatcatcaaatgttgttaaagggttggaaaagcatgaggatattacttcttgaaatatattttataatgactcaaaaattgaactctagaaactttaagcaattaataaatatatataaataagcaacatttatgtaaagaatattgaattgaaattatgtattataaaggcaccctgtctgataatacaattaaaatgtgtgttaactgatgaagataaaccaagagttttatggaaatacatagaagggacacctggacattggaaaaagtaaatcagcaaagtctttccaagaggtaacccccaggaaattggagttttatacagaagcatagacatgaaataataggataccagattatagggtataaaataaagactggtaagataaagggctggaagcaggcctttatcccatgttaagaagtttggtttttatcctgaaaattatgggattcctttatgtgatttttaaggaagaaagtaacataatcattttgatacttttttaaagccttactgtggtgaatgagaaaagtgatttcagcagagaagaggttctacctagatggaaggagaccaggttgcaggaatgtaggcacaaaatgattagaacctgaactcaagcagtgacaatgaggctagagaagaaaacaagatttgaaaaatattatttcagaaagtaaaatcagcaatacttgataacttattggatgtttaggggaaattggaaagattgactcagatttctggcttgggaaattgagtagatggtgttgctgttaacttaaaaaggatgttttggagacagaatattattaataggaaagaggatgttttggacttactgagtttgaggtccctctcagattaccaaatatccaataagtcattgaataaatcagcctggaactcagaagagagacacaatctagtaattgatattaaggtttgtcctcatacaaaagagttaattgaggccatgctagtcagtgaatggaatctcacggaaaagttatatgaggtattaaaattgggctgaagatgtaaccttaaggaagacttaccctaaaggcagagtattaatatattatttaattagtttaattaatagcaggacttttgcctgtttttaaatagtgatttttttcctaaaggaatcagctttttttttttcattgtgtgtgctttttttattttagagttacaagagttatccctcaggagattccttttaaaaaaagcaggattcatggatgatatgtaacataatttttccgtcgattactggtattatatctaaaataacttgagagtttgaggcctgaggcattaaaaaaatgaggaattcatcttgctttcaaagtactcaaagaaaaactgttctaaaacatttcaccaatatttgatggcacattagcattttcagctgaaatcagttacaatcgtttttgttttagctgaaagaaatgtgaagcatacggatgtaatgttcatttcagttgggtaatatctgagtaatcttaaattgtctaaacagaacaattgagtttgaatttgatatgctacctatagtatataccatgtataaataaatatgcatatgtatttttgttattaaaataatatgactgattaaacataaatcacattttggcagatgtgggaatctttcacagttttctagcaccagaaattatcaagttcataaattttttcaattacacgtatatttattgattgtaataaatcacttcaaaactgaatggattcttagcccttagccacataaagagtgaataaattcctggcccaatcagaagtccctttttcaccctagatgtaaccactattctgacttctttctttttttttttttttgatacggagtctctgtcgcccgggcttgagtgcagtggcacgatctcagcacactgcaacctctacctccccggttcaagcaattctcctgcctcagcttcctgagtagctgggactacaggcatgcgccaccacacccagctaatttttgtatttttagtagagacagggttttgctatgtgggccaggctggtctcgaacctcctgacctgaagtgatccacctgcctcggcctcccaaagtgctgggattacagacgtgagccaccgcgcccagcctactattatgatttttatcattatcaattccttgcttttgttccgttttaccaactatatacacatccctaaacattacaattcatgtttgctctctttgaacttcatatgaattaaatcatattgtatgcagtttttttgtgtcttgcttttttatcaaccgtttttgtaggattcattcatgttattgactgtaactaaggtctttgtttaattgtaaaatacaccactgtaccacagatcactgagacatcctactgttgaatatttagcttgtttccatttgggacgattatgaaaagtgatgctataaacattattataagagcatcctggtactcatgtataagtttctctgaagtgtatactgaagagtggaattcctgggtattaagaaacatgtattttcaactttcctgactgaaatctcacttttctaaagtagttatgccagtttacactaccatcttgaatgcatttattttaaatagatatatttaaatattctttgtctgcaatgtatattactatagattttatttatatgtgaggtgactaaattgatacaatatttttaaaatgtgtctttgtttttccagcccatgggaaaaatcctgagggataattcttaatgaaaaagtccatttttgccccactggtttgaattttgcctcatgtatctcatactaaattttccaatttaggacatatgcatacttaagtctgtcttttcctgaacttctgttccattaatctatttattcttttctcagcactgtatggttttgattatagtgcttttttagcatagtaggaaaggtcctgtgttgtttttcttttttattttattggctcatgtattgattgctccagataacattataatatctctgtcatgtttcaaaagtattcctgctgaggagacttccagccaagatggagtagctttattccttccagatccttcctattactactaaaaatgcctaggcattataaaataaacatagaaagattctgggccaggtgcggtggctcatgcttgtaatcccagcactttgggaggccaaggcgggcggatcacgaggtcaggagattgagaccatcctggctaatacggtggaaccctgtctctactaaaaatacaaaaataataataataattagccatgcatggtggcatgcatctgtagtcccagctacctgagaggctgaggcaagagaagaatcgcttgaacccgggaggtggaggatgcagtgagctgagatggtgccactgcactccaccctggatgacagagcgagactccatctcaaaaacaaacaaacaaacaaaaaaaccaaaagaaagaaagaaagattctgaaagatggaaagaagaaggcagactacctggctacctgggaacctcaggaattgagaaatgacatggcagtgagttacttgggtttccttattatctcctgtatattctggacaggatactgaagaaagccttcaacctggaaccaccaacaggtggcgtaaacaaaaaatacccctacaaaagcctgtttgtctagccaacagacaaggacaagggtcacctaagaggcaagaatggcttttcagcaatatttgccctactacagctaagcaccaatggaaaaactgttcagttcccttatagtttcagttgagtcaagcaggcagctgatattccacatcaccccctgccatcccacagaagtaagtggcatagttctgaatccctcacctggtggtggcagcagggctgagtagggagctattcttccatctttcacctggcagagcagatgtcactctgatttcctggctatgatattaaagttgaaaccaagcagaagttgatctatcaccagcccagtggaaacaagctgtgctccagttttcccagcagggtagtgtcagtggagtccagtgatgagctgagcctccatccccattcagtatcagtgagacttaacaaggcagcacaaagtagagctagttaccactatttcacctttcctttcccacgtaagtgaggcctggcagagaggtgaacctctacccccagctgtatcaacaaggctaagccaggtgaggctattcgtacttctgctcacaatatgagtcaaccatctactctccccaacccttggtattagcatgcgcccctacttggtatcaacagtggagcaaggtaatgtcaactttcaccagaaaggtctcagcagagccaagaagggagctgaacttctaccttacagtcttaaattaagcagtgtgaatcagtgcttcacttttgccagagtggtgtcagtgagaccttgcagaagctgaacatacatgtccataaggcccttgtgttacattgcgacatgggggacatctgctaaaaaagattaaatagtctcaaatataaaataccaaatgtcctaggtgacaataaaaatatcagtcatcataccaagaacaaggaaaatcacagcatgagtgagaaaaaaacagtctacagacaccaacacaaagaagattcaggtgttgaaattatctgacaaagattttaaagcacctattataaaagtgcttcaataagcaactatgaattctctttaaaaatgaaaaaatggaaaatcttgccaaataaaaattataaaaggaaccaaatgaaaattatagaactgagaaataccatcaccaatatagaaaactcacagggggcaacagacggaagtggcacaacatttttcaagtgctggaaaaaagaactgtcaactacaaatgccatattcagtgaagttattcttcaagaatgaataaggacatactcaaacgcgaaaactaaaagaatgtgtcactagaaaaccactctgaaagagtggctaaataaattctttaaagggaaaggaagtaatagaaaaaggcctgaaatttcagaaaggagaaaacagcagaatgggtcaatacaatagattgtattttcttataatttttaaaatcacagttatactgtataatatggtattctatatatgtacatacttaacacaatcatatttaaaatgtggaagggtaaagttgcctaaatggaggtaagatttctgtatttcacttggaatgataaaatgtcaatactggtagagtgtggtaagttatatctgtatattgtaatactgagaacagccactaagaaaagtatacaaagcaatatactcaaaacgctatgaataaaggtagaattctaaaaagtgtttaagtgattcacaataagcaagcatataaaaacaggaaaaagaaacaggacaaaaacagaaaatagataataaaatggcagacttaaggcctatggtcttaatacttaccttaaatataaataatctaaatatgccaattaaaagacagattttgacagaatggatttttaaaaaatgatccaataaatgccattctaaagaaactaatttcaaaaatgatgacataagtaggtagtaagcaataggatacagaaggatggcgaaagatttatgtgtgaacacaaattttaaaaaaaaaagcaggagtgggctgggcacagtggcttacgcctgtaatcccagcctttggggaggtcgaagcgggtggatcacctgaggtcgggagttctagaccagcctggccaacatggtgaaacctgtctctactaaaagtacaggaatatccaggcatggtggcacatgcctgtagtccccacgactcaggaggctgaggcaggagaatctcttgaaccggggaggtggaggttgcagtgagccaagatcacaccactgcactccagcctgggtgacagagtgagactccatttcaaaaataaataaattaataaataaataaaatttaaaaagcattagtggctgtattaatatcagaccaagtagacttcagaacaagaaaaattctggagacagagaggacatcccataatgtgaaaggctcaatccaccaggaaaacagcaatcttaaaagtatgtgtaccaaaaattgaaatatacagaatgctccaccaaaaattaaacaacacacattttttttcaagcacacatgaaacatttaccttggaaaaccatatcctgaatcataaaacaaaccaaaacagtacttaaaaattgaaattatgcatagtatgtcctctgaccataatggaaccaaaccaaaaaaaaaccaaaaaacaaacaaaaaaaaaaaacagaaaaatatcaggaaaagctctaatacatgccagaggaaattaaaagatactctagtaaataatcaaataagatgtctcaaatgaaattttaaaaatttacacaaacgaaaaatgaaaatataacacatcaaaaaatctgtaaagcagtgaaagcagggctgagaggaaaaattatatgcaaagcagacattaagagaagaggaaagttctcaaatcagtaatctaagttttttcctccagaaactagaagaagagcaaaatatattcagagcaatcaaaagaaagaaaacaatgaattaagtattgaaataaataaaattgaaaacaggaaaacaatagtcagtaaaataaaatctgcttctttataaagctcaaagaaattggtaagcctcttgctacattgcaaagataaaggagaaagggcacaatcaccaatgtcatgaataaaacaaggagtattactacagatcttctattctttaaaaggataattaggtaatactattaaaaacttcatactcataaattgtacaatttagtagaaatggaccaattccttgaaaatcacgaacttctaaaactaaccaagatgaaatagacaatctacatggtataaaagccattaagtaacttaaattcataatgaaaaagttcctgaaaaagaaagcctcaggactttctttttggtttcactggagaattctaccaaatatttaaaaaagaattatcatcagttttagtcaatctcctccaaaaaaataaaagatgaggaaatacgtttcatgagtctagtataatgttgataccaaaaacagagaaagacagtgcaaagaaagaaaatggaaaaccagtatctcttacgaactaaaatcctcaataaagtattatcaattacatgcaacaatgtataaaaagaattaagtgccacgacaatttgacatttatttgaaatatacagaaaactacttcagtagtagaaaaacaataaatctaatctaccatgtcaacgagctaaagatgaaaaatcaaatgatcatatcgattgatgcaaaaatagcatctgacaaaattcaaaacccattcataataagaactctcagcaaactaggactagatgggaccttaacttgattaagagcatctagagaaaacctatagctaacagcatacttaatggtgaaagaatgttttccttcaaaaattggaaacaaagcaataatatcttctctgactacttttattcaacatagtactagaaatgctaggtagcacagtaacgcaagaatatgtgctaaaaccacatagattagaaagtaagaaataaaactctccctgtttgcagaccacttgattatctgcataggaaaaaatgactataagaataagtcattttagctgctttgtggcatataagataaacacaaaaagaaaaaaatcaattggatttctatatactataaacaaacatttggaaactgaaatttaaataacaccatttacaattgttcaaaagaaaataaaatatctagatacaaacttaaaagcacacatatgttatctttatgcaaaaactgccaaacaaagaaataaaaggacacttgaataaagacacattctgtgttcaaatattgaaaaattcagcatagtaatgatgtcagttctcccctaattgaaccataaatttaatgctataccctggcaagtgttttgtggctataaaattatataaattcattctaaaattatatggaaaaacacaaaacctagaacagctaagacaatttttaaaaagaacaaagtggaaagaataactctacccaatgaaagtttcattctgtatctacagtattcaagatagtatagtattggcagagaaataaaaacataaatcaatgaaacagaatagagaacctataataggcttatacaaatatattcaattggtttttaataaagatgcaaaagcagttcaatggagaatagacttcaacaaatggtgctggagcaattggaaatcaacaggcaaaaaaaaaaagaatctcagtctatgcctcatgctttattacaaaattatttcaaaatacatagtaggctttaatataaaaagtattatatatatatactgtaaaactgtcagaagaaaaaaaaaagcaaaagtctttacgacctggggctagatgaatgaagaggccttagactcaacacaaaaagcacggttcatacaatgtaaatttcacaaacttgagctcatcaacataaaaaaattttgttctgtgaaagaatgaaaacaaaaactgcaggccgggtgcagtggcacagtcctgtaatcccagcactttggaaggccgaggcaggcggattaccaacctggccaacatggtgaaaccttttctctactaaaaatacaaaaactacccagacatggtggcgggcacctgtaatcccagctactctggaggctgaggcgggagaatcgcttgaacccaggtggcggaagttgcagtgagccaaaatggcaccactgcactccagtctgggcaacagaacgagactccgtctcaaaaaagaggatcaaaacaagacaacagttaatctatgaatgacaaaatattgacaaatcatgtttttaactgtgattgccctaaaacacacaatgacatatgatgattttatgtaatatttataattattaatgataacatactgtaaatcatatcagaattgtaggagtttcccattatttggaacacataccagtaacatatttatacaaatgcagctaaaagaaagctaacatcatttcacatttgacattgcatcctgtatgatttgtataccaaataaacatttcatctttgcattgatgtgctattaatgttaaacccactccttttgtttgtttgtttgtttttgtttatgtttttttgagacggagttttgcccttttgcccaggctggagtgaaatggtacaacgtcagctcactgcaacctccaacccccaggttcaagtgactctcctacctcagcctcccaagtagctggaattacaggcgcccgccaccaggcctggctaattttttgtagttttagtagagatggggtttcaccatgttttagtaaagatggggtttcgccagtaggctgatctcaaactcctgacctcaggtgatccacccacctcagcctcccaaataaacccacttcttaataaaacctatccagttttaatcagtttgaccagaaggtaagatttttctaaacgttgtataaccctttacaatttttgttaaagagcagatcagtgttctgagacaaccctgttgtgcttttattccaatgttcaatttatggaaaaactgaataatacccctttaactatccagtatgttcacacacagaatctcttttacaattaatttttcacaaaccttccacaatttgttcaaaccttcatctttatcctaacttaaaacaatcctttaatatttaatctagccaaataattccacatttccatgccttcttataatcttttaccaaaagcacatcttactttccttacactttgcatgtaaaactgtttcttcagtagtctcaattatgtgttacaatgttaactcagcaatttttatttttaagccatttaattagagctctttcctatgtaaacatcatacacacaacacatacaaatacatacacagacataagatccagtagttaaaaggtttttcacttgccagtttcttaattcaattactggctttagggttgatcccttggaggaacagggccaggaaagcatgcagtttctatggcctaataaccaggctcagctggaaggcaaaaacaggtccccagaattaagggtctcatttttatactgaatcctggatccccaaaagagaaatgctatgtaagaaaacagtgtgatgattttactgtgcatttcattgcaaagcaatctgaagccaatcagcccatccccatgggaatcttctctcttagtgaggggtggggacatcatcataccttccaggtggccaggagcatgcttctgtaatccaaacgtgcagagagctgagtatctttccataactgacattagctatccccaaaagtatatttcctacccagttgttacacaccagagttctctcataatgtgaagtaatttctgatatcccaaaaaataaaaaacataagataacgtaattcaagacaaaacagaaccttagattttgagagggatctgtctactttcaattcctggggtttcatgaggaaaacagaagtttttcccaaaatggggtctgtggtgccttctctgtttttccctaggctgttaaagcttgaatatttacttttaattaagcttttaaccatagcactcttttaaaaaagtttttttaaaaatctcttattacccagctttagtcacgccaaactgccaatatttctggcttttgaactttactaaatgtaacctcccaggggctcagtgaaaggaaagtttaagacagttcatggaggagaggtgaatcaacaaatggcaaaggttacccaaagatcagccaggaagtactcattacctaggctgaaaattgaacctgaatccagggccactattgggaaaagacaaagctttaactgctaagctacagcactgggcaatttctattgcccttcccagaaaaagcctagagcagtaaattttgagtttgaaatggcttttaaatgctcaagataatttttagagctaagtaggacatgaatcccaaaattcctatttcctggaaggtagagaccaagagaaggtactgccacatgattacaaggtcaagctcccaaggacatttttcagcatgtggtctctgggcaagatggttgccctgtgtaacagaaaagataggaaagggaaaggggagaaagagtttgcactgcctgtggcagggcggggagggtcagggaactcaggagctcagggaagccagagaaagtcccacccattgcagtgacactgaatgaaaagttcaggcagccacttgtcagtaatgaagggtttcttttccacaagacccatcagctctgaagtttccccctttggggagaaaaaagctctccatgtcccataattttgtacatgcctaattctgtcaccaacagccatcagcaaagattgcaaggcagattaatccaaagagaatagtaattaaaattctttaatgccaaatacatttttaaccaaatggactttaccaagaggggcctctaaccccctcaatcttaggaagaactctaaccttcctatgttgggccttgaacccaagttcattcaagcatccttgccttttatcaagaggggcttttaacccactctgtcttaagagagactctaactttcccaagttgggactcaaacccaatcccatcctttacctgggtaccccaccacttactgaaagtcggccaatcagtgctgcagtctatttcctttgggttgggggtttcctcagtattgtccctttgggggttatcagggagatgctgcctgaacagggtcctgatccagccccaagagagggttcttgaacctcacagaagaaagaattagagacaaatccataaaaagagagcaagtttattagataaataaataaataaaatggctacccaatgggcagagcagcagcatgagctgctggttggccacttttatggttatttcttgattatatgctaagtaaggggtacattattcatgagttttccaagaaaaggggaggcaattcctggaactgagagttcctcatttttttagaccatatagggtaatttctgacattgccatggcatttgtaaactgtcatggcattggtgggagtgtcttttagcatgctaatgcattacaattagtttataacaagtagtaaagccaactagaggtcactgtcattgccatcttggttttagtggattttggctggcttctttaccacagcctgttttatcagcaaggtcttcatgacctgtatcttgtgctgaccccctagctcatcctgtgagtaagtgtattagtccattctcatgctcctaataaagacataggagagactgggtaatgtgaaaaggaaagaggtttaattgactcacagttccacgtggctggggaggccttacaatcatggcggaaggagaaggaaaagtcacatcttacatggtgacaggcaagagagcttgtgcaggggaactcccatttataaaaccatcatgtctcatgagatttattcactaccatgagaacagtatgggggaaattacccccatgattcaattatctccacctggcgctgcccatgacacatgggaattattataattcaaggtgagatttgagtagggacatagctagactctatcagtaagaatgtcgtaactcctgggaatgcagccctgtacgtctcagccttgttttacctagcccttatttaagatggagtcactcaggttcaaacacctctgacaggaggatcacttgagaccaggagttcaagaccagcctgggcaacaaaatgagaccccatctctacaaaaaataaataaaataatacaaattagctaggcatgttagtgcacaactgtagttctagctactcaagaggctgaggtgggaggatcacttaagcccagaaagcagaaactgcagtgagctgtgatcacaccactgcacagaaaaagaaaaaaaaaaaaactgtcagtcaaccaaggaatactatttttaaaaaatgaagatgaaataaagacatgtccaaataaaaaagtttgttgtcagcagactcaccatgcaaaaaataaaattacagaaaatttttaaaagcagttgaccagagatagtgagtcaaatgcatacacacaaaaacaaggagcactagtaaagtgcaaagaccagctcagtcagggagaccctaacccagtggtgctagaggaattaaagacacacagaaatatagagatgtgaagtgggaaatcaagggtctcacagccttcagagctgagagcctgaacagagatttacctatgtatttattaacagcaagccagtcattagcattgtttctatagatattcgatgaactaaaagtatcccttatgggaaacgaagggatgggccaaaataaaggggtgggtctggctagttatctgcagcaggaacatgcccttaaggcacagatcgctcatgctattgtttgtggtttaagaatgcctttaagcggttttccgccctgggcgggccaggtgttccttgccctcattcccgtaaacccacaaccttccggcgtgggccttacagccatcatgagcatgtcacagtgctgcagagattttgtttatggccagttttggggccagtttatggccagattttggggggcctgttcccaacagtaaagctaattgtacaattatagaagacagtataagtgcatatttcttgtcctttttctcctaattaatttaaaaaacaatacatgtataattggttgaacctacaacatatagacatgtaatatatttgacagggaaagcacaaagaagatgggtggaagcaaagctgaattgcagtaagtacataacaccagatggtatgtcaaatccacaggaacaaaataataaaaccagaaatgggaaataagatggttaatataataagccatataaatatattcttgtcctttcggtttctttaatagacataaattatataaggtaataattatagcaatcttttgttgggttttgagtgtgtgcatatgtctgtatacatatatgtgcatatacatatatatatctgtgtgtgattgtgtatacttatgcataagtatacacatgcatatgtagtatgtgtagtaatggcacaaaaagagagaagagagaatagaactatttaggagtaacatttctatatttcatggaattaagttctgataagatattcatcgtaaaaccctagagcaacgattaagaatatagctccaaaaatatggttaaaaaagggaattaaaatattacactagaaaatattcacttcatgtaaaagaaaacattaaaagggaataaaggaactaataagagacatatagaaaacatagagaaaaatggcaaatgtaaatccagatatatcattaatatcattaaatgtgaatggatttaacaattcaatcataaggcatacattgtcagactgaatgacaagtatttttaaaaacccatctgtgtgctttctgcagtagacatattgtgtattcagagatacatatggattgaaattaaaaggatagaaaaaatatatattatgctgatatagtctggatctgtgtccacacccaactctcatgttcagtgttggaggtggggcctggtgggaggtgactggatcatgagggcagcttctcatgaatggtttagtaccatccccttggtgctgttcttgtgatatttagtgagttcttgagagatctggtcgtctgaaagtgtgtagccccttcccacttgctctctcatgctgctgctctggccatgtaagacgtgtcttctgccataatgtaagtttcctgaggcctccccagatgcccagcagatgccatcatcatgtttcctgtacagcctgcagaactgtgagccagttaaacctgttttctctataaatgacccagtctcaggtatttctttatagcaatatgagaatggacaaatacacatggaaacaacaaaccaaagaaaaataaaatatataattaaaattctttatcagtttgcatacttctataaaaaggtgcttccctttaactattatttagttatgaattgatacagttaatgtagaaaaaacagaagtgcttaatactttttctttgtttgatttgagttcattaacatttctgaaacttcctttatggcccagtagattgtctactttggtaattattaacatttgatcttgaagaggtctataacatttggcaatggttggtttactgttgcatatatgtacattaggacaaatttatttcttgtggttttcagacattttacatttttattaattttatcaatttttcagttagagaggtatacaaaaatatctaaccactttttatgtggatttgtctattttttctttgaattcagttaacttctacttcatgttttttgccaggtacagtagcacatgctataatcccagcttctctggaggctgaggcaggaggatcacttgagccaatagtttgagtccagcctgggcatcatagtgaaacaccctgtctcaaaaaaataaataaataaaataaatagatagacagatagagaggcacactatcttactgggtattgacaatatttttatatctgcatatttgaattgacacttttaacattctgaaatgtttttcatctctaatagcatttcttgccttataagctacttttttggtatgctaatgctacaaccagtctattttgcttggtgctttcatgataatctattttcatcattctcatttcacccttgtcattaaattttaaatgtaaatgactcttgtaaacatttttttacttctttcctgaaacttgttttgcactcactgtatttagacagttttcatttattataattattaataactcaatgtttgttttctatttagcccactggtttcctttttctcttacttccttaccttattttagattaatacagtagcttttattattcagttttcttcttcagttaacttgttatatattcttcgaatgtgttttaggggtttgggtttttttaaggactacccaagggtatatttcaacatccatccattatagtttctactaataataatcacttttaccatttctaatatgaataattgcttttttaattttaatttctaatttttgtgtgtacataataaatgtatatatttatagggcacatgagatgtttgctacacgcatgcaatgcataatagtcacatcatggaaatggggtatcaatcccctcaagcattaatccttgctgttataaacaatccaattatactcttttagttatttttaaatagataattaagttaatttctgtagtcactctgttttgctatcacatactaggacttattcattcattctgttttttgtacctactaaccatccctacctccaccttaccctctccccctctacccttcctagcctctggtaaccatctttttaccctctaactccatgggttcaatcgttttaatttttagatcccactagtaagtgagagcaatgtttttctttctgtgcctcgcttatttcacttaacataatgacatccagttccactgatgttgttgcaaatgactgaatctcattcttttttatggctgaattatactccactgtatataagaaccacattatctattaatctattgatggacacaggttgcttccaaatcttagctattgtgaacacagctgcaacaaacatgggagtgcaaatatctattcaatatattgtttccttttttttttcagtatatacccaccagtatgctaatgctacaactaatgctgcagtaggatttctggaacatatgccagcttaattttttgtttttaaagaaacctccaaactattcttcatagagtttgtaataatttacattcccaccagtagtgtacaagggttcccttttcttcacattctcaccagcatttcttattgcctgtccttttgataaaagccattttacttggggtgagatcatattatagttttgattttcatttctctgatggttaattatgttgagcaccttttcatatgcctatttgccatttatatcaaatattttgcctatttttaaattgaatagatttttttcctgtacagttgttgagctccttatatattctggtcattaatcccttgtccgatgggtagcttgcaaatattttctccattctgtgggttgtctcttcactctattgattgacctttgctgtgcaaaagacatttaatgtgatatactcctatttgtccatttttgctttggttacctatgcttgtggagtgttactcaagaaatctttgcccagatcaatgtcctggagagtttcccctatgttttcttgtagtttcatagtttgaggtcttacatttaattatttaatgcatttttatttgatttttgtatatggtgagacataggtatctagttcctttttttttttttttttttttgcataatggatattcagttttcccagcaccattcattgaagaaagagtttttttccagtgtgtgttcttggcatctttgttgaaaataagttcactgtaggtatgtggatttgtttctgggttctctattctgttccattaacctaggtgtctgtttttatgtcagtatcatgatgtttgggttattatagctttgtaatataatttggagtcaggtaatatgatttcttccagttttgttctttttccttaggatagctgtggctattctgggttttctgtggttccatataaattttaggatagttttttccatttctgtatagagtaacattagtattttgatagggattgtattaaatctgtagattgctttgggtactatgaacattttaacaatagttactcttctaatccatgaacatggaatatgtttatattttttatctctttattttattagtgtatcatagttttcattaatctttcattaagatcttttgctctttggttaaattaattcctaagtatttacttttgtgtgtggctattgtaaatggggttatttttatttatttttcagattgttcactgttggcagataaaaatgctactgatttttgtatgttgattttgtatcctgtaacttcactgaatttatcagttctaatagttttcttgtgtagtctttaggtttttccacatataatgtcatatcatctgcaaacaaggaaaattttacttcttccctttcagtttggattttctttatatatttctcttgtctgactggtctatctagaacagccattactatgttgagtaacactgatgacaatgggcatactggtcttctaccagatcttagaggaagggctttcagtttttccccattcattatgatactagctgtgggtctgtcatgcatggtttttattatgctcagttatattcagtctatcctcagttttttgatggcttttatcacaaagggatgttgaattttatcaaatgctttgttagcatcaattgaaatgatcatatggttttccccatcattctgttgatatgatgtattacattgactgatttgcatatgttgaacaatccttgaatcccaggaataaatcccacttggtcatggtgaatgatctttctgatgtattgctgaattcattttactaatatttcattgaggagttttgcatcaatattcatgagagatattggcctatagttttcttttttatgtgtgtttggtcttagtatcagggtaatattagcctcacacaatgaatttagaagtattccctcgtctatttttcagaatagtgtgaatagaattggtattaattcttcttaaaatgtttggtagaaagcagggaagccatcgggtcttggacttctttactgggagatattttattacagctttgatctcattacttgttattgctctattcaggttttagatttcttcatgtttcaaccatgttaggttatacatatctaggaatttgtccatttctactagattttgcaatttattgggatacagttgctaatagtagccactaatgatcctttgaatttctgcagtatcaattgtaatgtcaccttttttatttttgattgtatttatttggatcttccctctctctttttttctagttaatgtggctaatggtttgtcaatattgtttaatttttcaaaaaaaacttaaatgtttgtttcattgatctttgatttttttttcttcattccaatttgatttctttctcctctgatctttatttcttttctgctactactcttgggtttggtttgcccttgcttgtctagttctttaagatgcattattagattgcttatttgaagtttcctccttttttaatgtaggcccttacagctataaacttccctcttagtactgcttttgctgtatcccataggttttgatatgtattgtttctgttatcatttgtttcaataaatttttcagttttcttcttaatttcttaattgacccagtggtcattcaggagcatattgtttaatttctatatatttgtatagtttccaaaattcctcttgttattgatttctagttttatttcattgtggtcagagaagatgcttgatattattttagtttttaaaaaatgttttaagacatattttgtgacctaacatatggtctattctagagaatgttccatgtgctaaggagaggaatgtgtactctgcagccattgtgtgaaatgatgtgtaaatatctattagatctatttggtctatactgcagaccaaatctgatgtttctttgattttcttcctggaagatctttccaatgcttaaagtaggtgttgaagtctccagctactattgtgttggggcctctctctctttagctgtagtaatatttgcattatttatctgagtgctcaagtactgggggcatacatatttaaaatttttatatcctcttcctgaattgacttgtttatcattatatagtgaccttctttgtctcttctaatagtttggccttgaaatctattttgtctgatataagtgtatcaattcctgctctttttatgtttttattggcatggaatatctttttccattcctttattttcagtctatggtgtctttgtaggtgaagtgttcttctcgtaggcaacagatcaataggtcttgtttttccatccattctgccagtctttgttttttaatggaagcatttagtgtaattacattcagtgttattattgataagtaaggattttctcctgccattttattatttgttctctggttgttttgtggtcttttcatcctgtctttctttagtgaagatgattttctctggtgatatgacttagtttcttgctttttatttttttctctccattgtatgttttttggtttgatattaccatgaagcttgcaaatactatcttataacatattattttaacctgataacaacttaacactttttgcataaacaaacaagcaagcaagccacaaactaataaaagtctacactttaacgttatccctccactgtttaactttttgttttttctatttatatcttaatgtacggactatgtcttcaaaagtttttataattattatttttaattggtttattagtctttctacttaagataagaatagtctgcaaaccccagttacagtgttgtaatattctgtatttttctgtgtacttactattaccagtgagttttgtaccttcaggtgattacttactgctttttttctgatcgaagtacttcgtttagcgtgtcttgtaagacagatctggtgttgataaaaatccctcagcttttgttgggaaagtctttatttcttgttcatgtttgaaaaatattctattctagggtaaaagatttcttctttcagcactataaatatgtcatgcccctctttcttggtctataaggtttccactgaaaaatctgctgccaaaagtattggagctatattgtatgttatttgtagttttttttttatttttctcatgctgcttttaagatcctttctttatccttgaccattgggagtttgaatactaaataccatgaggtattaaataatcttagggttcaatctgcttgatgttctataccactcttctacaatggctattgatatctttctctaggtttgggaagttctctgttattatccttttgaataatctttctacccctatttctttctgtatctcctctttttaggcctgtaactcttggatttgcccttttgagactattctcttgatcgtgtaggcatgtttcttattcttttttcttttgtctcctctgtgtagtttcaaatggcctgtattcaagctcactaattctttcttctgcttaatcagttctgctgttaaaggactttgatgcactctttagtatgccaattatatttttaagctttagaatttcttgttgcttcttttttagttacttaattctctttgttaaatttatctgatagaagtctgaatttcttctctgtcttgtcttgaatttattcttgagtttattcaacacagctattttgtattctttgtctcagtggccacatatctctgtttttccaggtttggaccctggtgccttatttagttcatgtggtgaggtcatgttttcctgggttgtcttgatacttgcagatgttcatctgtgtctgggcattaaagtgttatgtatttcctgtagtctttgcagtctgtgctcatttgtactcatccttcttgggaaggctttccaaatattatgaaaggacctgagtgttataagctttagcgggcatcccaagcccagtaacgctgagattcttgcagacttgtaaaggtaccaccttgataatcttatacaagatcctaaagaattctctggattatcaagcaggctattgttgtcctcccttcctttctcccaaaaaaaatgagtcttctctcattctctctctctctccccgctgcccctctccccactctctctctctctccctctctctctctctcctcccctccccccgctctctcccccctctctctccttgagctacctggagctgatggtggtgtagcacaagcacccttgtggccaccatctctaggactgcactggatcaggcctgaagccagcacaatattgggtcttgctcaagtcctgctgtaaccactttctggctaccatctatgcccgctcccgctcccgctccctctccctctccctctccctccttgagctacctggagctggtggtggtgtagcacaagcacccttgtggccaccatctctaggactgcactggatcaggcctgaaaccagcacaacactgggtcttgctcaagtcctgctagaaccactttctggctaccatctgtgttcactcaaagtcctgcagctctacaatcagcaggttacaaagccaacagggcctattttcttcccgtcagggcagcaagttcccccaggccctaggtgagtccataggtgccatccaggagccagggactgaagtaaagtccttagatgtccacctagtgttctcttgtagtatggctgagcttgccctcaaaccgcatgacatagtcctttgcacttttcccttcacattccaaaagcagaggagcctaaccccatggcaaccaccatctcaggcttatggcgagtactgccattctacctcagatatttccttaaggcccaaaggctcttctatcagtctgtggtgaatgctgcctggtcttgaactcacccttcaggggagtggtataccctctggcccagggcatgtcccagaatgtcatccaagaggcagttcctggaaatcccaagagcctacttgatgctcaaccccctgtggccaagttggtacccgagttgcaagacaaagtccctttcacttttccttctgcttttctcaagcagaaggagttttgccccatagccaccacaggtgggaatgtgcagaatctcacctgatgccagcaagtctcaccatctcacccaagcccttgatacctgggtatcactgctcattattcagtgcccaagggctctttagtttgcagttgatgaatcctgccaggactggatccttccctacaaggctgtgggttcccttctggtccagggtgtatctagaagtgtccaggagctagggcctagaacgaggacctcatgactctgaccagtgccctatcctgctctggctgagctggtatcccagctccaagacaaagtcgtcctcacactttgtctcctctcctcaagtggatggaagtgtctcttttggagccacaagctgtgcatcctggggttaggggaggggtgatgtcagtactcccttagatggtgtctcagtaggtcgcttccctctccacccccagtccactgtcagtggaccctgttcagccctaggactcacctaattattgcagtccttgtggcctcaactgcctttgaagtttatttgctgccccagagcactttagtgccagatggtgaagctttcaggaactcaagttctgattgctaggatcagcagttcccctatggctagggatggtcagctgagttttatccagtttcgctttctgctataacaagggcaacaccgagttcagtgcctcaaaattgcctgctgtccttctccccagggcacagaaatgctgtctgcaccacacctccactgccacgggataggacaggggtcctgttgactattcaaaactttttctatgtcttcaatgcctcttttagcaatatgaagttaaaaccaggtactatgagtgctcacctgagtttgagttttacgaaggtactttttttgtgtagatagttgttaaattggtgtacttgcagggggtggcggaggcaacaattggtggagctttttgttccaccatctcactccacccctctcttcagtaattgcctttttattcgtatctttcttgaatttgaggaaattcttagacattatttttggttattacttcttcctattctatcttctctttctggaatccaattatactatatttttgagtgtgtcccacatgttttgtggctttttatatttttcctctttcttttttcttgttgtttactttctctgcatcagtttgtggaggtttttttattgttgttgatctgtctttgagtttagtattcctatgttttgtagtgtttctcccttttacctgtgtttgcattatttacccctgatgaactttgtaatttcccttctattatgtccattaaacttttttagattccaatgctgtggtgatattctgtaccatttcatccattttgttaattttttttctattttcttgaacatattaatcatagtttacttgaaagttcttggctgtaaactttcaatgcatctcttttgggggttttttttgttctgttttttcctctcaattttgggttctactttctggcaaatcaagtaatttttaataattttatgttatatgtaaaagactcatattggccataggtgacttaatcatagaacattcctccttcttctgtaggcagaaagtgtgagaaatcaattactacaatcccatcaggaattgagctggattacagctgggctacgaacatggtgggttttccattccctcagtcatgaaagacactaggaggtttagctctaatattcataggctgcagcccagctctcttgtctccagcctaaccaatatagcctcaaaaactagcaaatactttgacaggaaataggcattgtactttggtcagacttacttccctagcaagtctttgtttttcaattattatgaacaatgcaaaagatttcattttgcctttcataagctttttgtctagctttgcatgcttctgtataccaccagaatctacaattgctccaaggagaaaaacatccatgagcttgggtttattcaaatttttaagtttaaatgttttaagaggtttctggctaattcttccttagcagaggttgtctgcctagtaaaattaacagtcagcctatgtccaaaatcaacaaatacacacagtgggggtggcttggtaggaaaagctggacattatccgttttactctggaaagtttcctcctctttggaattttatttcacttaatcattattatttctgcaattatctgatatctttaaaagcagcatttttataattatgtgatgttttccacttgttacagtaaaagtattaccctgctgtgacattttgcatcctacccagaaacagaactcctgtattatattttttaactgattattgctaggattaaataaaaaagatacttctgtttaaatctctttgattctggtttgtgtaatgctctgtgtgtcaggcactgttgtaattgctttaaaattactaactcattttaattctctgtattagtctgtttcacgctgctgataaagacatacctcagactgggcaatttacaaaagaaataagtttgttggacttacagttccccatggctggggaggcctcacaatcatggtggacagcaaggaggagcaagtcacatcttacatggatggcggcaggcaaagagggagcttatgcagggaaactcccctttctaaaaccatcagatctcatgagacttactcactattgctagaatagcaagggaaaaacctgcccccatgattcagttacttcccaccaggtccctcccacaacatgggggaattcaagatgaaatttgggtggggatacaatcaaaccatatcatttcacccctggcccctcccaaatctcataccctcacatttcatacccaatcatgccttctcaacagtcccctgaagtcttaacatatttcagcattagctcagaaatccacagtccaaagtctcatccaagacaagtcaagtcccttctgcctatgagcctgtaaaatcagaagcaacttagttacttcctaggtacaatgtgggtacaggtattgggtaaatatacacattccaaatggggaaaattggccaaaagaaagggactacaggctccatgcaagtctgaaatccagcaaggcagtcaaatctttaagctgcagaatgaactcctttgactctatgtctcacaaccaggccacactgatgcaagaggtgggttcccatggtcttgggcagctccactcctgtggctttgcagggtacagcctccctcccagctgctttcacgggctggcattgagtgtctgtggctttttcaggcacacggtaccagatttcattggatctatcattctggggtctggaggatggtggccctcttctcacagctctgctaggcactgccccagtagggaccctgtggaggctccaaccccacatttctcttctgcactgccctagcagaggttctgcatgaggtccccacccctacggcaaacttctgcctgggcatccaggcgttttcatatgtctgaaatctagatggcggttcccaaacctcaattcttgatttctgttcactcgcaagctcaataccacatggaagctgccaaagcttgaggcttgcaccctctgaagccacagcttgagctctacgttgtcccctttcagccactgctggagcggctaagatgcagggcaccaagtccctagactgcacatagcacaaggaccctggtcccggcccataaaaccactttttcctcttagtcctccagacctgtgatgggaggggctgctgcaaaggtctctgacagtccttggagacattttccccattttcttggggattaacattcggctccttgttactcatgcagatttctgcagccagcttgaatttctcctcagaaattcttttctatttcttttctattgcattttcttttctattgcattgtcaggctgcaaattttccaaacttttacactctgcttcccttataaaactgaatgcctttaacagcacccaagtcacccattgaatgctttgttgcttagaaatttcttccaccagctatcctaaatcatctctctcaagttcaaagttattgaactctctagggcagagtcaaaatgctgccagtctctttgcaaaaacataacaagagtcacctttgctccagttcccaagaagttcctcatctccatctgagactgcctcatcctggactttattgtccatattgctatcagcattttgggcaaagccattccacaagtctttaggaagttccaaactttcccacatttttctgtcttctttttagccctccaaattgttccaacccctacctgttacccagttccaaagttcctttcacatttttgggtatctacagcagtgccccactctactggtaccaatttactgaattagtctgttttcacactattgataaagacatacccgagactcggcaatttacaaaaacattaaaaaaagagagacgtttattggacttacagtttcacatggctgggaggcctcacaatcatggtggaaggcaaggaagagcaagtcacatcttacgtagatggcagcaggcaaagagagagtttgtgcagggaagattccctttttacatcagatctcgtgagacttattcactatcacaagaacagcacaggaaaatcctgcccccatgattcaattacctcccaccaggtccctcccacaacatgggggaattcaagatgagatttgggtggggacacagccaaaccatatcatcctcataacaaacatatgcagtaggtataattattgtctctatttcataagtgagaaaaatgagacacagttaaatgacttgctaaaggtcacacagcaagcagttgtatagcagattcaaacctacagtctgggttcttctataatagtgagagttaatagtagaataaatacaaagcatcattcagtagatcattctgcgtgaatgctataaactcactaagaatcatttacatcaatatgtgttactttccagtactccttttctcttaataagaatgttgtttctgaacttcccagttactataccttcccttctcccaaaggtaatcactatcctgatttctagcaaatgaattatctttacttcttttgagctttatatcaacagaagcattttggtgtcttatgttttattaaatatacaagaattgagttatccattcttttgtggaaggacatttcagttgttttcagtttcagggtattatcaataatcgtgcaatgagtagtcttgtacatgtcttttagtgcacatatgtatgcattcttagatttccacctaatggacaggatagacatgacttagaactaccaagttgtggagtatgcaagtgaattctgcatgctagaatctgcctttctcaaatagatgtaccaatttatattctcttcaacattttatgagaactctattttgcttcacattcttactgacagtattgtcaatctttttccattttagtcattttggaatgtaaatagtgacagcaaaatatgtttttaagttttttcattgattacaggtgttattaaacatcttttcatgtctttattagccattgggatctcttcttttgtgaagtgcctgtttaagtcttttctactttttaagaattagattacttgtctttttcttatttattggtaggtatttcttataaattttagatatgaatcctttgatacatgtatcatccatttattctcctcctcggttgtttgccttcttactctcttaaaagtatctttgctgaacagaaattcctaattttaatgtattggcttgtcaatctttcagttatagtaaatatttgttaagtgaatgatcttgaaggagttcagtgtcagctacaagagataatcattgtaaaacataaattctgtatcaaatttatgtataaaatattttagaccaggcgcggtggctcacgcctgtaatcccaacactttgggaggccgaggcgaggattacgaggtcaggagttttagaccagcctgaccaacatggtgaaaccccatctctaataaaaatacaaaaattagccgtgcgtggtggcctgtgcctgtaattgcagcttctcaggaggctgaggcaggaaaattgcttgaaactgggaggcagaggttgcagtgagccaagatcgcaccactgcactccagtctgggcaacatagtgagacttcatctcaaaaaatatgtatatattttagatatgtataaaatattttggaacacagaggaaacagtgaccaattccaaccagagtgtcaaggaattcttcatggagaacatgatgggaaggacttctaaagcaaaagaaatatgaacaaatgtactaaatgtaaataagcattgtggttttcagaagttcaagtgtggctaaagtcaagggattattaattctatttgcaggaaataagaaggtaagttaggttggagtcacattttaaaggagctgtatgttttggtcgggggcatagtttctaaagattttgaagcaaaggaaagacattttcagatttgtttcaggggatatactgttcttatcaaaatggattgataagagacagagacagaccacttagtgtgctttatagcaatctaggtgaatgatgataaaaataaggcttatgcctgtggcaacaggaatggaaagtactgggggtatatcacagtggttaataaaacaggctctgctccttaataggattgtgaccttatgtgtatcttaaccattcagagttttcctaaataataataataataataataaaacctactattgtcattacgaatattaaatgtttgtaaagtacttagcaaagtacttacatagtaaaggaaaactgtgtgatatgattcaaatagacttcagaaacaagaaatacaaaaaagattaattcagggttttcacttagacagcttcttaagagtcccagtccctgagttaaggaattcaaaagaagcagcatattttgggggaataacgactattaggagtctctatggcatacaagtaacaccatacaactggaaatctatttgctcctccaattaaatagtgtagtccttatttcttatttgttcagtgttaatgattttcatcccttttgttttctcttctggtactattcacttaactgagagtatgctttactgtgttattctcagaataagagcatcccagaggattcgtggaagaaatgcaacactttcgagtataaactatcaaatagccaggttttctctctactgtatttgatcacctagtcccttattttttttaaagcagaacttagtattaccattgtataatgtggagtaggtaattttcctctcaaatcagaacattctgatctggtaaagctaagagttcttggctctctttgaaaagatagattaaatctacctgtctttttgctattttttgctgcctatagatcagtgttatattgttcctcttactaattattatataatatatttacacagaagtcttggctaaagttccatcaaattattatacttctttaaccttactaaaatgaatttcctccactattctttacatataaatacatgtaatttatatagacatatgaagtctatagtaacacctatagtaccagtatttctttactactggaaaactaaatcatagtgactattattaaaaattacttgaaaaccagacctctgtattctccatagggctaaatattagtaaactaaataataaaactgtttccagattttttttgttaaagatttttaaagtattaatagaatttaattaattacataatatatattatccatgtctaattatttgtctagctatattcatcatggaaaaaaatgttcaaaggaaaattgacattatgtgtgaaactttgtcaaaaatatgtcattgatgtttgagacaaggtaataaaactatcacagaaattcttctttttcttactaatatataatattaatatgaagatgtattctcacatcaaattttggtatatacagaagtcagtagtaatatgatttggccgagtacctttgctttcataatagttttataatctttgtgtgtgtgtatgtgtacatacaaagaggcacttaattttttagttcttgttatgtacccaaatttatatcagatgctttctgttctcatttcctttcattcttctaatggtggtccatgtttcaataacttgcctatgagcacaaagctagtaagtagactaaaactggaatgggtacccaagtctgtcttactcccaaacctattccttttctgttacctctgcttctacttccctgccttacagtcagaaaatttataaaggtaaacagtttgtcaatgtgaaaaactaaaagtagtttttaaagtatgcagaatattgtgcagacttaaaatcattatagtgaactacatttattaatacagattgattatttatgacatattgtcaaattgaaaatgcaaattaaaacatccatgtgtggaaacaataaaccctggggatttcagaagcagggaggagcagagtagggacaaggattgaaaaactacctgttgggtactatgttcattacttgggcaatgagatcattagaagcccaaacctcagcatcatgcaatatacccatgtaacaaacctgaacgtgcactcctgaatctaaaaataaaacgtaaaaaaagaaaggatttgtcattcttgaaaggacagaaaaaaattcatgtgtgtgtatttttttatgtatgaaaatatttatggaagtatggtcaacaaaggtttaaaattggttgtctaataaaatgtttgtgatttttaaatttccttatacttttttgttgattgaattatttttggtctttttagtaagcatgtattttaagaatcataaaaatcacttaagactactcttacattcagcaaaaaaaaaaaaaagaaacaaaatataagaacaggttaaaatatagaaaatgtatttttcaccaactgtcatttctagaacctagtttacaattgtataacagatgatacatttaattaaatctcttacatatagtcatccattttttgcatattgcatattctagagcagtgagtaaaatggcttgaatgccaaactcatggatttggtactacattttattgacaaataaaataataggtgtttaagctactttgagaataagcttcattccagtataattgaatagctcctatcagagctcctatctgtatcacaagtaactattataaactctaaaccaaacaaagaaacaataactatctgaaagcactggagagtgctctataaagtagacagattctaccatttggaagaaggcactggttgattatcccattcttaaaacttttagcctgagagtaggccccaatctggcctaactggcagctaaaacctgctggcttcttggctacaagaatggtttgggaaaactatagctacattaaagtaaaaagggaaatcctagaaaggagagagccaaagaggggagcctgaaattctataaataaactccctgtatttctggctgacctctgagccatgaatgagctgggtagactacaaacagcacaactagggctaaagggattgaactgaaatttgaattgccatcctctgcatagcagagtttgcagttaggtctgccgaagtcactgcttactaaaatttaaaaaaatcaatattataacaaaatccagtgtctattcaacatatcactcagtgtccagcatatagtctgaaattatttcacaaagaaacaagtgaacatgacccattcttgcgagaaaagataatcaattgagactaaccccaagatgacccacctattgtaattaacagacaaaaattctaaagcagcttctataatcataatcaagcagtaaaggaacatatgcttgtaatgagtgaagagataggaaatcttagcagaaaaaaatagaaactattgaaccaaatagaaatttaagaagtgaaaaagaaagtagctgaaaagtgttttcagggtatcttctttaaatttaagaccccacctgagccagtgaaatcatttagtaaatatatagcatcattaaataaaactactaatccagctctataaagcaggttgaattggctttcaaaccaacaaaatttattcctacttatttgtgtttgggaagtttttacattgtttgctgttggaacatattaatgtatccatgcatgttgaaattatatgtagaatgaaaggaaaattagaaatattcaagattttactctggaaaattatctttgactacaagagagaaactgcactgaagataattattttagcttagcattttttatgggttatacagtatcaatttaatagtagatagcagaatagctagtttaagagttctataaactaccctcactgacagtctgattcctttatataattttttttactgaagtcaaagttataatattagggaaaagtaccatttctaatcaaatatttataccacgtttaattttttgtgtatgttttgctaatagtgcctactataaactcaaattaataacttttataattattttatagttgaattcaaacaaatgacaacaaaaacactaaaagaatggtttgcaggggcaagggcaagatggccaactagacacagacaagtggaacagctcccatggaagtactgagacaacaggcatgcttttaacagatctttacagggaaggcatcaagagtggaccaggagaagacatagaagctgggctaaaggaagagaaagctgggaacgctgcatggacttttgtgcaccaggactcatttttgaaccacaacagctccaggagcatgggtgagttgaactggcaaggagcaacccgctctcaccatgggcctctggaaccccagcaggaggggacccctcaaccaccacagacacgtgaggtggcagggagagttacttagggaagtcttaagggcagcaagccagctgatgtggagcccagagggtttggtgcagaagtaactgtagtggagcatggccagggacagccatccccctagacttcacttgctcccataagagactttagtcctaggagaactgttggacctgatctgtccagggaagtcttgcgcaacagacagggctggtctgacctgagccctccttggtctgctggcctgtcctggggccctagcctggtcatgcctgctggcagggcagtcttgaggtccctgggtacccacgccgtagcttcaacactgatggaccatgcctgaccagtagagagtttcgatgaggcatccctatggccacgcaccagcctgcacgctccctccccagcctgtgcagctttcctagacccatggcactccccacatcactttgctgatgcatgtctacacaggtggcttttgctttacttgcccagccagcacacaggaacgcagtctgccctcctcccttgctgaccaccattgcagacacccttggtaagcacagagctggcaagtctcactcctgccagcaccccacccttgcactaacattgcacagagaacagcagatcatcccacaccctgaacaatcactcttatttgaggggcacagagaaggcacccagatctatgatggtcagcaccctgcccccaagccaacaccacctccagtgcaacagcacagtctctagcaagggccccccatcccccaccagctgtgttgcctccaccactatggtgaacacctgcagggaggcaggcacccctgcatctgttagcactcttctgcagatgctgcacctcagaaccccagcacaatggactgaacctcaaagaggtcaaactggggcccaatgcaagtcccccagagttagagcacacagtccaggagttgggagctgagcattggcctcctaaaatgttccaaaaacaagattggattcttccagtcagctgaatgcatcttataccataatcaaaccctcaaggttatcaaataggataaaagaaaaaaaatccaaaggtcagcaacctcaaagattgaagatagataagcccacaaagatgagaaagaatcagtgcaagaatgctgaaaactcaaaaagctagagtaccttctttcttccagatgaccacaccatctctccagcaagggtccagaacatggctcagatggctgaaatgacagaaatagaattcagaatatgggtagaaatgaagatcattgagctacaggagtatgttgaaactcagtgcaaagaaagtaaaaatcatgataaaacatggcaggagttgacagacaaaatagccagtactgaaaagaacataaccaacatgatagagctgaaaaacacactgcaggaagttcataatgcaatcacaattattaatagcagaatagaacaagctgaggaaagaatctcagagcttaaaggctggctttctgaaataagacaggcagacaagaatagaaagggaaaaaaagtatggaagggaatgaacaaaacttccaagaaatatgggattatgtaaagagattgaatctgcgactgattggtgtctctgaaagagatggggataatggaaccaacttggaaaacatgtttcaggtatcatccatgagaacttccccaacctagctagagaggccaacattcaaattcaggaaatgcagagaactctaataagatacttcacatgaagatcatccccaaaacgtaatcatcagattctcccaagtaaaaatgaaagaaaacatgttaaaggcagctagagtgaaaggtcaggtcacctacaaagggaagcccatccaactaacagcagacatctcagttgaaaccctacaagctagaaaggactggggcccaatattcagtattcttaaaaagaattccaatccagaatttcatatccatccaaactaaacttcataagcaaaggagaaacaagatccttttcagacgagcaaatgctaaggaaatttattactaccagacctaccttacaagagctcctgaaggaagcactaagtgtggaaaggaaagaccattaccagccactacaaaaacacattgaagtccacagatcagtgacactagaaagcaaccacatatgtctgcaaagtaaccagctaacatcatgatgacaggatcaaatccacacatatcaatactaaccttaaatgtaaatgggctaaatgccccaattaaaaacacagagtggcaagctggataaagaaccgagacccattgatatgctgtcttcaagagacccatctcacatatacaatggcatacactggttcaaaaaaaagggatggaaacaaatctaccaagcaaatggaaaacagaaaatgccaagggttgcagttctactttccgacaaaacagactttaaaccaacaaaggttaaaaaagaaaaagaggggcattaggtaatggtaaaaggttcaaatcaacaagaagatctaaatatcctaaatatatatgcaccaacacaggagcacccacactcataaagtaggttcttagggaccttcaaagacacttagactcccacacaataatagtggtagtctttaacaccccactgacaatattagatcactgagaaagaaaattaacaaatattcaggtcctgaactcagccctgagtcaaatggacctgatagatatctacagaactctccacgtaaaaacaacagaatttacattcttcttattgtcacatggcatatatcctaaaattgatcacatcatcagaagtaaaacgctcttgaggaaatacaaaagaactgaaatcataacaaacaatctctaggaccacagtgcaatcaaattagaaattaagactgagaaatttactcacaactctacaattacatggaaactgaataacctgctcctgaatgactgtttggtaaataatgaaattaaggcaaaaatcaataagttctttgaaactaatgtggacaaagatacaacataccagaatctctgggacacagataaggcagtgttaagaaggaaatttatagcactaaatgccatcaaaaaagttagaaagatctccagttaacagtctaacatcacaactaaaaagaactagagaaccaagagcaaacaaatcccaaagctagtggaagacaagtaataaccaaaatcaaagctgaactcaaagagattgagacagaaaaaatgtcttttgtaatggatgagtataaggctccagatagatacagagaatgatgacttatgtaaacttactctctcttagctctattactgtccctgtttttctgtttgatgagttgtttactctttggcaataattttgctaaaaatttctgtaatcatgttttttattgttaaataatgtaaatgtaaagaaaacattatatatttataaatacatgtagtatttccgaaagttttcttaaaaagggtatacgatctctaataacaccataatatactgatctattatgttaatatactgatctattattaatttgttcatatctctgatgtctgtaacatcaagcacatttgtcatggtttttaaaataatatatatgtgtgtttgtgtatgtgtatacatatatatatgacacatgctgggcatagtcattgcacatactaggtatttgcatgtttcttaaactgaaaattaacttatataatcatattcttaagactttgtgccaatttatttaaatataatacatcaagcttacctttagaactattttgaagctttttataaaagataaacttatcactaatgaaatataaattggaaatagtcagaaaaagaagaggatgccaaaatgttaactgtgaaactagttgtttttgtattgtattgttacattaaaaaccaccacaaaatgtggtggctttaacacatatagtgatttgttatttttcacaagtctgggctttctgagtgggaatattttctcatgtcattatttcagccacatgagtctaaggtcactcatgtagctgaaataatgtcacctcagttgggtctggagaatctaagcctcactcagatgtgtaggaccttggtgctggatattccactagacctttctctccaaatggtcacccatcattcccttgtctagcccagccttcctgacatggtagtagaagtttaccaaagagtgaagacagaagaatggaaaccttttgaaacctaggcttcagaacagccataccatgacttattgccccattccattgatcaaatcaagtcagaaatccagcccagttgcaagggttgtagaaatagaccccacctcctgacaggaggatttacaatgactgtatgaccatatttaatttaccacagtagtatatgtgtaattattaagtataaaatttatttctaaacttactgaccatgagtactaagtatcagaatgaagaatgaataaatgtttataatccctcttttttttaactttaaattgaagtttaggggtacatgtgtagaatgtgtaggttttttacataggtaaacatatgtcatgagggttggttgtacagattatttcatcaccaggtattaagcctagtacccattagttatatttcctgcttctctccctcctctcaccctccacccttcaacatgccccactgtgtgttgttcccccatgtgttctcatcatttagcttccacttcttagtcacaacaagtggtatttggctttctgttcctgcattagtttgctgaggataatgggatccagctccatccgtgtccctgcaaagaacatgatctcattgttttttgtggctgcatagtattgcatggagcataggtaccacattttctttattcagtctgtcattgatgggcatttgggttgttcccatgtctttgctattgtgaatagtgctacaatgaacatacatgtgcatgtgtctttataatataatgatttataatcaattgggtatatactcagtaatgggatttctgggtcgaatggtatttctgtctgtaggtctttgaggaatcgcgacactgtcttccacaatggttgaactaatttaccctcccaccaacagtgtaaaagtgtccctttttctccacaaccttgccagtatctgttattatttgactttttagtaatattctgacttgcatgagatgatatctcgttgttttgatttgcattttgctaatcagtgatgttgagcttttgttcatatgcttataggacacatgtatgtcttcttctgagaagtgtctgttcatgtcctttccccactttttaatgggttttttccctgtaaatttatttaagttccttgcaaatgctggatattagacctttgtcagatgcatagtttgcaaaagaattgtctcccattctgtaggttgtctgtttacttttttgatagtttctgttgctataaagaagctctttagtttaattaaatcccagttgtcaatttttgcttttgttgcaattgcttttagtttctttgtcatgaattctttgcccatgcctatgtcctaaatggtattgcctaggttgtcttccagggtgtttatagttttgggttttatatttaagtctttaatccatctttagttaatttttgtatatggtgtaaggaaggggtccagtttcaattttctgcatatggctagccagttctcccagcaccttttattgaataggttgttgcttgtttttgtcatgtttttcaaagatcagagagttgtaagtgtgtggtcttatttctgggttctctgttctgtccccattgcttgtttttgtcagctttgtcaaagatcagacagttgtaggtgtgcggtcttattttagggttctctattctgttccattggtccatgtgtctttttgtgccaatatcatgctgttttggttactgtagccctatagtatagtttgaagtcaggtagtgggatgcctccagctttgtttttttgtttttgttttttgcttttgtttttgtttttttgcttaggaccacgttggctattgaaatccctttatttttttaatgatacatacaaattacaaagaattcaaacaaggcaaaaatgtaaaaaggcagtaaaaaaataaaatgtacttcaaagctaactacccaagagtaataaatatttaacattgtttataaaacattccaacatctttcactgcttattatgtagctagaagaatgtatggatgtttaaatgagtgaaagacatagctatttaaacaattaggataattttctgaagctaatatatagtagcatttatttacacttaagcagaagaaaagggaactgagtaaaagagcctattgactttgaaataactgttttttattagaagagatattatatgctgaaatccctctaaattttaaaaaataggaaagtcattaataggttacagtcatatgttaactatatgttaaaccttagacaggattggttgaatccttgctatgaaagataaggatatttgcactattacatttcttcccacctaccctctccttaccttccaatttctgtttattatatgattttcagaaaaaaactgataaaacaatatccagtcctcaaactagtgcttatttcaaacttgttgcagagatgtaggaagaaaaacaaaaagtcagcccagactgtatcagatctggaacttgcacagaaaaaaaataggggaagcaagaaaccagagacaacatatagtctttgttggaatactctgctcttctgaaattttattaatgtccagtgctagaatctttcttcctagataagggtttagctcatcattatgtgaggactgtcatcaagtttaagattagttttccatttcagtgtgccttcgtttctagaatcttcatcttgaatgccatgagccctccattgcatgtttcttatagaagctgcttacaataagaaaaagatatggagtctcttttagtttgcatctctgtagatttagaggtattcatgagaatttttaagattttgagaattcaccattatgacctctttggagtccagagtagcattaggagcctcaaaatggagaactgtgtgtctcaaagatcttttgtttctgtccttaaccatccagcttttgagacttacgaagctatgttgtttgcttatttggttgttgcttgtggaggtttttcctctagtttttactcttttatgttgattttatgacatattaggagggggatttttgtgatacacctttattctactaaagatgaatggaatggaatactagaaatgcaaggcaataattttttaaagaaatatcctccacataaggaaaagttaatcactaaaataaacaatgtcctcagcctcacttttgcaacagatgcagagggacttttcataagttgctttcatgaaaaaatcttcaatgacctcttatttggtagaggcagctgaatattaaagttttgtcagaataaagtggatctaacaggtgcagaaacaaatatggcaagataaattgctttctaactaagctaagataaattactaagttaaataagataaatttaataagttggtacagtaaatagctaagataaactgctttttaaacatgatagaataaaaagactcagtatctaatgtggcacatagttcagtttaatatgtatacatatatcaccttgaggtatctttcttaaaatgcagcttctgattcagtagatcttggatggaacttcaaattgtgtatttctaattccgtgacaccactggtgccagttctcagatcatacttttagtaacaagattctagacaactatagactaagagctcctctacttgactgaatccttgagaccagagatactgccttatttatctttgcattgctgttctctaaggaagtacctgaataaaagtttgccctgaaatattttcttgttaaatgaattaatgaatcagatgcatgacaactaggggcctggagaactggtattctatactggtgggtgaggaagaattcttttgttttgaaaaccaagtgactgaatgataggatttctattttgtcttaaaatctaaaagccttactaaaatttttgctcacatgaagtctgccatatatcacattagctactttggccaacaaaatattacctcccaaatgcttgaatagattcttaattgctctcaagataacaaatgttattcaagtgaaagaaatctatatattaagtgttaccagttatccatcctggaaatagaaaaactttagtaatattactgtaataaaactgatttttgtttgtttgtttgttcgagacggagtcttgctctgttactcaggctagagtgcagtggcacattctcggctcactgcaacctctgcctccctggttcaaatgattctcctgcctcagcctcccgagtagctgggattagaggcacccaccaccgtgcccggccaatttttgtatttttagtagagacggcgtttcaccatcttggcctgggtggcctcgatctcctgacctcatgatccacccacctcggcctcccaaagtgctgggattacaggcgtgagccactgcgtccagccaactgattttaaactgtatgaaatctttttgggcctacccaactatctgtgaaatttacccttgagtaattgaacagatcgtctccttagactagtagttttcagttgctggctacattttagaattacctgggaagcttttaaaaatcccagtcagtgcccaggctataccaaagaggtgagacccaagtattttttaaagctccgcagataattccattgtgcacccaaggatgagaaccattacttgactattagctctttgaaatctgagtcagtgttcctcttatttttaacttttaacacttaatacatggtaggtacttcataaatgtttacttagtcaacagatgaattatgttataaggaagtattatctgaggcaaaacaggagcattcttcagtataaagggaccatttttactatgtttattagcatcttaaaatttgaaaagtttgaataccctcttaatgttaatactgaaagttggtatttgatatagataaacattttggtgttgagatattttgttgatgcaacttggatttcatatcactttttatcaagatttgatataaatggattgtgatcagaggtgagaaaactgtggcacaggcatttcactaccgtaatggaagtacttaaaggaatgttacaaagagatctaaggtgttctaggatacatcagtcggaaaacaaagatggttaatctacacattgctgagttgtggtatcaaccgtggttttgttttttgtttattgttttcttgagacagagtctcattctgtcacccaggctggagtgcagtggcgcgatctcagctcactgcaacctctgcctcccaggttcaagtgattctcttgcctcaatctcctgagtagctgggactacaagcgcgctccaccatgcttggccaatttttgtacttttagtagagatggagttttgccatgttggccaggctgttctcaagctcctgaccttacgtgatccacccgcctcggcctcccaaagtgctgggattacaagcatgagccactcacccagctggtttttttatataccagaaagaatagagagctatttataagagtgagtatttaagcttttctgctttttaaaatgaagcacagacaattgaagttttaacttcggtttatgaaaccactttataagcacctgtattataataatcattgatttttgaggggctttcctcagaacaaaattataactatatctgggatcaaagttctttagatgggctctcagttatctacaatttatgtttttaaaaatagtttgttgccattaattaatcattgcacagaaaagttcccttcatttggagctctgagctctgcatttctgtgataccagaataaaacacaaactgaaaaaaaagggaaaaaatcattttttaggtcttggatttattctaaataatcatcctacattttgtgtcactgatgaatttgagaattgtggggaccgtattgtacatctcggtatcagcctgctatttgtatttcacaacagttatcggcaattaaatgatgaaattctatttttaaattttgactctgaattataaaaacgtaatgaaacaatgtaataccaatgcaagtatatgattataatttaatgagcacttaattgccctttttagcaaatagctaaaatgtagaatgggttgatagaattagcaagaataagaaaagtcagcagatggagatcctagtttcactttgttataaactaggtgtgtaattttgtaaattatttaagcacattgtacttcagttgtctctttagaaaataaagaggcaaatctgctaaagacccttctagctccaaaattttatgacatgtaattctaatctctataactgtcatagtagtgcattttgaatggctgaaaagaacttcagataagccattaattataaactctttatttacggttttcttatgttttatttactttcaagaatttgatacttgcatcctcattttctataattaataaaataagtactcaaaatttcagtgccttttgatcaagagtgaaactgttccatgaattgtgcttagaaattttcttactgactgttgaaaagaatctgtgtttcctcgttgaatacaaagtgtcctaggactgggatgttttgagcaagcaggcaaatttttctgcacatgactatactattgttttctttcaggaaaccctgatagattggtgtgatgaaaaggaacttaatttgatattaacaactggaggaacaggatttgcaccacgagatgtcactccagaggtgagatagtacatgccttttcatattcaaggattaaactaatcatggtttttttaatcctttttactatatttatattatttttataactttgctaggcataacaaatgacttgtagttctaataatgtgaaaattttgctgtggatgaattgtgaaaaatgtttcctgactttttttctttgggcttaaactagaagtgatagaatatgaggaagattaaactggtccagaggtaatctgtcattttcttgatgtcagcctaatttcaggcacatttccaaaggaagtgatagcagaattctgatggttagcatggcatctggtctgatgtgctttgtcaatacaattcttttcttgaggtacccttttcatttgtctaaaattacagtaagatgactgcaatagaatatactgattttacagtacttttgttgaaaagggatatattttccacaattctaaatgtgaacagcatttaaatgcagaatttaatgagcccaaaagtagaattaatatctaggcttaagaccacaggaagcatcttcaactattttatatataggaagaaaaattagggaaagaatgaagaataagcactattaactaatatggggggggatgtattttttctttaaggaagccataaaccacagatgtcacctcagagctatacataaaattacatcaccacttgtgacattgtttcctttacctacccaaccccccaaaagtgtttcttggatcagtttcaacttaatatttactatgtctttctatttcaaatcagtacactattgtatctactaccttattaacattccacaaggtacttttgctctgcatctattaaataattactggccttcttataatagtacaatggttttcaaacgttagcctgcatcagaatcaatcagaggacttattaaaacacaaattgcttgaccccccacccctagagtttctgatttagtaaagctgcaatgggtcttgagaatctgtatttctaacaaggccccaggtgatgcagatgttgtcgttgttgttggaccatagaccatattttcactatatgaaaatgcaattttaagaattattttttttctattcctctatataaaaaccgtggtacataaacttttgatattattataattagggttttaaataaaatagttttggcttttaaagcaatcaaaatcgagtcgtattgagaggttaacttcaactgcataaagtcatccttacacaatttatttagcttctggcttctatagttagtggttctttggcaaagttttacatttcttttatgctatgactgactgaaaaagtacaattgggaaggaagccatctcctgcagaggtgtgcttgtgttttgtttctttgtaagaacattgactacttatgttaagatatggatttttggagtttgggtgctgtcttaagtgttttagtaaatcactttgcgtttatgtatgcctattttttgtgtgatggtttgatattttcatattttttcataacagaaaaatagaaaaaatttcaccagaaaattaattcataaccaaataacagtattatttttaattccttggataattgatcgtggggaaataatttacatcacaaaatgttttgtatcctactgggctttcagttaatacaaaatgctaggctgaaaattcaaacctttgaattctggctctgctacttatcaacaaggtgaccatagacggagtgcttttactcacacttctgatgctaaatgtgggtttttttactcgaaccagccagttcttcaactctccagatatcaaatgtccttctttttatttcaattaaattctgacactacctaccaggaattagtactagactctgcagatttaagggctgtgtccacaagattgccttcacgtcacatgccagtggcaagtaccagatccccaggctagtcaaaattctgtcctacttgactacaaagtcagttggttcccaaaccgcgtcccccaccccactctgcattttcagattcactaatttgctagaataggtccaaaacctcctggaaacactttacttatgcttaccagtttactataaaggatacaatttaggaatagccaaatgcaggagatgcacagggcaaggtataggggcaaggaggttccatcccctctcagtatttagcgcccctccggcaccttgatgtgttcatcactctggaagctctctgaatcccattgttccaagatattttatggagctcagtctccaacctcacccctcagtgagtggaactgaaaattccaatgctcataataacttagtctttccaatgaccagaccagccccatcctgaggctatctaggcacccaccctaagtcgtctcattagcataaactcaggtgtgatctgaagaggtttgggcctggcatggtggctcacacctgtaatcccagcactttgagaggcccaggcgggtggatcagttgaggcaaggagttcaagacaagcctggccaacaaagtgagaccatgtctttactaaaaatacaaagaattagctgggcatggtggcacacgcctgtaatcccagctacttgggtagctgaggcatgagaatcacttgaacctgagagtagaggtttcggcgagcagagatcacaacattgcactccagcctgggtgacagagggagaccctgtctcaaaaaaaaaaaggcggggtgaggggggtgcagaggtttgttaggaataacaaaaggcactctgtactgctatcactcaggaaattcccaagggttttatgagttctataataagtcaggaaccaagaagaaagaccaaatgtatttttatcttataccttaatagactagtcatttaaccactctgtgccttagttttctataaagcgagggaaataaaagcacctatttaccaaggtggctgtgaccgttcagtgagaactattcctggtattttatgtaagagttaatttataagagttaattttttttatttgttgctatgtaacttatgtaactaccaaatggacacatttgatagtttttcttttttgcatgtaataccagatagacaactatagccttttacttgttttgaagtatgtccatgaagtctttagaatcttgttaaattatttcttaattttggtagggtaagcttcatatttgatctcttccatctctatattatataaatcagaaatcttgaatttctgctattctagtatctaggttttgtttcttttcttttttggcactactagttgacaagtgtctgtttccatggcattgtatatttcattattcagaaattgagcagtattttattcttaaagtttttcagttatttgaaaactattgaggtgctcttatattcatatatacctatagcagctacatagttaaaattatattagaggtttcttaaatggatttaaaatatacataaatatgtcttctctaatacctgtttttgaaaagaagcaatttacctgattgtgaataacttgatctttaataggttcacttcatattttatatgtatatataaatacatatgatatgaatatctatggcaaaagtttgtagcagtcgtgggctattaaataatactaataaaataaataataaataagcaaacataaaatcaatataggcccactaaaaagtaattctactaatttcccttttactttacatcgtagagtagttgcagttcttataatatctaacgtataatattgatgtgtcagaaaggaatttagaaatataatcctcgctgaattatatactgatttgtctgttttgatagttgtatctaaagagaagaagctgtttctagacacatttacctatattatatacatcaggattgccaatatttttaaatgaggtcagaagttattggtagaaagcacaaatactaatttgataaaagtaaaacaatgtaaaacttctcccttaaaatcctaataatgctttatagtcgatgattgtcagtaattagcttaatctgtaaagcacaaagcaaaattgtttgtggatgtgtgtgttgtaagaaaaaaaatgaaggatgaaaatgatgaataggatgaatgaaaaaaaacaatccaaagattttgtcaatgggtatgagctctagataaaatgaaaaatttaatcaacagatttctctccaggtctattaaaaatgagaatagaatatcaagtatagtaaagtttatcttctttattatatattttataggaatagggctatcagaattgattttcctaaattatgaatttgtttatatttttaggccctgcatcatagaatatggttcatctgatacttgcatgccttctagccttctccctgcctctaaatatgagatgctatcaaaacttacatatgaaagcatgataattctcactcatcaactttttagaattttgtcttgataataaaaactggtttttaataatagattgcttgcctttttttttttttttttttttttgagacagagtctcactctgtaacctaggctggagtgcagtggcatgatctcagctcactgcaacctccaccttccacgttcaagcaattcctgtgcctcagcctcctgagtagctggaattacaggcgtgcaccaccaagcccagctaatttttatatttttagtagagacagggtttcgccacattggccaggatggtctcaaactgctgacctcaagtgatctgcctgcttcggcctcccaaagtgctgagattacaggcatgaaccactgtgcctggccagatttcatttttttctggtccgataaaggttggataattcattggcactagtgaaatattagtaattataaagttccacagattatgaaactcatttctatacaaagtattttccctttatgtcccattattacttcaaagcaatgtatgtccaaaaaaggtattattacataaaggatctgtgtttgataatatagtaaattagaaaatgttaaactgttaaatatttaaaagacacaaaataactttcagtacttttagagcactaagctgtattgaattaagggttgtatgctaatatattattttgatcataagtaaaatagttgagtaaaagcctagcatacctgtatgtctcatccacttggtcatttgtgaagcttttgtttttaatcctcaatatgtgttcagtgccatgcttggtactgaagttaaaaaatgagtgagactttcacaggggtaagcaatgtagcccacaagccaaatccagcctgtcaccttttttttgcatgtccagggagctaagaatatattttacatttttaaatggctgaaaaaatcaaaaggagagtaatatttgtgaggtgaaaattatttggaatttgaattttagggtctataaatgaagttttattggaacaaagctacacttatttatgtattgtctatggctaaaacagcagagttcagaagttgtaaacaagaccgcatagcctataaagcctgacgtatttatcatctgatgctttgcaaaaaaagtttgtccacccatggccttttggatgacaacaagtcatctttactcacatttttttattttctcacttttacctttggttctttagtaatccgaataatgttaggtttccttccttatatttttaattttagatggagcaaagaaaaaatgcttttttgccatattgaagtgtattgcctcattgtttcaatagacaatatagcctaataaaaataaaatatcccttattctaaataatatatagaattctgcactttaaaaattaatacaatgaatttgttgtacattaagtaaaatctcactgttaaaaataattttaaactgagaaaaagtaatttgaaactgacattcttaggaatgcctcataacaaaagtatgctgatataattgatgattatactcaaacaaaagaagaaatagcaaaaataccaggaaactgtaaatttgacataaggaatatttatttaaaagagttcttataactgtttcattatggaagtgaagaggcatcagacaaaatgacctctttcaagagggaaaatactacaaaatggtaccaaagaaacctgacttaggaaaagactctgaattttagaaggtatattctgtttatagactacttttaggttgctttggggcagattaatatctaagcttttctacaaatttttttcacttaggttattagatttttttcatgaaaatgtcagttttctagtacaaattaaagaaagttacaaaaattgttttataatcaatttgttgaaatatatgtatttcataattttaagtgtgtgtttactataagacaggtattattttatgtagtcattagtcatttttctttcttatattgtaatgcttcaaaaataagaacactgtataagccctgggaagaagaaaaaattgacctaagttactaacaacatgttaatgattttcagtttgttactcttgtgaaagagagtgagaatttacatttaataactcacctaaaagttaatattggccattttcacaatcagaaaacactctcctacattttaacagaagcatagcaaaaaataccatatttaatcatttgtttttgatagaaaatttgattttgttttgagtaaaataaaatacctgttatacatggtaaggctaaaattagtcatattgaactaggattttgactatcttaaaattgttctatgcaaataggataatttaacaatattaaattgcttacaaagcagaatactagaaacccttatacctgaagtatttaaaactaaatttaataaaatgttccatccctctacagtcagatttgatggttatatttgatggcattttaaggagctcatcctaattttatgaaatagttcccatgtcatatctttgtctaaacacgttggcatgcaatatggtatagtggaaaaagcttacactatagagtcagattcctaaatttaaatattagtgctactacttactaactatgaaacttaaggcaagttgacctgttcaaatctgttttctcatctgctaaattagctaatttttctcatctgctaaattagctgatgcctacctacatctcaaaattgttgattctaataataaaaatagtcaataataacaactaacacttacatatagcaattactgtgtgcaaataactcttttaagcatatgttaactcatttattcttcaaaacaaccatatgaggccaggtgtggtggctcatgcctgtaatcccagccctttgggaggccgaggtgggtggatcacttgaggtcaggattttgagaccagcctggccaacatggtgaaacccatgtctactaaaatacaaaaaaattagccaggcatgttgttgcatggctgtggtcccagctactcaggaggccgaatcacgagaatcacttgaacccaggaggcggaagttgcagtgagcaaagatggggccactgcattccaacctgggtgacagagtgagaccctgttttaaaaaataaataaataagatatgtataaggaaggtactatttattgttatctctgccttaaagatggagaaactgtgacacagattgattcattgacttgcccaagacttttcaagtagtaaatggcaataaatgcatgtaaaaggatctaacataatgcctgtaatctttgtagatgctcagtatttgttctttttcttcctcatttaattaacagtactacctgttatctctaattagatatggtagctccaaatacttttgctactaaccattgtgcttctgatagctattgttaactacaaacataattggtggatatgtcttaaaaataaggacttgtcttgaaacagccagatatgtgaaaaaataactttttagtaatagcccactttatatctgggttttataattatttttgtattgtccactgaaagcagaatttttttttttgtatcataggcacacttaagacctttctgtttggtaagaacagcattcattttctttgttcaatgtaacaaatatttatgaagcaccttggactttatcaaacctaaagctaaagtacatatactcctaaaatagtcatatgacaattcaagacagtttaaacctggtaccagaaatatttagccaattcaggcaaaaagatttattcaaagagaaagattaaaagagagcttgagtaatgagtgaaatttttataaaattcaggctaaaattgaatgggatttaggttttgaaaaaggaagaccttaaaggtaggagtaaagaagaaggaaaatatatgagcaaggcacagagaaatacaaacataaaatctttctggctaaaacagagaattcactttacgtagaaggatggatacactagacctacattattttatttctttcagactggctagagaggtaccaaatacagaaatgagagatttactgtattagtctgttctcacatcgctaataaagacgtacacaagtctgggtaatttgtaaaagaaagaggcttaattgactcacagttcagcagggtgtggtaggccttaggaaacttacaatcatggtggaagttgaagcaaacacatccttcttcacatggcggcagcaagtagaagtacagagcaacagggggaaaagccccttataaaaacatcagatctcaggagaactcactatcatgagaaccatgagaaaagcatgagggtaactgccccatgattaaattattagtacctcccaccaagtccctcccattacacatagagattatgggaattacaattcaagaccagatttgggtgggacacagccaaaccatatcactgccgttattcagagattccttggaaacgagaattcatgagtctcctatcagccagtatagacagtaaaatcatgctttcaggactttcttagactcttttttgaatcagcatttattcgaatgcacatgaatacattcctcagtaggactaactttattctctttggaggttgtttttatgccctggttaaaaaaaaaaaaaaagttctgatgtaatctgcaaacctagtaactatccatttatttacttattaaatttaaactgctgagaggcacacaattccaattttgttgatttgttgtctggaaaccttttcagtcaatatttcccttagaatcaagaatcaagacaatcggaatatgtaatcatagatttgtcagtgctatatcttaattagcttagcatttgtataaaattacaaactttataatagtggagaaatcatagtatctcagagtttgaagagaacaaagaccttcatgttcaaagccctagcatgcccttttcatcattccagcctgaacatttcaaccatcacttcttctatcgaagagttcattgtttagacaactctacttgtttgaaagtctaaatatatcaaactgaaatctgtcaccttataatttctacccacttgtcctaattttgctcttggctgtgctcaaaagaaggttaattcctcctctgcatgacatttctgatatttgaaaagaaatgttatgtttctccttaagtccacttacttatggattatttttgcatttaatttttctaccaggcacagacttacccaaaacatacatcctctattttttatgcatgaaaaaagaaaagctccatagtaaaatggtgccagtataaaaattacaggtacaaaattagaccatttagataaataattagagcaataactgactttgcatttaagactgttaagttttgaaatatgtcccatcaatacctaatttattgagagtttttaatatgaaagttgttgaattttctcaaaggccttttctgcatgtattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaagggtattggtctaaaattctcttttatggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtagtgatatcccctttttcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgtgagggtgtcaattttggatctttcctgctttctcttgtgggcatttagtgctataaatttccctctacacactgctttgaatattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccgtgtctgcagatgacatgattgtatatctagaaaaccccattgtctcagcccaaaatctccttaagctgataagcaacttcagcaaagtctcaggatacaaaatcaatgtgcaaaaatcacaagcattcctatacaccaacaacagacagagagccaaatcgtgagtgaactcccattcacaattgcttcaaacagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacaataaccaaaacagcgtggtactggtaccaaaacagagatatagatcaatggaacagaacagagccctcagaaataacaccgcatatctacaactatctgatctttgacaaacctgagaaaaacaagcaatggggaaaggattccctatttaataaatggtgctgggaaaactggctagccgtatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagcactaatatccagaatctacaatgaactcaaacaaatttacaagaaaaaaacaaacaaccccatcaaaaagagggcgaaggacatgaacagacacttctcaaaagaagacatttatgcagccagaaaacacatgaaaaaatgctcaccgtcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattacggcattattcacaatagcaaagacttggaaccaacccaaatgtccaacaatgatagactggattaagaaaatgtggcatatgtacaccatggaatactatgcagccataaaaaatgatgagttcatgtcctttgtagggacatggatgaaattgggaaccatcattctcagtaaactatcgcaagaacaaaaaaccaaacaccgcatgttctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacgtatgtaactaacctgcacaatgtgcacatgtaccctaaaacttaaagtataataaaaataaataaataaataaaaataaataaataaataaataaataaataaataaataaataaaaagactgttaagttgaaagggtcctattccacacagtagcactaaagagggaagagtacattgttccttgaggtcagaatttttgcaattttgagaataaggcaaaaacaaaaatttcctatatgaagaacccacaaataaaaattatatattcaatttcctttaaatatatatcctaattgtatacctactctatgtcagaatatgtgctcagcttttatggggccctatggatacgagagatcatatgttaaataaacatacaagcaagtgtagatgcaagtgatggtaagttctgtttctaattacagttctaactagaaaaatagtgttgcccatataaccttttatggagtagcataacatactgcttaattctgctctgtaatggggcataaaattaataataataaaaataacatagtggttaagagcacagactatttgggtttgaatcttagatccacctgttattagtgtgcaaccccatgcaatttacttaactttaaaaacctgttttcttatgtgtaaaatgatagtaagagtacttgcctcatagggtacttacgttatgtaaataatataagcaaggcactaaaaacaatatttccttgctatataaatctttgctattgttatctacaatatgtttagaaagagctttagctttaaaaataagtagatgatggtggaataaatattataagaattattctctgaaagaaaaatcaaacaagatagaacttaaagtacacaatagtatagttgcagaaaaggaaaaagaaatatcaaagaagacatgttaaatccttgttttagcttgaatttatcagtgatgatatcttgaaatcacctttccagttcacccttccaaatctactcttgtaaaatgaaaagaggctagcataccagaatactttggttttgcaaaatatgtgctaagaaattaacaacaaaatataaataaatattttgcagatatattagtaaaatgctaaaagtatatttatctagagacatagtctaaggaatgaagatttcaggatattcctttctttactactgtctggaatcaggaatatggatttctctctctgtgtattaggtatccatctatgaaatggacttactgttgcctttcacataaaatgtaataagatgacaacaaatgagtactttatatctgtcaagtactatgaacttctcagaataatatcactgaattagaagggcagaatatttgtaactttgttgttactgcctgccataaaaggcatctgatagggattcagaaagtagattgaggcaacaaagtaaacaatttgaataattctaataattttaccagtattattttcttatattgaaacttggaactgctactaaaatatgaaggacaaatgtccactggaggtagtaaccattttagatatttattaatggcacatagatgagaattagcagaaaggatccaagttccttcaaaagatgctgagaagaaagaagcagtaaacctctcttgtatgtacagtttgaaaatgatggttgtcagtttcactgaatgaacgagaccgaaggccaaaggcaacaatgtggaagaagcagtccatcatgctggaaggactaattgatatacaaagaaataaattatacttctctatgaagaatgaagataacattatagccatgagtgccactgggataatttaagtgtcttacccctcagcttcttcactcctttctataggttgtattgcagcaaataacataatatccttacgtggaataatcctcaggctaaacctttatggaaagaaaagctaggtcagttttgattaggaggtgcttctgaatgcagttttacaaaattttttaaatactctttttttacaaaatggaggtatttgaaccagagagaatataattgttagttttgaatattgtataactataatggagtcttattataatgtgtcaattgtctgctgtgattcaagattacattgtataggcaaacccattataatgaggtcactttaatacccccattgatgagattcaaaagaaattcatatcatgctaatttctgactattgttagggtatgtatttagaagtttagttaattgtgtgatactttgatataagtttccatttatgggccctatttacttcctctttcattctctcccattttgccattttcaagacttactggtattgtactttgtccttcgagatggcgctgctctgtggggtagatagatgaatgaatatcaccctctttaataaataatatttagaggaatgagaggttacttgtatataatattgaaagcaggccagttgtggtagctcatgcctgtaatcccagcactttgggaggtcaaggtgggcagatcacctgaggtcaggagttcgagaccagcctggccaacacggtgaaaccccgtctctactaaaaatagaaaaaatagccaggcatgatgacatgcccctgtaatcccatctactcgggaggctgaggcaggagaatcatttgtacccagtaggtggaggttgcaatgagccaagattgcgccactgcactccagcctgggtaacagagcgagacactgtctcaaaaataaaaaataaaactaataataatattgaaagcaaatcctagtataagtatacattcccccaaacatttaccatggacaatagtagcagcaatattaacagtaaattctagtctatctttgctcaaattttagttattgctctttgccttctaaatataaaatactataggacaggggtcagcaaacctatttaaaagggccagatggtaaattttttagattttgtaggcatatggtctctgtcaaaactacccaactctgccagaccggtagcacagaggcagccacagatgatgtaaatgaatgagcctggctgtgctctaataaaactttattacggccactgaatttggatttcatatatttctacgtgtcatgaaatattattcttcttttgattatctcttgaatcattaaaaaatacaaagatcacttatagagtgcaggccatacaaaaaaaaaaaaaaaaaacaggaaatgggcaggatttggcccttgggctgtagtttgccaacccctgttttagaacattcctattctatagtacactggcgtctgctctgttaatcttaaagctcatagtatgtgagctttcagaagaatactctgaaaaattgagattgagagaggaagccccataagaagttaatgcttcatggactcaaatatgtacttaaagcctactagatagatatagatatagatatagatatagatatagatatagatatagatatagatatagatataggtatagatatagatatatacatgccaggcactgtttaagatgttgagatagagcaatgagttaagaagtcacaagtccctacctttatggaatttacattttagtgagaggatacaagctattaaaaaacaagtaaactctatagaactggagatggtaagcgctatgtttaaaaattaaccagggagggaggataggtagcccaggtaggaaagagggttataattttaaatagggtcatccattaaggaaggcctcattgataagatgacatttgaacaaagacctaaaggaggagagagaggaagccatggatcatgtggaacctgtatgccacccttagtgtaacagagtagaggcatggcatgaactgacatattttaatgggaaaacaagttaggagactattaaaataatccaggtggaaaatgacagtggcttagaccaatgatagaggtggaggtagtgagaagtagattactgatatattttgaagggagaggtaaacagatgcaataagataaagagagaagtcaggtataagacccaagatttgccttgggaattagaagaatgtagtttccatttactgaaatggagaagactatgggaaaagtaggtttgagggggaagatcaggaattttactttggttatggaaacctgaacttcctttagatatccaagtggagatactgaattgcaattagatattaagtatatgaggccgggcatggtgactcacacctgtaatcccagcactttgggaggttgaggtgggtggatcacataaagtcaggagttcaagaccagcctggacaaccgggtgaaaccctgtctctagtaaaaaagaaaagaaaagaaaagaaaaaagccagacctggtggtgcacgcctgtaatcccagctactcgggaggctgaggcaggcgaattgcttgaacccaagaggcaaggtttgcagtgagctgagattgcaccactgcactccagcctgggtgacagagtaagactccttccccccgcccccgccccaacccccccagccccgcccaaaaaaagtagatattaggtatatgtatctagacttcagtaggaaaatctgggctagaaatattatttttggagtcatcaacatataaatggaattaaaatccatcacaattgatgagatcaccaagatatttactggtattactatttgttgattgatattactgcccctgattctttctcatccactttcaaagaggtaggtagtttctagtaatctgtcccctctgctcattcacaaagagtggaagggatcccactgaattagaaacccgacctacacaggaagtaccattagttgaccatcttcccattttgccgtggtgtaaacatatgagtgaatttttccaagtacctccttgctggaaactgtttgcactggaggtaagtgtgaaaggggaggttgtggggaatgatggggtgagggctgcctaaacttttcccataactcagaaatggtttcattctgaggaagggagaaggttcaggctggttcttatttccctgaaccagtttgtacagccctaaatttgacctgctttcctcaaactgggagtcagaaatcccttttctcttctgtttttctgctgcagaaattcccaacattcccattttgtgggctccagaaaggggtaagcgaagacttcaatcccagccaatcattttcagattaataatttttagtgttttggtttcttttatcatcataaaaaatgcttggatccatttttcacatctgtttaatttccttgtggattgttatgtatctatgttctagggtcattctgtatccctgggcaatagagttcagatccatctgctatttccatttgtgtgctgttctcttgtggattctcatttgcagtttattgattactgtatcctagatggaagacacccaattcaggggactgcctcactctcaatctcatcttttcctgaatggtgttttattcctctgctgagagcttgctattacactacccaactgcttctgatgatctgtcattgtttctctactgttctgtcttcctgcttgattgcctttggtttttgtctctcctttttgcctcacttcactcatctgctgaatgatttgcattcttcactcactggtgctttgtccgtcagcaaatggcctggtactgccatatccatctgctattttagcattttagactgcccagcattatctatctgctcccctacaattcccctatactatggcctaacaagtgctatgccatctgcctgcctgatcttgccctgcccaatctatgcctgtaacactgtaagtaggtgagattgtttagcatttctgctatcatctacacttgccttgtgccactgagttagactgctgactgagttagactgctgactgagtttgcttgactgttgcctcctctacctatttgctacctatggctgccccattaatttatttgagatattgaaatcatctcctttgtacttgcaacttgctgattggcctgtgttgcctcctttacagtttgctgcatttaaaaaatcactggcattgctcctctgttgtcttgtaaccctgatcatattttatttccaataaaagttttgcctacatatcgtccaaacatcttagaaataggaaaatgctttgctatctaacagcccagtccagtttgctcctaaactgactttttaaactaccacctgtcctttctgcttttttatacagctccatattcttctctttatgtaagaatatatttttttataaataatcatctttgcttaagttttcctttcacatcatatattatgtacatttatttcttgtgtatgggatcttttaataattttccatatactaaaattatttcttaatttattattcctaaattttccagggttttataaggataagttactcctattaattttatcctttttaataagaccagaagatttttttgcaactttaaaagcatcatctctaaaaataaatttaattatcttataattctttgtagtttagattaaagtagctttctgctctgctctattttttcctttgagaatatcatttctcagcttcctcatagtttacgtaataccagttctttagagatcctttagatgtatttatcttccttccttttaaactcttttcttgtatgttgggtaaacctttgaaattgatattttctcattattgtatttgcaaagtacttggcatctaaaaataacttgcaacataacattatctgcactgtaaaacttacagtcttatttgcttatatttaaatgaaagctcaaatacaagaaccaaagaagaattttggtgaaatttgcaagagtctaaggaggagatgtaaagtggggtgtgtatgtgtgcatgcatatgtgtatatagagatttgaagtgttttatgtgtgtatctacaatgtcattgtgctcgaagtgtggaaaatgctgagtatccatattaaattttatttttacaaaaaaatctaaagaggtgatagatttagggatacggaaaaagtatggatgggtttttattttcttttaataatatagataaaatttgtcagtgtgaagaaaaaggatgctctagggaagttaaaatcatttcagtagctttttaaaattttggtaaaatataaacataaaatttaccattttaaccaattttaagtgtacaattcagtgatattagcacattcacagttttgtgcaaccgtcaccactgtttctagaacttttatcatcccatttagaaactctgtacccattaaacaaaaactccccattcctccctcccccaacccctggtaaactataatctactttctgtctttataaatttgcctgttctagatacctcatataagtggaatcataccagttttgtctttcagtgtctagcttatttcacttagcaaaatgttttcagggttcatttatattatatcatgtattagaatttcatccctttttaactctgaccattattccactgtatgtatataccacaacttttttatcagttcacctgttggtggacactgggttgttttcagcttttagcttttacaaataatgctcctacaaacattggcatgcaagtatctgtttttcttttggttatataactagaaatggattcaatagcatttaatactttagtccaagaagaaattaaattaatagcaaagagatcagggaaaccacataattaatatgaaagattaataagtccaagatatgatattaggagcagaagaaattataaacttttagaaaggctacagaaggccaaatgataaaatttagaagactattctatgaataaaagggagaatgaagttaaaatgacacagatcttggatgattgtaagaaaacaaaaatgattctgaagaaagttaaattttaaaaaaataaccaacttaaggacagtatgatggcacatctttgaaatggaataatgtgggcttttatagaggagagaggtaggcatttgaaaggcaaggtttaaatgaagatgactaagatgagggaaccaggtcatgtttagaggaaccagcaatgggaacaggaattcatttcaatccagagatccttcatcctgtatactcagccttctaccactcatagacatttttctaaaaagattgctaggctcgaaccccagagattctgattcagtaggtttggaattcggtttaggtaatgtgcacatacatgcctctgtgtgtgtgtgtgtgtgtgtgtgtgtgtgtgtgtgtgtgtctgtgtgcgtgcgcacacgtgaacgtgtgtctgtgtgtgtgttttaatccactgatgaaacacaatatgagttaaattgaactctgtaccgtagtggcctagaccttataagaatttaaaaagttaaagagaattgacccttgtcttcaagcagtttaaaactgcagtagttaaaaaatgatggacttaggaaagcagtttaaaactgcagtagttaaaataatgatggacttaggaaagaagactttcaatctgttaggtgataagttctcatttgttaattcaacaattttagggggggtgatttttatacactctatccatcccttctcaattgaggttccccatctaaactatcaaacacagaaaattgtttgactgtcttctcaattctcctaagggtggcacaccagctagtaccattctatatgtgtgagagataagttaattcactagatacaaaaattctctcagaaccttttaagaaaggttgggtaatctgtagtctgctaggaatatgtgacacaaagacataaaacgtggctcttaaggtgctcacattccaagagaggggaaaagacatttaacaaaaaaaatgcatttctaatatcaaccacacaattttgttcttttcatctaatggtttgaggaaaatgttcaaagtcacagtggctgtatataaggaaatcctttcacctcttctaagcattatttattcaggaagaagaatgtaataagaatgataaagtctgtattacaacttatcacagctgaaggatgctggcagtaacttaaatgtcgataggaatctctttaattttaaagcctagagcattcagtgacaggttagtgatttcattggtagctattaataaataacagtaactaaaactaggcttattagtttcatagtaaagagtagaaaatgggtataggtaagtagataactaatgtccaataggctgttcttgaatgtaattgcaagcacagtgagagatttttgcccccgaagtacaactcttataccaataatgaaaatgttcaggaatttaatttattctcactatcaattaaaactcactaaaattcctgctgtcagaaggtttagtcatattcattagtttttcttacggatttgattatttctgaactataaatttatttgtgctccctatactgatttgtgcatttaaacttgagagcagttagctttcattcctattactcagtacttcacactgattcctttaggataaactttactaacacatttttccttcttccttccaatttcttaccaaactttattttaacagcacagctatggaaagatcaaggttgtcatgttgagaaaagcacaacaatagaaattacgaccagatttagcttgttttcttagcaataatgaacaattttaaaagattttgctttgcctgcattcattctgaaaaacattttaaagcagaaaaagcagattatgccgatattttaataaggtggaataaaggaaaatataagagtaacataattttattaaactcattttattaataataaatatactttttcttatcttatgatctctgaactcctattttattttgaggaagctgaatttaaaatagagtgctataacgtgtttcctttgtgtgaaagttaatctgagaaggcaaaaggtctatctcattcttactaggcttcaagtcctttatatctaataacaagaaaattctctaaattaggcaactactccctaacaaatcatctattttttcttttagttttttattttctccactgaatgacagcagaatgtattcaagaccttgcaaaggatatggctgaagatgtagcttccttatataaacattttgtggaggtttccataaaatgaagtgaaacttttgtgaagtttcactttttttattttgaatatagataataacagtagcaggcactaataatcagtctcctagtttcttaatctctcttctccccctatttgccctcctaccatcaaatacttcactgttgctggcagaaactaactcatggcacaagagatcaggtgggtgagaaagagatcactgggggaaagtaaattgccccagaaagactgtttggtgcaaagatccttttttcacatgtaacaatctttaattttatgaacatcaaaatcaatacctgaaaagtgcactagttagatatttggaatttttcaaatacaaaccaccaccagactttttgtatttgacttagaatgctttttagatttcttataatatttagtacttatgaagaaatttagtgttttttacttatatcagcaacataaaaactgctcaaatttgattcctcagatgttcaggaatcaaattttctttggtttattcatagccgtagtagtacatgtatatttgcattgtaatcaaaggtggtaatcgccctacagagttcttaagcagaggtcctcaaagaaaatactgtatctcttataagttaaattattttctcatccaatgctttctgatcaaaattaagatagactctgtcagagggataaaatatgaagtctgtttagatatcctgcttctcatgaaggttagtaactacatggtaaggctaaaggccatctgtagaaagcttctcttttaccaacaagaaaactggttttcaaatttctcgttactttctcgttagtgttaagatattaggagcacaccattttgcatatgatatgtgttcaactacagcataaaatgacctttttattgtgaaatgggtattcagtccatattgtaatagaaaaatatatggtcatttaggagaaggaaaagatgacgttcatctttttaataacagagttttaaaataactccttttttactgaacatggaaataatacatgctttttgcaagaaaaaaaagaatttggggaaaatatagcaaagcaaaatgaagttaataaaaacaccaataatctgaacccacaattattacctaagactaattcattaatttgcccaactgggagcacaccatatatactggtttatatcttggttttcttagtaatatcatcccaattattataataattactaaaatgtatagtacacttactgtatgccatgtatttttataagtactttgtatattatatctaatttaatccacacaagcctacaaaataggtaggtaccactttacagataagaaaattatatttagaaagattaaatgattaaataaattgacttggatgtagcaaaagatgatagaactagaatttgaactaggtagtctttactccagatcccttgctcttagccactctccttttcatataatgtaagcttttcttcatttaataactgttctacaaaaaaattgggatttgtcaatcactgaaaaatacttaaaaactatgagtaatttaatttccctatcattaaacatttaggttctttcctatttcctatcacattctctttgtataaattgttatgtatacttctaatgatcactttagaaatatttcctaaaatacaataactcactcaaaattgtgaagtttcatattacatattgctaaattaccctcttagaatatgtacaagtttatgtatttgtactatcagtttatgagactgtatttccattaatcattgttaatcttaccaatctggtaggtgaaaaattgtatttttattggcatattgtagaatattaatcatttttaatcttaccaatctggtaggtgaaaaattgtatttttattggcatattgtagagtaatttaaacactgttcttgaatttattcagttttgtttctccttttataaactgcccaggttttctgttttgttttgtttttggctcagtagctgttcttaaatactgattgtaaccacaaagaggagtgtaaagaattggttgtcaagaaataattttggtaaggtcaaatttatgttttggctgtatcattttgacatataaaccattcattttctcatttctcaaactccgttaacataccagtactcaattattttatcactcatgctcttaacaacacagatcaagccaaaaattatatcctgaatcaaaggcattaagttaataaaatacaaacacatttcttcctaataagttagtttttccctttgtgagattttttcatggctgatgcatgatagtttatgttctaactatccttttcttatgtaatgttcactgttaaataatttacagatagaaacttattgaacttcagtaatgtagaattaatggtctattcatagatataagccctggaaaataatgtataatttggacttttaatacacttagctactattagcagtcattttaaaaaataccaaatataaactcttacacaattattttgcttggcaaactcatttttctatataggaattccaaaggagacattattctagcatgcaattaatatgaattatatttgattatctagatattgaaaccattttataaacttctctgacatgtagagctcaacttcctcttaagcattcaagagaacctatttttttttagttgcccataatatgcaaaccatttcagaacccagagatttttggtgagtgaattaacatgtagtttgtatttttacatggaaactatatgtataaatggttttcaaccagggtaaattttggttccccagggacatttgcaatgcctggtgacatttttggttgttacaattggagggtacctagtgatatcaggtgggtagagcccaggaatgctgctaaacatcctgtagtgcatgggacagtcccggcaataaagaattatctgacccaaaatgttaatgcagagattggaaaaaccctcatgacataatatcgagtacgcactaactgccaggttgtgctggaggctgcgggtacatgggtagaaagttatgatcttactggttaggaaagttacatttcattgtgaaacagaaagatctagattttttaaaggataatttaaatgataatgagattttaaaaatgatatgatattaacatataataatgtaatataattgttatgttaatataatcacattttgttataagaatatataattattgtgctgtggtaattttatgtgtgataaatatatgacatatttaggaacaaaaattctgcctgagggacttacttagttttgggaaactttcaaagaagtgacaagtgatactggcactgtttttgttgttgttgtttttattccttaccttttatttaatttacaaaaaaaaaacccacaaatagtaagttacaccataatggattttcaaaaactgaacatatctatataaccatccagatcaagaaaccagaatattatcagtgtcccagaaaatggcccttgttcccccttacagtcacagctcaatcctcaagtgtaactacaactttgacttttagcactacagattactttttttttttcaaagacaggagctccctctgtcacccagactggagttagaattacttttgtgttttaccgaactttgtataagtggaaccatataatatgtaatcttttgtgtctggattcttttgtttagtgtcatttttgtaaaattgattcatattatttcatgtagtgttgttcattctcataactatattgtataatacagctatatttattaacccattctactgtaaaggcacaatggctgaaaccgttaagttgacaaataggtcagtttggctgcagaatgggttttgagggagtggcaagagagagctgggaaaagtaggtaaggtcagatgatggaggatacctttgtcatattaaaggcatttggatttttttttctattaagaaatgagatttttcaaaagatattaaacaaggggaaaatataatgagacttgcattttagaaagaccattttgacagcagaatagaatgggttgagtgggagcaagcttagctgtagcaccaatcaggaggtcattggaatagttcagataaaagatgctgagaacctagaagtagacagtgtaggtggggatagaaagggacatatgattttctctggatagaattaattgcacttttggaataactgagaataagggttgcaaagactagttttctgagccaaccttcaaagcccgtgtgtattactaaaatgcaaaatgtgtgcaataaagaaaaataatagaatttaatgttagaatttaaagttgaattcaaaataattttcaaatgtatctttaatgtttgaacttacagaaaaacagatatcattagttgagaataaattaataaaaatctttatggataatctgaaggaaacttggcaacagtctagactaaaggttaatagtactggccacttgtttgttttcatttcaatttttaaagtatggctttctcttttgttgtttcaggatatcactcatggtacattttgccactattacggtagctttcagttgaggagggaaaaaaatgtgtgtgtgtgcgtgcgcgtgcgcgtgttcacctgtgcacacattcacgcgctaaatgcaggagttgagagaagaaaggaaagggggagttaaaatattgcatatggatgaataagaagaaaagtgtcttaagcagaatgaacttagttccctgttattatttctgggtggggaaattgctctctctttttattttgtttgtgcatgcatgcctaaggagaataaaggcactcagaaagttcccccatagtcaccgggtgatagcttcatttcaaagatgtatcgttttctatctgagacagtagtcaagctaattgtctctttgtgacctacagaatgccagcaattagcttttgataaaaagaacagtgcctatcaatgttttcaaagatgaagaattctgacataaaaaataaaattagtgaactctcatttgatggtaattacacctgttgtctattgactaaagcaaatatgtgatactttttaaaattatggtcaattctgtaagatttttagatgaatttgtatcttattataacatctatattcattaaaagctctaatacacataaatgagggtaatttattcattgtataatcagtgctttttgcattaattggtgaaaggcttctaattgctctgatatacctcagggtctgtcctccacaaatgaagaaccacaggcacttgatttttttgtttgtttctgttgcatttggggaacatctgtattaggtccaaattttagtgaattctaaattttatgctttcaattaatgattttattgtagatttttaaaaatcaagtaaagagtaatctttatactaatttattttgaaaatgtcagattttgaaaacaacagaccaatgtaacactgagtaaagcacatctgcatttttaatttttaggaagaaatatggattccttttcttgtcacatttattacttaaaaaaaataaagtatgcctgttaatcttcaacacagattcaaagatgagaatagtatgtattagtctgttgtcatgctgctaaagagagacatacctgagactgggtaacttataaaggaaagatgtttgacacacagttccacatggctggggagacctcacaatgatggctgaagacgaatgaggagtcatgtcgtacttggcagcaggcaagagagcttgtgcaggggaactcccatttataaaaccatcagatctcatgagacttattcaataccacaagaaccaatgggggaagcacccccatgattcaattatctccacctggccccgcccagggcacaaggggattattacaattcaaggtgagatttgggtaggggcacagccaaaccatatcatactataatggcaaaaatttaaagaatcaaggagctaccttgctttgtatttgcttctacttttcttcatcagttttatcaaaaacagattttggcactgtatttttacctccataatttgagtttttactgaaggatccttgagagtattaaaagcatggcaattagctagaagcaagagttctttttctattttgccgttagtttatctgccatattccttatcatatcattttatcaccaaatgaagtcctaaaatcaacaaatgagaaacttttaaaagtactttgacatcatcttgtattcaatcaagaaaatattgagactttactagttttaagtgagaaagaattaaaagtattagttgtggcaaagatttagtcccttaacccgaatatttgttaaaatcaaagaacaaaataacctatctaatcactgcaaatcattcttatctaaatgttgccatcacaggagtagccaggtatcattagtgtaatcttcagtctcaatacccttcagtcatgagtccaataactcaaacctcatttcaagttcacattccttttatcccaaataatggaaaaatgggaagaatagtaccctttcttttttgtctaagctattaactgcatatgcctgaatggaagatgacagcaactataatatgagacacctattttcccaatgagaagatccataaatggggggattatccatcttaaatgtacatacttttagcaatttagataaaatagtggaacacttaggttaactaatttaaaacacaaatataaatttaaagccacattgaaaatagtatattatttaggacaactgattctttttcatggcaattttttgaaaggtgttatgcaaagtctcaacatataccattaacatcaatgtctttattatcatttccagagtctaagtaatttaaaagttttccatgctatatcatcttttgtttaacagctctattgagatataattcacatatcatacaattcattcattgaaagtgtaaaatttaatggtttttggtatattacatttattttctaaattgtggcaaaatatgtatagcacaaaacttgctattttagcctttttttttttttttcttctgagacgtagtctcactctgtcacccagactggagtgcagtggcacgatctcagctcactgcaacttctgccccccggattcaagcgattctcctgcctcagcctcctgagtagctgggattacaggtgcgtgccaccaagcccagctaatttttgtattgtagtagagacagggtttcaccatgttagccaagctggcctccaactcctgaccttaggtgatctgcccaccgcagcctccctaagtgttgggattataggcatgagccaccgtgcctggccctaatttagccatttttaagtgtacagttcattggtattaattatattcacaatgttgtacaattatcactactacctgtttttaaaactttttcatcaccccagaaactctgtaacctttaagcaataactccccatttcttccttcccataatccctggtaacctttaatctactttctatctttataaattttcctattgtaaatatttcatgtaagtgcagccacacaataattctccttttgtgcatggcttttttcatttagcctaatgtcttctcagttcatgcatgttgtagtatatatcagaactttattgctttttatgcctgaataatattctattatatgtaataccacaattcatttatccgttcatcttttgatgaacacctgggttgttttcatcttttggctatggggatagtgctgttgtgaacattggcaaacaagtatatgttcaagttcttgctttcatttccattggttatgcacttaggaatggaaatgtgggatcatatggcaattctgtgtttcacatcttaagaaattaaactgtttaagagttttatggttttagttcttatactatagataaagaactatagttctttatactatagatctattttgagttcatttttgtatgtggtgtgaggtacgagttcattcttactgcttaattatgaatacatggaatttaaaatttttctatttaaagatattactggaaatgttattccaagcctgaagtagccatttgcctaacattaggacacttaccattttcttttatcctgtaaagatatcctaacattcacaatataaccacatacaatattgctttttattaattatttctgacaggtatcttttatatccaaacaacactagtattgatgaagagatcttttaggcttgtgggccttcatcaaacagtactttttgatttaaaaaaagtgaattcagtaaaatatgcgaggccttataacagttcaaatgtaaggcaactaactgttctttgctgatgagtaactttggtttaaaaaaataacttgccatatggaagttaagatgtgggaacatgggtttgattttgtgctattcatgtatattggaggtgatctcaactctgtgctaattcaaacaatttatatttccaggtaaaaataaactttagaatttgtagaaaattcatatgctagtgttgcatcctgaaattattatttgtctccaaattaaagtgaaaagtgattcaatagagaaacaccttgattccccatatctgtcagttgataaagtagctattgcagaattctacaacagagagaaggaagagtgagatagtaaatagaagagtagcgtttatgagttcaattaaaactttaaagaacagataattcctgtcttatttcctcattatttaaattgtatctaaacacaggatgaagaaaacatctgaactcaatctataaagataacaaaaccttcataccaaagtggaataaaaataacaaggagactatagacctaatcatatgtgaaaatatatgtagaaatattgaaataatatgcaaaaacttgatacagcatcaagttttttctaaatgtacacctcttcctaagcgaaactgattttaagaattcaagaacggtaaattttagacatcctttaatttcatttttatcattattaggtaaatcacaaaagattatatggtcatcttgatgtatgccaaaaagacataaaattcagtgtatttttttccttctaaggatacatagtaaactagaatgaaagaaaaattttaaacatggtaaaatgtgtttatcacaaaaaccaacaaatacaataaagctgaaacactggataaattcttactaaagacagaaaaaagaaaaagatagttacagtcaccattatttgttctagaaagtctaaccagcacagacagtttgggcagtcagtaatatgtgtcaaaaatttgaatgtaatgatataattacatagagagattatatgatggaaatatgagaaaagatatgaagaatgaaatgagaaggtccaaagtacattatatcagagccccaaaaggaaaaaatagaaagaataaaggcaatgatcaaagagataatgactataaagtttacagaactaatgaaaaaacacaaatccagaaatcctaacggtatagtgtatctcaagaaggataaataaaagaaatatgtttctgaacacatgggaatgaaatgtcagcactaaagtaagggaactattgaaagtaaccagggagaaacagcagatcacttacgtagaaatgacagcaggcttttcgacaacattggaataaaacagacaatagaacatgtaaagcattgaaggaaataacgagaattgtttattaagcaaaatatctttcaagaatagagataaagagggagtaaagcaagttggccaaataaaaggctccaccagtcataccccaaacaggaacaccaaacttaacaactctccacagaagaaaagcatctttatcaaaaccaaaaaacagatgagcagttatagtacctggttttaacttcatgttgctgaaggagacactgaaagggataggaaacacagtcttgaattaccaacaccacccctccccagtcataccccagcagcaactggctgcatggcatggagagagaatctgtgcatttgggagaggaacagcacagtgattgtgagacgtagcattggacacagtgctgccctgtcacagcagaaagcaacaccaggcttaactcaactgaatactgcccatagagggaccatttggaccagccctacacagaggggaaccactaatccctgcgattggaaagtgagttttggcaagccttgccaccacaggctaaagtcctttgcagcccaaaataaatttgaaaggcagtctgcgctccaagaactacaattcttgggcaagtcctagtgctgacctgggctcagatacagtgggacgtgggggcacatgacctactaagacaccagccaggacagctaaaggagtgcttgcaccatcccttccccatgcctcaggccacatagctcacagctccaaaagagaccccatgcttctgcttgaggagagggaacagtaaaggggactttgtcttgcatttggaaaccagctcagccacagtaggataggacaccaggcagagtcatgaggccccctttccaggccttagctcccggacaacatttctaaacacaccctgggccagaagggaacctgttgccttgaagggaaggactcagtcctggcaagatgcatcaacttttgactaaagagaccttggatcctccaaggtccagcagtgatacccatatagtatgccatgtgccttaggtgagcctctgagacatgctggcttcaggtgagacccagcacattcctagctttgatagctatcgtgagagactctttctgcttgagaaaagcagagaaaaagtaaaggggattttgtcttgcaccttaggggagtagagcaccaagtgggctcttggggacctgatttcaggccttggagcttggacagcatttctgaacctgccctgggccacaggggagtccactgccctgaagagtgagtcccatgcctggcagcattcaccacaaactgactgcagagcccttgggcctaaaggaaacatcagtgttagcctgacagtactccccttgggtctgttgtggtggtggccataaggtgaggctcctctgcctgtggaaaatagagggaagagtgggaaggactgtgtctcatgatttgagtgccaactcagcttcagtaaaatagaacaccaggtaaatgtctaaggttttttttaattccagtccctcgctcccagacagcatctctggacctaccctgggctgggataactcaacaccttaaagggaaggacacaagcctgtctgacttcacatctgttaatcgtacagccttagtgccttgattgaacatagacagcagccagatagtggttacagtaggccttgggtaagacccagtgctgtgctggcttcaggtctgacccagctgacccatactactggtgatggccactggtgtttgtatcaacccaccatccccagctccggaagcacagcacagagagagactccatttgtttgggagaaaataagagaagagaacaagagtctctgtgtggtaatacagataatttttctggactttaaccaagaccaccaaagtggtatctctgcaagtctgcaagaactatagcattactgggcttggggccgaagtcccttcaaatacctggaaagcctttctgagagagacaggtgccaacaagcccagattgcgaaagctaataaatacctaactcttcaatgccagaaacactgacaaacatctacaagtatcacgatcacccaggaaaacatcacctcacactacaaactaaataaggcactagggaataagcttgaagaaacagagatatgtgatcttttagatagagaattcaaaatagatattttgaggaaactcaaattcaagataacacagagaaggaattcagaattctgtcagataaacttagcaaagagattgaaataataatttaaaagaaacaaacagaaattctagacatggaaaatgcaattgacacacccaagaatgcatcagtctcttaatagcagaatcgatcaatcagaagaaagaattagtgagcttgaagaaagactaattgaaaatacacagttagaggagacaagaaaataaaaaaggatgaggtatgcctacaaaatgtagaaaataggctcaaaagggtaaatctaagagttattggccttaaagaggaggtaaagaaagagataggagtagaaactttattcaaagggataatatgagagaacttccaaacctcgagaaaaatatcaacattgtgcaagaaggttatagataacactaagcagatttaactcaaagactacctcaaggcatgtgaataattaaactcccaaaattcaaggataaagaaagaatcctaaaagcaccaagagaaaagaaacaaatgacatacaacggagctctactacatctggcagcagaggtttcagtggaaaacttacaggacaaaagaaagtggcatgacatatttaaagtgctgaaggaaaaaagttttgctctagaacagtatatctggtgaaaatatccttcaggcatgaaggagaataaagactctcagacaaacaaaagctaagagatttcatcaacaccaagatttcatcaacaccaaacctatcctacaagaaatactaaagggagttcttcagtcttaaagaaaaggatgctaatgagcaataaaaaatatcatctgacagtgcaaaactcactggtagtagtaagcacccagaaaaacagaatattttaagactgtgattgtggtgtgtaaactactcttatctcaagcagaaagactaaataataaacgaatcaacgataataaccgcaacaacttttcaagacgtaataagacataaagagacacaacaaaaagttaaaaagcggggacacaattaaagtgtagcatttttatgagttttctttttgcttatttgtttctatatgcaatcaatgttgtcatcagtttaaaataatgtgttatagtatttgcaagcctcatggtaacttccaatcaaaaaaacctacaatagctacaaaaaaatatataaagcaagaaattaaaacataccaccagagaaaatcacttccacaaaaaggaatacgggaaggaagaaaagaaggaagagaagaccacaaaacaaccagaaaacaagtaacaaaatggcaggtgtaagccctttacttaataataacattgaattataaatggaccaaactctcaaatcaaaagacagagtggctgaatgaatgaaaaaacaagactcaatgttctgttacctgtgagaaacacagttcacctgtaaagacaaatataaactgaaaataaaaagatggaaaaagatattccatgccagtggaaaccaaaaaagagcaggagtagctaaggcaaaatagttttctaaacaaaaactgtaagaagagacaaagtcattatataatgataaaagggtgaattcagcaatgaacccaatgctggagcatacagatatataaagaaaatattattagagctaaagagagagatagattccaatacaataataactggagacttcaacaccctactttcagcattaggcagatcatgcagacagaaaatcaacaaggaaacatcagacttaatcagcactatagaacaaatggacctaatagatgtttacagaatattttatccaatggtggcagaatacacattattctcctcagaacagagataattctaaaggatagaccatatgttgggtcacaaaacaagcctcaaaacattcaaaaaaattgaaatgatagcaagcatcttttctgaccacaatggaatacaactggaaatcaataacgaggaatgttggaaactatacaaacacgtggaaattaaacaagatgctcctgaatgatcaatgggtcaatgaaggaattaaggaaactgaaaattttcttgaaacaaatgaccaaatatgccaaacataccaaaacatatgggacacagcaaaagcagtactgagggaattttatagctataagtgcctacatcaaaaaaaggaaaaaattcaaataaataacctaatgatgcatctcagagaactagaaaagcaagagcaaacaaaacccaaaagtagtagaggaaaagaaagaataacgatcagaacagagataaatgaatttgaaatgaaggaaatacaaaaagatcaacaaactggaaagcttgttttttggaaagttaagcaagattgacaaacctttaaccagaataactaagaaaaaaggagagaagatacaaataaacaaaatcaaaaatggaaaaggagtcattacaattgatactgcataaagtcaaataatcattagtggctactatgagcaactatataccaaaaagttagaaaacccagaagaaatggacaagtttctagacagatacaacctatcaaggcttaaccacaaagaaatccaaaacctgaacagagcaataacaaatatcaagattgaagctgtaaaaaaaagtatcccagtgaagaaaagcctgagatccaattccctgctgaattctacagaacatttaaggaagaactaataccaatcttactcaaagtattccgaaatacaaggaggagggaatacttccaaactcattctatgagaccagtgttaccctgataccaaaatcaggccaagacatgtaagaaagaaaagaaaagaaaattacaggccaatatctctgatgaatattgatacaaaaatcctcaacaaaatactagcaacccaaattcaacagtacattaagatcattctcataaccaaaagggattcttggcaagcgtacaaggatggttcaacctacatcatacatcctatcaacagaatgaaggacaaaaactatatgatcattttacttgatgctgaaaaatcatttgctaaaattcaaacttgctgcatgataaaaatcctcaaaaaaactgggtgtagaaggaacatccttcaacataataagagctatatgcagcagacccacatctggtatcatagtgaaatgggaaaaactgaaagcatttcctctaagatctgcaacatgacaaagatgcctactgtcagcactattattcagcgtactactggaagtcccagctacagcagtcagagaagagaaagatataaagggcatccacattggaaaggaagaagtcaaattattcttgttttcagatgatatgatattatatctagaaaaaaactaaagactccaccaaacaactattagaactgagaagcaaattcagtaaagtggcaggttacaaaatcaacatacaaaaatcagtagcatttctatatgccaacagtgaacaatctgaaaaagaaaaaaaaaaaagtcccatttacaatagccacagagaaaattaaatacctaggaattaacttaaagaagtaaaagatctctataatgaaaactgtaaaactgatgaaagaaattgcagaggacaccaaaaactggaaagttattccatgttcatgggttggaaaaattaatattgttaaaatgttcatactacccaaagcaatctacagattcaatgcaatccctatcaaaacaccaatgacattcttcacagaaagagaaaaaaaatcataaaatttatcaggaaccgcaaaagacccagaataaccaaagctatcctaagcaaaaagaacaaaactggaggaatcatattacctgacttcaaagtatattatagagctatagtagctaatacagcatggtactggcataaaaacagacacatagaccaatggaacagaatagagaatctaaaaataaatttatacacctacagtgaactcatttttgacaaagatgtcaagaacatgcactcaggaaaagacagtctcttcaacaaatggtgctgggaaaactgaatatttatatgcagaagaatgaaactagacccctatctcttgccatacaaaaatcaaatcacagtagattaaaaacttaaatctaagacctcaaaactgtgaaaccattacatgaaaacattgaggaaactctcctggatattggtctgtgcaaaaatttcttgagtaatatctcataagcacaagcaaccaaagcaaaaatggacaaatgggattacaaatttaaaagcttctgcagagcaaaggaacaatcaacaaaatgaagagagaacccacagaataggagaaaatatttgcaaactacccacctgacgagggattaataaccagaatatgtaagaagctcaaacaactctataggaaaaagatctaataatccaattaaaaatgggcaaaagatctgaatagacatttctcaaaagaagatgtacaaatggcaaacaggactatgaaaagatactcagcatcattgattatcagagaactacaaatcaaaaccacaatgagatatcatttcaccccaattaaatggcttttatccgaaagacagggcataacaaatactggtgaggactagagaaaagggaacccttgtacaccattggtaggaatgttaagttagtacaaccaccatggagaacagtttggaggtttcttggaaaactaaaaatggagctaccatatgatccagcattcccactgctggttatgtacccaaaagaatggaaatcaaggccaggtgcggtggctcatgcctgtaatcccagcactttgggaggccaagacaggcagatcacctgaggtcaggagttcaagaccattctggccaacatggtaaaaccctgtttctactaaaaatataaaaattaaccgggcatggtggcacatgcttggaatcccagttactcgggaggctgagacaggagaatcactgaaacccagcgggtggagattgcagtgagccgagactgtgccactgcactcaagtctgggcaacagagcgagactctgtctcaaaaaaaaaaagtggaactcagtatttccaaggaatatctgcactcccatgtttctggcagcactgttcacaatagccaaggtgtggaatcaacctaagtgtccatcagcagatgaatggataaagaaaatgtacatctacacaatggaattctatttggccatataaagaataagaacctgttatttccaacaacatggatgaaactggaggtcattatgtttgtgaagccaggcacagaaagacaaacttcacatgttctcactcatttgtgtgagctaaaaatgaaaacaactgaacgcatggagatatatagtagaaggatgattaccagctgaggatggtagtggggaagtaaggggactaagtataaaaagtagttagaaaaaaatgagtaaaacctggtattggatagcacaacaggatgactgtagtcaataataatttaattatatatttttaaataaaaaatataattggattgactaacacaaaggataaatgcttgaggggatggatattccatataccatgatgtgattattatgcattgcatgcctttatcagagtgtctcatgtacttcccaaatttatgcagtacctactgcatacccaggaaaattaaaaatttttcaaattttttaaactaaattattcaaagaagattacaaaaagtctgatagtctctgggcaatttgtgttaatacaaaaaaaattaaaaccaggaaagaaaaccctgagagatcaggagataacatactcttcatagagatatgaagcatttctttgttttctgtgctttcttagaagcaaacctgattaggtacagaagaagcctatatatgtccttattacagtgttgagtaaaatgtcagtttccatctatcgcatttattgttcctgatttgaataccctcttctcttggatacttaatttttattctgtgaaaagaaatggaagagaggatctgagtttaggttattcataatcatctcaatataaaatagtattgcctgcttacaaaatctttcaagtttattttggaagcctaaatttttaaataatttttgttgattaattcttaagtttggcttggctcttttattacctgagacactcttaagtgtataactttgaaagcataacattgaacatcaaggtagcatcaaaggaggaaatgtataaatgtgcagtctcagtagtgtttttacgtatgtgtgtgttagtgggggtagtcatttctacccattctgaccaggtaattaagtgtggttggtgccagtagatacaaccagtttcttctaccccactcccaccagctgccctaataaagtcacttttcagttgcctgttgtccaaacctgaaaaacaatcccaatcctagggtgtatagtattattaactatagtcaccatattatgcattagatttcctgaacttttttcctccatatctacatatcaacttctgaagaacaggaatgagtaactcttttttttaacgtaggttgaaagacatacctagccaatattctaccattaacgaatacatacatattccatatataaaaatgttaacaatccataggaatatcaatattctttcatcttttcctggaatgagatacaaagtagtactgtttatataagtggaatatgaagatacgtattctcatgaaaatctcttataaaaagtgatttgttcacctgagtgcccaagttttatggttagataatttaattatcagattaatgtttagataaaagttattgaaaaataatatgtaaagagaaaagttgtgatgctaacgagtgttcactgctatgtacttgagttggttcttgaacaggggttgggatctaaatgttagcaaatacagtgagatttttcatagttaaagtgaaaaaaacttgaaaatctttcaaatacatattaatctcagtaagccaaacaaccagtttttaccccagcattgaaataaattctttggttgaattaggtaaattggttggcatgctttataaagaggaataattacctttaaacattagaaccttagctggcacagcaattcattaaccattggaactgaggtaaactgtgaaaactaccaactcagacaccatttcatgctcactgcaaagtatatgttcattgaatggaatggaaaacaaaatgcctgcagtatgtaaatttgtactcttttcttcctgtgtccttcctaccatggtactgtctcctttgacctttcatcacaaccagatcttatttaaatattgtacaatttgaactgaaaaaaaaaatggagcatcttctcttcacatgaaacgttatctgcttcttccaggaattgaagaagatgtaaatatttaagaatattaaaaccccaagaaaagatgttcattagcaataagataatatctctcaagtaaaagtgagatgccttttacaattaccttgatttccagattgcatcttctctgtgtagcagtagtctttgaccatttggttgtattattataagttgatgtggttatgattgtttgaaagttgtttgtaactaaaataaaaataaaatctgtaaatgaatggttttaattaattagactaaattcgagactgcttttacaataatgtgactcttacttccgttctgctctgtttcttgaatgagaaaaaaatagatttataacaagtactccttgaacatccttgggagtttgtcgtggatgtaacttttatccactacatgatgtcccaagaaaaatattttaaggatacctactctgtaccatagaatacttataggagcagcctcagaattgttagtttattataaccctttttaaaaatgtaaaatgaaattaatgtgtttgtcctttaataagcagaagtcaggaaaatgtaactggctggcattaaactgcctatttttacctaatttatctcctcactaaatctatattctgttctgatgaaggattctcacatttatgtcagtctacaaagttgaacataaagtgattataaagataagaccaaatggtacatattgtcattaatctacatcattccttccatcagcagtatgtttttcaaagtatggtcttctgaccagcatcagaagcgtcacctggaaacttgatagaaatgtaaattttcacctggaaacttgttagaaatgtaaattttgaggcacctagacattctgaatcagaatctctggaagtggggcccagcaatctgtattttaacaaggcttctagaagattctgatgcacactaaagtttgagaaacactgctctaactacatctcactttgataacttaacaaagttattattaatagtagtcattagctggtatttcaaagatagtctttgttatttatttaagattatttaatcagcagagggcactgcagtaattgttaaggaggaaattttattaaatctacctaatcaggttacaagcacatgagtactaatatataaatttgtctgctctgttaataaaatcatgtctataaaaataagtgaaagcactatactaagtgatttttcacagagtcactatgcatgtaaagtatttctgcacatttagatatatctattatatgttctttacgggtttttttaagacagagtctcactctgttgcccagactggagttcaatggcacgatttcggctcactgcagcctctgcaacccgggttcaagcgattctcctacctcaggctcttgagtagctggaactacaggggcatgccaccacgccgggctaatttttgtatttttagtagagacagggtttcaccatgttggccaggctggtctcaaactcctgacctcaagtgatccgcccaccttggcttcccaaggtgctggaattacaggcatgagccaccatgcccaaccatatgttctgtacatttttaaacatcattgtctgttagcaatatcttttttaaggtcatttttcctatgaagttaaaatatgaacaatttcatcaacaagatacctgaattactgaatcattgtttttgacactgtttttacagcttagcagtctttgaagcgtctttctgactttaatgttgtcctcaaagtatcaagaaaaaaaaaggaaaagatcacaattatgtgatttttcacagaagtttgcaactttcatattggaaaaatatttagacgtcaaagataaatattttatttaaaaagaatagctaagtccaattaaacctttatattttagaccgactagttcagaaatactgatacctgaagtaagactataaatttctaccatctttcaaggaataaaagaatctggtaatcaaattaataatgtataagagggaaacagaactttaagctagttaaggaaaaaatggtttcaagcttttaatggcatctttttgccattgataatgaacagtctgttaataatgaatacttgtgttatctattcattaacagatacagataacctttatttgtctgtattgtactagcatatgtgattgaaagtgataaagctacattcttcaaaccattcttctgttcagattttctaataaacaggtatctttctcttgttatatttgtaattaagttttattctcttattctttgttttctagttgcatctccccatttatagtttacaggtctttgtactcagctcttgctctcttgtccatcttccagtccccatctcattcgctgcctgctccctagtttagatccctaatttcagtattctacttcctacgtggcatttgccagtgctcttgcatctgggttcttgctctccattctctttttcctagtctttggttctctactactctttgcaggtagtttctggatttttgtattatttctgttctctaactgatatgtgcagaactgcaaggatgtaagaagaattggaaagtagaagcatagaaagagctaacatgtattgaatacctattctatgctaagtgatttatcatttagttctcagagccctcttataagatgtaggtatgttttattattacctccattatattcataagtactctggaaacttaggttaaatattttattctaattcacatagcaaaactacatagtaaagccaagtttcacatctagattggtttatttattccttcacttctttattcaacaaatatttgttgagcacatactatatgttgggctccgaactagatgctgaaatagatccagctcctattgttattgcccttaactgtgtaatgtcattttctgacttcatagatgatgatcttttactacaccaaacagcttaagaggaagagaaaataaaaggaaaatagaagggttctaatgttttatgtaaaatgtttgatacaaacgtgagaaagactgtgtttgtgcttgatttaagaataccctattgaaaagaacagtttgtatctagcatagagagtctgacatccacctaccccaaccaactcaccaccatcagcatcaatgcctttcagtggcatcaccatgatatattttttcttttatgttctaaaacatataaggtttgtgtctctatgcccaaattcttcagaagatcttcagaaagaattaactgtcctgcctgaattatgtttagagaaagatgaagaactttgtaaagaatacagtcagccctgcagaacccctaactactgtattttcgatcctcagttgattgaatccacagatgttgaaccagcaatatggagagcaactgtacctacactgtgatccatccatctatatatttttataccctgaaaaatattttagatggcttacccaaatacataaatacaacagaatttttaaaaatataaatgtgaagagtaggacagagaaaaatcagatgaaactaaagttgtgttcagtaagcctactgaaaggtattcacaaatttgttctcaaggataacttgattcacaagcattgtaatttaaaaacaaactggtaacatagaaaagtatccattcctagttatgatacttgaaaggaaatttctcctgtaggtcctcctaaagaccacagtgtaatacggtgaacaattcagatgcttcctaatgtaaataagagtttgagccattttattgattctgatttcataccacagaagcaaagcccaataaaccaattctataaaaagtgaaatgaggcattcaaagtagatcactctccagtggtctggcaaaatccagtggtatgttttagaggatttagaaaaattaatgaaccacatctcttttaggcaattctcacgtatcatttgtcaattgagtttttcatgtgctgggtgacagtgagcttacacgctctctgaggtttgttctactcactactgtaacatcaatacctcagatactacctagtacatagtagatgcttaataaatattcgttatttaaatggataaatgttgtgctttgaagtatcaattttaagtgaaatactccctttcagctatctgttgatatttcccttcatgtccctgaataaagtgtgctactatactttgggatatatcatctttatgtgaagccccgaattcatgaaatgtcaaccattgcttatataactttttcaagcaagtaatgaaataaatattaacactatccaagaagttcctttaatattgttaacagtgacatccccttgcttgatgtttagggctctgattttaacatccttgagaaggtgttaacctccataaagcaatttataacatagaagtagtgtttcgtcttggtaagtctcaaaatcataacagatagattggctttggaaaataagtaataaagattggataatgacatggatgaagctggaagccatcattctcagcaaactaacacaggaacagaaaatcaaacactgcatgttctcactcataactgggagttgaacaatgagaacacatggacacagggaggaaaacaacacacactggggcctgtcggcggggtgagggggaaggggagggagggtattgggacaaatacctaatacatgcagagcttaaaacctagatgacgggttgacaggtgcagcaaaccaccattgcacatatacctatgtaacaaacctgcacattctgcacatgtataccggagcttaaagtaaaatttaaaaaaaaatttaaatacgtaaaaaaagatgggataatgccagcaaagtccttacgtttttgttagtttttctttaaaatgtctcccattgttaaatatcctgttatgctaggattcactgtaccagtaaattgcatcaattctgctaatcctgtattctgtataattggaagggattaactaatttatatgcgttctaaactttatttataacatcaattagcatctaatacatacctgatgcattttaactgcttttgcccagagctacaatcttattgaagagtagcattctactttcaaagaaatattgaaatataaacctttctctctataccttcataatttactttttgtttgcctttctacttatttactgtaatacttcattttgcaaactttatttttgtattgcttccaactattataacttgcttaatttttggaaacagaggactggaaatggattaagtcatgtatttcaccctcaagttttagcctaaaatgtatcttgaccattatacagtaaaatatatacctattttgattgacccttcaaaaatgaaattttcttgtctttaggaaaatttaggagactttaggaaaatgaaattttcctttcattagtgtattccagatttaactgtacttatcttaagaatgccgtatcctccaggcatggtggcttatgcctgtaatcccagtactttgggaggatgaggtgggcagatcaccctgaggtcaggagttcgagaccagcttggccaacatggtgaaaccccatctctactaaaagtacaaaattagccaggcatggtggtgcgcacctgtaatcacagctactcggaaggctgaggtaggagaaacacttgaacccgggagacggagtttgcagtaagccgagatcgtgccactgcactccaggcaaaaagagcaaaactttgtcccaaaaaaaaaaaaaaaagggtgccctatcctaaaactcctagtatataggtaaaccccttcacatcattaattttttatttaaaaaagacggttgggcaagatggccaaataggaacagctccagtctgcaacgcccagcaagatcaacgcagtaggcaggtgattgctgcattttcaactaggtacacggctcatatcgttgggactggttagacagtgggtgcagcccatggagggtgagctgaagcagggtgaggcattgcctcacacaggaagcactagggatcagggaagtccctccccttgccaagggaagccatgaggaactgtgcattccggcccagatactatgcttttcccacagtctttgcaaaccgcagaccaggagattccctcgggtgcccacaccaccaggaccctgggtttgaagcacaaaactgggaggccatttgggcagacaccaagctagctgcaagagttttttttcataacccagtggcgcctggaatgccagtgagacaaactgttaactcccctggaaagggggctgaagccagggagcaaattggtctaactcagcagatcccacccacacagaacccagcaagctaagatccactggtgtgaaattctcattgccagcacagcagtctgaagtcgacctggggcactccagcttggtgtggggagggggcgtccaccattactgacgcttgagtgggcagttttcccctcacagcataaacaaagcagctggaagttcggactggacagagcccaccacagtgtggcaaagctgctgtagccagactgcctctctagattccttctctctgggcaggacatctctgaaagacaggagccccaggcaggggcttatagataaaactcccatctccctgggacagagcacctgtgggaaggggcggatgtgggcgcatacttaaacttagttccttcctgccagctcctaagagagcagcagatctcccagcacagggctcaagctctgctaagggacagactgcatcctcaagtgggtccctgacccccatgcctcctgactaggaaacacctcccagcaggggttgacagacatgtcatacaggagagctctggctggcatcaggtgaatgccgctctgggacgaagcttccagaggaaggaattggcagcaatctttgctgttctgcagcctttgctagtgatacccaggaaaacagggtctagagtggacatccagcaaactccagcagacctgcagcagagaggcctgactgttagaaggaaaactaatgaacagagaggaatagcatcaacatcaacaaaaaggatttccacacagaaaccccatccaaaggtcaccaacatcaaagagcaaaggtagataaatccacaaagatgaccaaaaaacagcacaagaaggctgaaaattccaaaaaccagaacacatcttctcttccaaaggatcacaactcctcgccagcaaggtatcaaaactggagggagaatgagtttgacaaattgacagaagtaggcttcagaaggtgggtaataaaaaactcctccgagctaaaggagcatgttctaacccaatgaaaggaagctaagaaccttgaaaaaaggttagaggaattggtaactagaataaccagtttagagaagaacataaatgacctgatgtagctgagaaacacaacacgaaaacttcatgaagcatacacaagtatcaatagccgaatcaatcaagccaaagaaagaatttcagagattgaagatcaaattaatgaaataaagcatgaagacaagattaaagaaaaaagaatgaaaaggaatgaacagagcctccaagaaatatgggactgtgtgaaaagaccaaacctacttctgattgctgtacttgaaagtgacagggagaacagaaccaagttggaaaacactcttcagggtattatccaagagaacttccccaacgtagcaagacaggccagcattcaaattcaggaaatacaaagaacaccacaaagatactctttgaggagagcaaccccaagacacataatcatcagattcaccaacgttggaatgaaggaataaatggtaagggcagccagagagaaaggtcaggttacccacaaggaagcccatcaagctaatggcagatctctcggcagaaacccaacaagccagaagagagtgggtggccaatattcaacattcttaaagaaaagaattttcaactcagaatttcatatctggccaaactaagcttcataaacaaaggagaagtaaaatcctttacagacaagcaaatgctgagacaatttgtcatcaccaggcctgccttacaagagctcctgaaggaagcactgaatattggaaggaacaactggtaccagctactgcaaaaacatagctaattgtaaagaccatcgacactgtgaagaaactgcatcaactaaggggcaaaataaccagctagcatcatgatgacaggatcaaattcacacataacaatgttaaccttaaatgtaaatgggctaaatgcccccaattaaaagacagactggcaaattggataaagaatcaagacccattgatgtgctgtattcaggagactgatctcacgtgcaaagacacacataggctcaaaataaagggatggaggaatatttagcaagcaaatggaaagcaaaaaaaagcaggggttgcaatcctagtctctgataaaacagactttaaaccaacaaagatcaaaaaagacaaagaagggcattacataatggtaaagggatcaacgcaacaagaagagctaacctaaatatatatgcacccaatacaggagcacccagattcataaatcaagttcttagagacctgcaaagagacttagactcccacacaataatagtgggagactttaacaccccactgtcaatgttagacagatcaacgagacagaaaattaacaaggatatttaggacttacactcagctctggaccaagcagacctaatagacatctacagaactctccaccccaaatcaacagaatgtacattcttctgagcaccacatcacacgtattctaaaattgagaacataattggaagtaaaacattcctcagcaaatgcaaaagaactgaaatcataacagtctctcagaccacagtgcaatcaaattagaactcaggattaagaaaatcacccaaaaccgcacaattatatggaaactgaaaaacctgctcctgaataactactgggtaaataacaaaattaaggcagaaataaataagttctttgaaaccaatgagaacaaagacacaataaaccagaatctctgggacacagctaaagcactctttacagggaaattcatagcactaaatgcccacaggggaaaatgggaaagatctaaaatcaacaccctaatatcacaattaaaagaactagagaagcaagagcaaacaaattcaaaagctagcagaagacgagaaataactaaaatcagagtaaaactgaaggagatagagacacaaaaaaccttcaaaaaatcagtgaatccaagagctggttttttgaaaagattaacaaaagagatagaacactagccagactaatgaagaaaagagtgaagaattaaatagatacaatacaaaatgataaatgggatatcacactgatcccaccaaaatacaaactaccatcagtgaatactataaatacctctatgcaaataaactagaaaatctagaagaaattgttaaattcctggacacatacacccccccaagactaaaccaggaagaagtcaaatccctgactagaccaataacaagttctgaagttgaggcagtaattaatagcataccaaccaaaaaaagcccagaaccagacagattcacagctgaattctaccagaagtacaaacaggagctggtaccatttgttctgaaactattccaaacaacagaaaaagagggaatcctccttaacttactctacgaggccagcatcatcctgataccgaaacctgagagagacacaacaaaaaaaatttcaggccaatatccccgaggaacatggatgcataaatcctcaataaaatactaaaccaaatccagcagcacatcaaaaagcttatacaccacaatcaagtcagcttcatccctgggatgcaaggctggttcacatatgcaaatcagtaaacataatcctcacataaactgaaccaatgacaaaaaacacatcattatctcaacagatacagaaaagtcctccgataaaattcagcggcacttcatgctaaaaactctcaataaactaggtattgatggaacgtatctcaaaataataagagctatttatgacaagcccacagccaatatcatactgattgggcaaaagctggaagcattctctttgaaaactggcactagacaaggatgccctctctcaccattcctattcaacatagtattggaagttctggccagagcaatcaggcaagagaaagaaataaagggtattcaaataagaagagaggaagtcaaattgtctgtttgcagatgacatgattgtatattttgaaaaccccattgtctcagcccaaaatctccttaagctggtaagaaacttcagcaaagtctcaggatacaaaatcaatgcacaaaaatcacaagaattcttatacaacaataatagaccaacagagagccaaatcatgagtgaactcccattcacaattgctacaaagagaataaaatgcctagaatatgactaacaagggatgtgaaggacctcttcaaggagaactacaaaccactgctcaaggaaataagagaggacacaaatggaaaaacattccatgctcatggataggaagaatcaatattgtgaaaatggccatactgcccaaaggaatttatagattcaatgctatccccatcaagctaccactgactttcttcacagaatcagaaaaaaactactttaatatggaaccaaaaagagcccttgtagccaagacaatcctaagcaaaaagaacaaagctggaggcatcacactacctgacttcaaactatactacaaggctgcagtaaccaaaacagcatggtactagtaccaaaacagatatatagaccaatggaacagaacagaggcctcagaaataacaccacacatctacaaccattttttctttgataaacctgataaaaacaagcaatggggaaagaattttctatttaataaatggtattgggaaaactggctagccatatgcagaaaactgaaactggatcccttccttacaccttatacaaaaattaactcaagatgaattaaagacttacatgtaagacctaaaactataaaaaccctagaagaaaacaggcaataccattcaaacatgggcaaagacttcatgactaaaacacaaaaagcaattgcaacaaaagccaaaattgacaaacgggatctaattaaactaaagagcttctgcacagcaaaagaaatgattatcagagtgaacagacaacctacagaatgggagaaaatttttgcaatgtctctgtctgacaaagggctaatatacagaatctataaagaacttaaacaaatttacaagaaaaaaacaacgccatcaaaaagtgggcaaaggatatgaacagacacttctcaaaacgaagacagttatgcagccaacaaacatatgtaaaaaagctaagggtcactggtcattagaaaaatgcaagtcaaaaaccacaatgagataccatctcatgccaattagaatggtgatcattaaaatgtcaggaaaccatagatgctggatagggatgtggaaaaataggaatgcttttatactgttggtgggagtgtaaattaattcaaccattgtggaagacagtgtggcgattcctcaaggatctagacccagaaataccatttgacccattactgggtatatacccaaaatattatatatcgtcctattctaaagacacatgcacacatatgtttattgcagcaatattcacaatagcgaagacttggaaccaacccaaatgtccatcagttatagactagataaagaaaatttggcacatatacaccatggaatgctatgcagccataaaaaaggatgagtttatgtcctttgcagggacatggatgaagctggaaaccatgattctcagcaaactaacacaggaacagaaaaccaaacactacatgttctcactcataagtgggatttgaacaatgagaacacatggacacacagagggaaacatcacacaccagggcctgtcaggggatggagggttaggggagagatggcattaggagaaatacctaatatagacgggttgatgggtgcagcaaaccaccatgccatgtgtacgcctatgtaacaaacctgcacgttctgcacatgtaccccagaactgaaagtatattaaaaaaaaaaaaagtggagaaatctgaaaaaaaaaagacagttaatttacactaaagattaggaagatggtaaatgtagaatttttcctctagccagtacatggggaaacctgacatgatgacttcttgagatccttttaattctattataaaagcatagagctaggagagatatggattatctcaggttttcagagactaattatttcaagagtaatagacaaaggaaaatacccagattacttacctggtgagaaatctactaagttgttatagcaatctgaggccacatttttagaatttaagttattagtgagatgagatttctatcaaatacttctgagctataagcaatatgaaaggactgctaatataaaaattttctttattttcttggtcctcagcttttattcagtggtccttgtgaattgagtctggatgcctcaaaaagataaatgtttcagaaactaaaagtatggttattgaaagcctggtttataatcatttttaagtgggttttactagtctgacttcattcttttttggcttatttcactcagtctgctatttaatctttaattacaggccacaaaagaagtaatagaacgggaagcaccagggatggccctggcaatgctgatgggatcacttaatgttacacctctgggcatgctctctaggtaagaaagtcaccaacatgttgcaaaccatttgctaggtgaactgtttccgtgatattaaaaaaaatctacactttggcattgttgtgaatattaaatgagctagtccacataaagttcttagcttatactaatcacttaataaatattacctactatcattgttaaaaaaaaaagttaattccataccactaatcaatacactatattgatgaacctaagaaactttagtcttaacacttaagtttgccccttttttttccagagttaagagctttagtattctgtcagccacaattttcccacttcacttctttttgttgttgttgttgttgttgttgttgttgcttgttaagttaaactttcagagactgtcatattactactggtaaaagttatcaattcctaacccagagaatccagtttattactatgtaaagttactgttttctgtgactgtttataatcatcagttgatatctattaattgtaggtaaatactgatttaataaaactaaactgccaagtttattaaaataacttgttctcacaagttaggagcttatattccaatttataaatagctatgttgatgtgttgttgtgaaaaaaaagaagctcaattcatattgttaatcttttaatgcttggcaactgggtatattttaattattatattacattaatgatatactattattatatgaaattagtctacctaaaactatgcctttgttgacatagatgttgatatccatcctcgatttaatggtacttatttgctactattttagcaactcttagatttagatcccctaaatgaggacaattacatcacttaagttaaagatagaagtgtcaacttagtcagaaactgttgaaggatttaatgaacgttaattaatagttgatctcagagcaacctaaaaataaatagcagctgtatagtttcagggtttcataatttatagccctttatgtatcctgtgtgtaatatgaatataaaattaaatgtgtccattgactattatggaatatgagttgtaatgttctttctgttacatagacaaagtttatatcccatcagtggcagccacttgaagcacagatacaggagattatgaatgggtcattagttactatgttctttttgctgtcacgtgtactgtaacatttaattttagtaaaagcaaataaagaattaaagtaccacgatagagactaaagctaaaattcatgctggcctttaaggaactccagttgattctttcatagtgttctttttttaaaccattacttatattacctacaccaatgaggtcaggggatcccgtttttcctatggaattaagtagtagttttcaaacataaaagaactctttcttgtatacaagcaataacatcaggaaagaattaaacttcattctcttgctaattcttttgtaataaaattttaattcggtaaacataataatatgcttatttgccaagtcccatattaagcattagggatcctaaggttagaaagaaaaataagaaatggtcctctccttaaggatcccacagtttaaatggagaaattatttcttgcaactgttaagataattcttcaaattgaatgtagctttcttgatccagtatagaaatatcactttttgttatatcaaaaggttttcctgaattaatttttttctcccttttgtatcctcataattacctagcactggactgctgagtgaatggaaaattaattagcaggagctgattctaattactttggaatgagttgttcatctttatcctgaaggctttgaaaattaatacatataagcagcatgggagcaccttctggcttttctgtctgtgcattgctgatttaaccaagaatatatttataaactttggaacagacatagtagtttacattagttacagaaaaggggatatttccctgaatgttcattttttgtgcttctcaaagcctttttaaaaattattatttttataatagccatcattagattggttcttcctttctacagcctttctattttgtatgcacttctggctttgtacatgcttctgctatggaacatgtcatagtatattgtaattaattatttgcttgtctgtattacctagttagtagaaacttcttaaagacaggagctttatcttattcttttttacatcctcagcccctaaaacaaattctgacacatagtaagtactcaaaaaatgtatattgttgcagttactatggataaatcagtgttttaccatagttctatagcatgtttttttcaggtaaattaatgcatcaagttggtgccttaccttcctatttttatgtctagagagcagcattagataaaaacaaatgtttaaaccattacgtctgtttgaaatggtttcctactatttggacaacttaatatcctccagattttttatataagtaagttgggagatattatgaagtaatggttaagaacatcatctctgaagacagattgcttgtgttctatgttaatgtcttttttgttttcattttctcatctatataataaagatgttaatagtaccaaatttcttggataaagtgaattaatctatgtaaagcacttagaaaactgactcgtagtaactcttaagtgatgaccatggttgtttcgttagagtttttgtttttagagtaggtctgctggtgaaaccttttcgtagcttttcttcattaggaaatgtctttatttccatattactcctgaaggatattttcactagatacagaaatctgggttgactgttcttttctttcagcattaaaaaaaaaaaagtaaaataaaatatgattccactctcttttgctccatggttcctgaaaagaaatgagcaatcaattcaaattgctgtttccttatgtgtaatggcaaatttctctggctgctttgaagatattttttctgcagctttagtttcagcaatttgattatgatgtatctgggtgtagttttcttttagattatccttctgggttcagtgaactttatgattctgtaaatttatgtctttaaccaaatttgggaaatttccttttttttgctgctcctatgacatgaattttagattttttggtaatgtctcacaaatccctgaggctctgttaatttttaaaatcttttttactctgtattaattttaggttatttctatgatctatcttcaaattagctgacttttcccctctttcatcttcattctgcctttgagaatatctagtggtttttatttcagatatattttcagttctaaattctccatttggtttttttgttaatggtttccatttctctactaagaacttgtatttttacatttatttcaaaagtattgccctttatgtcatggagaatagttataataactgcttaaaattattcttcggacaatttcaatatctggcttaccttggggttgacatcggttgatttcttttcccatgagaactggtcaaattttccttgttctatgttgagaaattttggattgtatcctggacattttgaacactgcattgtaagtaaattatttaactcctgttaaaatcctttggggaattttaattagttagttttagcaattgatctgattgggttcagattgtaaattctgtctcactttctgtgggtagtggctcagcctttgctatattgttagtgtctgcccagtacatgaatgatttaggagttagtttgagacttgggcagtagtatatactaggtttatgttttaaaatcttttcttgtacttattttatactgtcccacgtattcacagctcagggatgaccctggaacttgggtcaattcacatccaaaattagagaatccaccttctttagctctcttcttttcaagaattttcccctcactctccagcttccaggggaccccattcccagttactctggccagaagaggtttcttacagagtattaactccctttgcaattatgtagttgtacacaactgacctttgggacaaagagcaaaagaaaagaaaaaagagagaaagagattcctcttaccttagttctttagacaatatcggctccttttttttgtttccattagccaaagagataggtaggtcttctctctgagctttgggtgctaacactgtcattatggtattgcagctccacaattaggcctagccccattaagagctgttattcaagttctgacttcagtcccaaatctgcctgctattatttacattaaacgtcatcaggtaatcactgtgtactctataaacaatcggtaggagagagaagctatggttactttctccatcttggctgacaccaaagaacaagtgttcaaactttaataccagatccctgacttcatatttactagcatttactagcagtgttaccttggtactttacaaggtttagcacatcttgttccagtggttaactaaactgcccacaaaatagtagcatttaacctccctaaatttataatttattccctacttgtttttttttaaaagatcaaatactcttttttccccctaaatttcattaaaaacaacagactaaccactgtggttatacactgaagaatgatttgtcatggattttattctcagttttgtcattaatttgatttatgatctctacttagttttatagggatattacatagctgatagaaatgttatgaggtcctttaaagatttactcacacatatgtgtgtgtgtgtgtatgtgtgtgtgtatatatatatatatatataaaataagaaatatctaattcataaaaagagaaattgattgccagttttccattttagtatgaagagatttaccattgtaatcttcagtgactcatctttcaattctgtaactgtaataaacacatgcactgcttttagggaggagataatattttccatttgctgccaaaaatggttttataactgatattggttaaaagaaaaatttcaggaaataacaacacaaaacttattttttatagaaatgaatcaaattattcttagtattatttagataatattaaagtaacatgagtcatttaaagtaacagtactatcatcttaaagagtttctgtttttttaacccacaccaaatatacttagcttataaaagtctgtaggggagcataagatggcagagtagtatatataggaatctgtttctccacctggacaaccgtttgaactggcaggatctctctgatataactattttggaactttgtagtctattcaaaggcttatggcttactggaaaagacttgactagtagattttggttaatttgggtcaattttaacctagtgtgctactagccaaccattctccagtgctccagctagcaggtactagggtttataggacagcttgtagaagacagaatgggtaattaaggaccttatcttccaaatattggggatccaggttctattgtggattactgctttaggttgtagaagtgcagaggcaaagacaggctgccattgtttcaacccacactggctgaagtatcttcaagggatttataaggacagtacctacattttcccctacatttttcttcttctcttttgggacccagaaattacaggattagaaaattcaaaggcagctacatatatgggggaatttagaaagtcactatgcatgcccagaggaaaaggcaggctgagaaaaagagaaaggccttaagtttatacctcaggcttatttcttacacagaacactttataacaatttaaaaaaaaaaaaaagcaaaccctagggaagggagagaagctgatttctagaattaccatattataagattcaaatattcagagttcaacaaaaataaaatgacaaagcaaagaaaaagtatgatccattcaaatgaaaacaataaattgacaaaaatccatgaggaagatgaaatggagaacttactagacaaaggctttaaaacaactatcttaaagattctcaaagaactaaaggaatatattgataatgccaagataatgatgtgtaagcaaaagtaaatatcaataaatatattttaaaaacataaaaaaagaatcaatcaggcagctaaaatgacctatcagtttaatatcatcttttaaggccatgatgggactgtccataatcaggcttctctccactgtatgcaggaggaagtggccactattaacagccctccctttttgtagcattagacagcaacaggccaccctgagattatttacagagaacagctataaaaacacttgcaaatatattcagtccagactagaaaatacttttcccccatgagtgtgaagattcatattgtaggctagtaaatctctctgcacatgttcatcatgacaatgtactcaggagttctaagtcatgatgagcatcctgcagcagttccagtgaattatggatgaaaaacatgtatcctttaaaaaaataaagaagaaaaaaaaaagaataatgaagaaatgagttgacaagtacaatcgctgaaaaaaaatcattagtgggattcaaaagcagttttcagcaggcagaaaaaagaatcagcaaacttaaaggcaaaacaattgaaattaacaaatctgaggaacagaaacaaaaaagatggaagaaaactgaacagagcctaagggacctatggaacaacattaagcagaccagcatacacattatggggattcaagatggatgagtgagggagaaaggggcttaccagagcaaaaactcatgaacactaataagcgtgggaaactgtcaggtaggcaaacctaaactgtaattgacaaattgctagaggttcagtgcagacaactatgagagttaaaaacttcagggaaactcagtcgctacaattttgtgaaaactgaatggaacctaagggatctctggaacaagtcttcggaacaaccaggttctcacagtaaatattagaggaaaattccctcatgtttcagcagggaagaggaaagggaactattgtgaaatacaccagggtactctgttcttcttaatgagccctaacccgaggagaaactacttaacctgaacctaccctgctggagtataatcaaatactaacttacctaggggaagggaaatacccaacttcagctcactgtagccatcttctcccatgtaacaggggaggaaaaattgagaaaaactcgtgaagttcactaaaagcctcactaaaagactgagacctggccaggcatggtggctcacacctataatcccagtgctttgggaggccaaggcaggtggatcatgaagtcaggagattgagaccatcctggctaacacagtgaaacctcatctactgaaaatacaaaaaattagctgggcatggtgccacgtgcctatagtcccagctgaggcaggagaatcgcttgaacctaggaggtggaggttgcagtgagctgagatcgtgccactgcactccagcctggcgacagagcgagactccatctcaaaaaataaaaagaccaagacctaatgataggactatagaatacttccccacccccacacatccccaccacattactagaggcctgtctacagcagttccttttacctggtatatcatgtttggctatgaagaaaaattacaaggcatatcaaatggcaaaaaaatacaatttgaagagacaaagcaagcatcagaagtagacatggcaggaatgttggaattatcagtctgggaatttaaaaatcattgtgattaacatgctaagtgctccaatggatgaaacagataccatgcaagaacagatggataatgtaatcaaagacatgaaactcctaagaaccaaaaataaatgctagagatcaaaaacactataacagacataaacagtgcctttgatgggcttattagtagaatggacacagctgaggaaataaaaaactcttgagcatgaggatctctcactgcatacctccaaaactgaaaagcaaagagaacaagttctgagaaacgaaaaaacagaacagaatatcaaagaattttgagacaactctaaaacgtagaacatctacataatgcgaatacccaaaagagaagaacgagaaaaacagaagaaatatttgaaacaatgaccgagaatttccccaaattaatgtcagatgtcacaaaaacaactatacctagacataccatcttcaaactagagaaaatcgaaaataaaaaatcatgacagagtccagaggggaaaaaaactccctatctatagaggaagaaagataagaattacatttaacttgtcctcagacatgcatttaaaaaatcagtctatgatttggggcatacagtatgtaaagatgtaatttaagacatcaataactaaaaggggtgagggacagagtagtataagagcagaggttttgtatgctgttgaagataagctggtataaattcaaattattactttaggatgttaaatgtaatcttcatagtggccacaaggaaaataggtacaggatgtacattaaaaaaatgagaaaagaattaaaatatttcactaaaaaaaattaagaacaaatgaagatagtaatgtaggaaataaggagttaaaaagctataaggcatatggaaaacccttaacaaaatggtagaattccctttttgtcactaattactttaagtgtaaatggattaaactttccaatcaagagacagagattaatggactggataggaaagcatgatccagctatatgctgtctacatgagactcattttagatccaaagacataaataagttgaaagtgaaaggatagaaaaagatagtcaggcaaatagtaaccaaaagcgaaccatggtggctataataatatcaaataaattttaaatcaaaaatgtttaaatatcttaaatccaaaaagtttacaagagacaaaggatatatgttactagaaggtttaattctgcacagtaatattatacttataaacatttatgcacttaataatagactgtcaaaatagatgaagcaaaaatggacagaattgaagaggaaaatagacagctatgcaagaatagttgaggaattcaatatgccacattcaataatggatagaacagccacacaaaaggtaagtaaagaaatgtaagaacttaaacaacacaataaaccaactagatacaacccacatatataaaacacttcacccaacaacagtagcatacaccttctgaagtacacatgggacattctccaagatagagcacattaggctacaaaataagtttcaataggttttttaaaatagatgccataaaaagtatattgcaaaatagtatattcttcaaagcatattctccaaaaagaggatgaagttcgaaatcagtgacagaaggaaaaccggaaaatttacaaatatgtgaaaattaaacacactcaaatagccaataagttaaagaagaaatcataagggaaattagaaaatatttaaaagtgaattaaaacaaaaatgcaacataccaaaacttcatagcatgcagaaaaagcagcactgatattgctgtaagcatttaaaaaataattacatttttgaaaacctcaaaaacagcagtctcatgtataactataagttaagaaactagaaaaagaataacaacctaaacccaaagctagcagaaagaaggaaataataaaaattagagcagagataaatgaactagaaaatcaaaaaacaatagagaaaatcaactaagctaaagttggttcttcaaaaagatcaacaaaatcacaaaattttagctagatagactaagaaaaaaaaagaaactcaaattactaaaatcagtaatgaaaatggagtcattagtaccaattccacagaaataaaaaggactagaagagtacagcgtaacaattacatgccaacaagttgaataacccagacgaagtggacaaactcctagaaacacaaaacctactgagactgaatcacaaagaaatagaaaatctgaatagacctatacctaggaaggagaatgactcagaaattaacaacctctcagctgggtacggtggctcacacctgtaatcccaacactttgggaggccaaggtggatggatcacttgagcacagcaaaaccagcctgggcaacatggcaaaaccctatctctactaaaaattcaaaaaattagccaggtgtagtggcacacacctgtagtcccagctactcaggggtctgaggcaggaggatcacttgagcccaggaggtagaggccacacagtgagccctgatcatgcgcactgcgctccagcctgggcaacagagtgagaccctgtctcaaaaaaaaaaaaaaaaaaaaacctttctatctttctatttacaaaataccaggaccagttggcttcactgatgaattctaccaagtatttcaagaacaactgacactggttgtttccaaaatcttttccaaaaaattgaagagaagacaacacttcctaactcattttatgaatggcagcattggtctcataccaaagacaggaaaaacaaaacaaaactgcaggccaatatcccttaatgaatgttgatggaaaaatgctcaaaaaaaacccccagcaaactgattgcagcaacatattaaaaagaattatacaaggtgaccctagaatacaaggatggttcaacatatgaaaataaatcattgtaatataccacagtagcagaatggagggaaaaaaaaacccatgtgatcatttgatgatgggttttcagcatcaatgggtgctgaaaaaaaatttggaaaaattcaagtttcatgttaaaaacactcaacaaactaggaaaagaaggaaactaccttaatgtgaaaaaggccttatgtaaaaaacccacagctcacatcatattcagcggtgaaagactgaaagcttttcctttaaaatcaggaacaagatggggatgcccactttttccacttccattcaacatagtattggaacttctagccagaacacttaggcaataaacagaaatgaaaggtatccaaattggaaaggaagaagtaaacctatctttttttttttgacatgattatatatgtagaaaacccaagattccacacacaaaaccattagaactaataaatgaattcagcaaagttgcagaatacaaaatcaggctgcaaaaatcagtcttatttttatacaatgacaataaactatccaaaataaaatcaagaaaatggaatagaaacaagagcccagaaataagcccttgcatataggatgtaataattttcaacaagggtgtcaattcaatgggggagagaatagtcttttcaacgaatggtgttgggaaaattggatatccacttgccaaagaatgaagttggacctttgcctactgaatataaaaattaattcaaaatggatcaaagacctgtacacaagagctgaaactaaaaaactcttagaaaaaaacatagggggacagcttcatgacattagatttggcagtcatttcttggatatgacaccaaaagcataggcagcaaacaaaaaactagataatttggactttatcgatgttgaaaatctttgtacattgaacaaagtaaaagggcaacccatggaatcaagaaaatattcacaatcacatatctggcaaggtattaatattctatatatatatattttttttaattcctacaagtcaataaagaaaatgctatttaaaaacaggcagaagactcaaatagatatttctccaaagaagatacacaaatgactgataacatgaaaagatcctcagcatcaatagtcattagggaaatgcaaatcagaaccacagtgatatacaacttcacacccattacgttggctgttatcaaaaaaataataataaataagtggtggcagaatgtttagaaacattgtgtattgctggtgaggatgtaaaactgtgcaactgctatgggaaactatggcatatcctcaagaaattaagcatagaattatatgacccaggaactccacttccaagttacatatccaaaagaattgaaagcaggggctgggtgtggtggtttaaacctgtaatcccaacactttgggaggctgagacaacaggatcacttgaggccaagagtttgagaccagcctgagcaaaatagaccctgtctctacaaaacttgtttaaaaaaattagccagtcctggtgacacacacctataatcctagctactcaggaggatgagggaggagtatcacttgagccccggaattcgaggttacagtgagctgtgatcatgccactgcattccagtctgggcaacagagtgagactgtctcttaaagaattgaaagcagggactgtaatagatatttgcacgccaatattcataacatcattattcaccttacccaaaagttggaagcaacccagatgtccattgattgatgaatgcataaacaaaatgggttaaatacatggaatgaaatattattcagccttaaaaattattgttaattctaacacttgctacaacataaatgaatcttgaaaacattgtgctaaatgaaataagccagattatataaggacaaatgtgtgattccacttacatgaagtatctagaataaccaaatgcataaagaaaatagaacagtgcttatgagtggatagcgagaagagaatggagagtttttgtttgggatgatgaaaaagttctggagatggacagtggtgatggttgcacaataatgtgaatgtacttaatgccactgaattgtatacttaaaattagttagaatggtaaaggttatgttatgtatattttaccagagttccttttatagctataggacaggaaatgcaacatacataaaatgtacattttcttgaaacatttctgcagtgtttcaggcccaacttccagactccagtatgacaggaggtatactgggtttcaaaagacaagtgacacagatggtgtgaggaccacctcaacacaggagagctgacacctttctccttctctcacccaacttttatattttcctaaatatcatagcttcataacagatttgtgatagctggacttatttgttataactcataaaataggaactctgggcaataggaacagctccagtctacagctcccagcgtgagtaacgcagaagacaggtgatttctgcatttccaactgaggtaccgggttcatctcactggggctcatcggacagtgggggcaggacagtggttgcagcccactgagtgtgagctgaagcagggtgaggcattgctatttatgacaaacccacagccagtatcatactgaatgggcaaaaactggaagcattccctttgaaaactggcacaagacagggatgccctctctcaccactgctattcaacatagtgttggaaattctggccagggcaatcaggcaagagaaagaaataaagggtattcaattaggaaaagaggaagtcaaattgtccctgtttgcacatgacatgattgtatgtttagaaaaccccatcgtctcagcctaaaatctccttaagctaataagcaacttcagcaaagtcttaggatacaaaatcaatgtgcaaaaatcacaagcattcttatacaccaataacagacaaacagagagccaaatcatgagtgaactcccattcacaaatgcttcaaagagaataaaatacctaggaatccaacttacaagggatgtggaggacctcttcaaggagaactacaaattactgctcaacaaaataaaagaggatacaaacaaatggaagaacattccatgctcatggataggaagaatcaatatcgtgaaaatggccatactgcccaaggtaatttatagatttaatgccatccccatcaagctaccaatgactttcttcacagaattggaaaaaactactttaaggttcatatggaaccaaaaaacagcccacattgccaagacaatcctcagccaaatcctaagctggaggcctcacactaccagacttcaaactatactacaaggctacagtaaccaaaacagcatggtactggtaccaaaacagagatatagaccactggaacagaacacagccctcagaaataataccacacatctaccactatctgatcctgggcaaacctgacaaaaacaagcaatggggaaaggattccctatttaataaatggtgctgggaaaactggctagccatatgtagtaagctgaaactggatcccttccttacacattatacaaaaattaattcaagatggattaaagacttaaatgtaagacctaaaaccataaaaaccctagaagaaaacctaggcaataccattcaggacataggcatgggcaaagacttcatgtctaaaacaccaaaagcaatggcaacataagcaaaattgacaaatgggatctaattaaactaaagagcttctgcaaagcaaaagaaactaccatcagagtgaataggcagcctacagaatgggagaaaatttttgcaatctactcatctgacaaagggctaatatccagaatctacaaagcactcaaacaaatttgcaagaaaaaaacaaccccatcaacaagtgggcgaaggatatgaacagacacttctcaaaagaagacatttatgcagccaacagacacatgaaaaaatgctcgtcatcactggccatcagagaaatgcaaatcaaaaccacaatgagataccatctcacaccagttagaatggcgatcattaaaaagtcaggaaacaacaggtgctgaagaggacatggagaaataggaacacttttacactgttggtgggactgtaaactagttcaaccactgtggaagacagtgtgtcgattcctcaaggatctagaactagaaataccatttgacccagccatcccattactgggtatatacccaaaggattataaatcatgctgctataaaggcacatgcacacatatgtttattgcggcactattcacaatagcaaagacttggaaccaacccaaatgtccatcagtgatagactggattaagaaaatgtggcacatatacaccatggaataccatgcagccataagaaaggatgagttcatgtcctttgtagggacgtggatgaagctggaaaccaacattctcatcagactatcgcaaaaacaaaaaaccagacaccgcatgttctcactcataggtgggaattgaacagtgagaacacttggacacaggaaagggaacgtcacacaccggggcctgttgtgggatgcggggagcggggagggaaagcattaggagatatacctaatgtaaatgacgagttaatgggtgcagcaaaccaacatggcacatgtatacatatgtaacaaacctgcacattgtgcacatgtaccctagagcttaaagtataattttaaaaaatatgtttattttaaataaaaaatggaaataatatttttgaagtaaaatgatttattgatgaaaaatacttgaaacagaagatactagaataatactttcaatgtgctgaaagaaaataacatttaatcaagaattttacactcagcaaagttaccattcaagaatgggggaggatgaaatgtcattttcctacaaacagaaatgggaacattttatcaccaaaagaacctcacgtaaagaattttaaagatatactctggcagaagaaaaatcatctcagatggagagttgaggatacaggagggaaaagagagcaaagatattggtaaatatctgaacaaatcttttttaaaaaattgactattgtcctggtccattctgctgctgtaacaaaataccttagactgggtaatttataaacaacagaaatttattgcttacagttctgggggctgggaagtccacaatcaaggtgcccgcagattcagcgtctggtgaatgcttcaaagatggccctttcttgctgcatcttcacgtggtagaaggggcaaactagctcctgacggcttcttttataagggcactaataccactcatgaggacagagttaatcacctcccaaagtcctcaacactttatactattgcactggggattagatatcagcatatgaatttggggtaaacaaaaacatttagacaatggtaactatataaaacgataaaaataatgtctcaattatgggaagaaaaaatatgttagaattcttgaaaacagcatgtaatttgagatactgtgattatagttaagtattctaacaggccaggcacagtggctcacccctgtaatcccagcactttgggaggctgaggtgggctgatcacttgagtccagaagttcgagacaagcctgggcaatatggcaaaactctctttacaaaaagatacaaaaattagaccagcatgatagcacgtgcctgtagctactcgggaaactgaagtgaaagaatcacctgagcctaggaggtcaaggctgcagtgagccatggttgtgccactgcactcgcctggggtacagagtgagaccctctcttaaaaaaaatttagtcctattttctaggaagatattaaatattgattatagttttttaaagttaagtatgcatattaaacttattagggtaatcactaaaaggatggacggagtatacaacttccagaaatagagggaagaaattaatgaggaaaatacttaaagtaagataagaaagggagaaaaaaacaaacaaacaaaacaaaacaaaaaaaaacaaagacaagtagaaggcatatgtattggttaaaaaaagttataatacgaattcccagaacatcttccacttaaaattttcccatagaacactgcttagtttctcatattcaaacttgataaacatgtataccttcatgtttatctgaaaaacagcttcagctgatacatatgaaaattttatatttatatctgaaaaattcagtaaattttcaaaaaaattttattaaacttttaagatggtaatataattgtagattggcatgcagtataaggaatgatccagagaagtcctgtgtaccctttactagttttttccagtggtaacatcttacaaaactatagtacaaaattacagttggatgttgacattgataacatcatgacacaacaatttgttcattctttcatttgttcatgggtacttaggttgacttcatattttgcctgttgtgaatagtgctgcactaaatgtgggagtgcagatgtgtttttgatatactgatttcctttcttttagatatatacccagtagtgcaattgctggatcatatgataattctatttctagttttatgaggaaatttcatactgctctccatagtggctgtactattgcttttctattgtcattgcccttttattgccacaccacctctctgtcacccagcccccctttcctaaactctggcaaccactaatctattttctagttcaatattttgccatttcaagaatgaatataattagaaccatacagtatgtagccttttgggattggtttcttccattaagcataatttcctggagattcgactaaattgttacatggatcaataattccttacattttattgttgagtagtattccatactatatatgcactacagtttgttcaaccattttctgttgaaggacatctgggttgtttacagtttgtaattatgatgaacattacaccaaacgatgcggtatctaggttccatggcagttgcaggttttctgtttaaatgaactgtcaaattattatccagagcaactgtatcattttacaatcacaccaacaatatatgagtgtgtctccacaccttgccagtatttggagttgtcactatttttattttagccattttgatagttttgtaaatagttttaatttgcatttccctaatgactagtaattttgagcatctgttcaggtgttttgcctattgtctgactgtgttttttagtttttttatccctgatttttgagagtttttatgtgttctagaaacctgtccttcgtcagatatgtggattgcaattgttttctcccagtcaatacattgtcttttttcctcttcacagtgtcattcacagagcaaaactacttaatttccatgaggtccaatttatcatctttttcttttagcagttgtgtttttttgatgtaaagtctaagcacccttcacctaggcaaaggtccaaagactttctcctgtgtttttttctaaaacttttataattttacattttacctttaaatccatttgagttgatttttttctaaggtgtgagtttaggttgaggtgttttttcgtttggttggttggttggtttttgtgtatgaacgaccacttgctccagtgctacttgtttaaaaaaaaaaaaaaaaaaaaaaaaagctacctttcctctgttgaatggcttttgcacctttgttgaaaattaatctggcctattattagtttagttctagttctggtttctctgttctgttctatatgtctgtccctctgtcagtaccacataatctttatcattgtagctaaacaataagtcttgaaattgcatagacagattcctcccactttagttgtctttttcaaaatttttagctattttggtcccttttgttttccatgtaaattttagaataagtttgtctatatctacaaaaaaattgctcagatttttataggaattacattaaatctggatgtaaatttgggtggaagtgacatcttttccatgttgagcctccatgaacacattatgtctcttcctttagattgtctttgatttcttttattgcagttttcagtataaaaagtctgaacatgtttcgttagatttacacttaagtatttaattgtgttttcagttattgtaaatggtgttttattattaatttaggtgtccacctcatgttcattgctaatatatatagaaatacaattaattcttggatgttgattttatattctacagccttgcttaattgctagtactattaattctaggagggctttttcttttttttttttttgttttttgttttgtttgttgtttgttttgttttattctttgggattttctgtatagacaatcacatcatctgcaaataggggtagttttacttcattctttgtgatttatatgccttttattctttttctgcctgttgtcctagctaaaacttccagtgctattttgaatagccatggtgaaaatggatatccttgctcttttcctgatcttggggagaaagcactcaatgtttcactattaagtatgttagttgtacatttcttataaaagctctttttcaaattaaagaagtccatcccttaatttctacattttttgagagtttttatcatggatcagtgtttgattttgtccggtgaatttcctgtgttaattgatatgattgcatgatctactttttcttcttagattgttgatatgatgcatatgttgatttattttcaaatattgagctggtcttgaattcttggagtaaacccacttggtcctagtatatagttctttttacttattcctgacttctatttgctaatattttagtaaggatttttatatctatattcataagagatactggtctatatttttcttttttatactatcttcatctgattttggtatcaagttaatactggcttcataaaatgagttgtgatattccctccacttttactctctggaagagtttatgtaaaatgtatattaatttttctttaaacatttcagagaattcactagtggaaccatctgtcctagagctttatttttctagagtttttttactataaattgaattttcttaaaagttacagggctatttatctattttatatatggttaatgtagtattttatgctttttgagaaatttgtccatctcatctaagttgtctaatttatgtatatagatttgctcctagtattctcttattgttattttctcgtcttgagagtctgtattaatacgcctgtttcattcctgatattggtaatttccatctttttttcagtcttgcttaagatatttccattttatttatcttttcaaagaacaagctttttgtttcattgactatctctgtttttctgttttaaatttcactgttatctgctctttattatttcattccttctccttgtttggggttcattttgctctttatctagttcttgagctggaagcttgttattgatttgagacttttctaatgtaaactttaggagcactgatttaggtgcattccatgaatttgatatgttatatttgcatttttattcatcttaatgtatctttttattttttgagatttttttcttttttttttaatctatctaacactaggtcttatttcttctatcaaacttcatatgtgcccatcaatcaacttctcatctttccctcctccccactacccttcctggcccctggtaacaaccaatctactacctatcctcatgagattcacttttttagcccccacattatgagggagaacttgcgacattcttccttctgtgcttgccttgtttcatttaacataatgacttttagttccatccatgttcctgcaaatgataggatttcattttttaatcagtgaataatgttccattgtatatagatactgcattttctttatccatttgtatgttcactggtacttaggttgaatccatattttagccattatgaatagtgctgcagtaaatgtgagagtgcagatgtcttttcaatatgttgatttcccttcttttggatatatatccagcagtgcaattgctggatcgtatggtaattctatttctagttttatgaggaaattccatactgctctccatagtggctctactaatttacatttccaccaacagcgtacaaatgtttcctgttttccaaatccttaccagcatgtgttactgcctgtctttttgataaaaagccattttaactggagtaaaatgatatctaattgtagttttggtttgcatctatctgatgattagtggtgttggccatttgaatgccttctttgggaaatgtctattcatatagtttgctcattttttaattgaattatttgttgtttttgttgttgttgttttctgtcaagctatctgagctccttagatagtctagttattaatcctttgtcagacaggtagtttgaaatgttttcttccattctgtgggttgtctctttgctttcctgattgtgtcctttgctgtgcagaagctttttagttttgtataaccccatttgtctatttttgcttttgttgcttgtggttttgaagtcttagacaaaaatctttgcctggaaagatgtcctggagcatttcctcagtgttttcttctagtagtttcatgtttcaggtcttagatttaagtctttattttgatttgatttttgtgtatggtaaaatataggggtctaatttcatacctctgcaagtggatatccagttttctccacatcattaattgaaaagacaggtctttccccattgtttgtttttggcacctttgtgaaacatgacttggttataaatacatgaatttatatttgagttccttatcttccccattggtctcgcatatctgtttggtgtcagtaccatgttgatttggttactatagctttgtagtatattttggagtcaggtcatgtgatgtgatacctccagctttgatttttttgctcaagattgctttggatattaggctcttttgtggttccatatgaattttaggattgtttttatatttctgtggaaaatgtcattgatattttgatagagattccactgaatgtctagattacattgggtactatggtcattttaacaatattcttcctatcatgagcatagaatatatttccatttttttatgtgctcttcagtttctttcatcaatgttttatggttcttcttgtataggtctttcacttctttggttgaattgattcctagttattttatatctttggagatattataaatggggttgctttcttgatttcttttttggattgttcactattggtatatagaaatgctactgctttttgtatgttgattttgtgtcctgtaactatattgaatttgtttatcaattccaacagtgttttagtggagtctccagatttttctaactataaggtcatgtcatctgcaaacaagtctactttcacttcttctcttccagtttgaatgccctttgtttctttctcatgcctaattgctctggccaggacttccattttgaaaaaaagtagtgacagtgaagatccttgttttgttccagatcttagaggaaaggcgttcaatttttttccttttcagtatgctagtaactgtgggtttgtcatatatggtctttattatgttgaggtatgttccttctatactcagtttgaatgagggtttttatcataaaagcatgttgagcttcattaaatgtttttacagcatatattgaaataatcatagggtctttattcttggttctattaatgtagcatatcacatttattgatttgcatatgttgaaccatccttgggatgaatcccacctgatcatggagaatgatctgttcaatgtgttgttgaacttggtttactgacattttcttgagaatttttgcatttgtattcattggggagggtggcctgggtttctctttttgttttatcctttttggttttggtgtcagggtaatgctggccgcatagaatgactttgaaagtattccctcctcttcaattttttttagaaagtttgattagaattgctattatttccaaactaccatcagagatactataaatacctctacacaaataaactagaaaatctagaagaaatggataaattcctggacacatacaccctcccaagactaaaccaggaagaagaaaagaatgtgtattctgcagcagttgggtgaaatgatttgtaaatatcagttaggcatattaggtctggtgtatagtttaatttggatggttctttgttgattttctgtttagatgacctgttcactacagagagtggagtattacagtcccctactattattgtattgcagttatcccttaagatctattaatgtttgctttatatacttggcagctccagtggtgggtgcacagatatttataattgttatatcattttgctgaattgacctctttatcattatataatctcctcctttgtctatttttacagttgtttacagttatggctacagttgttacagttacagttgttacagttacagttgttgatttgtagtccattttatctaagtataactactcctgctctgttttggctcccagttgcatggaatatcacttttcaccccttcacttacagtctatatgtgtctttagagacgaagtggatttcctgtaggtaacacatagttgagtcttatttctttatccattcaggcactctatgtctttgccttggagaagtgagttaatttacattaaatgttattattgataagtaaggacttactcctgccatttgtcatttgttttctggttgttttataactcctttctcccttttttactttcttcatatgtggtttcagtgattttctctggtagtatcttttaatttgttgctttttatttttagttaatctgttgtaggtatttgcattgtggttaccatgacgcttataaaaaataccttataacaagttattttaaaaagatgacaacttatcttagatcacagaaatgggaacagaaactgaaaaaatgggaaaaatcttttacactttacttccatcttccccacatttagactcgtattgtctcaatttgcatattttatattacctatctcttaacaggttgttgtagctcctattgtttgtgatatatttatctattcgccttcatactggagttatgattgtgtgtccagagttggttccttccggtgggttcgtggtctcgctgacttcaagaatgaagccgcggacctttgcagtgagtgttacagctcttaaaggtggcgtggaccaaaagagtgagcagcagcaagatttattgtgaagagtataagaacaaaccttccacagggtggaaggggaatcaagcaggttgcccctgctgactagggttggccagcttttattcccttatttgtccccgcccatgtcctgctgattggtccattttacagtgtgctgatttgtccattttacagagggctgattggtccattttacaaatctctagctagccacagagcggtgattggtgcgtttttacagagcactgattggtgtattttacaaacctctagctagctgtagagcactgattggtacgttttacaattctagctacagagtactgactggtgcattttacaatcctcttgtaagacataaaagttctccaagtccctggttgacccaggaagtccagctggcttcacctctcaatgccccctttagacaggacaccccaactgctgttgggaattgggcgatgcttgctctagctacttcctgctggaaaggggcacagaaggggccctacagtggtagtgtcctccagaggggaactctctaggccagccaaagggtcagtgggttggtccaggggtcctcggtagaagttgttcattgagctcatttggggttccattggtaagacatcttactgcttttaggattctgtcttcattcatgacctctgattgattattgtatgccttggagtagtcttatttgggtcctatccatttggtgttctctgaccttcctgtacctgaatatttatatccttgtgaagatttggaaagttctattattatttctttgaataagctttctaccccttgatcttcctcaactccctcttgaacatcaataaaataatttctagatttgttgttttgatgtgattttctgtatcttaccggtgatcttcattgctcttcatgctttttgcttttttcttctctgtgtattttcaaatagcctatctttgagctcactgactctttcctctgcttgatccattctactgttgagagcttctaacgaacttttcagttgaacaaatatatatctcagttccaaggttaatgtttggtttttaattatttcaatctgttcattaaatttttatcataaattttgaattgcttttctgtgttaccttggagatcactgtgttttcttaaaactactattttgagctcttggttagggagctcacatattgctgtttcattagggccagttactgtttcattgctctgtccacttgggaagatcatggtttcctgtttactattgtttcttttggatgtatgtacatgtctttgcattggaggattagttatatttattccagtgttctgtctggcttgtttcgcttttttgtgtttgttttttataatctcaacttttagattcaggggtacatgtacaggtttgttacatgggtatatcacataatgctgaggtttgtggtacaaatgatcccatcacccaggtaatgagcgtagtatacaaaaggttgtttttcagcccttgccccgctccctctctcataccttggtagtccccagtgtctattgttcccatctttatgtccatgtgtaccaaatgtttagctcccacttacaagtgagaacattcagtatgtggttttctgttcctgcatgaatttgcttatgataatggcctccaggtacgtccatgttgctgcagaggacatgatttaattccttttatggctgtatagtattccatggtgtgtatgtatcatgttttctttattcaattcaggatatatttgattcgaggcttttttttttttttttaccacttccccattttcagtcctaggtgacacattatccccaggttcacctaagctctagtaaatgatcagaatgctacccttctcgggtgagggaggtgaaacatggtatatccttccagtgtaggaaagctaagccagtgtttcgtgcccagggaacctgtgggatgcacctcctacagcgtggtactgctgaacagccatcatgatttagcatctcctttggctgagtttatgagcagagtttccagggtcagagactataatcccacctcctccctttgtctctgcctatcctcaggtatatttgttccttcagacacttgtgatgcttcccatgggttaaggcagggacaggtctactgccagggcatgcaaaatgatggaaagctggctgttcaccttgatctcactttttccaatgttaaaacagtaagttagaggaaaattttctacatgcttcgtgcaaggcaggatggggaggaggaacatcatggatgtggaaatctgatattcttactgtctgttcagagttttttcacttctttctggccccagggccacatctcatcttcatatttgagttctgggatatttctagtgatattctctgtgctgttcatttgcttttggtttcctgttgagaggagtgaagtcagcctgctcgtacattgccattttgaaaccagaagtctctggtttcttgagatttcctctttgatccatagattattcagaagtttatggtttagtttccaagtgtataggaattttcctgttatctttctgttactgatttcaactttgcttccactgtggtcagagaagttactctataatttcaattcttttaaatttgtttaggtttatttttatggtcacagatatggtctatattggtaaaaacaatgtgtattattctgtcagctggagtgttctacaaatatcaattcgatcctgttgatttgtgttgctgagttcttctatatgcttgctagttgtctgtctagtcattctatcatataccattaaagtgacttgtatccaaaatatacagagaacttctagatatttaaccaatttatgtgaaaacttacatccacacaaaaatccacatgcaaatgtttttaacagccttattcgtaattgccaaaagttggaatcaaccaagatttacttcaataggtaaatggataagcaaattatgctgcatccatacaatggactcttattcaataataaaaggaaatgagccatcaagcaaccaaaaaagacatccttacatgcatattgctgagtaaaagaagccagtgtgaaaagaatacatattatatggttctaactttatgacattgtagtaaaagtaaaattataagaacagtaaaatgatcagtgtttgcccagagtttttgaaaagaaagatataggtgaatggataaagctgaacagattttttagagcagtaacactatttgatatgaagtagaaatacggaaacatgacattatacatttgtcaaaactcatagaactttatcacaaggaaggcttaatatatgcaaattgcatttgatggatcccagaaagcaatgaggactctgccaagagaatttaaatgcattacaaaataaataaaacaacctcatggaagcgggtggaggggaaaagtactgacctaaataactttggatatgagtggagtctgtaagactaaaggtaaaagcaactgcacataagcgctttagttgataaagttgtatcccatggaggtatgggttaacaattctaattttaatatatatgtatactggaattgaacagttaataaatggatggcaggtagtgagacaggtttctcactgtcacagtgggaaatcacatatgtacaagcaaggggaagaggctagaatgatccatgtgatcctaggtaatgaattagagttggagacatcagtatgaactcatatctagctttaacatagatacaaatggttacatacagaaatatttgttttatatatatatatatgcacacacaggttagtttacacacgtattcctttgctttgtcagcagagagggtctaaaataaatgacatatcaatatgaaatgatataattaatgctgaaatcttagtttttattaccatttggcaataaaaggagcctgggttccttggagaagtggctgattctgggaccaaggcaggaaatatacaagatgaacctggtatatctcgtagtgcttaaaagtaaggaagcactcaagaaaacaaactacaacaaaacacacattggcgggtatatattaaaggggcataggagtcaattgacatctcccgatgaccaaagatgtaaaaatgtgagcaacaaaataagcaacaagcagtatcttattataatccaaagtataaaataaacatccatgactccatgcttatacaaataactttttgcacaaattaattcatgagggagaagagacaaatgtcctgtgcatataatttccaaataatttatatagatgctccaccctcaaggaaggggcacataactcctcacttcttaggcatgggctacatacagtgacttccttccaaagagtacagaactggggtcaggttggggaagagtaactttgctatggggagcacctgacaaatacctcagctaagagatcaagatcagtatcaacattcattagtcagattgatagcatatacctgtgatatgatgtaataaaaatggctgtatatctctatagtcttcttccaaaaatcccataaccctaatcttatcatcagaaaatatcagacagacaccagaagtgggcattctgcaaaaaaaaaaaaaactgaccagcacttaccaaagctatcaaggtcatcaaaaacaaggaaagcctgagcatctatcactgccaagaaaagcataaggagacatgacagctaaatgtaatttggtaatctgaatgggatcctgaaacagaaaaagggtattaagtacaaagtaagaagcatgaataaactgtgggctttagttaataataatgtgtcaatattggctcattaattgccacaaaggttccataataatacaagatgttaaatgtaggggaaacatggtacagagaatatgggaactccctatactatcttctgcatttttctgtaaatccaaaactgttcttaaaaatgaagtcaatttaatcaaataataacgggatattctatacaactgtcaaggagcaaatgatttcaatattatttaaattgttcctgagtgtagtaaaacgtaaacatttctcaattcatgttatgagtctgggataatcttattacaaaactagaaaatgatagtagaaaaaagggaaaatgtaggtgaatattcattgtgaacatggatgtgaaaacttcaaaaataagatactaacatatcaaatctaaaagtatatttttaaaagatacatcaggataaagatggatttatttcaaggacacaaagatggttaactgattaacatgaatcactgcattaacagattaagggagaaaagtcatatgaccttctcaattgatgcagaaaaagcatttgataaaattccaaacctgtttatgaataacgactcttagcaagcaatgattcgaagggaacttccttaatttgacaaagcaaatatagttaataattagatattgttagtattctctttaaagttaggaataagacagagtccaagtatacttctgtccaatattgtacaaagtaaaaaaaaaatgatacaagcattgaaaaggacaagtaatctcccatgattactacatgggaattattaaaaaatcagtagtcttttagaagtaatggaagagttcatcaagtttgttggatagaagatcaggatacatcagttgctgtcctataaacccaaggtgtattttttaaagggaccaaatttcatatttactgtttatttcatgatgtagagattgtaactgtaacagtttctgagcattcctcatttcatcaaaatggatttaataaatgtctaactggtgaagatactgtattaggtgctatacaataggttctatgcagaatcgaccctctagaagtttataattttggggcaccctgcactaacagacggaaatacactaactgcagaacagaaataataagccagtacatatatgaacactaaaatgtttagatttaagtttaaaattacaaataaagagactttatctcaacctttttattgtgaaaaatttcaaacatataccaaattgaaagaattttacagtgaatacttaagattctactattaacattttattgtagttgctttatatctgtcatctattcggccaaaagaaattaaaaaagaaaaacactgacaacatctagcattgtcaggagaagcagcaacagtgtgttgataggaatgtaaattggtacaaacactatggaaaattacttttatacagtaaaactgcacatctgcttattcctgtgactcataaaatctgcttctagctatttaccctagaacattagctttcaaatgtttttgaccataagccacagtaagaaatgtacttaacattgtaattcagtacacacacacatatgtatatatatgtctctatgtatgtgggtatgcatatatgcatatatatctacataaacaatatgcacacacatacatatacaaaaggcacaaacttttctgagtcaatatttatcctaacttccaggaaagcattctgatattttctgttctgttcttttttaaaaaatgctagttatggcaactgaagtcagtttactgccctgttaattggtcgtgacctacaatttgaagaacactgtcctagagaaagctgtgcacatatgtaatattgtgcagcattgaaaatgaactatagctatgcatatcagcatggaggagtttcacaaacacagtgttgagtgagaaaaccaagttgtataagaatatgcacagtatgatttcatttgtatataaatttcaaaagcatgctaaaatgaaaatatatttagataaacatatgtggaaaagttttttttaagtgaatgatttatataagcaccacatggatgaaccttgaaaacatgttaagtaaaagaagcaagtcacaaaaggtgacatattatatgtttccctttatatgaaatgtctagaataggcaagtctgtatggacagaaaatagcttagtgaatgcctagggctgggagttgcaagaaaatgtggaatgactgctaatgggtatgggatttttttgtggagggtgatgaaaatgttctaaaatggattaccaggatgattgtacaactctgagaatatactttaaaaactattgaattgtatcctttaaatgggtaagttgtatggtatatgaattttatattgatagagctgttttacaaaaaagtaagaatgttttaaaattcaggataatagttatttggagaagaagggacttgagatcaagtcaaggcacgcagtactctttgaaagtatcagtgatagtctattgcttcacctaggtagtaggcacatcagtgggatttttattgttattgtctgttttatacacgtcataccttgttgtgtatttaatatttaacagaaattttaagagaagcaatatttttcatattcttctattctcatgcctgttgtgatcaagtttaacatagaatattgaacttctagtgtaaatctagattaggaccagttttcatccaaatatgtcctgtttttaaaaattactctttttgtattaaactttcaaaaaaattggaataaaaaggtaactatcccattatatagtctgtgggtcagaatattcttaactataacctgttcgcttttcttcatcacctttgcaaccaccctaattcacctgttacatttttcgacattctcttaactgtattccttgcttcctttcttgcacctctccaaacaactttctactttgcagccagaaatatcttttgaaaatacagatattagtatgttatttctctgctcaaaattttttagcaaaatctcactctccactgtagataaagactgaattctttaagattactttccagggcctatatataatttgtcactgctgctttttgcatcagcttccacccacacttgttgttgtttttaccacacatatcaggttctattgttagcttctgagtactttgtacatgcccttttctctgccttgaatgttcttccttctctctttacctctgtaacaactaccagttcttcaggcagaagcttagattttttccttccttatagaagccttctcttaactacccctacccttccttacctaagactaaaatgcccttcctattgttcccaaaggatttttgcttaatatacatttacatttatttaaaatatgctttatattttatatacataaacaaaaacaatgcgctatgtaacatgctgaatcagatacatgagagaaaataaactaagaatgagtcaactcgtatttagtgttttttgttatcagactttcttttctttatatcttctgtcatcccctttcagttcatcttagactattattcctgaaatagtgcttggtaatattagtaatagcagaatccatgtatcatctccaatgccttaagaatacattctagctctttacagtgaattcatgacttctactgtcttaattctaatgtactttttaaggaaagatggaccaaatatttatttaatgcctattatgtactagattatactgtaccttatatttcaaagattatgttaacccttttaacaactcaggttatggaaactaaggattaaagaagtttagtaatgaagacaggattacactaatagtaaatagtagtaccaaaactcaagcacagtttatcacagcagttctcaaacttttccatggatgagagtcaactagagaacttgttaagatacagattactggaccccaccctcatagttttttatccaatatatcagcaacagagaggaggggataagggtggtatgggacattttgcctttccaacaaattcctgtatgatgcatatgtttctggtccagagaccacaaattgaaaaatactaatctgtcagacagcaacatctttccactggtccttcttagcctcatattactcctctataagtaagcaagtggatgcttgctggtgagagacaatatactcaaaatgcacttggtgctttttttaactctatgcttttgcattatttttcccctcctcctaaactgcccttctttttgatttttgttttgttttgtttttttgagacgaagtcttactactgtcacccaggctggagtgcaatggcacaatctctgctcattgcaacctccgcctcccagattcaagcgattcttctgcctcaggctcctgagtagctaggattacaggaacctgctaccacacccggctaattttttgtatttttagtagagacagggtttcactatattggccaggctggtctcgaactctgaccttgtgatcctcccacctcggcttcccaaagtgctgggattacaggcatgagccaccacactggctacttttttttaacctatggtactttataccaatttgtgttactacttactatcttgtgttgtagttgtttatatgctttaatgttctacattttacaattataaacttcttaagcatttgggttgcatttattccataatacttagtacagatctttagctatttgataaatattggaatatgctaaaactttggtgcttatagtttttaaattattgaatgatataatgtttgtaaaaatactttattaatcctaaagcattatatagaggaggagtactttcttcttgcagtgactctggacattctatagatgaaaaagtatgtcttaaaattaatttttaaacacttcaaagagatcagggaaatgagaaagaatacataaatctctgatgtaatgttttgacaaaatagtaaaaaaaaaaattgatgggaaataacaaatgtaatctcctggctgtatagaaacctttaattatatcacatatgcatacatacacacacacagaaaaatagtggtctggatgtaactgttggttatattagcactgctactaaggtgtcaacctagagcaagtgaagtattattggagacataaaaagcctggatttgattaccaaaaattggaataaaaagaattaactaagttttcacttgccactaaccttctaatggagggagttacaacattcttggaaaataaaatccaacacatttcataacgtgataaaattgttacagtgatgtcagtaaggataagttaatggacattaataaacacaagatggaatgaacttactggataaaattacaaaaatcccagagctatgtattaatcaaattctttgtactccaaattatttttccatattttgtaggtaactatatttgtctttccttcatagaaatattgggaggataatatgcagtaattgttatggtaatatttctagtttttagaaggaaaggtgctacaaacttccggatgtagctaatactatattctacgagggattattgtgctcttagttaaaattctagatttattcaataaattgctagatttgcttacatgaaaatagagaacttaatattgatgacattccaatcatattactggtgatattataatcaattagctatcatattgacaaaaagctaaaatgtagcattttagtttggaaagaaaaacaaaattcctaagtaaacaggaacatattaagaactatataattacccagtgccattttgtcactaaagtactttatccaattctgactgccagaactaaaacagattttgaagaaatatcattaagattaaaggtcagaaaatagccttaaagtttttaatgaaataatgaatagtttttctagtaagaagaaggccagcaggtgattcagtaaacattttcagatatatggaaagttgtaaataaatggcaatcttctctttcagattgtaagtaggacaagaagaaaaagtaataaaatataggacagttttaggttatttcagagaataagagtggttaaagaaaaactcagtcaagacatttggggaagagtgttcttacattactttaaaaatactgtaaaattttaaaaatagcataatctctttgttttcaaattatgaaaatgagataatgttaccagatcagagtaacacaaccagtcaatgacagcataattccagctctcatatgaaaatctaggcctttgctccttgactccagtcttccactgcttttccatttttttatgtttcttaaccagttagtttaaatgtagcctggaaattgacaattatctctgaaagatgtttctagcttaaaatgcctgtgattatcagtgggtctattaatgaatgagctctccaacctcttcccttctgccattcacttgtgaaaaaccttgttttactttaaaacttatagacttcctgagaagcaagagctcaaatctaaatcttaagtgctttttgtgttagacttttgaacataaatatcactaggcatttttaatgcactatctcaaactcttaaacaattgtataaaatatgaagaagctgaagttagacaaaataggtaattagacttggtcagattgcttaaaagtaggtaaattattctgattccacattcagtacattttttccaatttgccatactaaccataatgtaaaaacttcaaccagaatgcctaatttgtatagcaagcagtgaatgtcttaagataacacttttattcctaaaacagttgttcacatgtaaagtaaaatgattgttatttgttcttaatgtatttaaaccgggcattcatagcaatttagtgttcatctactttctcttttctttcaggcctgtatgtggaatcagagggaaaacgctcataattaacctgccaggtagcaagaaaggatctcaggtaaatcacctggacatattaatggtttagtgtaagagcttttgaccagccgtgaaagttagccagccaaaaagttggagcactccacaagactgccctcacatctgataccaattgcaggattcccaaagtcactcttgggttcagtaattcaatggaaagacatagaactcactaaaaactgttacacttacagttatggtttattatggggaaaggatacagattaaaatcagccaagagaagaagtgcataagacaacgtccaggaatactaccaaacacagagagcttcccttgtcctctccttgtagagtcatcaatgctttactctcctggcattcgtgtatgataatatacttgtaatatttttaatcagagaagctcacctgagtttttgatgtccagagtttttttttttttttttggtttggtttttttttttgttttgttttgttttttttgcagttcattatattttgcccatgtgaatgacctttagtctttagcgcttcccagagattggattgatagcattagtctccagtatgttccagaactgacaccatgtggccaaaagtccccatcataagtcatattgttagattgtgtggtggccaaagccatcaggtaaacaaagacactgctgtcacacatgacattctgaacatctagagatctcctccaactagttaagggcaactacttttaccctcagactctctttgggtactgttaattctttgctgtacaagctaccccctggcctttggccaaggctttttttattgtatagcaacacagtcatgtttgtctgggcatctatatttactatggtatttatgtgacagacacagcagtagtatcagtgtgaatatgcctaagatttggccaaggcagtgtagggtgtggatatatttagagaaatagctaatccatccactaaagccattacatacattttcataattttgtattaagttactaatttctcacctttaatctaccactattgatatgtttgtacagaactatatatcatagaaattagctgatggttacctaagtgcatttcttcctcaggccagtcattttctattaacattatatcctgaggaggctttaactgaatttcccaatacacttagccataacctaaaaaataaaagtcaaaagatactggcacgttcttagagtccttctcagacattaacagaccagaatgtctcccagaatgatgctactcaggtttgcaggcttgttggattccaaaaataagagtggtctcagcaacatatgacttcactctttcaagcatctgttacagttgagctaagaaacaatgtcatctcttgttctgaacctctttggagataccaatgcagtattatttcccttactgcataacctatccattcattcctttaccctcagctaccattcttccttctctctatttatacccaaactttttcaccttttaaagagttgtaaggtttggccactgtgctgattcagattgccgttggtaatactagtttagcaagttcctcctgcacagtctattcctattcatttagagtaggattgtatcccttaccttcattttagctagcatagataacaataaccaagagattgtgtgtttaacttctttctttatattttgcatctccttatgcatccagtgagataactttttgggaattatctccattaactaatcacagtaaagaagcaattccatgctgtggttgacactgtcttcactcagggatcaaaggttcatcatcccacaccctctcttcacttcctaagccatgtatttcagtgagtcagggtctttctagaaaatcttatttttgacaccaactgtaaggagttttagccaactgcaaaaaatagccacctacaaatgtggagtactccacaaaattgctcatttctgaccctaattgcaaattcaggagatcctaaaatgaccttcaggtttaataatttactagcattcatggaactcacagaaagctgttatactcatgattattgttcattgcaaggaaagaatacggattaaagtcagccaagggagaaagtgcatagggcagagtctaacagaagtaacaaatgaggaacttctgttgtcctctctctttggagacatggacatgtcacccttctggcgtcaatctgtgataccacacatggagtaatgccagctggggatgctcacctgagcctttggtatccagagcttttattgggactcaaacacttactgccagtgtggctgacctgtaatctttaatcctaaagtagagagaagcaattgggggccttctatgtagaaagtggggtcagaaggccaagaaagggagtatgagtatatatccaagtcacttaggaacttttatgcaggtgcaaaaaaacttatgtcaaagtggccacaagattatttaatagacagatgaatgaaagtccatgtttactgctagacacgaaagctttgtgtgaaatcttgaattaatggggagagagggagggtagcctatacctgtctgttcttttcctgatccctttccctcattcctgaactgcagtctaacattgttagactgtctctggtgcccaaagtccatggacaacaaagacattcctattaggcgtgaaattccaaggacctagagatcactcccagaagctgagtgtaaagaccagacctctcctcggtcaaggttaaattctttaccacacaatctttaaagagtaaactgattgagccatacaaagataggtcgaaagattaaacatctttcccgatattatgtaaccctccaaaaatttttaagatttttttttttacatcttagattttaagctattacttcaaatgtgaaagagaaagacctccacctcttctgcagctatagctggccttatattctgatttttaggttcttacctattctcttttggtaatacgttatagataatagtgagcacctcagcagcagattatattaactttatgcagtgctctttgcaagcttattttatattttgcttgctgtacaatgttacctagctatactttatgatggtagttagaactttagctctctggacaaaataatctggttctcacctcggttgttagttctactgccctgctctaactaaaaatatgaaacctctttcctgcctttttttaaacaacttcagtaccaataaatctttattcattgtattttcccaagaaaaggagaagggataggaaaagagtcagcatgtgtgttaaaaaaatgattagaagatgggaaaagaagtagagaatacagcaaaatcaaccatcaaataaacataccccagtggtggggtcaccgaagcccaaacgggctcaatctcctgcagttcaagaatgaggggttgggattaggaaaataacagacaggtacaggctactctccctccccataaattcaagatttcacacaaaggtttggtgtctagcagtaaacacagagtttcatttgtctgtctcctattaaacaatcttgtggccactttgacataagtttcttgcatctgtgtaaaagttcctgagtgccttggatataaatattcatattcttttacttagcctcctgagcccactttctgcatggaaggcccccagttgcttctctctacttttggattaaagattaagtagatttggccaggcgttggggctcaggtctgtaatcccagcactttgggaggccgaggtgggccgatcacaaggtcaggagttcaagaccagcctggccaacatggtgaaaccccatctctactaaaaataaaaaaaaactagccaggcgtggtggcaggcacctgtaatcccagctactcaggacgctgaggcagagaattgcttgaacccaggaggcggaggttgcagtgagacaagatggcgccattgcactccagcctgggcgacagaatgagactccgtctcaaaacaaacaaacaaaaaaaaatggttaactagatttgacccatccaagatacagcagtgtcttaagtgtttggcatgaatcacatcaagaaatggtcttgactcaggaggttgggaacaagggatgaagggctcctagtttcttcaggatttttgcataaatcatttaagagttgtagaaataacgcaagaattaaatgtgtgtatgtgagtatgtaagttttctcttggggaggaggggatggaaaagagggtagtatacaagtttttagaatgtatttatttatttatttttagagacagagtctcactgtgtcaccctggctggaatgcagttacacaatcatagctcactgcagcctcaaactcttgggcttctttcctatctttcctgtctttctcataatgcatctttcaactaccaagttgtatatagaaattttactttttttaaaatgcagtgcatgctttttttttttttagagaatgaatctgattctgaccatccatgcctgtcctcagtcttatttttttttatttttccataagttattggggtacaggtggtatttgcttacatgagtaagttctttagtggtgatttgtgagatcctggtgcacccttcaccgagaggtatacactgcaccatatttgttgtcttacccctcaccccccacactctttcccataaattcccataagtccccaaagttcattgtgtcattcctatgcctttgcgtcctcatagcttagctcccacatatcagtgaaaacatacgatgtttggttttccatttctgagttacttcacttagaataatagtctgtaatctcatccaggtcattgcaagtggtgttaattcattactttttatggctgagtaatataccatcatatatatataaaatagtttctttatccactcattgattgatgggcatttgggttggttccacgattttgcaattatgaattatgctgctataaacatgtgtgtgcaagtgtcttttttgaataatgacttcttttcctctgggtagatacccagtagtgggattgctggatcaaatggtagttctacttttagttctttaaggaatctccacagttttccttagtggtttcactagtttacattcccaccagcagtgtagaagtgttccctgtttaccgcatccatgccaacatctactgttttttgattatttgattatggccattcttgcaggagtaaggtggtattgtattgcagttttgatttgcatttccctgatcattagtgatgttgaacattttttcatatgtttgttggccgtttgtatatcttattttgagaattgtctgttcatgtcattagcccactttttgatgggattgtttttttttttttttcttactgatttgtttgagttcgttgtagattctggatattagccctttgtcagatgagtagattgtgaagattacaaaacactgctgaaagcaatcatagacgacacaaacaaatgtaaacatatcccatgctcacggattagtagaatcaataatgtgaaaatgaccatactgccaaatgcaattttcaaattctatgccattcccatcaaaataccaccatcattcttcacagagttaagaaaaacaattctgaaattcatatggcaccaaaaaagagcccgcatagccaaagcaagactaagcaaaaagaacaaatctggaggcatcacattacgtgatttcaaactacactataaggccatagtcaccaaaacagcatggtactggtataaaaataggcacatagatcaatggaacagaatagagaacctagaaataaaatcaaaaacttagagccaactgatcttcgacaaagcaaacaaaaacataaagtaggaaaaggacacccttttcaacaaagggcgctgggataattggctagccctatgtaggagaatgaaactttatcctcaactctcaccttatacaaaaatcaactcaagatgaattaaggacttaaacctaagacctaaaactataaaaattatagaagataacattggaaaaacccttctagacattggcttagacaaggatttcatgaccaaaaacccgaaagcaattgcaataaaaacaaagataaatagctgggacctaatttaaactaaggagcttttgcatagcaaaaggaatagtcagcagagtgtatgttttttttttttttgtcactgtaactatttttattacatcacaataattaggagtagtacagttcatgacaaaaatattacaaattttagatcatttcacagcacatactcctataaacatttaaaagttaatttcaattaaaagagtggtcatttttaatgtttcatatgaccaacattgtagcactgtagttccttagcttatggagaatgctataacatattttatgcttacttcatggcatattgctaagacaatgttttacatatgattgattctgagattgatggaggaaaatgcaaatccaaaatcacgaaacagtttgattgccaccatcttatataattacaaaagtgcttcatcttaatttttttttctttctcttgcatacaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaaggtaagcctgatgagagttactcagaggcctaaaggacccacaggtaaatgtactggtttcatctgttttgcatcgcatccctccctacatttaatacttcttcagagaaccctaaaaaaataagtgggatgtccatgacactccactactatgtttccttcttgatatagattccttgaagtcactgaagttaattctgagttctgaggcattactgatgagctgttgcctattgaagtaatagctacaatgataaacaacgtgacattttagaactctttggagatgtcatttttgtggacatattaaatatataatgtttatatattcaaagtatcaaaatgtcacaaattcttaaaggaacagcaaactgaaggtaaaagaccttagatgattcaagaaatgagttgggaaagattaataaagatttttaaagggacaaagcttttcagcgattgttgaatttttcttaactaataacttattcaaacattgcttgacacaaattaccctagtggtaaagataggaaatggatatatttgcatttctactttaagaaatattattaggacaatatcaaagtattacaaattctctttgggcaactccatgggtaaatatactaccatgagttacttgagtaaatttaactgtcttaaagttatagaacatggtttattcttcatacctactaaagtcaacctagtatgccttaatatctacagaaagtagcatatcaattctggaaattatgatttttcattaagagcataaagattgaaaatttaattgctatatgacataattatcagattttatggattatccagttattttggctacgagcattgtgaggttttttttttaataatatatagattagaatcatcgagaaatccttttgaagtgtccattcagtgatccagtgagtgcttactaaaggctagtaagtatttaagttttgtgtgattttttttttatgaaaccaattggtgaaacaggcatttttaaatcattatatgttccttttcctttactctgaattaaaagagtaagaagtgccataaatttcaatcttaggagagaagcttatggcatttaaaatctaagctgattctgtcattctacatttggaaaatgttagcatttcatttttccatttgtttttaccttttttcctttttagtcattttgcttgtatagtttcatgttttcctgtcactatattcatagttgttatgtgttgtgcattagaagcatccattctacaccagtcctgctgttgtcatggcacacggtgaacagcccatccctggtctcatcaattattcccatcattcaacagatgaacgggtaagacaagaggcttttgcattaatggttttccaaatatgtattctacttcctctccttggagataggctgtaacatatggaagatgtgttgttttattctgatggattttcagccttgctttcttgtgaaagtgtgagtgccattgagtatatccatcaaggaatttaatagagtttctcctgtgactaaagtactctgctatcattaagattctgtcatttgtgacaatgaacttttatcaaatgacttgcaagaaagtcattgctcagaagttatttttgtcttaccaatttcatcagatatctttaaataaattgcctggcttaaaattacctcttaagagaatcactttgagtcttaaaatctagacagattggtcaagcaaatagttgatttgtattaaccttcctgttttgtcttatgattttgcatctcatttttttttcattcattgagctctcattacaaccattgcagagttgaattttgatataaattctgtgattcctcatcataagtaaactttttaggtgcatatttgtttattcagtcagtggctgaatgatagcttgcaaaaaaatgccaggttgtaaaagattaaactgatacataaaaatcattaaacagtgataatttagacattggatgaaaaaaaaacgatctaagtccctaatatggatgtaaaatgagaggggcagagaagaaaaagaaataataaagtgaaatttggttttaaatacttaggaagcaaaacacccaaaattaggagagaaaaaaaccaacaacttagcatccatagtctcttagaagatactaccaagtgaagactttttaaaaattttaattttgtggggtacatagtagtggatatatttatggggcatgtgagatattttgatacaggcatacaatgggtaataatcacatcagggtaaatgggtatccatcacttcaagcattcatcatttctttgtgttacagacattccaattgtattccctaatttattctaaaatgtacaacaaattattgctgattgtaatcaccctgttgtgctatctagatcttatccattgtatctaactatattttggggtacccattaaccatccctatttcccactccccctacccaccctctccaccctctggtaaccatcattctaccatctttatctccgtgagttcaattgttttaatttttagctcccacaaataagtgagaacatgcaaagtttgtctttttgtgcctggcttatttcatttaacagtgtcttccagttccatccatgttgttgcaaatgacaggatctcattcttttttatagctgatcagtactccattgtatatatgtaccccattttctttattcatctgctgatggacactcaggttgataatgctgcaatacacatggaagtgcagatatctcttcaatatactgatttcctttcttttggatatacacctagtagaggcattgctggatcatacgtagttctgtctttagttttttgaagaacctccatactattctgcatagtggctatgccaatttacattcccaccaatagcgaacaagtgttcccctttctccacatcctcaccagcattcattattgcctgtcttttggataaaagccgtattaactgggaagagatgatatctcattatagttttgatttgcatttatctgatgatcaataatgatgagcaccttttcacatacttgtttaccatttgtatgtcttcccttgagacacatctattcagatcttttacccatttttaaattagattgttttatgttttttcctatagagttgtttatatagtctggttattaatcccttctcagatgcatagtttgcaaatattttctcccataccttggattctcttcattttcttgattgtttcctttgttaggcgaagctttttaacttgatatgatcccatttgtttactttttcattggttgcctgtgtttgtggagtattactcaagaaatctttgcccagtccaatgtcctggagagttttcccaatgtttccttttagtggtttcatagtttcaagtcttagatttaagtatgtaagtctttaatccattttgatttgattttttatatatggcaagagataggtgtctagttttaataatctgcatatggatatccagttttcccagcaccatttattgaagagactgtcctttccccaatgtatgttcttgacccctttgtcaaaatgagcttactgtacttatatggatttgtttctaggttctctattctattccattggtctatgtatctgtttttatgccagtaccatgatgtattagctactatagctctgtagtataatttgaagtcaggtagtgtgattcttccagttttgtttttatttttgcttaggatagctttggttattctaggtcttttgtggttccatataaatgttatgattattttttctgtttctgtgaaggtattttgatagggattgcattgagtccatagattgctttgggaagtatggacattttaacgatattgattcttccaatccatgaatacggaatgtctttcctttttgtgtgtgtccacttcaatttcttgcaaaaatgttttatacttcatcatagaaatcttttacttctttggttaaatttattcctatgtgttttctttgtagctattgtaaatgggattactttcttaatttctttttcatattgttcactgttggcatatagaaatgctgctaattggccaggcgtggtggcttacacatgtaagcactttgggaggctgaggtggttggatcacctaaggtcaagagttcgagaccagcctaaccgacaaggtgaaaccccgtctctactaaaaatacaaaaattagcctggtgtggtggcaggcccctgtagtcccagctactcaggaggctgagacaggagaattgcttgaacctgggaggtggaggttgcagtgagctaagatcgtgccactgcacttcagcctgcgtgatggagcaagactccatctcaaaaaaaaaaaaaaaagatatgctactaatttttgtttgttgattttgtatcctgccactttactgaatttgcttattagttctaatggttttttgttggagtcttaggtttttccaaatattgtatcatcagcaaaccaggataatttgatctcttcctttccaatttgggtgctgtttatatctttctgttgtctgactgctctagctagcacttccaatgctatgttgaataacagtggtaaaagtgagcatctttgtcatgttccagatcttagaggaaatgctttcagtttttccccattcagtatgatactagatgtgggtctgttgcatatagcttttattatgttgaggaacgttccttctatacccagtttttttagggtttttatcatgaagcaattgaatttcgtcaaatgctttttcagcatcaagtgaagtgatcatacggtttttgtcattcattctgtagatatgatgtatcacattgattgatttgcctatgttgaaccatccttccatccctgggatgaatcgcacttggtcatgatgaatgatgtttttaatgtgtttctgaatttggtgtactagcattttgttgaggatttttacatcaatgttaatcagatattggcctgtagttttctttttatgatgtgtctttgtctggttttagtatcagggtaatactgaccttgtagaatgagtatagaagtattccttccttctctatttttcagaatagtttgagtaggattggtatcggttcttctttaaatattttgtagacttcagcagtgaaggtattggttcttttctttgctgggagactttttattatggcttcaatctcattacttattgctgtattcaggttttggatttcttcatggttcaatcttggtaggttgtatgcatctaggaatttatccactacttctaggttttccaacttattggcatatagttgctcatagtagtctgtaatgatactttgaatttttgtggtataatcatgatgtctcctttttcatctctgattttatttatttgggtattctctcttttcttctttggctaaagatttggcaattttgtttatctttcttagaaaaacaacttttcattttgttgatcttttgtactgttttttgtttgtcttaatttcatttattgctgctctgatctttatttctgttcttctactaatttgggcttgattttctctagcttttctagttctttatcatgtgtcattaggttgtttatttgtagtttttctacttttttgatgtaggtgcttattggtataaactttcctcttagtactgttttgcctatcccataggttttggtgttttgtgtttccatattcatttgcttcaagacattattaatttgcttcttaatgtcttcagtgacccactggtctttcaggagcatattgtttaatttccgtatgtttgtatcatttccaaagttttttttattgatttctagttttatgctgttgtgggttagataagatacatatgatttcagtttttttaaagacttgttttgtggcctaacatatcgtctgtccttgagaatgattcgtgtgctgaggagaagaatgtgtattctgcagccattggatgaaatattccataagtatctattagatctatttgatctgtaatagagattaagtccaatgtttctttttttttttttttttttaagatagagtcttgctttgttgcccaagctagagtacagtggggcattctcagctcactgcaacctctacctccaaggttcaagcgattctcctgcttcagcttcccgagtagctgggattacaggcacgcgccaccgtgcccagctaatttttgtgtttagtagagagggggtttcaccatgttggccaggctgatctcgaactcctggacctcaagcgatccgcctcccaaagtgctggaattacaggcctgagctaccacgcccagcctcaatgtttctttattaattttctgtctggagaatctgtccaatgtttaaagtggggtgttgaagtctccagctattggcatattagggtctgtctctctctttagttctaataatataataatatttgttttatatgtctggatgctctggtgttggttgcatatatgtttacaattgtcatatcctcttgctgaattgattcctttatcattataaaatgaccttccttgtctctttttatagtgtttgtcttaaaatctattttttctgatctaagtatagctactgctactctttttgggtttccacttgcatggtatatctttttccatccctttattctcagtctgtgtgtgctttttttttttctttttttcttttttgagatggagtgtcactctttcgcccaggccggactgcagtggcgctatcttggctcactgcagtctctgcctcccgggttcacgccattctcctgcctcagcctcctgagtagctgggattacaggcgcccgccaccacgcccggctaattttttgtatttttagtagagacggggtttcaccgtgttagccaagatggtctcgatctcctgaccacatgatccgcccgcctcggcctcccaaagtcctgggattacaggcgtgagccaccgcgcccggccgtctgtgtgtgtttttataagtgaagtgtgtttcttgtgaccaacagattgttaggtcttgttttctaatccattcagccattctgtgtcttttgattggagagttaagttcatttacattcagtgttattattgataagtaaggacttactattgccattttattatttgttttgttttgtttttttctagttctttgtggtcttctctttcttccttccttcctgtctttctttttgtgaaagtgtttttctctggttatatgttttaatttcttactttatattttttgtggaactattgttagttttttggtttgaggttaccatgagccttgcaaatactatcttataacccattattttaaaccaatgacaacttaactttgattgctaggagttaagagcaaagagacaactgataaaaactctacactttaaattcatccccccagttttaaacattttattttttctatctatattttataatagtatgtctcaaaaagttgtaggttttttttttttttttttgagacagggtctcactgtgttgcccaggctggagtgtaatggtataatcacggctcagtgtagccttggcctcttgggctaaatcagtcctcacatctcagtctcccaagtagctgggactacaggcacgcaacaccatgaccaactaatttttgtattttttgtaaagacagggtttcactattttgcccaggcttgtctcaaactcctgggctcaagcgatccacccaccttgccctgtctaggtgctagatcacaggcatgagctaccatgcctatagttattattttttagatcatctcttagttgtcctactcaagatatgagatgagtaatttatacatcacacttaacagtgtataatattctgtgtttgtctgtgtatttattgttaccagagagtttggggccttcagatgatttcttatttctctttaatattcttttatttcagagtgaagaacttcctttagcatttcttgtaaaataggtctggtgttgatgaaacccctcagcttttgtttatctgggaaggtctttatttctccttcatgtttgaaggacattttcacaggatataattttgtaggataaaagtttttttccttcagcagtttaaaatttgccattctctcccagcctgtaaggtttccactgagaaatctgctgccagacatattggacctcctttatatgttatctgttatttttctcttgatgcttttaggatcctttctttatccttgatctttgggagcttgattattaagtgtcttgaggtggtcttctttggggtaaatctgcttagtgttctgtagccttcgtgtacttgaatattgatatctttctctatgttttgaaagatctttgttaatatctctttgaataacctttctaccctgatctcagtctctctctctctctctaccttttctttaaggccaatacctcttactgccctttgaggctattttctagatcctataggtgtgcttcattattttttattcttttttcttttgactattctgactgtattttcaaatagcctgtcttcaagcttactaatttttttctgcttaatcagttatgctgttgaaagactctggtatattcttcagtttgtcaattcagttttcagctccagaatttctgcttgattgattttaattatttcagtctcttagttaaatttatctgatatgattctgagttcattctctgtgttatctttcattttgttgagcttcctcaaaacaactatttctaattctctgtctaaaaggtcacatatctctgttactacagacttggtcactggtgccttatttagttcatttagcaaagccatgcttttgtggatggtcttcatgcttgtggctgttcatcagtatctgaatatttattctaatctttgaagtctaggcttgtttgtacccatccttcttgggaaggctttccaaatactcaaagggaattaaatgttgtgatctaagtctggtcactgaggccatatgtgcattagggggcaccccaactctagtaatgctgtgagtcttgcagaggtactctgactcttatagaggtactgccgtggtggtcttaaataagatccaggagaattccctagattaccaggcagagtcttgttcttttcccttacttttccccaaacaaacttaatctccctcttcatgctgaactgcctggagttggggaagggttaatggaagcactcttgtggccaccaccactggtactgtgttgggtcactcctaaaaccagcccagtactgggtcttgcccaaggcctgtggcaactattttctggctgctgcttgtgtttactgaaagaccaagggatctttagtcagcaggtggggaatcctgccaagaccaggttttttttttttttttttttttttttttttttttttcagtgcagcaggtccccttctggcccaaggtgggtttagaaatgccgtccaagagctagggcctgggatgggaggctttaggaatcttcttggtgtttattttaccaggttgcaagacaaagtcctctttacttttccttctcctttcctcaagcagaagtctctccctatggccattatcactctaggctcagggcagctaccgcttggctgccactgatgtttattcaaggcccaagggctttttagtcaccactggtgagtcctgcgaggcctgtatctctcccttcaggacagtgaatgcctttctggcccaaggcaagtctagacatgccctccaggagctaaggttaagattagtacatcaaaaattatttgagtgacccatttttcagttctcccaaggattgtacacaactaataccattctagatgcataggagataagttaattattagggtttaattctttggaggaactagttgagaatgattgtaaaactgttctaactggatgttctcatatagcatcagtgaagactttctcattgattaactatttattagctggtatttaacagtcctttgtaaatagtaattggtcttttgacagatgttcagttttataagtagactcacatgtttatgtttcctgtgacaaatgacagttaacaacatatcaaagagtataatgttgttcttcagactgggcatctatctatacagtagaatgaaaaggaagaaataggtaacagaaaataatgaaaagaaggccttgatgcttctgaagaagttatgttaactttgaatgcttctctagcactaactttattaatgagtcccactggttctgaatgacctggtgtgttgtcagtgtgtcagaagacctctatgtgagaacagtcatttggaatatctatatatactatttggcttacttttacaagttttacctatgtaaaattaatattgaaagggagcacctgattacctattagaaagaaaaattacaatttccctcagctggtcacaatctgaggcatgtgaagcaatgtggaataatgttaaaatcttgtatttagagacggaaaacctggatataagcccttacctcaccacttaataattcggacaagttacttaaaatttaagcttcagttctcatctataaaatggaaataataattatcctgtatctcacaacagattattatttttagtacaggagatgacatatatgaggaaatttttataaactttgtaaattaagaattaagtatttgcagaattctttcaaggtaccaaacactatcctcactgctcagaatacaaatataaacaggttgttccagcccataaaaagttcacagtctagggcctgggtgcagtttctcatgcctgtaataccagcactttgggaggctgaggtgggcagatgtcttaaacccaggagtttgagaccaacccgggcaacatggcaaaaccccatctctactgaaaaataaaaaattagccagacgttgtggcacatgcctgtagtcccagctacttgggaggctgaggtggaagaatcacttgagcccaggaggttgaggttgcagtgagctgtgatcatactactgcacttcaacccaggtgacagagcaagactctgtctcaaaaaaaaaaaaaaaaaaagagttcacagcctagctgaagagttgcttttttaaattacttctttaccttcctaactcagttatctacttctagtaatcaaaaagtgaaacttggtcaatgtactgactgttcagtagttactaatgagctcattgctacttattgcaaaattaatcagcttgctatttcaggagatagagacttaagaaattcctcttgtaattgacatttgttcgttgtctgtccagcagtcattttccattccctcttcctagcactgtaccacatttcccagtcatgtagtttgggtggaattgattaaacctccagtgtaggttgtcttaatactgtataatcaacatacccatttcacctagccacagtcattagttaaaggatcatgtaattcaaagcagtcagagccagtggatttcatctcttatattttaatttaactactgggggacacagattctctgtttcctgctgaacatgaatgaggaaatatacaaccccaagaattacgtcttgggaccgtgaatggaatgcctgctatgatggaactagcataagaaacaatcctgagaaacagaagtttaaaagagatactgggtcccagtaacattttgtgaaccactcattcaagcccttcttgaactatacagactgcttgactttttggttacatgagccaataagctaatagagataactgttgtccataactaaaaagtatcttaactattataatatacctgaataagtactgtatcatcaaagaaataagacattttcctaataatgactaaaatgtatcaaataggaatccctgaagtttcatatttcagtaaaaaaacctgattcaagaggatagagggttggaaaatgtgacttaaaggaggaagaggatgaaaataaatcctgctcctctgtatttataaaataaatgaagatattttcagagagactggatccaaatctgaaggtgacaacttatgctttgcagcctcaaggcaactgataggttcaaaactcaaagtaataatattaacaacaggcaaagaaagaatttaagacaaagagggaagctatccttggagatttgtaataggaaatctcatttcactgacagaaattaaatcttctggagaaatccaaaacaataatgatgctccctaagctgtattgtatgaaagaacatctactgattgccctgggaagaaaaagagttggtgacttcttcttggtaaatgatacggaaaaaacaatatttttatccatatcatttgtatatatattatatatatatgtgtgtgtgtgaatatatatatgtgtatatgtatatatatgtatatgtgtgtgtttttatatatatataaaacaaacatgctgtatgttatgtttatcaaacatgtacatatacatgtatacaccaccgcatggtggctggcacctataatcccagctacttgggaggctgaggcaggagaatcacttaacatatatgtgtatacgtgtgtttatgtatacgtatacatgtgtttatatgtatacatgtatacgtatacatgtgtttatgtgcacgtatacatgtgtttatgtatacatatatattaaaactatatatatacagttttattgtttccttttatccatgaggattttgagatattaaaataattatattaattgaataccaatcattctctaagcattttatatatatcagctctttacgtaaatcctcattttgcttgtaagaaatctgaagctcatggtagttaagaacatggaactacttagtggctgaactggtattcaagtctaggcagtctgattctaagatgggaattcttgactactctgctatagcacctttcataaaagaaaaagtaaaagaagacattttgggaggtgacaaactaattataaactctcctcaaaaatgagaattggggtccaggtgcggtggctcacgcctgtaatcccagcactttggaaggctgaggtgggcggatcacctgaggtcaggagtttgagtccagcctagccaacatagtgaaatctcgtctctactaaaagtacaaaaattagccaggcgtggtggcgggcacctgtaatcccagctactcgggaggctgaggcaggagaatcacttaaaccccggaggcagaggttacagtgagcagagattgtgccattgcactctatcctgggtgacgagaaactccatctcaaaaaaaaaaagaaagagaaagaaatgggattttttaccatggtttgaaatacttaagtgataagatgcactgcccaatctaagaattgtaaacaatcgaatgtcgaatgtgtttactctggaagtttactgatccaagcaaaaaagctttaagctataaacatctgtggagtaagaagaatatatagataaatcaatataatgaaatactttggagaatacagtatgatacatgttaaaagatagttttataaaggttgagttataacacttagaagtataaaataaatatgtgccaaagattttatttaacttattaaataatgagagaactagtaagctgttacaccaattcaaacaagaatggaaaggacacagacatatgtcaacagtcatgaagactggaatgaatttataaatagaaaatttgtgcaagatatacaggccaatgagtagttgctcctgatcaggactaaacttatttgcatttctatggacaggaatcattacttacattattattagttttcttcaacttgcaaagttgtaaaatcgtgtaaaacaatgaaaagtacagataactcagaaggatatacaagtcagggcattctagtaatcttagtaatcgtgaagataatttttttttccagacaggagcttgctgtcacccatgtcggagtgcagtggcacaatcacagcttactgcagcctctaccttctaggctcaaacaattatcctgcttcagctgcccaagtagctggggactacaggcacacagcaccatgcccagctaatttttgtattttttgtaaagacagggtttcatcatgttgcccaggctagtctcaaactcctggattcaagcaatccaccctcctcaacctcccaaagtgttagcattacaggcatgagccacagagcctggcctctaagatagtttttatttaccacaaaaaaatgtgtttgatctcattaggtttgggctgattcgttacataactggagcaatttttttttttttttgagactgagtctccttctgtcgccaggctggagcgcagtggcacaatctcagctcactgcaacctccacttcccgggttcaagtgattcctctgcctcagcctcccaagtagtgggattacaggcatgtgccaccacacccagctaatttttgtatttttagtacagacagggtttcaccatgttggccaggatggtttccatctcttgaccttgtgatccggctgcttcggcctcccaaagtgctggattacaggcatgagccaccgcacctggccgcaagattattaattaaccagatatcctccttaagtttgttttacaaataagaagaccacaaaattaatttttgtctggaaattttcttagggaatctcagattctattaggttgttaaaaaagtaattgcggtttttgccattacttaatacttttaaaggtctctatttttgccaacccaagattagtaaactatgcccaagaaacttcaccatcatcatcattttggtaagttcctctcttctccaggtcaccaaaattttattcccacatgtaagtgatcttccttaccacataaaaggctgaaaccttctgctccaggtactaggttggtttctctgggagggcattgtcaccattggcttcaggagtacagccaatatttttttcttcaaagtggtagtgatatttgattagatgaccatcattctcaaatatatctccaggtaaggccttggttgcacaatcagtttgtacaattatatcctgtttaaaaggaagacattcttattaggattgcaaataactatactgtcaagaaaagttaggaaattactaagagtttctgaatttggaggaagtcagaatcaaatattattttgaaatgtttcatattagtttaagaaatcagggtctactaaattgtgtgggttacatatagcttaaaaagaagaaaaagagcttcctcatgtatccagaaaatagaacatttaaaacaaccagtgtcaatactactccaaacaaataggaaaagaaatttccttctgtattcctttttcattctgtgttgattcagtcctgtgataattaattattattcaaataagccttggcttagcagtctgctttcatgaaactttctgcttctggcctgagagagttttagaaattctaactcagtccactgtttaggtccaaaagttgtccaagcagaagtctactcatgagtctattctttcaagtattagtactttgaagtatttggtacaattctttccatgaagcttttgaaactatctctgttgaacacacaaactctggcctatagcttaataagcataatcttcaggtaaacatcaaaatttgttcatagatgacagactattgttaattgtaaccaataatatcaaaatgcaagaggttaaaattctttccactgggggataactatttcaaaagagttttgatcagtatccccttaaactaaaaactcttgcaaatatggtcaaatgatttttgaccagggaaccaagaccattcagtggggaagacagtcttttcaaaaaatggtcctgggaaaactggatattcacatgcaaaagaattaatttgaacttttatctaacaccatatacaaaaattaattcaaaatggatcagagacctaaagctaagacccacaatacaactcttggagtcaaaactttatgacattggatttggcagtgattttcttggacatgacaccaaaggcactggcaacaacagcaaaaagtacacaaattagactgcatgggaattttaaatctttgcacatccaaagattctatgaacagagaaaaaggcagtccacagaatgggagaaaatatttgcaaattatatacctgataagagattaatatccagaatatacagagaactcctaaaactcaacagaaaaacaacctgattcaaaaatgagcaaagattgttgtagaaaaaaaacaggttcttgtcacaagaccagaataatttaggcatgtggacacattgtagggtgagtagggcaggatttattggatgaaaaggaaaaaaaaagggaaattggaactcctggcaaagcaagagagaatcctgctagcaggtttcctgcctcacagatttaattgcaggccaccccacacgcaagctgaagaccccaggctcctcccctctgcaaatggtgtgggattccaaacttcccgtaactccaccccatcctccccgtgccagtcagagattctccagggatcctctgccttatctgcctcctgcatctatcattccccctctgaagacatacatttaactgccgttaaaataaggataaggatgaataccaatcttaactgcttcctgctggtaaggggcactgttttggtaaacagcagtcacatctccttcagaggcctatctaagggtccccaacaaaagggaccatcggccaagcctccagttgcatgaccgtttggaggttgatggcctgaaggtgacaagagagaaaccaggttattagaaaacttgtatcaaaatgaaacaaggggcaggtgaggacagctcaaaaatctcgtgtcctttgaccagtctgtacagggagaagggggaccaaaagcttgaccggtaagaaaaacttttacccttttgctagcatttcagacttctgggttcctgtcccctgagctcaatcctaagccaatcagtttaaggtttgggaaattaactcttctcagtttggaagatgtatccaaagggagtgtcccatagtatggagacacagttacctatctgtgaagagaggacagggaaggaaaaaggaaaaaaaaaaaagaaggcgttttgttgttgttttttttcagaggagtcccagtggttcaggatgcaattgaaagggatacagactgaagattaatgactactcatgtagaaagaggggagcaggtgtccctggttcctttttcttcctagcatatacccgaggtatgtgagggagggaaagtgaggtgttcctctttctttcctccatccttgtatcccagtgactgcaacagggtgccacccataggttttaaagtggctttcacccatgttaacagggggagctaaggggtgggaggtatcagcttttaaccacatatgccctatctccactgctgtcagtagccttgaattccccagaccccatttatgcgatggatactagcataacctttattcatgaaacaagaagcttggcttaactggcaggaatcagtcatgctcacctgcattgtgccttttaacttccattaccgtctgcctctggattcctcagatctagtgttctttcctagggcgttgacccatagcttggagttgagtttgagacaaaaatgtgtcttggggtggggaggagttgcatggactccttatcataagctgaatgctaaggtgaagctgtggaattgagtcctcctccaacaagggagagaaaaggatgtctcatgacatgcccaaataactgttggctatattcatgcttgctaagatttgggtgcatggtgcttggctttggttagctcccttggtcttactttcccaaaaaggaaacctggatgggcatcctatttattgccatcacctggcaggatttgcaggttaattgctcagaactagaatattgatccagatttctacatcacctgtcccttttgttctttctgagctacagctggagattgctggaacatgcagggttagtctaaaatgtaggttacaacttaaaaacaactaggagtttagaatgtaatgacaaatgtataaattgtgaaacataatttctctctctccagtccttattttcattaaaaaaaaaatcatgataggactgagttgtttgcaaaatagacttagtcttatatttagcctgattatttgcataaagtacagcaagaataactatttgtaaataggccttttagactggctttgatggaactctattccacaaggaatctcagataagaccttttaaagtgaagcccagccatgggtttgtagcctcaaatacctgtgagttaggtgatcctctcctcttaaggtcccaggataaacttggagatcctgggcctgttagaaagagacattctttactgaccacagatcaggaaccctatacagggactgggtagacaagggtatgaggccagttttctcaattggcttttatgagctctgcaagtcaagcttgactcctgaaagggaaacacacccttccagtcaaagccttggtaaaaaaaaaaaaaacttgtttctccaattgcatcctgttgcaaaagaaaatggacttttattgcactgatccaaacaactatattgccagaagttaagaatactcacagatactttccaaattctagagaaaccaggcagagagaaacacacgttctccaaattttgttcacagtataccttacttgattattaagggctgtaaatagttcaaaatcagtttccatgaatctgaaaaataaaacaaggatcagcaatattccaaaaaactcaaaaagattgcttcagttttctgcatttagtccatttagttaagtctttgtgttgttgtttacttgtttgttttgagacagagttttgctcttctcacccaagctggagtgcaatggcatgatcttggctcactgcaacctccacctcccaagttcaagtgattctcccgcctcagcctcccaagtacctgagattacaggtgcctgccaccacacccagctaatttttgtatttttagtagagacagtgtttcagcaggttggccaggctggtctcaaactccatacctcaggtgatccacacacctcagcttcccaaagtgctgggattacaggcgtgagccaccacgcctggccccatttagttaacttttgtgttgcttaatattgatgaacattttatttctttatgagtcctgtacgtttttcctttattccaatgtcactatctccaaagttattagaaacctgcatttgagagcacctgttagagtcctataggtgattataaaccatcttttgaaaaggatcaaaacaaaacaaaaattgtctgaataacaaaatgtccagggtagttacagttagaatcaccattgacagagaagtttggttatctttgtggtttataataacttgacataacaaccttaattatgattgatagcatatactttagacattagaatttttgaaatttcctacaattttgggacatatattagtattattccccaaaatatatcctaaagtagattaaacaccgtttggcaatcccatgtaactaaatatgccaaataatcctgtttacttcttttctagatgccccaggggacctctgtagcactcaaaaagccaggtatcaggaaaaacaattttgaaactgaagtttgattttgggaagcctattaaatatattagaggtttaaaacaactattgttatgaaatagaattccagattaccatgaattatttattttgccaaaatgatgactcagatactttaaaaaagcaaaaacttattatgaccctttacaaattttgcaaaagagcagattagtgccttaagagtatcttgtgctttcatttcaatgctcagttcactgaaaaaccatataatacctttttgaatttagtcaatatgtttacacatggaatttttttcaagatttttacagtccttctaccacttgtttgaactttgagctttattttatctaattcaaaacaaccctttaacactaggcaagaatttacatttttatgccttttttataatcttttactaaaaacacatcttattagtcttacatgcctcacatgtaaatttatttccagtagtttgagttatatgttataatggtaactccttgaaattttttactttaatgtaaaacctgataagttgttttcattatgtgctaggtgctgccaaggcttaactccttccagcttaattaaagatgcggttagtactacatgtccctagccttaccatttatggagcaggcaagtcaaatagttctttaaacccaaaaagcagtttataaacttaaaacatttagcaaacctagcacctgacctgcatagtttagtccacctgtttatattttaatgacatctgctttttaccaatattctttaagggttgtttttatttctcaaagattaaagtcacatgaactgaaaggcaccacaacttttatcatccctttaaaaatttttttgatccaagcactatcttcctttaagccagttaattagagctctttttataggcatcacacacacaacacatatataactaaacagacaggcaaaagaaaacccagtcaccataagatcttttgcttaccaatctcctaattggattattggatatagccctttaagagacagggctaggaaaacatgcagcttctaaaacctaataaacaggcatagatggggcaaaaacagattttcagagggatctatccacttttaattcttggggttccatgaagaaaatagaggtctttccccttcatgtgtgcattgagggtggcaagacaaacggagaaaaataattcagtcaactgagaaaaaaaccctttttccagaaaaacaagatccaagaaaagaaaaacataaaggccatttaaatatacctataatttgaatatccacttttaattaagccgagcactctttttaagaatttccttttaactcccttactacccgactttagcgatgccaagtggccaatatttctggctttcaaactttactaaagactcagagaaaggaaaatccaaggcggttcatggaggggaagagaatcaataattagcaaaggtcacacaaatatcaaactggaaaggactcattgaatcccaggccaccattgtaaaatggcagaggctagaacaaaacattgccacatggttacaggctttgctcccaaggacataaaacaagatggaggcctgcagcaaagtttgctactgaccatatggaaagtcatgcaaatcacaccagattggttacagcttaaggccaaaataacaaatcctttttcacaagtaaaactctacagagaatataaacagtgatccccattattcctggtccagcaaaatctcttccaaaaggaaaaaaagaaaaacaaaccctcacttaaaaataaattcctgaccctgtggagaaaaggaaaagacagcttaaatgcagggctgtattaactgctaatagggtggagaaaagaaaaagatgcctggggaagaacttcgtattcttatgcaaataagttcttccaccagtgagaaaaacttaatcactttcccacagagtgaaacccctttccctggggaggggaaggctccacagatgcaatgcagagagcattggccagcctgccattaggcacccttgggccatgcatcccagccctggcagggagaggagtgcaggagctgccattctgtggtccatcttgcgcatgcctgcagctgttgggatgaggtggtgcacagtttcctctaccctccaaagaggtctgaggagaaagagacatagaagtgaaaggaaaaaagatttttagacttgcttggtacttaccttttctcaagccccatgttgggcgccaaaaatgttgtagaaaaaaaacacgttcttgttacacaacagggataatttagttgcatggacacattataggatgagtagaacgggatttattgtgtgaaaaaaaaagggaaacaggaaacctcagcaaagtgagagagattcctgctagcaggtttcccgcctcacagattgaattgcaggccaccacacatgcgagctgaagagcccaggctcctccccactgcaaatggtgcgaacttctaaacttcccatagctccaccccatcctcccagtgtgcaggccagttggagattctccagggaacctccaccttatctacctcctgcatctatcagtatgaggatacaaaggcataagaattatacagtggactttggggactgggggaagaaagtgtgggagggggttgagtgataaaagactacacactgtgtacaatgtacactgctcaggtgatgggtacaccggaatctcagaaatcactactaaagaaagtattcatgtaatcaaacaccacctgcttcccccaaaaaacctattgaaattaaaaataaataaataaaaacaaaagtgagcaaaagattcgaatagacatttctcaaagaagatttgtaaacggcaaatcttgaataccacagttttaaaaaggtaaaagaaagcagtgtggacagggagagcattaacagttctctggggactttatacaaagcatacaatttttaatatgtttacattaataaaattttccctatagacatataacctagggaagactgggcttctcttttgatattgtaactctttatctgtgcttaaagaacaaacttttgtgatttctattggctttctgggaaatgtcaaagatagttttatttctttttctttttttctgggcctgtggactttgtagataagtacaaaatagttttacattccctgaaatttttttttaatttattttatgtttgggatcaaattttgagttatcagaggaaacttagacatgtaatttaaataggaccatggatacttgagaaataatttttgattgtctaatcaaaatgataatgaaatattttttttaaaagcatgaaaggtaatacagttgttaagaagtgaggaacttttgttctttggggttttttccttaaatacccaaatacgtaataaagttaacatataggagagaaaattaatctggtaagacacagaatctctgctatctaggcagatgatgtagatcctaggtaaaggcattaatcaccaaaccagccaagaaagccatcaaaattaagtgaactttgttgatatgttaacacatttattttttctttttttgacacagagtctcactctttttgcccaggctggagtgcaggacacaatctcggctcgctgcaaactccacctccggggttcaagtgattctcctgcctcagcctcctgagtagctgggattacaagcacgcactaccacacctggcagatttttgtattattagtagagacggggtttcatatgttggccaggctggtctcgaactcctgacctcatgatctgaccacctgggcctcccaaagtgctcggattacagacgtgagccactgtgcccagctgagaaaatatattcttaagtgaaccagttttataagtatattataactgttagtattttcatagataaaaaactagtctgctactctaaatgccattttaagaaatcctgtgagacttattggtgactcttctagattcacttggcattataaattcccagggaacaacttggtctaatcaactatcatctatcatctttcaccttaattatttcagtggctggtctcatcatttccacccttgcctcccttcaattcagtcttcaacccatagccagagtcgactttttaaaataaagtaaataatgtcacttctctacttgaacccttcaatggattcttatcacattcattgttaccaaaactccttgacatgttctgctaaattctgtataatctggctcctccctgatttctaggctcttctcttaccatttctctcttgtgctttattgcttactaagctccatatagctttttctttcctcagggaatttgctgtccccattacttaaaatgttcttaaacctactctttacctggctaactcctgtgcattctttctgttctggtttatctctttctcacagaaggaattctgtgatccacactgcccacctaaattatgcctgcagttattctctatcattgcaccttgttattttcctttatagcacttatagttacaattatatacttattcatgtgtttacttaatttatctctagaactgtaggtgggaagatccatgaggacatgagtcacatctcttttattcatatggtctatccagcacctagcacaggttggcacatagtatggactatataaattttggtaaatatatcccatgaaaacatatgatgcatcattcgtcttgatggaatcaatgtctattaattaaattcttaagactgacattttaaaaagggatatatttcgccatacccatgatgtataagaattgttccatggccaggcacagtggcttacacctgtaatctcagccactcgggaggctgaggtggagggattgcttgaggccaagagttcaagaccagcctgggcaacatagtgaaaccctgtctctacaaaaagtaaatttagctggatgtggtggtgtgcacctgttgtcctagctatttgggaggctgaggtgggagaattgtgtgagcccaggagtttgagactacagtgagctgtgatcacaccaatggatctccaatctggatgacagagcaaggcctatctcacagaaaggaaaaaagaaactttcatgaaatagacaagtagtcaccatattctgttcctatattaagtaaatatattaaatgaatataataatgataatagagaatcatttttgaatgctaaccataaaacattcttctatgcattttataagtgccataagaaattaatactggcatgcagatttcagcaagagtatacctttttgttttcctaaaaggcaattacacgggaaaccaaataataataaggatggattactaccattgagagcaacaaaaattctgaaatttttaaagcaatgagagaataactttagtaagtataaatattccttgtaaaaaaaaacaagcttatatgaatatttaaatttttaagtttataaaaaagatctcttgatagtcatacttcatatgtttgccatctaagtggtttttcattataaatatgaatcatgaatttttgtagatttttgtattatgaatttttatctaaatttaggtattcacattttttgttaaatttcattttgttggattcagcccatcagtctactaagaggtctttttaaaatttatatcagctgtctagtatattacttgtcttttgtagtttctgtcaccagcaaatatgttaagcatgctttcattcaagtcactgataaaacttttttttaggctaggccatttcacatactaccagaaaccctgctggttgtaattgcttaactagcatatttctatttcaacacatcaaaacctacagacctactttctctatcgacaaggcatttatgcgtgacttatcaaataccttaatgaactcaagatacattgcattgacaagttttgggaggttgtttgtttgtttagatggggtctcactctattgctcaggcaggagtgcaacagcacagtcactgtatcctccacctcctgggctcaagcaatcctcccgcctcagcctcctaagtagctgggagcacagggacagttttttctttaataaaactttgtaacatttaattataacctctgaaggatcagtattagaagctctgagaagacatgtgatatatattttctgatataacccatttaggtattatatgtaatcaatcttttttgttcttgtttttgtttttctttctaagacagagtttttctctctggctcaggctggagtgcagtggcacaatctcacctcacgcaactttcacctcctgggttcaagcgattctcttgcctcagcctcccaagtagttgggattacaggcacatgcaatcacacgcagctgatttttgtatttttagtagagacagggtctcaccatgttagccaggctggtctcgaactggctggtctcaaactcctgacctcatgatctgcctgccttgacctcccaaagtactgggattataggtatgagtcactgcacccagcctgtaatcaatcattattgttagttcaggtgctgtatcacacacctggatctcaaataggatttatagaaaatgcagcctaccttaatgatctctaaaaagagaagttggaaagaaagggtgcacattttggacttggccaccaagctggtcaagggatccaaaaacctccaccatagagactgataaattgtagctattgaagctgtacttctttgtacataggtgctttgggagactcactctgattattgtaaatttgctcactagctacccaacattaaattcaaataacagagaatttctattgtacagccttgcaactttgctttaagtttaaacttttctttaaaataaaattttaagtggcaaaaataattattagaagagaaaatgtgtgctcatttttgaatattcttggcatcaaatataaatttgtatgtttactttattggcattcatactgccatttcaaaggactgcagcattcaaaaggggaaacaatattttgactgtgtattctgatttttataatgtaactctccatttcttcttttaaaagtgcctgcccaaccagtgaaattagctttaggacaggaaaaaaaaaaaaaaaaaaaaaaaaagcatagataaagaatcagcacagttcctaggaaaattatgtgttcccattacagttttccttaatgaggaaaattctgttatttaataattcacagtcaaaattacattgcatatctaaagaaagtttgagattatctgggacaaattgtttcctccatgctatgagttgcataagatagtagaaatagattacttctctaaaagtaggaatgttatttcttttgtgatttggcatttttccttctcatttgttctgatttaactcactacaaattctacttgctcaaggtagatcctcactactccatggcaagcctttggttcatctctcttactgacaaccttatatacattgccaaattgcaattttcagacctttgctcttgactcaatttcccctattttctcctcttcttattatattaaaggccatcagagctaaattatttgttctttctatttaaaacaattttcctgaattaatactttgctctattccttctatctcaaagaactgcttgtaattctcagttagtggctgcttctacttccttattattagatatcatctatgtacgagacactgtattcattccttgtttctccctagttgttgagtatgttggccacttattttctgaaacagtcccccaccatgttttcattactgaaatgttttaattaggcaagaacacatgagcacacactcactaaaaaaagaaaatgaaacatagataagattaatatcctttttgaaccaccctctcattcatttttatttaccctcacactcccccaaaagtaaacatttttatcattttgaagggtatccttcaaaagttttctgtacttttctgtaaaaacataggaaataaaatcctaaggtttttgtttgtttgtttgttgttgttttgtttgttttgagacggagtttcactcttgttgcccaggctagagtgcagtggcacagtcttggctaactgcaacctccccctctcaggatcaagcgattctcctgcctcagcctactgagtagctggcattacaggcacctgccaccatgcccagctaattttttgtatttttagtagaaacgggatttcatcatgttggtcaggctggtctcgaattcctgacctcaggtgatccacccacctcggcctcccaaagtacagtttttaagtggtgtgcgtgtgtttaattaagaaagggataaagggccaggcacagtggctaacacctgtaaacccagcactttgggggccgaggcaggcagatcacaaggtcaggacatcaagaccatcctggccaacatggtgaaaccccgtctctactaaaatacaaaaattagctgggcatggtggtgcatgcctgtagtcccagctactcagaagactgaagcaggggaatcacttgaacctggaaggcggaagttgcagtaagccaagatcgcaccactgcactccagcctggcaacagaacaaaacttcatctcaaaaaaaaaaaaaaaaaggaagggataaagaaacttgcaagctgcttctaaaatttatatagatagaattgcaaagggcaaaaaaacaaccaaaatagtgttgaacaagaaaaagatcaaagtgggaagacctgctctaccaaatatcaagatttagtataatgatacgattaaagtaacttcttaatggtgccagaattaatatttagaccaatggaacagaatttaaagcccaaaacacaccaacacacatatggtcacttattgtatgataatttatagtgcagaattatagagaagttattttttcaataaatgatgctgggacaacaggctatttatatgaaaataaatgaaattggaccccctatctcacagtatacaaaaatcaactccaggtgtattagagatccaaacaggaaggaggaaactataaagcttttatagatttttacagaacaatgtttttattatgctggattaagaaaggatttcttttttaattgaattgaagtaaaattcacataacataaaattcaccattctaatcattttaaagtgtgtgattcagtgacttttactacattcacagtgttgtacaactattttatccaattccagaaaattttatcaccaccgctcccaaaaaaacaccttactcattaaacagtctattctccattccctctgcccccagcccctgacaaccattaattggctgtctctgtaggtttacttattttggacataacatataaatgcaatcatacaatatgtaactctttatgtctagcttctatcactaaataaacaacattttcaaggttatccatgttgtagcatgtatcagtactcctttttatggctgcacaatattccattgtaaggtatactgcatttagtttatccatttattagctgatggtcatttgggttgtgtgtactttttgattattaaaataatggtgttatgcacattcatgtatgtttttatttgaacacctgttttcagttctcttgaatatacacctaggagtggaatttgttgtaatatgataattctatgttaacttttaaggaagtgccaaactattatccatagagctgcatcattttacatacccaacagcaatgtatgagggttccagtttctctatatccctgccagcatttgctttttttcttcttttttgcttttgagacagagtctcgcactatcgcccaggctggtgtgcagtggcccaatctcggctcactgcaacctcagcctcccgggttcaagtgattctcctgcctcagcctctcaagtagctaggattacaggtgcccggcaccacgcctgactaattttttgtatttttagtagagaaggggtttcactatgtttgccaggccggtctcaaactcctgacctcatgatcttccagcctcggccccctaaagtgctgggattacaggtgtgagccactgcaccgggccttctttttttcttaattcttatcatctgaatgggtgtgaaatggcatctcattgtggttttgatttgcatttccctaatgactaaggatgctgaacatctcttcatatacttgttgatgatttgtgtagcttctttggaaaaatgtttattcacaccttttgcccattttcaagcgggttgttggtctttttattattcagttgttagagttctttacatattatctggatgctggactctatcagagatatgatttgcaaatatttcctccctttctgtattttgtcttttcactgtcttgataatgtcctttgcacaaaagtttttaagtttaatgaagtccagttaatctaatttttctgttgttgcttgtacttttggtgtcatatctaaaaatccatcaccaaagtcgtgaagatttacctttatgttttcttcttagaatttgatagttgagctcttataatacaattaggtatttgatccattttgacttaatttttgtgtatggtgtaaggcaaggcttcaacttcattcttttgcatatggatatgcagttgttctagcataatttattgaaagaatgtcctttccagttaattgccttggcactcttgtctcaaatcaattaagtataaagttaggagtgcttatttctggaccctcaattctattccattaacctatgtttgccttatcccagtaccacactgttttgattacatagctttgaagtaagtttagaaagcaggaattagcctgacacggtggctcacacctgtaatcccagtattttgggaggccgaggtgggcagatcacttgaggtcaggcgtttgagaccactctggccaaaatggtgaaaccccgtccctactaaaaatacaaaaaaattagctgggcatagtggtgggtgcctgtaatcccagctacttgggaggctgagacaggagaatcacttgaacccaggaggcggaggttgcagtgagccaagacggtgcgattgcacgcgagcctgggcaacaagagcaaaactcggtctcaaaaaaaaaaaaaaaaaggaagaaagcaggaattatgaatcctctaactttctttgtctttttcaagattgttttagctattaggttccttgagattccatatgaatttcaggataggtttttctgtttctgcaaaacacaccagtgggatttgacagtgattgcattgaatctgtagatagctttgggcagtattaccatcttaacaatattaagtattgcattccattaacacatatgtctttctatttatttgcctttaatttctttcagcaatgttttgtaatttttgatatacaggttttataatttcttggttaaatttactctgcatattttattctctttgatgctattgtaaatggacttgttttcttaattttatttttgaacatttcagtattggtatatagaaatacaactgatttttgtgtgttcttcatgtattctacaacttcgctaaatttgtttattagctctacttgttctttttgtggatgtttcaggaatatgtatatatataaaaccatgtcatctgtgaatatagttctacgtcctttccaatttgaagccttttatttctatttcttgccgaatttccctggctagaactttgagtacaatgttaagtagaattggcctgagtagacatcctttttcctgaatttaggggaagttttcagtctcattattaaggaggatgttagctgtgggttttgtctagatgcctctatcaaattcaggaagttgccttatattcctagttttccaagtgttttatcctgaaagcatattgcatcaaatgtttgttctacattaacggagatgatcatttgtgaagtttttttccccttcattctgttaacatggtgtatttcactgacttcttatcttatggtgagccactcttacatttttggaataaatctcatttggtcttgatgtataattgttttagtataatatttgttgtttcctagtattttgttaaggatacttgcatctatatttataaaggatattagcctgtagtttttttgttcttatgatgtcattgtctttagtgtcagggtaatactggccacttaaaatgagctaggaaatgttccctcctcatattttgtagaagagttggtaaataatttttgttaattcttctataaacatttaatagaattccctagtgaggccatctggtcctgggcttttccttgttgaaagtatttttatgtactgattcaacctttttagtggttctattcagattttctatttcttcttgagttggttttggtagtgtctgtgtttctaaatatttatctgttttatctaggtcatgcaacttgttggcatacagttgttcctagtatttaattattatgaaataatcatctggtagtcatttcatttcggtaagctcaacagcaatgttcctactttcattcctgattttagtaatttgaatctttttctctttttgtcagcctacttaaagatttgttcgttttgttattacttttatttttttattatactttaagttctagggtacatgtgcacaacatgcaggtttgttacatatgtatacatgtgccatgttggtgtgctgcacccattaactcgtcatttacattaggtatatatatctcctaatgctatccctcccccctcctcccaccccacgacaggccatggtatgtgatgttccccttcctgtgtccaagtgttctcattgttcagttcccacctatgagtgagaacatgcggtgtttggatttttgtccctgcaatagtttgctgagaatgatggtttccatcttcatccatgtccctacaaaggacatgaactcatcctttttttatggctgcatagtattccatggtgtatatgtgccacattttcttaatccagtctatcattgatggacatttgggttggttccaagtctttgctattgtgaatagtgccacagtaattttgttgatacttttaaaggaccaactttgattttgttgattctttcaatgtttttgtgttctctatttcatttatctccactataattcttattattttcttttgtttgctttgggtttagtttatactttattttatagtttcttagggtggaagattagtgtattgatatgaaatctttcttctttttaaaagtagatgtttacagctataagtttccctctgaacactgtttctctgcatcacttgaattttcatatgttatgttttcatttttatttgtctcaaattattttcttatttcctttatgattttctctttcaccattggttatttaaaaatgtgtttatagcagcatgatttatagtcctttgggtatacacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgacctttgcccactttttgatggggttgtttgttttttagaaaatgtggcacatatacaccatggaatactatgcagccataaaaaatgatgagttcatgtcctttgtagggatatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagatagagggtgcagcgcaccagcatggcacatgtatacatatgtaactaacctgcacaatgtgcacatgtaccctaaaacttaaagtataataataataaaaaaaaaagaaaaaaaaagtgtttaatttccacatacttgtaaatttctcaaatttctttctttcttttttttttttttttttttttttttgagatggggtctcgctctgtctcctaggctgaagtgcagtggcacaatctcggctcactgaaacctccacctcctgagttcaagcaattctcctacctcagcctcccaggtagctgggattacaggcgtgtgtcaccacacccagttaatttttgtatttttagtagagatggggttttgccgtgttgaccaggctggtcttgagcagctgacctcaggtgatccacccacctcggcctcccaaattgttgggattacaggcatgagccaccgcacctggtcccaaatttctttctgttactgatttttaatttccttccattatggtcagaaaaaatacactgtaaggtttcaatctttttaaattttgtgagacctattttgtggcctaatatatatggtatatcctcatgttcacttcagaaaaatgtgtattctgctggtatcagatacagtgttcctatatggctgctaggtctagttggtttatagtgttgttcaggtcttctattgaaggggtccccaagccccaggccaaggactgataccagtccatgacctgttaggaagcggtccgcacagtgggaggtgagcagcagcgggcaagcaagcattactgctgagctctacctcctctcagatcagtggcaacattagattctcataggagcatgaatgcaagggatctaagttgtgtgctccttatgagaatttaactaatccctgatgatctgaggtggaacagttttatccaaaccatccccaccaacccccagtccgtagaaaaattgtcttccataaaaacactccttggtgcccaaaacattgaggaccgctgttctattgtacttgttgatctaactagttattctaactattattaaaagtggaatattgcagtctccaactcttatttttgaagtttttctctcttcattattatcagtttttgctttatgtatttttttaataattgttatgtcttcttgattaactgacctttttatcattatataatgtcttttttgtctcttataacagttttggcttcaaagttgattttgtctgatattactgtagcttctctagctgtcttttggctacagctcccatagaatatctttttccattccttcaccttcaatttatttgcgtctttggatctaatttgaatctcttgtagatagcatagacaatcatactccacttaacaacagagatatgttctgagaaatgcattgttcagtgattttgtttttatgcaaatgtcacagagtgagtataattacacaaacctagatggtataaccaactacacacctaagccaaatggtatagcctgttgttcctagtcctaggctgcaaacctgtacagcatgttactgtaatgaatactgtaagcaactgtaacataatggtaagtatttgtgttttgaaacatatctaaacatagaaaaggtaccagaaaaatatagtattataatattatgggaccactgttgtatgtgtcatctgttgtctatcaaaatgccattatgcaatgcatgattctagttggattatagtatttttaattcattctgccagtttccatctttgaattggatagtttatgtacatttaatgcaattactataaagaagggtttcttccattttgctatttttatataatatcatttttgttttttatctcctctattacttccttttttctgtatagatattttctggtgtaccattttgattctccttgctacttttactaactattatttagttattgtgttagtggtttccctgggaattacaattaacatcttagctcataacaatgtagtttgaattaataccaacttagtttcaatattatacaacaacttcataccttgtccactacttacgttattattttcataaattacctatcaatatattgtatgcctgtcaacatagatctataatcattgctttatgtagtttttttaattatatggggcagaaaagaggattcacaaacaaaaatatacgtgagatacgactgacctttgtgtttacctatgtagagttctgtatttcttcatgtcagaggattcacaaacaaaaatatacgtgagatactgacctttgtgtttacctatgtagagttctgtatttcttcatgtcagtcacaattactatctagtttctttttatttcagcctgaagacctccctttagaatttttttgtagggcagatttatgagcaatgaactcactcagtttttgtttatctgggaatattgtaatttttcttcgtttttgaagtttagttttatcagatatagaattattggttgacagatttttcatctttcaacattttgaccatatcattccactgctttctgactgtcatggtttcttttgaaaatcagctgtaaatcttattgaggatcagaattctctcttcatctttgtcactttcaacaatttgattataatgtatcttcgtgtcagtcttttttagtttatcctgcttgggattgttgaacttcttgtgtgcattcatgtctttcatcaaatttgggaagtttttaggcattgtttcctcaaataatctctttgcttctttctctcctctccttctgggaccaccattaatcatatctcagtgtgtttgatggtattccacaggttgcttaagccatgttgttattttcctttatttaagccatgttgttattttcctttattttttttctttctgatcctcagactagataatgttaatcaccttattttcagctcacatctgctgttgagtcccactagtgaatttttcatttccgttgtaattttcggtgttagaatttgtatttggtttctttttatgatatttgtctttttattgagattcccagttggtgaggcatcattcttgttcttgcctttagttctttgtttatagtttcctttagctctttcagctaaactttattaaaataattaatttaaaatctttgtctagtcagctcagtgtctgagctttctcagagacagtttccgttcatttcttttttcttttctttttttttttccctgtgtacaggttatactttcttatttctttgcatgcttcataattttttgttgaaaacttgacatttaaatattataagtggcaactctggaaattagattctcccctctccctggggctttttgttgctgctttttcagcagtagtagttatttgtttgttattcattttttgaaatacttttttcaagcttgtatttctttgttgtgcataacctctgatgtttctgttgtttgcttagtggtcagctagtgatttgacaggtatttccttaaatacctagaaccaaaaaattaataataaaaacaaaacaaacaaatcagagaaaatctcccagtttttgcagatgagctctttgtatatgttaggtcacacttcaacactcagccaggcaatttacagctcttcattagttttcacttcctgctggtatagagtctcaaatttatccacaagtgagagaatagaaccttctcaggtcttttctgagggtgtgcccagccctgggcataaacctgaccttttagagtccaaaggatacatgggagcttttcagagtccttatgccttaaagtacctcattccataaccctcactcccaggtttttcactttatctattgtttgtcctgtttttccatgcccagatgacagtggctaatacatttgcctttaaatatttgaacaaacattacccaatgaatagctgcctcaaccctgggaatattctgagttaagtgaaataaaggcaggccctttgagtgtgtccttcaataagccataagatatttcaacacaaaaaaaccacaattctttcagaataaggtttgttttccttctggtactacagacctgtattggaaatgtggactgttgtcttcaaggccaccttttttgtctatttttcttgattacccatttacctggttgtaaacattttattcattttcagagttctggtaaagtttattctgcctgtttttgccaatttattttctgctttagtagagtgatggaattttggatttctctactctgctgttttcactgatgtcacccaggaaggattccttttaagacacaaaaaccactaaccataaaggaaaatattgatatatttagcaacattaaaattaaaagatttcgttcatcaatagacatgataaagtaaggtaaaagacaagctacagagtaggaatagatattcacactagatacaactgctaaaagactagttatccagaataaatactaaaatctaacaatttaataagaaaagaacaaccaaataagggaaaaaatgggcaaggatttgaacggggacttcacgagaaaaaatctaaatgactgaggaatgtatgaaaaagtgctcactctcactaagaatcagagaaagggaaaataaaaccataatgcaatattgttacacaccaaccaaatttttttaaatgaataataccaacaatgctgggtggaactgagttgtagaataagagaaactgttactattctttgtggacagatgtatagattggcttaaccaacttagaaattttttaaagaaggtattcataccctataaccaaccattctatccctgaatgtgtatatatatatatatatatatatatatatatatatatatatatatatacacatatctcccagaaatttactcacatgggtatcataacacccatgggttcacagtggcatttttcataatgtcctcaaaatgaaaacaatgcagttgtctatcaacagagtaatctatattcactgactccttttccttacctccagtttttttcttgaccccttgtaatcaggttctgtcttcatcaaataatgaaattttctttcaggtaactaattactaccatcctgttcttcataatctaattcttcaccctttttctagtatctgtgttgacatattcttctatgttcttcatctttagaatctcatttatttctgtaacttcaacaactgtatatctgcaataatttctaagtctgtatctccagcataggcagtttttgtttttttttttaagattggggcaaagatttgttctagactatgtaatgaaattgtaaatttatgtttactgatattaactggatccacaatggtaattgaaaattcttttgccttacccatcattttcattcatcaatgcattttttgagaattttaccactctcctaaagtcatctttatcacttttacttccccttattctcatcaataaggcctctcctgcaagcaccaaaaaaatagtagtaataaatatctgtgtcttttacccacaatttactttgctttatcatgcctactcaattcctccatttgtatctactctttttacttaactggtaatttctttaataactggatgtaatggcttcttttcagctctctctctctattcctattctctcccatatttgcttttttttaatcttgcaactttcttcttttttccattgccttgatactcacccatctcgatttgcctcttttttctctaataatttcttatgataagaacaccaaataatttatcttccaaaccagaatgcttttgaaaatgaaaagaggtgctgtttgataattaagccagcataataggtataatcctagattgttcaaggaaaaatcagatgtatggttaccccatacatccttatcttagagatcttatctcccttcagtttgttttcttttgttaacttttaatatgaatgttacctcaaattgtcagccatcgtcttttgttctttcacatattctctgcaggtgatctgacacatttgaatgactcaaattactacctccattgataattcccaaattatatgtcctaactttttcctgagttccagactcatatacctcatcaaatagctccagattagtagcccgaaagtacctagccacaaaatttaaacttatcttctctctcgagtatcctgatttttaatttacattgaggcatatatacacacagagatatgtagtgtatatatgcagttatgtgtataagtctggagatatatatcacacacacagagacattattcgtgcagttgcttcattagatattggacataaaatagtagcaaaacagttccatcatgacagtgcattctcatatgggagacagacattgatcaaagtatcacacgtataaatgttgtgatactttctgtaagtatggtcattgctatgaaggagagggatgtgatgtcatatgaagtataaaatgggtatttgaccttcttttaaatacatggcctttttaattggataagtggcaacaaatagctcttcaaaattagactttatttcttggaaatatttatgacaattcagtactcaaatatgttagcaaatggagtcgtcttgcttctcaaaattcctactgcttttcatactatttatgactatattgtttataaaccatataaaatttcaaacactgaaatggtggcaatatctttggaattaaggatgttggtatagaaactaaataaaggagcttctatagaaatagcattagttttgtgaggcagaaatgatgcataatattaggaataccttgtagtcacaaagtctggctgtttcttcttttcacatagtaagtgatatttgttgattaaatgttaattgcttgtctttttatcatatgtttcaagtcttgcgtgcaaaatttgaaagtcctcatgttcccattcttagaagacgtatgcccgttactggtagcccagaacatgaactaaattatgcaaggcctaaagtaataaatttataatcaacatatattaataatgttaaaaataatctacagtattagtctttatgtttgtatatttttagaataatgataattacattagtctttactatgttgataagtataataataacagtaataataaccaacacattaaatatttaccacttgaaagtgctaaataatctacacacattattttacttaacccttgcagtattccagtgaagcagattctattgttgtcctcaattttcagataaaggaagtagcaattcaaaaggtatatccatcaggatcctagcagacgtcagatagcatgcttaaataggtaattgaggagagttcaataagaacctataggatgtacaaaggtttggacagaatttagggaaaaccacaagacatcatggaatgcctgggattagtaacagtgggaaccattaatgcttctacctaatggggcaaagggaaggagtgctattagaatctagagaaagagctataagccagaagggcagtctgacatgagctatgatcttgagttgagtgacacagccaacctttgatgatctggtagagagggagctaggagaataaatgccagatcttaccctatcccaactcagtcttctgccagtgcctttcactgactgaacccagctggaagccagggcagaaaataatttgttgatggtgtgcatacaggtcagcttagagaagagagggtgaaaatggttggagactgatctgaaaaggaaatggaaaatatataggaattaaatagcttgctcaagatttcaaactattaaatggcatagcaagtatatgaatgaccaatcctttattcctaaccacaatactatactgcctctcatattaaaaagttttatgaaatggtacttgccagggaaaatactttaaatctgaaagtttctattctatctcaagttgttggatgcatttatacctaacagtaagtgacaccaaatatgtcagagctgagcagcaaagaatgctaaaacaaagggggtcttgattctacatgttattgacattttcagaatattaaaccatagttgttccccttgttcagattccagactccatcatttctcgtggtgttcaggtgctcccacgagacacagcctccctcagcactactccttcagaatcgcctcgtgctcaggctacatctcgcctctctacagcttcctgcccaacaccaaaagtaagtatggttccttcgcatcttacacctgctcttctatagtaatctgggaaaactaaccaatatttcctcctgcttgtcaaggttggattgcatgcaagattacactgtgaaaaatgaataaagtgtaagatagttcccacccattgtgtcacaaattgtcatattaggccactagtaggacaatacagatttcattcaaaatgtcttactcctacatcatagctaagggtattactttctgtagctcctgtttctttgttgtagatttgttattttttagtatacttaacattatagatgtaaagttatttgtttatgccgaggataaatgtacttttggccagtaaacagcaagattaacaaaattgtgtcaccaaagggatttctttaaacttgtccgggctggggtagctccctgctctagtatcattccaaattttttcaaacattcatcttggaatgttgctgcctaatatttgcaaacaaatctaaatttattagaaagaaagttttaatgccaacctttgggaagagggtagaagtttcttagtctttttttttataatctgtcactgaattgtatagggtgaggaaaggatgagacacttatatgctgttcacatctttgtatacatgataaattaactagcagacattattactgctgtgactactttctcctggaatgctccttgcctgattaagttagtcatttgtgctttcaagttctctatgtgatggatgcaatattggtatcaaaagattaacagtaacattccttattatttaataagacatgatgttagacactaaatttgttttaggattctgacagttaatttttcaaattatagttttttctctgtcatcaaatttaaggacctgtatagctgtcttcctcaattccatcttttctatcagttttgtgaatgttataatttaatttgactagaagggatctcagtttctgatgtgaatagtgcagtttgttttacattacttgttacaatcttctcagcaatgtttccagtgttactgttgtatatcattatttttagatatatgtcaaaaaaactgatattaattttatcatttaaaaaactgaggtcctgaatcttcaataaagataaactataagaacattgtagacattaaatgtatgccagtgccatttgggtgccagtaagctacattttcaaatgcataaaagcaaggaattcttaaaacctgaattagatggaagaatctcatctatatcttttatattattaaaacaaagtaacttacagtttgactgcattaaaatccagttgtaccagctaaactcacttgtaaagtctagaaaatatttaaaactaaaagttaagttcactataagatgttttgttcactgaatattaagacctaaaagttgggaattcagaactattcaaggcatagttgcttttccttaataatatgctgaaatcataaatattttttgaaaatattttatgctaaatttaattatacatagtagttcttgagtatttttataactttgtaattatattttagttacaaagaggatattaaataaaatttgaaaaatcacttggtacttccaaattcaccaaagtaaaattctgaaaaataataatgttaatattcgtcaaattaatttgcttattgcagaactttaggagagcaagtggcttgtcttgatattttttccttagttaacacttagatgttcaaattgacagtgaattcataaaagcattatatctttttctaggaataagattatatttcttttgaataattttgatcagcactagaatgtatacctcaaagataaagttatcactctggtgtaatttttaatatacacttgaaatgctgaattagaatattaatataataaaagaaactagtttgaatgttgatattttaaaaggagttagtctattccaattaggcatctggaaataacgtttaaaaaataaattaaaggacagaaggaagtgaaatttgtctttctagtaagaaaggtctcataaatcataagactgcttaagagaatctaaactaggtgcttttataagtgctttaatatcagtgacaaatatactccttgtcttcatggagtttacaatttagtcatatattacaggttgagtatccctaatccaaatgcttgggaccagaagtgtttcagatttcagattttttcagattttggaatatttgcagatacttaaaccagttgaacatccctaatcagaaatccaaaatactccagtgaacatttcctttgtgctaaaaaagtctcagatttcagattttcagatagggatgctcaacatgtaaaataaacaggtagataataactttaataattataatttcatattaatttaataattataatttaaatacaatgcatgctaagaagaaatgaaaatgttatggtagtagaaaataatagcaggggaacttcatttagatagggtgagtagagaagacctaacatttcaccaggggcgtgaagaatgaatgaaaaccaaatgtgagcttttgtgctatgtggaggttttaggaattatattgatcaataatgaccactttaaaggcaggtgtcaccaatcaagaactcttacactaaaacttcattagtatgtgaatagtctaattcagtgatgtcaacagccaatttcaaatatctgttcttttttatttaaaataatgaatctttttgcctttccccactgagtcaaatatcaagaccatagattttagcaccgagctctgtttaataaaaaattaaaatttattttaattttttagcataaaaatttggggccgagaagtccaaaagcaatttcggggtttcaaatttgagatactgggtagacaataatgttattaactataccaaggaataaaagagaagtaccaagtcttgagggtaaaagaaaagagtttaatgcatcttgattgggaatgtgtttaatctgaggcatatgtgagacaaccaaggagtgatatccagcacaaaattggaaatacaatttgagtttgaaattcttatttttactgcatcttggttatgatatttataacttagtacatattagtgttagccaaatcccatagaaatcctttctacatttcaaattcggcatgcacagattttcatgcacagaaatgtatgtgcaaacgtattttgtctacatcagaaatacaatatagttttgaatgatcggtactagaaagagcacttgacttgataatagaagatctggatggaaatgcttttttctctacctcataaccacagtaaattaagcaagttacttaactttactgagttttgtgtctattatttgactgaccatccttacctctacaacagtgtttattaactcattaaataagtctttgcctggtagtagaatagcaacagtgagcaagtagacattgttccaacttctacaaatagatcagacaactaaaaattaaaataaagcataataaattctagaattgattatcaagaatacataatattatggaaatagctaccagaagcacttaaccaatatatagatatattgcagtataacatcctaaattatatattgaccgtttaagattctccagctatagtgagaacaaaatctataaaactataccaggtcttgatttctttttgttttttttggtaccctcattacaacctaatgaagataaccatgtattatcttttcttaacaattcttcatagattatattttctccagcaaatttgtttgctgaaattatatcgtatatagggaaaagtcatttctcttttatatcatatattttcttttaatgaaatctgactgaaatgaggaataattttcactcctcttgctttatgacagtgaagtatctttcaagaacaaagttgggatatttgactttcattgtcctgagtaaaatagtgcctaagtcaaatagtacataaattatatttaaagaagtatagacaatatctagactcaagttctaaaataatgatagtcttctaaaaatgatttgctggaagaataattctgtaattgataaattctcttttaaagtgagcatgattcatagcttagatgagtgctgattttcaattatgaaggacagcagcatctctatttagaaataaaatcaaggccgggcacagtggctcacgcctgtaatcccagcactttggaaggctaaggccagtggattgcttgaggacaggagttcgagacctgcctggccatcatggcaaaaccccatctctactaaaaatacaaaaaattagccgggtgtggtggcacatgcctgtaatcccagcttcttgggaggctgaggtgtgagaattgcttgaagctgggaggcagaggttgcagtgaaatgagatcaagccactgcagtccatcctgggcaacagaacaaaactctctctccaggaaaaaaaaaaaaaaagaaagaaaggaaaagaaatcaagaagcttaaggcagaaaataatgattacagcaaaaaataaaaatttttcaaactttcaatttaccattcattttagatgttattaaaatgaagaatatttttaaacactaattttattatcgttttattccctaaacatctgaagtttgattttgagtaagtaaatatagtctatagtcacatatgttcctgtaccttaaaagttagcaaagaattttgtgcttagaataaccagcaagttgtgttttttttttttttttttgctcttaggaagaaaatataaatactatcaatatctaattgaagttatcaatatctaaagtttatacaacaattaaaatgtagatgtattgaaatatctttatatgagggatatatacctttaatccactaatgtctaatactatattcaaacaaaatatgtaattattacttctttgtaggtttctcttactgtcctttgagcaaaagaatttagattgctctggttaagttatattcttaactcagggtttttaatgtatgagtctgaaaggcagtgtgaattcctttacctataaaaatggcactgctgattctatatcagcataatattttctctgggatgttttcctagtagtgttagtttttacaaagtattgaatattgtcactattttcctttgtgaacaccagggtgattatgtgatatggctaggtcattggctaaacctgggttcccaagtctctggagaagctcataaaatggccatacttccagcctaaatcaagtcactaactggtgacggcaaattatttttttcctatttttaagagcctaaccaaaatcaataagactatactagacatcaagcttctttgcttttgctgaaattatatcaacattggtatgacaatatgttcagctattaatgacattatagaaatagattctacacataccgtcaacacacaacaaaaaggttggaaaccagtgaattagtgagatcaaaaatacattctctgaacaaaaatatgttttcttttgtgaacatttacctcatctggggggtgttgagcaataatattctctgcattattggttagatccagcatttctcaaacatactggtctccagaccccttcatgcttttaacaattattaaggaccccaaattacttctgtttatgtgggttatatctaacaatatttgttgtactaggaattctgagggccaggcatggtggctgtaatcccatcactttgggaggccaaggcaggtggatcatctgaggtagggagttcaagaccagcctgaccaatgtggaaaaaccctgtctctaccaaaaatacagaattagccaggcgcgttggcacatgcctgtaatcccaggtactcaggaggctgaggcaggagattcgcttgaacacgggaggcggagattgctgtgagccaagatcatgccattacactccagcctgggcaacgagaacgaaactccatctagctagaaataaaaatagtaaagcctttacatgttaacataaacaacatattttatgaaaaaataagtatattttccacaaccaaagaaaatctgaaaataatggcattgttttacattttttcaaatatatgttaatatctcgcttaatagaaaatagctggattctcacatttgcttctgtattaagtcttgtaatatgttgttctgattgaagaataaacaaattgagcctcatatagatatatagttagaaaaggaaggactatattgttcacatttttttataattgtggatgttctttgataccataccaaaaatttacaatttttagtttagtaaaggttagttgaaatgttgaatctaaaaccctggctaggaccattccatactcacaccttaaaatccattggtctgtcttgcacttcaaatggatcttttacccaggcatgattttggaacacatatattggtcatttggaaaatataaattcttccaaaagttgacatattttgttatattatatcaaaaagtcaccttcattaatataatcaccaagctcatctaaaaagtctggaatgtactggaagctcttaagctcatagtggcacatagacattttctaagttctaatttatgctttgaagctagaaattgggctgggcgtggtggctcacatctgtaatcgtagcactttgggaggctgaggcaggcgggtcacttgaggtcaggagttcgagaccagcctggccaacatggtaaaaccctgtctgtactgaaaacacaaaaattagccaggtgtggtggtacatgcctgtagtcccagctgcttgggaggctgaggcaggagaatcacttgaacccaagaggtggaggctgcagtgagccgagattgcaccattgcactccagccggggcaaaagagcaagagtctgtctcaaaaaaaaaaaaaaaaagaaagaaaaaaaagaaaaaagctagaaatagtattactggcaaaaaagcaacaaatagttttttcttaaattgacagactttgtttatttttgagaaaatgtataccaaacatctaagtctgaataataataatttattagttatttcattctttcaagtaaaaatggtattctgtattaaaaactagctattcagcttacaactcaaacaattgcataaataagtgattttccttgagacaaccaccatcctttggtatgcagaagtattttgttcatacgccccattttgtcacattcaaggctcaagttttaattaatttaattttcccattttgtcacattcaagggccaagttttaattaattttaattaattaaatttaatttaactaatattaaatagtaaatttaatgtgtattaatattgtcatataatattgtaattactcatgtaaatgtaaatattacattgaggatatagtaaatattaaatttactatgtcattgaggacagtatttcaaactagcttttttaaaaagaaaaacagaagatggcagtgaatagaacagtgattgttcatactacttggatctactgccttaatttatactaggatgtcaatccaccattgattttgtaccatcagtgcaaatgtcaacgtagccaaaaaggcaaataatgtctgagtactattactaaaataattttgactttgtcaagccctgaaagggtctccaggaccctcatgggtttgtggatcaacttaaagaaccattgataaaatcaaatgagcaaactggcttatgtttcttgaaaatattctggatgaaaatgatggctattgaatcctttatatatatattttttttccatagaagcagtattatagtggtatactcagtccaagagatctgatccaatgactaccggtaccatggttaagcattataaatagtttacctgtcctctgtgatccaggttaatcctagggcagggaacacctacacctctctgattccaatgacagacttcattaaatttttgaagatataagaccagaagttataattcccagctaactccattcattttcaatgtggtattacttctgcacttggataataactaattttccccaggatattctgtctactaatagataacatacaaagccctcttttaagaaataggccagacgtggtggctcacacctgtaattccagcactttggaacgccaaggcgggtggatcacctgatgtcaggatttaagaccagcttggtcaacatgctgaaaccctgtctctactaaaaatacaaaaatttagctgggcgtggtggtgggcgcctgtaatcccagctactcgggaggctgaggcaggagaatcgcttgaacccgagaggcggaggttgcagtgagctgagctcacgccactgccgtctagactggtgacagagcaagactctgtctcaaaaaacaaaaaaagaaaagaaaaaaagaaataacctggttgttggcagataattctattgagtatataactggggatagctcatttttgaaatcagtttagaacatttaaaatgtgggaaattcaaataaaaatgcaaattttcactgttttctaaaaagtcagatcaacattgctggcccaccactgatataatactctatatcaatactcagctaatattctttagaccctccagactattttactcacttacattaaatgcctgactcctatggacatttaagtaactgatttctgccctaattctctgttatctaatttctcctcccttataacatgtttgtttggggatttattctcatttgttagcgaagcagaattttgagacttcaaataaaagacaattcctttacacccttttctaatgagaaaggcactacctagtatgggaaagaatttaatattttgatgaaactaaaattacacaataaagcattttaactatttttggtctataacttattttcaatagttttcctctgatgttctgctgggtatgtaggattttacctcgatttttcttttttcgttcatgcaagtgtcccctttgtttttcattataattatcattataatgataattgaaaatgaaacttccccatctatttctaattatttaatggtcacagagctatgtttattactgaagctaaatgtaacaactatgaaatgtataattgccactctgaagtctaaacttgcaaatgaaatttgatatctgagaagatatagcaaaccaaaaattgctaactgtagaattaacattttatagctaagacagactgtaagtggtatagtttctgtatagtttcttttttgtttaaaaaaaatgtacttactcatttggaaaaaatttttaaaattcacataaaaaagttcttataaaatacccttcataaataaccactgttaaaattttgctatgtatcattctcttatgtttttctatgcatttaaattcttatcataccaagaaggcagtgattaagagctcagtttctggagtctgacaggcctgatgatgaatcacttaatacatgtgtggctttcaaaaagttacttcacctctataaccttaattatctcatctgtaaaatgaaaaataatgatactatttgcttcatagggttgtcttaagaatttaagttaaaaatgtatataaatcacagcacaatgattaaaatataagtactcattaaacagtagccattattattaaattgtctatagcttttaacctatcttgcttacttagtaatatgagcatctttctatgtcatgaacatctttatatgttgtaaattaccttctacaatattacttggatttttgatattctaattgatagatgtgacatagttttttcaccaacccgtattttggatatttttgttgtgtcttattttctagttttaaaaacaatgctgtagataatctttcagaagttaaaggttttggagtcatctcttaatcaaactcagtaacttctgttatttctacttttattgaaagtatatgcagaacttttaggtctaagatttctatattttacattgacagcaggaatagatcatttttatgtcttcatgagtttaatgatatattggaagaagcagtttttagcatttgcatttgactgatttactggcagacatttaaaaactataaacccaaagtcgtctgaaaagctaacaagcttgagtgtgtaaaaatattatactgcgaggcacagcatattgagtaccagccctaggctaccatattataactttatgagggctgggcacagtggctcatgcctataatcccagcactttgggaggccaaggagggaggatcactgaagcccaggagttcaggaccagcctgggcaacatagtgagaccctgtctctacaaaaaaaaaaaaaatttaattagctgggcatggtggtaagtgcctatagtgccagctactcaggagaatcacttgaacccaggcggttaaggctgcagtgagctgtgatgatgccactgcactcccagcctgggtgacaaagcaaggctctgtctcaaaaaataataaataaataaaactatgaggactagttgacctcagtttctgttatttgtaacaccaagatattaaataacctctaaagtcccttgtaggcttataattcttttcttttgaaatagttccagtatcaactaaaaaatatttttaagcccttctctctctgatattttattaatctccaattaatacagaataatttacatgtgtttatcttttgcattctgttctagtacataaagtactagagacagagattattaacagaaaatgttctaacttcacttaagatcttttacatttaggtaaagcttgtctctgttaaatgaaatattgatttctctcgatatccactctagttttgttcaagttatgagaagatagggaagtgaactgttgaaatacaagaaattgtgaaattaagaatactagcattcagtataattaaatagctttgattcatttcaactgtttttaattgtttgggacatattttgtataaaacagcccaacaaatataagtggtccgtcctatcattatttcagcaacaaaatttgttagatattggcatgatttagagctatttaatatcccattttgactttaatatagagtacatcccatagtaaactatcctctggatcttcatatcttacaaggatacatattctaaaattaggtattttctggcccaaaatttcaggattatctccctactcattctacttttgttaaagagaaaacacagagtaattcagaaattcattgaatatttcagtgaatatttttaaatgcatattatatgtcaaatactgtattagctattggggatacagcaatgaatagacattttaaccctgttcttaaggagcttatagtggtaatatgtgaaaataaaatatttacaagaaatctaccatatacagggttgacaacctcaaagagctcttctaatccagtaggaaaaagtaaaaaaaggatgagtaaaaggtaagcatagtcatttaataaaataaatacatgcagcacagaaatatgtggggggggggggagtacactctcactagaaatctactaaaaatttaaaacaacacaaattttgcaatcaaattgatgactatttaaaaactataatcatcagtactgtaatgagcaatgacatgagtatttcttttcagactaataggaatataacctttcaagcaataaattcgtataacctttcatacacatgtgttgtatacctgtgttctctacttaaaaagtatatacaggccgggcgcggtggctcatgcctgtaatcccagtactttgggaggccgaggcggatggatcacgaggccaggagatcgagaccatcctgactaacacggagaaaccctgtctctgctaaaaatacaaaaaattagctgggcatggtggtgggcgcctgtagtcccagctacttggaaggctgaggcaggagaatcacttgaacccgggaggcggaggttgcagtgagccaagatcgcgccattgcactccagcctgggtgacagagcgagaccccatctcaaaaaaaaaaaattatgttttaatcagtcattttgtctctagaaatgtatccaaaataaattattaaagaggccatctcaaactatgtacaggaatttttatcacagcattatttatatttgtgaaaaattagaaataattttaatgtgtatggaaaataacttgtattaatagtacacacatatataagttattctataaccttaaaaatcatctcattaagaatatttaatgacatgagaaaatgctgaaactacaatgtatagtttaaaaattagtaaacaatactgtgtaggaatagaatagcaaattatttcacaatatacattatttttaaaaccaggaaaatatacatatctgtttggtttttgtttgtgtattttttagataggatctggtaattacacggatgtcctttggcctatttttcagatttgtagccaaacttaataaagccaactagagttatttatacctatatttacaggcataccttggagatattgtaggttcagttgcagaccactgcaataaagcaaaaattgcaataaagtgagtcacacaaatttttcggtatcccagtacctgtaaaaattatgtttatactctcctgtagtctattaagtgtgaaaaggattatgtctaaaaaaacacactgtgcataccttaattaaaaaatacgttagtcctaaaccgttattacaatcatctgagccatcagcaggtcataatctttttgctggtagagggtcttgcctcaatgctgatggctgctgactgatcagggtagtggctgctgaaggctggtgtggctgtggcaatttcttaaaatcagacaagtttgccagatcgattgacccttcctttcacaagagattttgctgtagaatgcaatgttgtttgaatgcattttttctacagtgaaacttccttcaaaattggagtcaatcctctcaaaccctgctgctgcttaatcaagtttatttatgtaaaatcatttgttgtaattccaacaaagttcacagcatctttaccaggagtagatttcatctcaaggaactcctttctttgttccttcataagaagaaacttgtcatctgtgaaagttttatcatgagtatcacagtaattcagtcgcaacttcaggctccccttctaattgtagttcttttgctatttctaccacatctgcagttctttctcctccaccgaagtcttcaactcctaaacatccatatggttggaatcaacttcttccaactcctattaatgttgatattctgggctcccatgaaccaaaaatgttctgaatggcatctaaaataatgaattatttctggatggttttcaatttactttgctcagatcaattataggaattactatatggcaactgtatagccttacgaaatctatttttaaaataataacatttgaatgttgaaattacttcttgatctgtagggtgaagagtggatgttgtattagcaggcatgaaaacattatctccttgtatatcccaatcagagctcttggatgactaggtacaatgtcaatgaatacttatattttgaaaggaatctttttgtctaagcagtggatttaacatatttagtaaaccatgctgcaaaaagatgtgctgtcatctaggctttcttgttccatttgtagagcacaggcagggtagattttgcataattcttaaaggccatagtacttccagaatggtcactaatcatcggcttccacttaaagtcagcagctgcattattccctaccaagatagtcatccagtccttttaagttttaaagccaggctttaacttcacctctctagcaatgaaagtcctagatgacatctgcttccatttatataaggctgttttatctacactgaaaatctgttgtttagtatagctgccttcatcaaggattttagctagattttctgggtaacttgctgcagcttctacagcagcacttgctgcttcacattgctcttatgttatagagacatcttctttccttagacctcatgagccaacctcagctagctttcaacttttcttctgcagtttcctcaccttactcagcattcatagacttgaagaaagttacagccttggtctggatttggctttggctttaaggactgttgtgactggtttggtcttctatccagatcactcagactttctccatattagcaataaggctgtttcactttcttctcattcatatgttcactggcgtaccactttaaatttccttccagaacttttcctttgcatttacaactcagctgtttgacacaagtagcctagctttctggctgtgtcagcgttcagcatgccttcctcactaaacttagtcatttctagcttttgatttaaagtggtagacatgcaactattccttctacttgaactcttagaggccactgtaggtttattaattggcctaatttcaatattattatgtctcagggaatagagaggccagcccacagagaggtagaaagacaaggaatggtcagtctgtgtagcagtcagggcacacacagcatttatcagttcagttcactatcttacatgggcaccatttgtggtacctcaaaacaattgcaaaagtagcatcaaagatcgctgatcatagacaaccataacagatataatcatagtaaaaagtttgaaatattgtaagaattatcaaaatgtgacacagagacaggaagtgagcacttgctgttggaaaattggtgacgatagattcgcttaacacagggtagccacagacaaaccttgaacttgtaaaaaatgcaattatccatgaagcacggtaaaacgaggtatgcctgtataccacagcatttttacatccaggctaagccagtctcttcttaatcctgctggatagaaaattttatcatatttcagtgaaagttcaaagataaacttttttttggtctcatgtgcaaataataaaaaaaattaagaacatataatgtgctgcctaaaggttatttattttaacccacataataactcttttattaaagatgggttttataatttctttttagacagataagaaatttggaaaaaataatttcagtttaattattctctagttagtgaacaggaaataatttatataaaggtctaattttatatagattagatttaaaggtctaattttgtatagattatactgtcttggaattaaaactatatagaactttaagatcaaaattataaatgtgtaataaaatataaataaataaatgcaaatgttaatatatcattagacatcagaacctttaaaaaagatgatttcctggctgggtgcagtggcttacacctgtaatctcagcactttgggaggccaaggcaggagtatcacctgaggtcgggagtttgagaccagcctgaccaacatggagaaaccttgtctctattaaaaacacaaaattagctgggtgtgtggtgcatgcctgtaatcccagctactcgggaggctgaggcaggagaatcacttgaacccgggaggcagaggttgcggtgagccgagattgcgccattacattccagcctgggcaacaagagtgaaactccgtctcaaaagaaaaagatttcctaaggataaaaatatggcagaggggtttagaggatctgtaacttgccaccatgattctaacttttgacttctcacttcttactctttgcaactttccttgaccttttttatccttttattagtttagttttataattgtatttcctttcctccagaaacacattagcaattatttttccttgacacatttgtatattaatcacctctctttcatttctttcttccttcctttatacttatcttaataaatcacaaattaaaatgttctatgatgaggcaccagctttactgaaagggctgaataatataatattatagtgaagtgaaatattaacttaattccaaaagtactttgttatttataggaatttgtttaaatgttgagctcttaagcaaaactttaaaaaaaaaatctctttctccaaatcatagctaccagaaacgatctatagctgccccaatatatactgagtgatactggttggaaaataatttctaagaaaaaagttttatttcttttcattgataatcataatttttttaaaaagccatgatatggtataataaggttaaaaatattagtctcagaatagttctgaaggtaaactagatctaaaaataaaatggccaactccttagcacaaacaaacagaaagaaatgttggtttaatctatgtaattttattctaaactgatacaaaatgtattatggagagaaggggagaaggtctacattcgttattccataggtaagagactaaatttaattaaacaacctgagagtcagaaggtaatatcagctgtactttcatattatttattgatgcattcagaaagccactgaacttctccagaccttggttcccttatcagtaaaagaaacacacaaaatatacaacattttctaaaacattttcactaaacattttgtaactaaagaaaaatatgaatgtatatacccagtgatatgtgagtgtaccttaatgcagttatcataagcctgaaatttctttgaagttttgtattttattttaaaaattaatatcaagttgatttttaagctatgaaatatatgtttggtttaattaaaatactacatttacaattatttttggcaagagaagtgagggtggggctagatagttttctaccttgttaatggtagaaatcgttttcagtgagctcagttttgggaaactgagctaaatcaaagggaatcaacatcacatattagtttaggatccaggcaatttcttttgttgcataatattactagaatccaaattcttggaaaaaaaagtaaatagaaatgtcaaagtcattttactacaggccagatcctggtaattaatcactgaggatagtttccccagtaattaatccctgaggaaagattcccagaatgttgcaaaagaggtaatacagtgcaacattttcagaatatttctaaggaatactttgttaaatatattctagttgagagactgaatagaagattgaagtattttggatcccatggataatatcttttaacatcttggtaaaatacttgtcaaaagatttcttcatgattaatgatgacattttttgttttgctcctaaattttgattatcaatatatataagtaaactagtaatctcaatttactccacaatcctcacaattatttacattcaattctcagactttgtttataatgccgtgatagtacaatataaacatttacagtttaacctctcttagctactgatagtgttttgcctttagaaaagtatgaataaaaatagctaatgatgtgaagctcttattattaagaatagtaaagtcattcatcttatctgaatgctaatcttttgtgatttcttttaaattcttatctaaaatgtaataatcaagcatttggccgggcacggtggctcacgcctgtaatcctggcacttttgggaggccgaggcaggcggatcacataaggtcaggagttcaagagcagcctggccaacatggtgaaaccctgtctctactaaaaatataaaaattagccaggtgcagtggtgtgcacctgtaatctcagctattcaggaggctgaggccggagaattgcttgaacccaggaggcagaggttgcggtgagctgagatcatgccactgcactccagcctggatgacagagccagactccatctcaaaaaaataataataataatcaagcatttggattagctgtgaatttcttttatgtatactaccccactataactgatgattaatggaggactaaaataaataaggacattacattttaaatctactgatttcacttttctctatttctcaaattctagtttatatagacatccttttcaaattctttctgaagtttttcagtattaggtattattgttacctgtttcagaagctgcaaaaaaatcacatgaaacttgaattgtagccagatgaaacttgaattgtagccatttctggctttgaaaaacaccttggctttctaaggttttcctcttatgatggtttcaaagacaggcttgtttatagaaatttgaaatcaagcattgatgagtggtttgctcccaaagtctctatataaatcagtcttataatctagtttttacattcagagtttagtggtaactgtctttttttcttcttataattcattgtttaagtttctatacttgcatttggaactgaaatggtacaggaaaaatgtcttccatatatatagtaacgtaaaatttcttccacagatggagagagacagacagacatagtacatatacatacacattctgttataagcattaatttttttccatcccatatattttcaggcctgctaagggaatgctactttaaactagaaattagggactgttgatttcgttcttagatttgtcatcaacttccagtgtaaccttgaaaaagatacctaatgttgctgagcttaatgtaattttaagccttctggaaataaaagacaacatagaaaatggtgttcacttattactgtgtaagttcagaacatcttcacagtttctgaaaattttcagaaagcctcatgaggcatcagactcttatatttttataggaatctaccaactctacctttataatctagatattgtgaatctgcatttaagatggaaaacagcttttgatataaagacctcagaaatcaaagaaaacagcacaagaggatgagcagatattatgaactcactctgaattcactccatagggagcccctctcttataggtgctgatgttctagttagtatccattgtttctaaatttgacaattctgttccactaagaatagtaagaattggtgattatcttttggccataacatttagttaatgctgaaaaattagtaaaacttgtttatatccagtagagccaaaagttgatgcaactcttatatagcaatatgcttttattcaaaacgaaaattccattttctcaatatgattattcctcagcaatttccatatgctatcagagatcttctaaaagggataagacaatatatatcctgcttccaggaaataaaattttataggatgttcaggtttctattatttcttgaagactttaactgggaacttttggcatcacactgatatttctgctatctcctaatataagcaggaacatcacagctaacttgacctatgctggtctgaattgagacctcattctggaatccatagtgtaaaaccacttagtctgaagcttcctatcccctttgctcttcaccctgccgttttttttttattgcctccctctttatccaaaacattagttctcattagagctctatttaaaaagtacctcctctaataaaacattttgtgttgagaaacttcccttgctcatttatgcagtaatgtgaaatgagttattttaaaaaaaaagttttacttttcatttcccgtcttacccaagatagcaaattttccaagaggaaaattcagctaaaataactgaaagctttgaggcagtaaatatatctaacattggtctggcattaaaattttctggttgggcagcacaattgtttaattgggaatctcagtgacagctgaacaacctcaatgcttgggtcagcaagcagaggagcttcactctgtcacctatcaagaatgatgcttgtcaggactgatctttccacctacagagcattcatgtttctagtcataccatttatgttttctaatattacaatggaatagacactaaaacactaagagagaaaagtacataggtatatttgtaattctttgttttttgtaagccaaatgcaaatgtaacactactccagatactgcttcatcagaagtccccaagataaccaaaagtaagtgccaatttcctcatctcagggatagtgccataacaaagactgaattctagggaccagcctatttgcagagcatgtcatacagcctctgggttagttaactccttggcctcctaagagctaccacagagagtcaattgatgtttttgcatgtattacttactaatgtatagaaaaatttttaagttcactttttctttattctgtctttcttacccatcttccctcattgtagcaaattagacggccggatgaaagcaaaggagttgctagtagagttggatccctcaaagtaaatatgtttctaacattttttggcaagatttcgtctatagcctacacttcttcctttttggagggtggtgggaggaagggggctttttccatttttcaccatcccattttttttattttaatatttttattggctgttgggtcatattactttttttttgtttcagctacacatagagcaaccagctgaaggcaagctgccaaataactagctttgaatggcaccacaaacaacagaaagggcaactgcctcattacaggtgcctataatttggggttctagaataaaccgttcctctgattgatgtcactgtgtgttaagttcctgttacacagagaactaacatttattttcagaatattatctccccttttagcttttttttgtaaaaaaaataattttaatgttattttggtatcatcaccatttatagttcatttcagagaaaagttattatgagttaacaatatgtattcaatacacataatcttaagaaattgaaagaaagaaattttatgtcatgtagtataatgggcccacatatagctgatagtagttatgccctcttaatcccctctgttttattttttaaatttcaaaaaactgatacaacaatcaacagaaccagatacatacctaaatgtttgtccatttgtgtatataacctgctaatatacaattgaaagatttctaatttgatcatcttgtttgctagttgctaaatatttatttgctcaatatgccttgggcactcagtactcaaacatttaatcataatgaaaaggtaaataagttatcactcttatgaaacacagaccaatcacatttaatgctgccaccttaaatgcaagttagaaaatttgctgaattctaaaaatatgcagaagaattacctcacaaaagtaattattttcttatatctcaatctcatttgccctaacagcaatagtaactgttaaattaatcaaaatgctagaaaattcagtgcactgggatgtcctaaaatttaatgactaccttgaggcctaatattcaatcatttcaaaattttgcacacctccaatttatttccattttacaatttatgaaatactaatttctgcactctttcctctccttgcctcttctgccttcttagctttacttttttgttattgtttatttgtttgtgtgtgcgcacgcacatgagtgcacatggatgaaggtgtgtttgtatgtttgtgtcctttatttcagaaaagccatcctctctgttctctaacactgctttatagtggatagctattttattaaaatgttatttcaccaaggataagaagaggggatgggaagtgttaatagtgtgcctatttcaaaaactaggcaatttaagattattcagtcagaaaaatgtgagtttgtgtatcctgatgatatatcagtagcattcctcactgtctatctgtgaggtatcatattttatctttgtctttaaaggaagataaatccattaatggtttaaactatggattatgactcaaattcaggtgagaaggtacagaacgacatgactttttgaaaattactgaaggtgaaataaagataaaaatggcatccataactgtagcaccatgtactgtaaactggattgtatgtgcgagtgcgcgtgcgtgcagttatctccgagttcaacttctggatgtatagaacttcaagttataaatgtatgtttattgtttttaagtgtatatacaatatgagtatgtatatacacatatatatgtttaagaacaaaagatacgttttataattaaatcagtttatattaatatggatgcagtcttgaatcaaaaagtgtgtttgggaaagaaagtcaaatttcataatatttaaatatctttactccatgtttctacaaaatagaaaatgtcaaagtgaatctctaggggatttataaggatggttatagtatttattttctctaatgctttggggagaaaagatgctgtaattaatcaaaataaaatgttgacttcctagtcacgggtttgttgagcatgcattcttacgttatagaaagacctttgatgtttgaaatgtttgccaaaggcagtgagaaatgtataatgctatgatcttatttttaaaaggaaaaaggaaaaccgaaaagagaacaagttgctttttcaattcattttctgatgtttacatgtagctccatcgaaagctggaggagctcagagatcacctagaaggcaatgtgaaaggatactctctcagagtaaatgtacgatttcacttggtgatttttttttccctaaacttctgctgactggtaactccaaatctgattggtttgtcctctcatctccatctttttcctttctgtctcttttccccctctttctttcttttctagctgcggcttcatgctcccatttatgaaataaagattaaattagcagggtagaggaccctaaagccacactgactaacattgctgttgacttaataatattttggccccagtgcaaaataaaatctttcttttcaaaaatcactatttcttatacaattgtatacttttttgaggatcttgtcatgagacttcatttggagatttttctattggtcatgtcttctaccccttgttagttatgtcagcagaataataaattatgagctggatgtgaggggtatatccttgatggtacaatttcaattttcaaggaaaataatcagtgttagggtatcataggtaatctggcaagtagacacatttgttctgagttaatagacttaactcagactcttttagaataaatgtatgtcattttgtttaaaaataagaaaattagcagtaagtaccttcaccaggaacaccttcacgtagcatcttacaaatacttgagctaaagtctaatatacccaagacaaccattgaaggaggacagtacctcgtatccactcaatcctgtacattcatcatatagtcagaattcatgatagtattttttgtgacagatagttcagactatcaagattttcaagaaaaatctctaaattggttttggtataaatgtagcagaagaaaaactaaattactacagtaatttatggctttcatttctggggtttccaagaaagttcctgtgaatcctggtatccgatttacttctcacaaggttattaccattcatttaattcacacagctgtaatagttttgttataaaaactagaattaaagttagggatatgataattatcttatttctcagcttgtttttaattgtataccacacatagtcatgtgtatctctacgctaaatttctgattattgaaatacaaagtgatttttattaataagttgttaattctaataactaaacagaaggaattaatacacgtgtctcatatctctacttcttcctttgagctactctttgttttctgcacatattcttatagaattttgaaaaccatccataatcactccccaaaacctattttgtcattttttttaaaaaaaagattagtatggattttatgattaaatcagtctggacatacctaattattctagaaacccataaaaatattttaatatgtgtattttagtcttgtgctctttcctaatcagtcatgagaagtaatttttcttttcaatgaaactgagaccaaaaagttgagacttgctgatttctgtatggtaataagttagtaagagaccaacatcaaatttaaaatttgatgccttaaaaattaggttatctcatgccattatttaatttcttttttcaacacctgtactactatataatgattaatctcattttatttcactgagaaacactttgttctgattaccttgtttctaaaaatattaaatataaggtgtatctgtctaaggatcctgttaactgtccaatatagaaaaaaaaaaaaaaaaaacctatccaaaggcaagtagtatcttctctagagagttcagctaaggaaacatgcaaatcaattgcttagctgaattttcagtttctctccttaccctttaattcctactacccaagtataccttaaagtgccttgaatattaaaaattgatgctaaaaagaaaaagttattctcagaaccatagactatattagacaggttttgtttctaaaatgaagtaaattggcattcggtgatgattttgtttcatgaaaatttattgtaggtgtacacacacaagaacaagtgtattagtccatttccacattgccataaagatactacctgagactgggtaatttataaagaaaaaaggtccaattgactcacagttccacatggtttgagaggcctcaggaaacttacaatcatggcggaaggtgaaggggaaacaaggtacgttgtatatggcggcaggaggggagagagcacagggaaaactgccacttttaaaaccatcagatctagtgagaactccctcactatttacaagaacagcatggagaaaaccacctccatgatcctatcaccttccaccaggttcctcccttgacatgtggagattacaattcgagatgagatttgggtggagacacagagccaaaccatatcaacaagtatatgaggtgtcttttacttcattaaaatgctggtgaagatttcaattagatgaaagagtcagaaccatgttccttatacaattgtataattttctgaggatcttctcatgagacttcatttggagatttttctgttggtcgcgtcttctacccttagttatgtcagcatgattacagattatgagctggatctgagggttacagccttgatgattcaatttcaattttcaaggaaaataattactattagagtatcatcataggtaatctggcaactaagcacatttgttctgaattaacagacttaactcagactcttatgtacataacctacagttacttttacataacagcagagttgaatagatgaaacacagattatgtggcccataaagtctaatattttatttaatagttaaattttaaaaaattcaattaaatattttattttatggagaatttaagatatcattcagaagtgcaggatgaagatttaatttgctaatagtttaatttgctaataaataaaaattaaaatattttaaaattaaatatttaatatagaaggtttgacatcattcagaagtgtgagataaggatttaattaaatcattaatgcttgaattggatgatgtagacaatatgttattttgtagaaagggaagagccctgtaccactattgattaaggataatgtaatcaacaatataaaatagaatattctaagatacaatgttttgaataatgtttatttctcatattaaaatgtattatttattcaacattgattcataaaatgggatgtattagattattgatttttaacttaaaaatgcatcatctttttctctatatcattcaaagcagaagtattttgaactttaagtgcgtttttagtaattttagtaataataaaatcatcatcttgtacctaagcagaattttactaccttaatgactacaaaaattactacaaatccttagattggtgatgtgctgatagtaactgaagaataaaaccacatagaggaaaaattaattttccatttagtcaaatggatgaatctattaagaagaatattaaaagtaatgcacaggcttgaaggccagtgaagacaatgttgagaattgaaaaacacaggataaggcaggggacggtggctcatgcctgtaacccagcactttgggaagcctcactgagaaacactttgttccgattaccttgtttctaaaaatattaaatatgaagtatatcagtctaaggatcctattaactgtccaatatagcaaaaaaaaaaaaaaatttaaaggcaagtagtatcctccctacttgcgggctgatcacttgagaccaagggaaaaacctcctgtctactaaaaatacaaaaaattagccaggcatggtggcatatgcctataatcccagctacttgggaggctgaggcacaagaatgatttgaacccaggaagtggaggttgcagtgagccaggatcgctctgctgcactccagcctgggcaacagagtgagaccctgtctaaaaaaaaaaaaaaaaagaaaagaaaagaaaaacatagaataagataatccaaagtaatactttctttacagaatataaatcaaggtaaatttacaaagaatttgattagttgacgagcagtggggccaaagagagcctaaatattaagatattcaggaaaaaagtagataaatgttcatgaaataaagatagttaaaagaaaagaaaggaaaggaatgaaaatactcatatgccacaattttgtattttcatctgaatactcagtttatgtattatgatattaaatttctattcagctacaaatatgtgtagataggttttggctgaccaagtgtgatttttttaagggctatgataaacaaaaaggaatatggttcatgaagacagattactggcatataagtgaaactaagatggaaagtgatgaaatggaaggaatatgacaattatctataagtacttaactatactaacacaaattaaaggatggtatttaaagtgaaaaaagtcaagggaggagttgtcacccaaaataagactacctttttaataagtgttaagaaaaatacctgaatcaagttagaaagtaatgatcttttgaaccatgatttttaaatgtttaacaattaatttcctgaatgccaatatgggatagtatgaaatagtgctaatataaataatgaattgggtaactgtgattttatagatctttaaagatgagtattttcattgcagccttagctctgaactactttcttatatttttgataaatagatacctattgtctttaggggggttttgtacttttatttttattgagttaatgcgataactcagagatcagcaaatcctgtttttttataggcccacaagctaagaatgagttttgcatttataaattgtggagaaacataaaaagaagaacattttatggcatgtgaaaattatatgagattcaaatttcagtgtttaaaaataatgttttattaaattataaccatgctcattcatttgcacataacctgcagttacttacacaacagcagagttgaatagttgaaacacagattatatgtctcatacagtctaaaatatttactctctatttaaacagaaatgtttgctgagtcctgctgtaactggttagtgtgtcaaaataacgttgacgtaggaatggttataatggagtttgtgaaatttcttcattttaaagcttgagaaaagaagcctgctcatttttctgaggatggtttcagattattctacaaggaagcatatgtttggaaaggttgatctcctcaaattgtctacctttacatttttattttcttcttttttattgtcttctctagctattctctctctctcttcacatagatttccccctctacacacacacatacacacaaagtcttcaaatatggaactctaatgtggatagaatatagattataaatttctcttttattggaggctcatttctgggttttcagagtacaaagataaatctcattattgctgtcttaaatgttatataaaatatgttattagagtattttcatttaacacattgcatttttctatttattacttcattacgtcttaacaaagatatttcccctgaagaccatgatgaacttttgatttttgctaaatgccctgtttggcctcacctaaaatcatataccttctatgggaaattttatacaactggaaaagatacactgacatgatcaagtaatatatcataccttaaaaatctaaatggtatttgaatcgaatcagctaactttgagtggggaagaacagatgaaacattagtccctagataagtaaatatttaatagtccttaggtgagcaaacagtttgtaaactctacttactttaagcaaatttgagtgtctcttgattcttttatgtagaacattgtttgagccttccttgtttggcattttggcatttacttatattaataatattcatttatttactatttcatttataataattatgtaacatctgagtatcttggtagatgatgtcttataaatatgaccagactacaataatgatgaagataacagtaagtcaattttaggattatgtctttggactaattttgagtaattttgctacttttcactttattattattctcttaatgtagttagtccaattctaaggtttcagttataaaaataagaaaaaatggccaagcgcagtggctcacgcctgtaattccagcactttgggaggccgaggcgagtgggtcacctgaggtcaggagttcaagaccagcctggccaacatggtgaaaccccatctctactaaaaatacaaaaattagccgggcatgatggtgggtgccagtattcccacttactcggaaggctgaagcgagagaattgcttgaacccaggaggcggaagttgcagtgagccgagatcacgccattgcactccagcctgggcaactgagtaaaactgtctcaaaaaaaagaaaaaagaaaaagaaaaatctatcttatcctgtgctttaaacaaaaaaaaaatctcatgatattaataaaatcacctgcagtggcctaagacattatttagaatggaagtgacccatttctgagatgtttaatgtgcaccatagaattgccctcctcggaactgactttaattcaaagataaagtactaataaaatatctcaagtaaattttcctagcaatagaaaatagagaactgagtaaattttaacaatgacaacactctcaaactgttttgaaagataaagtatttcagttttatgggcatagatatagacacagaacaaacatacacagcaagattttcttagaactagcattttgctaaagaaattcagatatgtgtatggctgaaaaatgtgtaatttctgaacatgtatagaatttaccatattttcaaaagtacctctaagcaataagtggctatgatactttttagcacaaatctttgtgatagttttaaaaattctgagcattatttcatcagttcagttttttaagatagaagaaaaagggtttgtatattcatttattaaataaacatatattgagcacctactacattctgctatgcttggcactggaaatacagttaaagaacaaatcttagataataagtgcatttgtgattcttctactgtcaccttctccagtaccttcatttccccaccgtacctttgtgttttgatacttcctgcagtatttgtaaatagagaatacatacttaacaacttcatcttacatggcattgtgagacaacctaacgagaaaagagtacacagaattgaacatggcagtgtgacaacgtagaaaataagaacagggaagaacattatcagttcagcatcataaaggttaaacattgttgtaagtataaaatagctatttttaaaaatcagtgataaaatagctgttccaaaaattctgtgaatcattctgataaaggttaagtctgttgaagagttgtgtgtttaagtttttatatttttatagtgttgctattgccattatattgtagaaagtgcctcaaagcaataagtggcaatgatactttttcgcacaactctttctgattgtaagctttaaaattcctgaatgttatttcataagttcagttttctaagaatagaagaaaagggatttgtattttcattcattaaataagcatttattgagcacctactacattctgctgtgcttggcactggaaatacagttaaagaacaaatctgataataagtgcatttctgattcttctactgtcatctttcttcagtggagaaagagaggttcagtaataccaaaaatggaatagttgaaacaggaaaaaagaatcagaatactggctttggtgccctctttaatgaatactgtgaacgtgtatggtagagttattctataaacaacctcccatgtagttcactagtgttaagccagtgaagatcagtgcagtaccgtaagaaaaattgtccagcgttctgctttctttcttaaatgaggatcttctcagcaagatcataccagattctgaacagagggagtcatctccatcatggatttttttttagcaaggtattttttgtcacaaagttttccttcaaataacttgagtcttgacatgttttcaaactcaagtgtctgcttataaagctgttttattatctggccaagtgtgttggtgatggagccatctaaaccctctgtgacccttactatgctatcctttcctctttaacagtgttttcttttccccactgcaaaaccaggctcggcttccctcgtgctcatctacctatagtgtatctgaggtatattttgcacgtgttttcttacatggtcaataacatgctcgccctcaccatttttctcattttattttcctttcgccttaatttattttgccttgcactttgcacttgcctgaaagggatgaggataccaaagggggaaaattcacctgttttagggggaaatttctctatttttatgaatgatgcactgttgtctgaataacttttttttggcagtcactacatcacattgaaataactaaaacccagatagccaacttgattgctgtgactacctttattccataatgactcttttgaattaggtaatttattattaaactcaaattggctaaaggcaagattccagtttgtatatctatatatgtctgtgtctgatagctgaagatttgtattcaattagtgattgttgtgtctcattaaccacagacataggaaaacatccaaaattgattattaaatagaaaataaatatacatctattttatataaaataaaagatgtatcccttttttaaaatctcattagatgactttaataattttttgctacttatattttcctaagattcttgtaatctagaagagattaacagtaaagagattcatgttcttttagtaaaatattttacatgaaatttggcctattttccttgtcttttaggaggtttaattttttatccttactgtgttaaactatagaataaatgagttttcttgttttcaaaaagcagatttattgaaatattattaacagactttgaatatccattaagtctcctttcaaagcaggggcactgtttgagtagctaagaagaaagagtatgtaccttgaaatatgacaggtaaataaaagaacttcaggccaggtgcagtggctcacacctgtaatcccagcactttgtgaggccgagatgggtggatcacttgaggtcaggagtttgagaccagcctggccaacatggtgaaaccccgtctctactaaaaatataaaaaattagccagacgtggtggcgcacacctgtaatcccagctactcgagaggctgaggcaggagaatcacttgaacccgggaggcagaggttgcagtgagccaagatcgtgcaattgcactctagcctgggcgatagagtgagacttcgtcttaaaaaaaaaaaaaaaaaaaaaggacttcagtagcctatgaattttaagaccttcattctttttttacaacataatttctacatgtatttactttgtataggccactgtagctaccatattaaagccagtattatcagcttaattctgattgcagaaatattatctcagaatgtcatcccaaagaaaacccttgaaagatagtactgtttaaaatacgaggtagtatatgcagaaccagaggcagaataccatctgcagatctcaaattttaagaaaaaaccaaaagaaatagcatgacaaacccatagcctcacaaagttgaatttattgagtcaatagaattgcagctatcttcttcaatttttaactttgcaagttataactgtgagatttttttctcttaaaactgatttcctggggagttaacttcttgaaacataccactagggagaagcaaagaaaagaaagccaaatgagctatttttagtatcaacaaagacatttgaaagagaaggttggtatcatctcatcaccacattttctataggtcttttcttaattcccaaagattatgagtgctagtgtaaaaaatatataacccatttctttttgccacttcatccaggcaattctccatttcccatgagagtgtgtaagaagtctaccattggcatcatctccaatcacagcctacagcatccatcagggtattactttctctatgacagcatgtgtgcaggagggctctcacgttggaatgtggaactggcttcttgggggcattatgtatgctgtggcatttgcaccatggcactcagctcttaactctggcttcatctagatttgtttctttcattgtgacacatgggctttctttatttgtcatgaagtgtgtttctctttctgtcactcgtggtagggtttctctctttcactcaatgccacatctctgtggtctccataggtgctgtttatgtttaatttatgatgctataaagaccaataaaatgaagaactccttaagtaatattcgtgataatcctctgcctagaaataattgtttctttttagtcttaaattggtaaatatttcacagaattttagactgtaaaccttaataattaaaatttcaaggaatattcttcttagctttcaatttttcatttggaaacctcttgacaggatcattggtacaaagtacagtatttattttatagcatcactatggaggtagccaaaccttccatggctcgatctcttctttcccttacatttacatcatcatcttcatttaccttcactattgtagaaattaagtctccaatccctaatgtagcacattggtttaccaattgcatatcactatcttctgtgtcattcattagatgaaaaaaataagccttgctcaaaaatgaacctatccatgagttgtataggaacaagatttataacctcagctggctgatactatttagcaaaaacatttctccacgtagttatggtccctttgtaaaaaaaaaaaatatatatatatatatacacatatatatatatacacacaattattttacttgtgataagctttgtttttgatatctcattatcaattaaccttcataacagccttgtttggggtaaatattaatgtcatcctcattttaaagatgaggaaattgagacgcagagaggttaactatcttgccgatcataaagctagcaagtgagtggcagaaaattgtcttttcttaaataccatgctttctcctgttaagaagttgttaaaagtcattagctctgtgactagcatgtagtagtcttgtattttcacttcatccatttactttgttcaggttgattatatagtttggggtatatattttgagaagatgcacctataagatacaaaactttaattaatacaaaacgttagtagtgtgtattttcacttcatccatttactttgctcaggttgattacatagtttggggtatatactatgtgaagatacacctataagacacaaaactttaattcaagaaaatgttagacatctaacatttatggttatataatttattgtcatgtaatttattgttatgtaatttattgttatttttctcttatttagtcatttgataaatattgagctacctcctatgccttatttaattataatctgccagttatttcttggcctttggaattggctttacgtttagaatacataaaatattgtgaatgtaatgagatcagtgtctcatacagtttttcatcccttcaagcaaagtgaaaaaaaaagaactcatctttcacgtttctaactgattttcaactttgttccagcagtgttgtagcagagttcccttttcaaatcctttgaaaagattgcttcagaattcccttagtataaaccaaagccagaattaatactttcttctgacagaaactgaattccttctgacttatttgagaagctggaatatatactagatatgaatttattataatttgtaacacaatatctaacccaaagaaaattaataaacatccaagttgtcatgcttttactggtccaaattgaaccctttacagccttatctttaatgtcttagatttcccagtagcaaggttgatttagataatttgacatttagatgctaaataatttatttcctgttgactagacagggactgaaaattgtgtttttatttaatgcttaagaacttctagctacctaaaggaatgatggttttaaagttgtaacatgcaaaatagttgccctttgaactcttagacactattaggacaccaattctgatctaaacaaacttggactgcctaacagttttggagcttttgcaaacagaagtttcagttaaattgcagtgagtaagtctacatattcaagaaaagaagggagagaggaaaaaaggaagagaagaaaggtaaatgaactttaaacaccataccattttctatttcaaaagaaaaaataggaacattttttaaacaccacagaaccacaaactgtttaaactggaagaaactgtagccaaaaaataaagattctatactgtgagataatcacctaagatgttctactatataaaatctcatttagaaaatctttaataatgatttattacttatttcaatatatttatctacagtgctccaccctttcattcacatgtattatttttatgccatttgtatactatagttagaaaactggagatagtgtgaagaaatcttagaattctatcttttgaaaacactacaactgctgctattaaaatttattgattcctacctcactttcaaatttgtagaaatgaactggagtatataaattgtcttgttaaaaataaaattagtatatatctctctctctgacatacatattagtagctaatccatagagataatgggaaaacacattacattctgtttgacagggatatttgatatatccatctaattaaagcattctttaaaaagaattgagaagaattctgtctacttgggcatacatttttaaatttccataataaaaatatttttaaaacacactattgtagttggcactagcgaatttctgcttatccttgtatattgcctcatataatgatcatttacaatataaaagaggtcatcagtgaaaatagggcaagaaaaatttaaagtttaagatgagggaatattaatggatgtgtaacaagtttagaaagttcttaagctcccttaaaactaatatataaactatatgtatctttgagagagaaaggagatatgtatatcctctccttcatggaagtaggaatgaagagagtccataaagtacttatgtgaagtccagctttgtatatacacagattagcttatcatcatgatgttctaaattttctttcctatgttctagagaatttacaaatgaaatagattaattagacatatagctagttagagcccaaataaatgatggcacattataatatgatatgttataatgtcatattataatgtgatagcagtaaaatgacagctcacctgcatttatacttatagttccagctgctgtttgaatgtctttttgtaatatcaaactcagtatgtccagctctgctttctaaatacttctttcaatggtaatgttcttaaagtttccctgcatagaaatcttctagttatcttttactctttcttgtttttcatctttgacatttagtgtgacattaaattttgtcatttttgttatttctccttttgaattatctcctaatccttacttcggatacataaatgaactttgttgccacgtctactttaaaatcctggctttggccaaaaataaataaataaataaataatgaaaatggcagctttctatacattacagaggtttaagaaatgtgaagcagctcatggtcatatattgctatggttcatctccatggatttacacagatttggtttaccaccaatcctagtgtaatttttaaagactcaaataagtatcttcttgaccagcaacaaggcaaattttcttttgctccttttgggttttactcctaaacatgcatttgggtgaaatgtatagcctagactttggcaagtagaattatcaattttccctggtcaccttttttccctttcaaagcatttccttcccaaccagtgttcttcagctaagccacagaacacaggaagtaatatgtgtagctattttcttaagatcctgtaaagatgttgacattctatattcaaaaaacagaagtttattcattacacacaatgaatataaatgcattaaggcttaattctctcccagaattgaggaagatatagtaatcccatcttttaagtagctcagtacttcttgaagtcatttgttatttaaagacgcacttgaaatttcatgtttggaaattctttgtgttgcttttttttttttttttttttttttggatacctagagtctctgaatagcctgtgcttaccatgtgattttagggcttgagatcgtgagacatatttttattttttttaaataacctctttatttttctgaaagaaacagatttaatcagcttctcaccatattctaaaaatgttcctgcttggcagttattaacattttgtcggttttcttgtactgttgaagcagacttactgaagatcaatttaacatactgtttaaagtttggggctagatttgaatcctaatcctggatttgaaacccaaccctgtgccttactaactttgtgaccttaagcaagttaacttctctgcacctcatattcctgtaaaataggaatgataccaccttttggggtatcttaagtatttaacagcttaatattacttggtgcaatgcctgatatgtgtaagtactcaataaatattaactatattattatcagtatttattgttatattaaaggtccaaaggtaaagttattttttgtttcaactaactctttcagatacattatctgttaggtttttcatagagtaaaatacgttttatgtatagtgattagccacaacctgattgaaacaagtattagctccactatcaacttaacctgacatcagcacttgtaccattcctgccttacttctttttcctagtcattgtaaaggatatagaatatgaaatacatgaacacttaatgtctttcttttcattctgccaggtgactatcttctccagtttttcaattgtctttttctccaaaatcactttcccatttagtgtctggattagttatgcacataaacacaccccaaagatgactaataggaatagtggttttttattatcagtagtatattgtccttgtattctattatatgtcatacactacaagcaatcaccagtttataagtgggcaaagcacttcctcacaaaaagtaactttatagtgactagatttctagactagtgttcatataactcttaattagctgatattacactattagtaactgaattgagatttaaattgacatatatggattaatgtaggaatctatctactaattgtaacattatttcttaggaaaatgcactttaacttctaacagaatccagcctacttcaaggcattttacctgacaaattctgagttgcaatgagatctacatcctgttttcttccttggacagctcagtcttccttacagtactcattgtagtggaaggtaaagggaggaggaaactctagaaattgggacaaggacttccccacagcatcatcaatcactgtttgttgaaggagtgtatgaattgaatgtttatattaaagatgtatgccaatatcattaaatttcagttaactttatatagtgtgatattattagtcctagattacttcttgctgcctcttcctggtaaatgatgatatttctgaatgattctttattcatttgttaagtgctacttattaaataccctctgtttcttcatatcttgtaaacaagatatagatctttgagtcagcagagcaaagttaaacagatatgtgactgactgtgattaaaagaagtaatcatttctactgccgggtctgtgtcgatttaatcagatgtggtgagctataattgcatttctctttgccccagtttacccgtctctaaaatttgaataaactagacctttatgttcctcagaagggatattctggtgaaatttcagaaaatggaagggagtcatgacaaagctaattcatcatgaatgtaaaaacagaatttttcaggtacagtatgagaggaattatatcttgttatcctgtgtgcattttactttttacatgaaaattcagtcagagagccaaatatgtttagaaaacatactctgagcttaaaagaccataatggtttggatgtgctgtgtaaatgtaaaacttgaaattgatcttgttttgttatttttccttggttgtttatactttcagttttgctgaaactaccagtaggtcataataagtcagcaagcatttatttaacatctatacattgctacagagtagatattgccatattaagcatatagagaatgttgcaaaaattaaatatggggccttaatgattttacaaattgaaatattgtccattttttaaaaaatcataatgtatgaattcaggctatgttgttctaaaatatgactagaggaaatgtctttggctttgaaaactaaaggtctttactaatcgggtgaaaaaagtctgtaggaaaatcaccattcttgagtcctgtgttcacagaatagtcatgagtgagttattttaaatttcaccaaattattgttaagtcacaaaaaaagaatttggtaaaggcagattttcctagaatagacttgagtttttggaaccttattacataactttaaaatgccgtaatacctctttagaccacatttttctctatcagagatggtgtcaggttggtagtaaggcttatttaattaattttccaagttcagacatcttggaaaggagagataaaggcaaggcatgacattactctttataaacatgacttactggaggagaatgcaaattttcatcctttaaatcatttaatcggctttattgagttacctaatatatttgggtgatagaggagaccctgaaagaaagaggacctcaggaagcattataggtcagaatgagtagcatatgcacagcaaaagtagtttgtgaaagggaatttggtctttttttttttttaattcactaagttgaatttaagggcatattttgagtcttatggaatccattttaaacatagtgatagcatttcctgtgcatttttagccacttaattatgtgaataaatgcttgctaccctttacagttgcagctgtcattctccaaagtagattcatccacaatatttacagtcgtaaatcctaaatctattgtatatatttaagattttttaatagtattctttcaccattaggcagcacctccttgagaaagaatttacatttttattctcatttttaacaagaactatacagctaagatttatagagaacttgagggctttttctacaatgtactccatcatcagaagtaggctaaattagaaatagaaatggagaatatatggtgatgtcttttccattagctttgaaaaattcaacttgtatagttacatgtatttgatgtcagagtattttataagtatgcctgatttatcatactgacttgcttctttttaacttaaatattttgggaacacagactcatgtttcatttttcagtgagttattttatgtccatgaataagcgtcaatgcattggttgataagttgaaatcacctacaccctttgaatatgtgtttttgcatcactttcgaatctaccttttaaagtgaatttgacttaatttccatgtgacttttattagtagagaaagcaaataattatgaaacacagtaagggttattatataaaataattttattttacaataaaacagttggatgtggattttacctagaaagactaatattatatatatattatatttctcccttggaactgacaagggagaaaaagtaggtatattggtactcaagtgttttgtattttaagaggaaaaaaagaataaaaaaggggcaatggaaaaaagagaagagaaggaaggagaaaataaaaggaagggaggcaattaccatagtttttcttcttttttgacatcagtatttaaataataggttacttgttctaactttcccattttacatcgttgcagagcataagcagcagcttgtagaacaaaggtgaattcagaaagaccttaaacatatttttggattaatgtttcatgaaaccctgaatggaattcagattcatgtggtctttttatagccatagttttcaattatattagcaattttccttgtcctatttctgtctgcctcaggataccaaaaaaagggtctattttcgaaattttgttcataccattctgcacccagtattgcctggagtcatgaaaacccagcttgctgctattttttctctttggcaacttgctgctataccaacactcagcaattaaatctaattctgtttgggctaccatgcttaaatgttcttgttgagaatcatggcatgaactaatgcatggctctaaaaaggctactgttgtgtgtctgcactgaaggaaaaattccatagcaatctagcccctttggattttatactgaagctgtagattaatggtgaacttctgtgtaatgcttgacaaagaagggaaatccctagaaatgaaagtgtgaactgaggtaaaaatggtcttcagtcagatgctgctaaattaatcactagtaatcatcagttgtggaggttaggagtcccttcacagaatgcacttgggtggaagagtaggaaagagaaaaaaaggatgccagtgagacctgaaagagattatatgaggaaatgttgagtccatcttcatttgtgtgctgtctcaaacatttagctcagagtctgaaatacttttggtcaaattaggactgattttaattgtcttattatacaatttcacagcctcatcatccagcataaaatatatcaaaaatgacttaattccctcatatccatgacaattccaaactgtttttaataaactttataattgcctccaatattttaaaatttattaggaacactggtttcatgtttaaacaatcagcatcctttattagttcccttaagcattcatcttattttaatgtatacaatttttacttggtagaaaataaaccagatgttatttttccaagtggaaagaaatcttttttctttccttttacattacagtttcaccttgaaaatataagaagcaaatgaatggtcccaaaatttggcatttatttttctaagtcatgtttctgggctatgagttactgaattttgcttaatttattaatgtaaatacagtaattgaaccacacaactgtcagttcctccatcctttgatatgtgggctgatgaaatataaataaacaaaaaatgttgtgtgaccagcagctctggatcatctaaatgacctcctttagttcatttccctttccacatatcaagtttatctataacttcaccaatttattagttttagagccatgtagcacagttcaagagttcaaagggaaagtcaaaataatctggggttattcattcaacttcaactgctaccatatggcaaaggtctctgtagccattcttactattacaggtcaatgacagtagcatttctaaagtgctcttgtgcatgtaagtaccactccttcggtcaacctatgtcactgtgctttcacttgcaattatctaactttcagacataactgaactctatttctgatctgaaatgttccccagctagagttatctacctggcctttgctttatagagtcatatgtcctggtagctgcaaattaatgatgaatgaaaaagagggaggagtgatggaagagagagaagggagggatggagaaaataaaaaagggaggaaggaaactagactcgtttttcattccttttttacttcagcatttaaagggtaggtcacttgttctaactttcccattgtaagtagttgcagaacataagcagcagtttatagaacaaaggtgaggtagtaaaggaagtcatactgtgtatgtgctagagggaatcatactatgtcatttgctttaaaagctgtgtctgaaatcgctttggcttccttttaaacatcccacctgcaaggaggaaatatttgcaactgctcttcagattagtcgaccaggcgtggtggctcatgcctgtaatcccagcactttggaggccaaggcgggcggatcacgaggtcaggagttcaagaccagcctgaccaacatgatgaaaccccatctctactaaaaatacacaaaaaaattagttgggtgtggtggtgcgtgcctgtaatcccagctactcaggaggctgaggcaggagaattgcttgaacccgggaggtggaggttgcagtgagccgagatcgctccactgcactccagcaggtgacagagtgagacaccgtctcaaaaaaagaaaaaagaaaaaaaaaagattagtcatgatgtgggtcaaaatacctgtcttttctcttacacacatctttttttaaaatttatttatttatttatttatttaagacagggtttctctctgtcacccagcctggagtgcagtggcgcagtcttggctcactgcaacctccgccttctgggctcaagcgatcctcccacctcagcttcccagatagctgggactacaagtgcatgcccccatgcccagctaattttttgtgtttttagtagagacagggtttttgccatgttgcccaggctggtcttgaacttctgggttcaagcaatcctctcacctcagcctcccaaagtgctgggattacaggtgttagctactgtacccagccctttttaaattttataagctataccttttgattactgcctattgacttaaaagacagttccagatcaggggttatatttgtgcttttacagtctgctttatgttttgaaggttgaagtaaaaaatgtgaagagaaaaaaattgcaaacagaagaataatctaagaatccctgttccattacttattacctcatttacattaacccactttctcactgcagtttcctacactttattttttcttgtgcttcttttccctttccttgtgtgtttgtttttttcattagaaatcacctgtctctttatttctagttatttcttttcctttcctttttcaatgaaagtaataacccatttcagccactgagaaagagtatgaaccttaataattgttattaatttttgtgtttcagtgtgcttcaaaggaacaaaatgagcttggcatagctgcttttatgttctggtacactgagcctaaattctaggcaagtagctcacaggaatataggagaggtaatctggatgaaactaacataaataaattagatacaatatttctaactgtaaaaattttatgcatcatataatgaccctgtcaaaagactatttataaatagaatatgcctttttcagcttgagttaaaacataacgttaatgggtctagggttacagacttgtgaatctagttagcttcacagttgttctatggtagactgtaaactgatcccaaatgtcttaatgtagatgtgtatgcaggggaaggactgagaaacaatgattcacagggaatctatacacaattgagtaaaactgatttgaacagatagtaaaatggtctgtctatattatactaaaaggtttgaattttataattttttgatcaaatggcattttcaatgagagtttctggggttttttatttgtttcgtttctctttttgtttttttagacacccaggttggtgtgcagtggtgcaatctcagctcactgcaacctccacctcccaggttcaagcgattctcctgcctcagcctcccgagtagctgagattataggcgcacaccactgtatctggctaatttttgtatttttagtagagatggggtttcaccatgttggccagcctggtctcgaactcctgacctcaggtgatttgcccgcctcggcctcccaaagtgctgggattacagacgtgagccaccatgcccagccgtgtttttcttttagataacttttgtattgtttttcatacattcagtaaagaatatagataagcaaagagaaaattaaaattacccttcagctcctcccatgttaactgctagtaacttttatcagaaagaaataataaggatggtgaactgaagaaaagagaagagaaagtagggagttctacagataatatagagtaaatcaagaataggccgggcgcggtggctcacgcctgtaatcccagcactctgggaggctgaggagggcggatcacgaggtcaggatatcgagaccatcctggccaacacggtgaaaccctgtctctactaaaaaaatacaaaaaattagccaggtgtggtggcgggcacctgcagtcccagttactcgggaggttgaggcagaagagtggcgtgaacctgggaggcagagcttgcagtgagccgagatcatgccactgcactctagcctgggcaacagagcgagactctgtctcagaaaaaaaaaaaaaaaagaaagaaaaaaaagaataaagaaacatatgtaaaacaaagaattaccaattaaaaatttcctacatggaaaattttttaaaatttttccaagtaggaattttttaaaacatgtgggatgtaagagttggaaagctctaatggatgagtttctgcagagtttgatacaattatattgcccatatgataactgagcgatgcaagacacagcaaagccacctgaagcaaccacaggaaggaagcaagttggtcaatggtgcaactgtctaggacagtggttagaatttaatagcattctcagttcaataaatacttagtgaaggaaaaaaataatgaaaaaaatatatgggttgaaaacattgacattgtttgtttttaggatagtgtaaatgggtatttagatgatatcaaattctaaatttgagaaatccaagctaaagtgttttggggtattgaaagcctaatgtaaatgtccttgggaaaattagtttcttttttttatagttcccattatttaatgaaatgtttcaaatgttatatatagtaaacaacagataatataacaaacacccatttggtaaccatttagatttagcacattttaatgttttactatgatttattcagatcttttgatatatttttaggaaactgaacaattgtgacaaagctcaaatttcctttgcatagaattctcatataagaacaaaacagaatattaaaggcctggcacagtggcttatgcgtgtaatcccaacactttggtaggccaaggcaggagaatcacttgagtccaagagtttgtgaccagcctggacaacatagggtgaccccacctctacaaaaaaaaaaaaaattatctcggggggatgtcacatgcctatggtcccaagctactcaggaggctgaggtgggaggatcacttgagcctaggaggttgaggctgcaatgagctatgatggtactactgcactgtagcctggacagtagagtgagaccttgcctcaaaaaaaaaaaaaaaaaaaaaaagaaggaaaattaggattgtgttctttccacatatggggcatatgttgacccggcatttgaataatgctatatttcccaggatcctttttactcctctttctctctttctgcttatatttattttcaagtaacctactggtttatagtataactttaatgattttcagtgtgtgctatgaagatagaatacacagacccactaaatatgtgtgtgttgtgtgtataaatacacagattttatatatatatatgatcacttctgtttgttgtgctcagattacaataaaataaactggtcagaagcaggcaagatgtctcaaaactactctggctaatcctaaccaaaccactgtgtcatacctctatactagaaatatataggaaatcaaaaggaaccaaactggaatgcaaatgaaacaaaaatcactaacactgaaccaacgcacctcctggcattattaataacattgttctgtcccaaatgaaacttcatatactttggacatggaggttaatgattgctaaaaagagaaaatctttataattaagttttctctggtttgatggttattccatgtgatgcatctttccataaattttgagaatgcctcaacacttatagggatagatttaacagtcaggagaatactagcaagtgtagtagctatcatggatcaatagcattatgaaatcatagctttaatgcagaaatttatttatggtaaaacttcaataaacaacaaaaattgtattctgtcttttaagagatgccttcattgacttttatgaaatagcagattttttcccaaaaggtacttttgtatcccactttgctggaaccctaagtctgaacacccgtgtgtctttttattaccaatctttggcctttctgaccaattacaacagtcttctttgatgtggaagaggttacaaatatttccaggctaggagggattggggagagtaatttcagtctggatttcggtagtttgtatcatagtcattatagccattattattgtcactttcatcattaccagaaaaacatgtatttgtcctttatacaatgttggatatgataacaaatgctctacatgcattagcttattttagtctcacaataattctatgaggtggaaattcaacaaaacatttgagcctttgcacacctttagctgtttcctcagtctggaaagttcttccccatgatcttcatctggctgtctcaaatcttaactaaaatgatacttattcagagaagtcttccttgcttactcttgtctaaaatagctataccttatcactacttatttttttattccattactgtattttattttctttatagcactaaccactttctgaaactatcttatttatgtacttattagtttaggtgcttatcatctgtctactactattagaatgtaaattccaagatagcaaggtctttatcaattttgttcatgttttacctccagcacctagataagagcctggcgatggctctgggcaactgagcttagctcaacacatactcttttttattattattattattgttaatttcttttttccacatatttgttcaataattgaatagtattatcttgatttttgtagatgtggaaactaatacttgaaataatttagtcaaggttatttagctagcctaacttcctatgtttttcctgctgaaaagaggattcgctacatacacaagtctctagctttaaccgatctaattagtgcatgtctctggacctacaggtatagggcttatgttaagaaaaaaatttacatacatctgaaataatctgacctatattgctcatcctgaaaatgagttatatattatattattaaactatacttgttaactattacttggttagatcatgagaggcttgattaacaacataatgtacgccatacatagctgtaatactaggcatcagaatgcctagttcttatatatttctcgaagaaacttttctacacactttctaagctcttgctactttactagtgcagtatagacatatatttgtacatctttcatgtgccttatgaatgctagttaagcatttagaaaaataaagtcacaactttttcaatcaatctaaaatatgatttagaaaggaaaacaatacagccacactgaaatgagtaaagcattagggtttttttaatgatcaaataggtgataagacatgacatttaagaataaaaactaagaatattaaatctaattaaaaactcagtatttcaaacttcatgcttaatgaaaacgaatgtgactttcttccagaagtgtcacaaaatgcataataattacaaatactcaataattcaagtttttatattattgactgtatctattccttggcctctattttttagaattaatcaatattttctgaaaacttcctgttcacatactcacctaaattaatcttacttgatcttacttttgagaactgtcaaaatcacacacacgcaaaacaaaaaaaaatcagcatttcttattacaggcctagaatatcatccaaacaaaaggataatagtaggaacaacaatatagtaatagctaacaatatatactgttaactctgagctactctctaagcaagcactttacatgtatctctaagcaagcactttacatgtattcttattttctttacaaatatcttatgagatagatgttattattatcttcacttatacgtgaagttatgacttatacagtgttatacagctaataatggtagagccaaaattcaaatctagacagtttttttccagaatactactccccaaagttcttttgttataccattctccgtcacccctacattcaaatccctgttctcagtggttctcatcgctaagagaaacagtcaagagcaaagaagcaatgaaaattcaagttgtgattaggaatgcaatgattgtcattgttaggttagaaaggtggagtgattgatagtgtacagataattaagtttggaagtcaagagaaccaagttctattactactttactgtatgacctaaaaccagtaataattcctaccttctaacctttagaatgaagagtaattactctgtaaaataatcagttattcatcttaagattgggaaataatgaataatctgaaattcctcttagccaaaaatacttcatttagctttataatacattatataatttgggtagtaatttttcttcatatttatgatcaacattaacattttcagaacaagcaccaaaccaaaacgattgttggtaccaagaggagaccagcctgggatttgcaaagtttccagaggtcactgaacatggttcaacttggaattaaagctttatataggaaatacattaagaacatttaacattgatgcttaaattcatatttccttgagtcatggtgataaccagttctaaagaatagaaagtgtgttctacatattatagtattttctttaagaacaaataaggaactcaccaagttacctataaagaagcataaacaagctttgattttcagtggtaattataattaacttcaccagctatataacctgacacacttccgacttctttaagaatgggtcaatactgaaaaggaagtgtttttcacattaacctagaacttaggaaagctcggtggaatttaacaatgaaaatttatataacagtgggaaaacatttaagaatggtcacctggaaaagatttataaaattgttttgcttataaatattgtctatttgccggcattctcttatgttgtacatagatttaaaaaaaacagcagcccaggcgctgtggctcaagcctgtaatcacagcactttgggaggccaaggcaggcagatcatgaggtcaggagtttgagaccagcctgagtaacacagtgatacctcatctctactaaaaatacaaaaattagccaggtgtggtggcgcacacctgtagtcccagctactcgggaggctgaggcaggagagttgcttgaacctgagaggcggaggttgcagtgagccaagatcatgccactccactcgagcctggtgacagagcaagactccatttcggggaaaaaaaatacaaataaaaaataacattgctactctctatcagtgagcaataaatgactgaaaattcaaagaataaatggttatggatacatacacacgtgtgtctgtttttatgtgtgtatgtgtgtgtgtatggaagttcacctttgattagaggtttttaaatgtgattactgttaaatgattagtccatctgaaccaatgggaaaagcacaactgaagcagaattttttttaaccctgaggatttaataacttttttaagcaacagtgttccttttttgtttcttgtttcggtctattaaatgggcacttgtttaattcagtgaccaattttatataattttcttaaaaaaaggacaccttttatatctgatttgataaaagacagcaaatagaggtgggaaaggtttcatatagctataatattctgcagataaaaggaggcttggaaattatctggctcagagacttttaaccttttttctgccatggacccatgtggtacttggtcaaagcctacagatatttttttcataaaaatatttttaagtgtataaaataaaatatataacattagaaaaccaattcaaatcatgatcaaaataacttttaaaacaaactgcaatataataataaatgcctatttttaaatgcattaaataacaaactaggagcagatctaataactactataatttgaaatcattataaacataaaaagatatttataaccattgaagtaaaaggttctgttaatattactgtgatttgttgcctgagctcataatgaaagaagataataaatattaattagatttttaaatataaagattgtaatttcatttctctgtcccagtgaatggacctgtcttttacccacaagattctctcaagggacccattgacctgagttaaaacccctagaaacatccatattttgcaaataagaaaaccaagacccatagagaggagataactttactaaaatcatacaacacagaattagattaatcctagcagagctaatctcagacctttactcagactttttctgtagctttagtctagaagttggcaattcatctattatttgtcactgattcctagcatgatttgtagcaaattctttattcttattgtgcctcagattctacctatataaaatatatgtgacttaaaatattcataaagataataagaacaacttcaatttctattttatttttacttacaatagttttcactttcacatacattaccctacttaattttccccatattatggatgaggaaattaaagctctaagtgttaaatgtcacatccaaggttacacagctaggaagaggaaagtccagtattggaaatcataccatgggactccaaaggacatcctctttatcatgctgcctttcatgtcataaaaagccaaaactctttgagttcttcagttgaatatgtgctgtgatatcataaatctaattaaacacataagagctattattaaactcaaataagccaaatacttgcatcctaatttattccaaaaagtgatgcatgaatggaaccatgggaaaaaacttttctagaacaattatccatttgtgtttaagaagtaagaagagaaagaaatagaatgtaagagtctaagattgtagagttattggcttaatgttatttaaatcaaacttttgcttctgtttctgggtaggctaaagaggcaagtaatctgagtaaacgggtccctttttctccttcctcttaatcttatgagtagatggtactcaaagaagttcattctttcagagactgattactcttaaataagtttaataaggtagaaaaactaaagtcaaaataagccatgatgcatcaaaaatttctatcatctctgtcattacagtgaccagaccatgtaagatataaaacatcctgctctcttagaaaataaggaatcttcttaacctaacctgaaactcttggtatagaaaacttttattggactccaaatgtcactatttgattaaccttaagtaatattaatttctaaattcttgagatcattctgtaggatacccagatatctcttagctataatctacatacttctcatattatctgtcaatactatcagacccaaataagtaaaacttctttgtaagctgataaaacaggtacaggaatggctatgatcatacttatactattaaaaataaattttagtctgctgagattgaaaagaaaaataattactacaaaatattcagatttagcaaatgtttcctctgtacaaagcagtgtatttaatgtagtgggaaataaaaagaggataaagtcatgatccttttcctctaagaacctgcagtctacttggggactcatatcagtaattggaatatgagtaactattaactcctattctatattataaacttctataagtcctatattagaatttcaaataagatgccgtaagaatctaggcaaatctaaacctaggttgtagtgttggttgcacagccatataactttattaaaagtcatcaaacttttaatacttttatacttaaaatgaatgagttttatggtagataaattatatctcaacactgctaaaagagtttagagaaagaagaaattatttctgattgaggaacttgggaatttttttttaatggctggtgtaatctaagctggatcttaaaggacaagtagtatttgcatcagaaaataagcaacagtgtattccagataaaggcaacagcttgtctaaggtctaaaagttcaagaatacaaggcagtttctagaggagctggttgagactttgctccatgccttagattatatggcttgcatgcctaccgtgcatatggccatatggctatgacatttccaaaatgttctggcgtatccctactgagaaacgtataactgtacatagaattttccacctctctttgggttagaaacaagagcttgcctacattataatgaggagggtgtgtaatcacagagttattttacagctgtcagtggcaccactgatcataacaactactgacatttattttcatttttatagcttaaaatcactgatgaatgcattatctcctttgagccacaatctttattttttttctgtgaggaaactgagattatgggagggcccagagcctaaaataccaaagccacattaaagggaaagtcaagatattctggcctgctaagagtaaaaagaggaagagaaaatgagtacatgatcattgaacagtttagacattgctaactaaattgggatgtacacatgaatcaaagttcatctcacacaaaaagaataaaatggataaagttaactactgtcaccaataatatgaaagcaaagttgaattttttcctgaagagctgaaataagcctattattgacaggaatagcccattttaaataccttgtattgataacagagaagagtacttaggaaacagtttctaaatagcttttttgttgtttgcttttttaacaatgtaaaaagattaaaatttaaattgtgtctttccaaaacagaggacttctcagattatataagtaagcagctaaacagaaacttaatttctaatttaaaatgtgattagtggccagtaaagtcatgtttaaaatggaaagatagttttcctaatgtccttcaaagaagatgacttattttgttcttgactttgaccccatctgaccaagtgctcagaatttttcaatatgaaccatactgtataccatttacaagaaaaggaatacaaattagcctggtgagcagcaaaataggcaattttttgaaatcggatttgtgttaacctgcaatcaaatgtaatttccattttaatacttatacattcttatattgttatgaacctattcttaacacgggttttattttctttgtttctctcctccctcacttctgtgaaatacagaagggaaaggatgttattcacacatttgtacccccactaactggtgttacagtacatctggcttccactggagagcccctgacatcgcagggaacggtgatcaaaattccacacactagcttcaagctgggggctcgtagctactgcagcattgaaagggaatcttttcctggcttctttaaaataagcatggtgatgggatggtttaagggaagaacacctctcaaatcacatgaccactgctacgctttcgtgtgtcctgctttcttcataacagcttggcactacattctttccctgtatcttaatgggcttgtgtgtgtacaagtggggtggagggtggggaggtaaatggatggttatacattatgcatgcatctttcactgttaaagcaatgtgccttcccttatatgtcacaaattatggtcacagattaaatcttctgtgtcttgagatattgggccatctctctctttttggtgtgagattcatgtgtttgggtgtgttttgatgtttacaccctcaattgttcttcatgttgcatttaacgtaagttgaaatgttctcccataagagttagcttttcatgttgggctgaaaaagtcttcatttctgtgtagcaattcatgttattataacctatggctttcaattgtacctcccataatgaagagctgactttaaacactgtgctattcttgttatgacctaagcataaggtaagtgatttctctaactgtatctaaagattgttgttgtttgttaaaatttcttcgctttttttaaggcattttcacttttgttccttacatttattatgtgctctcccttctgtttttctgtttcacatcttaagatttcctaatggacgatgtgatcttcagcaaaaattatattacacatgtaaacacatgttgaaatgaattatttgatgtctcaaaacaatcttgattagtaaatgaatataccctatgttttcattaagtccttcatgttttttattttctccattgactttaatataatatgctgttcctacatgttattttagttttgattccagttgaaaggggaattatttgtcaatactgtaaagtcagatgttaactgaagtaaaataacatgatccagtagaataaagtagaaggtaatcagatgccataccttttatttgtaatccctgacaaatttaacgttaggccaaaaactgttttattttgctttccagactttcctttttttcccatagagtaaagccagggtaacataaagaaaaaaacgagaagccataaaacttgagacagatctgtgttaccttctttatagtccataagaacagtagttgtttctcaagtgtatcatttcaagtgtatgccattacattgtgagttaagtaaaattttcattttgaaattgtataaaattaagtacatattataaagagaactagtttcatggtgcaagagaaaaagttatttgctacatgcataaataataaacaacatttttaaatttttcttttcttcagtggtgtataggttgattgattgattgatttatacacacacacatactcaagatcactaaaggaattcttataatcattgatattaaagtgattctccccaaatctggttcaaatagccaatgtaatataaatgggaaagcattgattatactgctgttggcaatttatgaaccttgataaacgctcagattcagggaattgaattgttttcatcatccaaatttctccaccaaagctgtttgaaatatgtagttctaaactgaggtgccacaaagcaacacttgggtttctttattcaattcatgttatgaatgattttgcttgttaattttttaagttacctagggaacgggagagggtattttgttgttgttttggtttggtttgggtttttttggtaaagccaactagttcttcaccaccatttccattatatacattagaaaatgtatataagaggcattatataaatctgttggaacattttatgagacaatttgaactactcatctgaactgctctgttcattgtaaatctcttgtttctatccatacactagctccactctagattggaagggcttaaagatgaactctggaggaatagaggctacgacttaagagtaactattactgatcaaaggagccactttccattcgcaaacattgctttgcgctatgggtttgggctccttctgtttctacatcttgttgaatgaagactttcttgacttccatttgacttctttgaactctgtttttgtcttttaacatttccccctttcttttccttctctctcccagatttttctctcactcttctagctttctcttgtgttctttgaatcactttttgaaatgtagtttctctctttattaagcttgtctattgtctgttagtgtgtgtttcttttctttaaggctgtagtggtatagttacacttatgttcattccatagtatagcaacttgcttatttattttgcagcaagttcattagtcattcttaccctcttggtatgaatttttaatgagaaatagcagaacattctgcatttacatattgtccccttctgtaattccatactttattttccattgtttagatttacaccctcaaacctctctctcttttcttttcctcattcttgtgtcttcttccctgtattattttctttaagcagtcattgatttatttcccatttggtccagaattgtacttaaataagacttctgagtaaaagaatataagaatattatcttcagactagctttttccttctagtatgtttaaaactagttgaacaatctgggccaaaagagaataactaacatttggaattatttttccttttttttttttttttttttttttttggtgtgtgtgtgtgtgtgtgtgtgtgtgtgtgtgtgtgtatttttcttgtatgtatgtttgtgacttttttattgccgtttttttaaacattaacaattgtttttttcagggaaggacaaccataacccaccctaagttgcaacattcctttcataagttgtttcattatgatagtagattgtgttgaactatagaaattaatttgttgtgtatatatccatttgtggcaagctgctgtggaatgggaagcagaggtctggagcttaaatacagtttcttttgaaattaacaacatgttaatgacatgtaccatgctccttgaatgtaacagttttatcacatttaaaagaatgtttcacattgacttaaacatttgagtcaaagcataagggtttctgattgataaattctatatacacctaagaactggtaaataaatttgttcaatttcattgattttcaacagaagcatatttcataatcaatattataactatgataaattatgataatcagtaacaggttatcagaatcaaatgtaaatgttatataaggatcaataagtaacaggttatcagaatcaaatgtaaatgttatataaggatttctctattttcctcccattaatttatatacatactaaaaaattactataatggaatacttagttacaacttaattacttgaattttattattattctagtcaagagatatactgaatgccttactattaagggccaatatttacaactaaatatacagtaacaaatttccatataccgattttaaatacaaatgaataaaaaatcacctttggtttatctctgtgtaatttacaatattgtaccccgaatttttttctggaagtcagttctttctttaaggaaaagataaagaaaaaagatgaaacaagtataacatttttactaacatgttatgacatctgaaatactaatatataaagcctttgctcctagacctcaggagcttgcccattaaatatgcatatctgcctattcatgctataaaccctaaattactgagtttatgctctttctacaggtccagtccaggtgcagcagcaaggagaacattctcagagccagtaagtattttaccatttctggtgggctgctgaactagagcttataaagctaaaaatgatattttggtgaaaaaaaagaagaaaagcaatggggaatatttatgtgacaaatatgaatattagggcttttaccttctaaaaatattgccagtatcaatacattaataaatatttcccttaatctaattgtttttgcaagctgacaccagaactttgatgcactcctaggagggtaggaatgagctcctctgtgactctgaacctctctttaattgttccactgccaaaagttatttgaaaacaaactaactgaaaataataataataatattgaaaattcctgaacagagactaattctgaaaaaagaatatgtggctcccaagagggtacatcatactcattttgtgaatatgaattcctgacatataataacttcacaggcagcatgtgttagaacatagaaccttaaaccaagagtaaagaatgctcaatttatttattggtttgatcactaatagcattaactcaggagtcatttaactctgtatatcattcatttttctgtcttataaaaaggaactataataggttttccttatctgtacctttgaaatgatgtcacattgaaaatcgtgtcttaaaagatttgggatcctaagaaaaaagtgctatataaatgctaatggttttattattgttctctatatcttaatagcttaatgacatcattccatcttcttcctgatctttatcaagagaagtacaggggaatcatactgaaataggcctactgatactcataccactgggagttttagcaaattgaatgatttctatttctagcagtatgtcagcattatttttgtgttatactcctggttatgctttattacagtgaaaggatacagattaacatcagcaaaggcaaaaagatacatagggcagagtccaggagaaaccaggtgcaagcttccagttgccctctcccagtggagccatatggacattgcttatttctcccagcagcaatgtatgacagcatgcatcaagtattgccaaccagggaagctcactgagccttaatgttcagggtttttattggggttgggtcacatggccatggagtgctcatgtggctgatctttatttcacaataaaaaaatagagaccttcacaaaggtaaaaattcatggggtttttttgtgtaaatttttccatttttgttttgtaaatctgttatcttagctccaaacccttgggcaaacacaattattgcttgcccaagaccattatattggcaaggcgcagtggctcacacctcaaaaaaataaattcctctgagcccctttgaacctccaatttagggtatggggagtgtttccaattgttacagtgagataagtctcgcattagattgcactttgatttcttttctttgagctccctagttgccaactttattttgtgtcctaggagtaaggaatcctttttaggactcctttgataatctaactaaatttgaaaatgcatttatccttggtaaaaatctgtcttattaccaataacactactatttgtctctgtctgtccttgtcattttttgttgtatctctgtaaggggtacgttcataaggaaaaacatagacataggcctcagtaagtattttgcaagctggccctgaaaaccaagtttcaggtttcttgtaagactggtgtcctttagataaactttaccctggtcattgatcaacctatgagaaccttccttgttctctttctgttttgttagtgagagtcttgctatggaagaattataataggcaccctgaggaatttttgatatgaacaaaattgtttatttaaaaggagcctgagaataaaaaggaaacaaaattgcaaacaactaatgagctagttttttattggtttgaggaaatatcccaaataaattgagattccaaaagtacttccataagaaattccttggccaaggcaaaataaaatgtaataaacttaaaataatgcctcttttatatccctcaaaaccaaatcttggccctaattaagaagatacctgggtctcactggctatagcaggcaatgagtttgcaacttttctgaaattgccatgccattatatgacttaaccaagtccttagaaactgaacctctttcgtggccaccaaatgtgaacaagctctcacaaccccttgccttgctatatccatcaatcccaaatgattacatcaggatctttatccaatcttaatgaagctcctatattgaaagatctactttggaccaaacttcaaaatctcataaatatcctgactttcctttctgtgactctgactctaagactaagtctttgttgaagtgacatttttcctttctagagtcaaactccctatattaaaatctcaatttctctacttatttgctgtgtgaacttgaacaagtgctcagtatctctatgcctcactttcctgatctgtaaaatgtggtaataacttgttcagaaagggcagaaattgtaaagaataaaataaataaattttaaaatgtggtaataagatggtctgccttatagattgttacaaggattaaatagtataatgctaggtacataataatcactcagtaaatgttagctgatattattgttactattactactaatactaccaattaccattattttcttgataatgatgatgataataaaataggttactttttattgaacgttactgtgtattaaatacttttctacatggttcatcccacttaatcctcacacacaacaacaaatcctgtgagtaaaattctattaatttctacattaaatagataaggaaattaaagattccagagttaaataagttgcttgtgtatatggtaaatggtatatgagttgaagccagtatttcagaccttgattttatagcccacatttttttttgtttgtttgttttgttttgtttttgagacggagtcccgctgtcgcccaggttggagtgcagtggcgcgatctcggctcactgcaggctccgcctcccgggttcacgccattctcctgcctcagccttttgagtagctgggactacaggtgcccgccacctcgcccggctaattttttgtatttttagtagagatggggtttcaccgtgttagccaggatggtctcgatctcctgacctcgtgatccgcccacctcggcctcccagagtgctgggattacaggcgtgagccaccgcgcccagccttatagcccacatttttaaccaacatgctgtgctacctaattaatttcaataaggccttcaaaacccgattcaatattgtgcaaaatatctaagcaataggtaagaatagaaattgatagctggtatatccgtgggtacttataaacaaatatctgattatcagtgccaaaattgttttattaccacgtgttatcaggatgatatgacactattgtcttctgtcatctttccacctataattcatttccgtcaaccactttatttttaataaagcaaacttttgttatttttacgaataactggttttatgcaagaaatcaagtaaaataaaaaaattttacagatgagaatttatatttcagcactgtaggacagcgttttaatagctttctttctgccccaccccgagacaaagtcttgctctgtcacccaggatggaatgcagtggcacgatctctgctcactgcaacctccacctcccaggttcaagtgattctcctgcctcagcctcctgagtagctgggactacaggcttgtgccaccatgcccagctaatttttgtatttttagtagagacagggtttcactatgttgcccaggctggaacttgaactcctgacctcgtgatcagctgcctcagcctcccaaagtgctaagattacaggcatgagccacggtgcccagccttaattgttttcttgatgtactttgttcagcctgtgttttatcggacaagtggtacattttcctgggattaacttttctagatttttttagtatattttaatggaattcagaatttttattgatatataatatttgtacatatttatggagtacaggtgatatcttgatacatgcatagaatttgtaatgatcaagtcagggtatttgggatatccatcacctcttgagcatttatcatttcttcatgttgggaacatttcaaatcctatattatagttattttgaaatatacaatacattgatgttaactatagtcaccctactgtactatcaaatattagaacttattcattctatataactgtatgtttgtaccttttagccaacttttctttatcccccacaccatccttcccagcctctgataatatcactctgctcactgcctcagtgaggtcaacttttttaactcccacagattaatgagaacttgcaacatctgtcattctgtgcctatcttactttcacttaacatgccttccagttccatctgtgttgctgcaaatgacagaatttctactattttaaatagtagtccattgtgtgtatataccacattttctttatccagttatttattgatggacacagtttaattctatatcttggctatggtgaacagtgcttcagtaatcatgggggtacaggcatctcttttgatatgctgatttcctttcctttggatatataccaatatagcagaattgctgagttatatggtagttctatttgtagttttttgagggagtccatagtgttttttataatgtcttactaatttacattcccaccaacagtgtataagagttcccttttctccacatccttaccagtatgtgttagtttttgtttttttatagtagccattctaactggagccggattatatttcattatggttttgatttgcatttctctgatgattagtgattttgggcattttttcatatacctattggccataggtatgtcctcttttgagagatgtctattcagctaatttgattactttttaatggaattatttgggtttttgctgtttagttgtttgaattccttgtatgttgtggatattagtcccttgtctgatgaacagtttgcaagtattttcttccatgttgcaggttgactctactctgttgattgtttcttttgctgtgcagaagcttttcagtttgatatagtctcatttgtctgtttttcttttgttgtctgtacttttgaagtcttagccaaaaaatatttgcctataccagtgtcctaaagtgtttcttctgtgttttcgtctagcagttttatagttctcgttcttatgtttaagtatttaatctattttcaggtgatttttgtatataataaaagataggcgtctaatttcatttttctgcatatggctatccagttttcccagcaccatttactgaggaagacaccttttctctgatgcatgttcctgatgcctttgtcaaaagttagttggttccctattctgtttcattgatctatatgtctggctttatacaaataccatgctgttttgcgtactacagctttgtagctgctattgttacaattactactagtactactagtactactagtaatactatgattagtatactggtggtacttctggtattatcattattctttttttttttttttgagatggaattttgctcttgttgcccaggctggtgtgcaatggcacagtcttggctcactgcaacctctacttcccggattcaagtgattctcctgcctcagcctcccaagtagctgggattacaggcatgcgccaccacacccagctaatttcgtatttttagtagagatgggatttcaccatgttggccaggctggtcttgaactcctgacctcaggtgatccacccgcctcagccccccaaagtgctgggattacaggcgtgagccactgcgcccagccttatcattattctttagcgtaaaggcactgtcttaaaagatctactcatttagtgaagatacattaactagttggaataacaaattaagctttaaaatacactagtcttacgtaaatttatcagataatttggctgccacctctgagagcagagttttaagaaaatggatgcatttaggactatgattagggtataagaggaagggaaagcctaaaggaaggcatgtcaagcttgggtacctttataaatcactccctccttaatgaagtaattatctttcttggcacttctgtctcctagtgttccttttaaactatctgtttgcattttctccagcttctttggtagctctttttttttttttttttggcccagtcattaattatcagtattattcagacttctctcatagatcttccattcacactctatattatgcatgagcaagaccatctattaacaagtctttcaagtaaaccaaatctataactccaatccatatcttcttcctaaacttcagttttttttccaattgtctgttgtagatcttttcttaaatattacacaagtatctcatactcaacgtgactaaaactaaatttatcatcttaatttactcttcttccatatttcaaggagtaacatcactagccactgatttgtccaaaccagaaatctttagtgtttattattcctcatcctacaagcatttttatcattctaaaatacaaatctaaacctatcatactcctttaataacattaacccttaaatggctccttattattcttgtgtaaaggcccaactccttaaaattgcttactattggcttctgcttatctctagttttacctggaattcagtgcaccagccatatgaacatttcaatttgcaaatagttccctctttcccaaaatgctgatttctcatttcttccaaaacctggataactcctacttatcctacagttctttcaggaagccttctatcacctcccaaatctgagcaaagtgcccctcccaagttcttttctagtatactgtagtttccctactttattgcaagagtatttacagtgtagtgcttttctgtcttctccactgtcctctctactccaccctaagcatcttgcaagacctcatctatcttgttccctgataccattaccagaatctatcaccatgactctctctcaataagagttgattggatgactgcataaataaatgagaggaagaccttaagcagacagagcaagcaaaagacagcagaattgctaaataagaaaccagtatgggaacagaaaaggaaaataatgaacattagcaaaaactctaatatatttattgaaaatactgggggttttgtttgtttgtttgtttgtttgtttgtttgtttgttttaactgctccttctcttcaaattatctcatgtatccactttggcccttatcccttcattcattctcactactgccacccaggttctcgacttattactacctcttgcctggagtgtaagtcagacttttcagtcttataccccttaatttgtcatagatggataggtcttctggttagttttcttgcatcttactattaagaaacatgaatttttatcttttttattattcccaggaaagaggattttgaaataatccttggagaagtatgttaatttcttatgcctcctatttttagaaaaaaatttctgtttatctcttgctgcaacctaatcccttatcatcttgattggcattcactggatctgacaatagctgcttaccatcacttagattacctttctttatataactaaggataattagcaattgacttccataaatatttattgaggtactatttataagcactatttttctcgacttttttatctagtctaagtaaaccaacttattcaattttccttgctatatccttatgtagtttatttactaggttctcgaaatttaaaaagaaaaaaatattttagagattgtatctcactatgttgcccagactggatttgaactcctgggctcaagcaatcctcctgcctcaatctcctgagtagccatcatgcctggctttcaaatataatttttttatttgtgaaacctatattcccaaagtactattcgctattcaatttaaattttgtcttatttctcttatttttctcggttatcacctttttattttatatgaaaagttgcatcattcattactttgagtcaggctttttaccttcctcgttgtcaacattatagcaggtattgctaagaaacattaagttaatagataggaagccccaaccctcatatcctcatagagacaccaacttaaaagcaatatatggtcataatagcttcatgaaaactccagaaaaaaggttgttgcaatacccccaagctggcacaaagccaagaatagccacattgaaatggataagaactgttttactttacctgtgatagtccctcctccaagtcagcatagcttagcatgataaagagaaaacaccctactcatggtttctttctgtgggggaagagtggaaacatacatccaatattctagcttttcagaggactgcccaaataactgccttctatctcactgcattgatggaactaccacagtttgaatgcctgagggctactgaaagccagggagagtggaggcagcttgctgtagtaccacagggcctacagtgccacacacaggcaccagcacctctcagtgcaatctggagaaagtgcccaattcttgacttttcactcaggagggagagagaagagtggaacatgcattaggtgttctgactttttggagggctaccaagagaatggtttctctgttgcctcactggggtggtaacagagagctggtgtactttggatgtctgcgggccactgagaataaggaacagtgatggcttgctacagcagcaccacagagcctccagtgctgcagacagacaccattgagagcaagagattgcaagctcctgacagagaaacctgcaaacctctctaattgggaaattacatacacagacccagagaagtcacattcccccgctttcaaaaaggtttcagaggccgcctcagaatttctagccaggttgattggtgagagtgtcccctatataaggccagtctgtaaagattgggagacatggctgtttctcaaatgactaaaactcagcaaaaaatcacaaagcacaccaagaaatcaggatacatgcccaatcaaaagatcaaagtaattatctagaaaccaacctcaaagaaacagagatttatgattacctggcaaataattcaaaataattacctttaaaaaggtcactgatctaagagagaacacaaatggacaactaaacaaaatcaggaaaccaatgaatggacaaaatgaagatttcaacacaaagttagaaactattaaaaaagaaccaaagagaaattctggagccaaaggatacaataactgaattgaaaaactcactagaggggttcaacaattacttgaccaatcagaagagatcaacagcaaaattggaagacaggtcatttgaaattattgttagaggagcaaaaagaaaaaaaaggaacagaaaagtaaagcaaagaaagccaaagaggccaggagtggtggttcacacctgtaatcccaacactttgggaggccaaggcaggcggatcacttgagtccagggattcgagactagcctggccaacatggtgaaaccccatctctactaaaaataaaaaaagtagccaggcctggtggtgcacacctgtaatcccagctactcaggaggctgaggcaaaagaatcgcttgaacccaggaggtggaagtttcagtgagccaagattacaccactgcactccaccctaggcaacagagtgagaccctgactcaaaaaaaaaaagaatgccaaaaagatttataaaatgccattttgtggaccagtgtatacattatgagagttccaggagaaaagggacaccaaacttatttgaagaaataatggtcaaaaacttcccaaatttgatgaaagaaatgtacatccagacacttgaagttcaaaggatataactaaggtgaatccaaagaggcccacactaagacatgttataatgaaactgtcaaaaatcaagggcaaagagaaaatttgaaaggagcaagagaaaagtaactcatcatgtacaatgaagttcccataagaatgtcattggataaaccttacaggtcagaagggagcagtacgttatattcaaagtgctgaaggaacaaaatctgccagtgaggaatactgcatccagcaaaactgtcctttcaaaaatgaaaaaagaaagactttcccgggcaaacaaaacctaagggagttcatcacaactagacctggcttacaagaaatgctaaagagagtcctgcaagttgacatgaaaggactctagacaacaacatgaaagtttatgaaaaacacaaagctcactggtaaaggaaaatatatatatatacaaattcagaatactatattactataatggtggcatgtaaatcacatgtaacactgtggggatggaaaatgtaaatgagtagacttttatatatgattgatagattgttctgtttcatgtaagtctcatggtaattacaaagaaaatgcttatagaagatacagaaaagaaaatgagaaagtaatcaaagcatatcgataatgcaaaggaagacagcaagagggaaaaagagggactaaatagctacaagacggacagaaaacaacatgtgccaataataaggcctttaagtgtaattggattaaactccccagtaaaaagacaaagtgaattaatggattaaagaaacaagatgcaattatattctgtctacaagagactcatgctagatgtaaagacacatataggctgaaaatgaaaggacagaaaaagatattacttcatgcaaattataatcaaaagagagcagtggtggccatagttatatcagacaaaatatagactttaggttaaaagctgtcacaagagacaaagaagaatattatactgaaagaacagaaatatataacaattataaattaaaatccagctaacattagagcacccaaatataagaagtaaacattgacaggcgtgaagggagaatagacaataacacaataatggtaggagatttcaatattctactttggataatggatagaacaaccaaaaagattaataaggaaacagagaacttgaacactgttgaccaattagatctaacagaatattccacccaacaatagtaaaatacacattctttcctagcatacatggaatattctgtaggatagaccacatattaggctaaaaaacaagtcttaacaaagttaggaagactgaaacctatgagatcttagtggactgaaactagacatcaatagcagtaggaaaactggaagatacacaaatatgtgaaaattaaatgagacactcttgaacaaccagtaggtcaaaggaaaaaaaaatgagagaaattagaaatatcttgaggcaaaaacacaacacaccaaaacttatgaattgcagcaaaagcaatactaagagagaagtttatattagtggcatgtactttaatgagggggaaagacctcaaatcagcaacctaactttttacctcaaggaatgagaaatagaataaactaaatcaaaagttaggagaaagaaggaaataataaagatcagagcagaaataaacaaaatagagaataaaaatactaggaaaaaaagcaatgaaactaagagtaggattctctaaaataccaacaaaattgacaaactcttagctagacagacagaagactcaaaataactaaaatcagaaataaaaggagacattgcaactgatgcttcggaaatagagatgataagagactgctatatacaattatatgccaacaaattgaatcacctagaagaagtggataaattcctagaaacacaaccttggtgttcagtcacagtcttggtgactgaattatggagaaatagaaaatctaaacatatctataaccattaaggatattgaatcagtaatcaaaaacctccccataaagaaaacctcccaataaagtaaaacccatgaccagatggcttcactagagaattctaccaagcatttaaagaagaattggtaccagttcttctcaaaatattccaaacacttgaagaagaaggaatacttccaaaataaatttattaggcaacattaccctgatacgaatagaaaaaatacaacaataaaaaagataactgataaaaaaaattgatgcaaaaatcctcaacaaaatactaggaaaccaaattggattatacacttcagccatgtgggatttatccctggaatgcaaggatcattcaatgcatgaaaatcaataaatgtaatgtatcacattaacagaacatggaatgaaaatcacatgatcatctcaaaaggtgcagaaaatgcattttagaaaattcagcaacctttcgtgatataacaatcagcaaactagaaacagaaggaaattacctcaatataataaaggtcatttatgaaaagctcataacataacatactaaatggtgaaaaactggaagctttttttttttaagatcaagaacaaagcaaagatgctcatttttgccacttctttttagtataatactggaagttctaatcaaagcagctaggcaatgaaaagaaagaaaatgcatcccaaatggaaagaaagaagtaaaattatctctgtttccagatgacatgatcttatgtagaaaactctgaaaattccacttatatacatacatgcacacacacacacacacacacacacacacacacacacacagagaaacactaactgttaaagctaatacaagaagccagtaaaattgcaggggtacaaagtcaacaataaaaaatcaattgcatttttatacactaacagtgaatgattaacaatctgaaaaagaaattaagaaaatcccatttacaatagcatcagaaagaataaaatacttaggaataaacttaatggagaaaatgaaagacttgtgcagtgaaaaccacaaatcattgctgaataaagttaaagacacagtaaatggaaagatacctggattcatggatggaaagacacaatattgttaaaatatccatactacccaaaggaatctacaaattcaaggcaatccctatcaaaataccactgacattttttatagaaatagaaagtaccaccctaaaattcatatagaatttcagaggtcctgggacaaccaaaataatcttgaaaaagaagaacaaagctggaagtcttacatctcttgatttcaaaacatattacaaagttacagtaatcaaaaaagtctggaactggcataaagacagacatataaactaatgtaacagaatatagagcccagaaatacatgttcgtgtatatggtcaaatgatctttgaagatggtgccaagaccattcaatggggaaagggcagtctcttcaataaacgttgttgggaaaacagctattctctttgcaaaagaacgaagacagacccttatcttataccatgcacaaaaattacctcaaaatggattaaagatctaatagttaagtctaataggtaagacctgaaactatgaaactcacagaaggaaatatgcagaaaaactttatgacattgaaatgggaaacgatctcttggatatgataccaaaaagcacagacaacttatacaaatgtagacaaatgagactacctcaaatttaaatattttctgcatcaaaggaaacaatcagcagagtaaaatggcaacaacagaatgggaaaaaataattgcaaatcatatatctgataaggggttaatatccagaatatataaagaacccctacaactcagcaacaaaaaaaatcaaatatcccaatttaaaaatggggaaaggacttgaatagacataactcaaagaagatatacaaatggccaacacacatatgaaaagctgctcaatgtcactaatcatcagggaaatacaaatttaaatcacagtgagataccacctaacaccattaggatgactactaaaaaaaaaaaaaaatagaaaataacaagtattggtgatcatagggagaaattggaacccttgtgccctgttggtaggtttgtgaaatgttgcagctgctacagaaaatagtatggcgtttcttcaaaaaattaaaaatagaactttcatatgatctgtcagtctcacttctgggtatatatccaaaagaattgaaaatagcatctcaaaaaactacttacacacctgtgttcatcacagcattatctacaatagccaagatatgaaagtaatcttaatgttcattaacagatgaggggataggcaaaatatggtctatttatacaatgaaatattattgagcctccaaaaaataaggaaatcctgtcatatgctacaacatggatgaaccttcaggacataatgctaagtgaaataaactaatcaccaaaaactaatacttcatggttctacttatatgagacatctaaagtaattgaactcatagaaagtagaatggtggttgccaggggctgggaggagagggaaatagggaattagccaatggatgtaaagcttcattcacacaaaatgagaaagttctagcaatcagttgtacaataatatgcatatattgttaattctgttaaattttttaacataaatacttaaaaattgtttaagagggttacaaaatgtatatagattaagcatctggaaaatgtattaaaaagttaagttaatcattgatcatagaattatcctggaatggacatatattgtccttcagtgtctcttttttgtgatgtgtatatgttaccattctatgtgtaacaagtgaattactgattctcattattagattcaccacctacataccaatggctttctattttaagcctgacttctcttccaagctccagattctccttgctgttgtgtactggaatcaccctttgatgtcctgctggcatctcacatttctttcatcagaaaccagatttaggatcctttcctccaaattattcctgtattgttcttttatacaattacactcccacttactctaataactaaatttgaaatctcctcatgatattaccatctccttctcaaagcatagtcagtcagtcatggaaccctctgctgcagctcttctaaatatcctttttcccattcttgttgtaatagttcaggccttctgcatcattctcctttgggattgcagtagcataataattgctcttcctatcttcagtctcttgctccctgacagtcttccatcagtcaagtattacattttaaagtacatactacttttctactgaaaatcttgaatagttctccattttccatagtactaagcctccagaatttgtcctgaactgaattgaccagccttataccttatatttcatcctcttcacctccaacctccagcttcattgggcaatttcgcattctctaaaagtactttcagatctttgtaattttgttcatattttctccagtttcatatgttcttctcccttttctcattgtttaaagatcccccctgtaaagccttatagtttgtcccatcagaattagctgttgctttttctttgttatcttacatagtgttttgtttgtactttaaaacataagcatacacatagtctgttattttttccttaaaacacagcctgatttgtgtgttccttgaaagactgtgtaagataggaatctcatctggtttatttcaacatactcccaggccaggtgcagtggcttgtgcctgtaatcccagcactttgggaggccaaggcaggaggatcacttgagcccaggagttcaagaccagtctgggcaatatagtgagatctcatctctatcaaaaattaaaaaattagttggatgtggtggcacatgctgtagtctcagctactcaggaggctgaggtgggaggattccttgagcccaggaggtggaggttacagtgagctgagatcaagccactgcattccagcctgggcaacagagcaagaccctgtctcaaaacaaaacaaaacctcactcactgtgtttaacaaagtgccctatattgaccagaataaagtttgaagttgtaagtagtgtttgcttatctatacaaccgttctactttgtcagtctatataatctagactgtactgtgtgcataacatctttggaccttgatgttaaggcctttttttcttcctcaaagaggtgataatctagttaagaaaatggacatgtatataaataagtataattactgtgagatatgtggttaatataatatgcaattagaagtcctaaaaattgagtattttatagtacctcagtgcaaaaatagacatacgtgcattgtttcagaaaggagagactattgatgaaagtgatttttgaaattttgaaataatttcaaacttcagaaatgttacaagaatagtatagagaattcctgtatatctttcatccagactcccccaaatgttaacattttgtcacatttcctttatcatttctctctataaattaatatacatattatcccaaactacttgtgagtaaattgcagacatgatgcctctttacccctaaataatttaatgtgtatttccttccaaaaaaatctggagggatggcaaataaaaaagactttctcttacataaccacagtacaattatgaaaattaggaaatgaacattgccacaatactattatgtaatcttattcaaattacattttgtcagtttttctaataatgttctttataacaaaggagacaacattcttctgatctgggattcaatccagaatcatgcgttacatttagttatcctgtctctgtagactcctttaatatggaacaagtcttcaagtttgtctttgtctttcattacctttatatttttgaagcatatagctcagttattttgtacaatgtccctcaaatttatatttttctcaggtttcttaatggtttaattcttgttatacatttggtcaggaatatctcaaatgtgatgttgtatctttctcagtgcatcttatcagggggctcatgatgtcagtttatcctattactggtgatattaactttgatcacttggctaaaagggtgtctgcgagatttctccactgtagttaatgagtacagttaataaatatcttgtagggatatactttgagaccagacaaatatgttttgtttttcttgaggcttttaccttctagtcttagcattaactgattatttttccctaaaccaattattactagatggttgccaagtggtgattttctaattccaatatttcttcatgtaacagctgaccttctgttataaggaagaatttattctcaggccagcatattttcaaaatgagaaaggcatcatagctctactttgggccttattggtatttgcccaaaatacaaacactttctttttttttattttttttattatactttaagttctggggtacatgtgtagaaggtgcactttttttacataggtatacacgtgccatggtggtttgctgcacccattaacccatcacctacattaggtatttctcctaatgttatccctcccctaaccccccaccccccaacaggccctggtgtgtgatgttccccttcctgtgtccatgtgttctcattgttcaactcccacttaggagtgagaacatgtactgtttggttttctgatattgtgatagtttgctgagaatgatggtctccatcttcatccatgtctctgcaaaggacatgaactcatccatttttatggctgtatagtattccatggtgtatatgtgccacattttcttaatccagtgtatcattgatggacatctgggttggttccaagtctttgctattgtgaatagtgccacaataaacatatgtgtgcatgtgtctttaccatagaatgatttataatcctttggatatatgcccagtaatgggattgctgggtcaaatggtatttctaattctagatctttgatgaatcgccacactgtcttccacaatggttgaactaatttacactcccactaacagtgtaaatgtgttcctattcttccacaacctctccagcatctgttgtttcctgacgttttaatgatctccaacctaactggtatgagatggtatctcattgttgttttgatttgcatttctctaatgaccagtggtgatgagcatattttcatatgcctgttggctgcataaatgtcttcttttgagaagtgtctgttcatgtactttgcccattttttgatgggtttttttttttcttgtaaatttgtttgagttctttgtggattctggatattagccctttgtcagatgagtagattgcaaaaattttctcccattctgtaggttgcctgttcactctttttagtttctaaattttttagtttcttttgctgtgcagaagctctttagtttaattagatcccatttgtcaattttggcttttgttgccatttcttttggtgttttagacatgaagtctttgcccatgtctatgtcctgaatggtattgcccaggttttcttctaggatttttatggtcctaggtcttatgtttaagtctttgatccatcttgagttgatttttgtataaggtgtaaggaaggtgtccagtttcagttttttgcatagggctaaccagttttctcaacagtatttattaaatagagaatattttccccattacttgtgtgtgtcaggtttgtcaaacatcacatggttgtagatgtgtggtgttatttctcaggccttcattctgtcccattggtctgtatatctgttttggtaccagtatcatgctgttttggttactctagccttgtaatatagtttgaagtcaggtagcgtgatgtctccagctttgttcttcttgcccaggattgtcattggctatgtgggctcttttttggttccatatgaagtttaaagtagttttttccaattctgtgaagaaagtcaatggtagcttgatggggatagcattgaatctataaattactttgggcagtatggccattttcatgatattggttcttcctatccatgagcaaggaatgttttttccatatgtttgtgtcctcttttatttgcttgagcagttgtttgtagttctccttgaagaggtctttcacatcccttgtaagtcgtattcctaggtattttattctctttgtagcagttgtgaatgggagttcactcatgatttggctctctgtttgtctgttattagggtatagaatgcttgtgatttttgcacatttattttgtatcctgagactttgctgaagttgcttatcagcttaaggagattttgggctgagacagtggggttttctaaatatacaatcatgtcatctgcaaacagagacaatttgacttcttctcttcctatttgaatatcctttatcgctttctcttgcctgattgccctggccagaacgtccaatattatgttgaataggagtggtaagagaggtcatccttgtcttgtgctggttttcaaagggaatgcttccagtttttgcccattcaatatgatattggctgtgggcttgtcataaatagctcttgttattttgagatgtgttccatcaatacctagtttattgagagtttttagcaggaaggagtgttgaattttgtcaaaggccttttctgcatctattaagataatcgtgttttttgtcattggtttggtttatgtgatggattacatttattgatttgcgtatgttgaaccagccttgcatccaggtatgaagccgacttgatcatggtggataagatttttgatgtgctgctggattcggcttgccagtattatattgagaatttttgcatcgatgttcatcagggatattggcttgaaattttcctttgttgtgtctctgccaggttttggtatcaggatgatgctggcctcataaaatgagttggggggattccctctttttctattgtttagaatagtttcagaaggaatggtaccagctactttttgtgcctctggtagaattcagctattaatccatctggtcctggactttttttggttggtaggctattaattactgcctcaatttcagaacttgttaatggtttattcagggattcaacttcttcctggcttagacttgggagggtgtatgtgtccaggaatttatccatttcttctagattttctagtttatttgtgtggaggtgtttatactattatctgatggtagtttgtgtttctgtggaattagtggtgatatcccccatatcatcctagcactttcagaggctgaggtgggtggattacctgaggtcaggagtttgaaaccagcctggccaacatggtgaaaccccgtctctactaaaaatacaacaattagccaggcatggtgacacatacccgtaatcccagctacttgggaggctaagacaggagaattgcttgaacccaggaggtggaggttgcagcaagccaagatcgcaccactgcactccagcctgggtgacagagacaagactctgtctcaaaaaaaaacaaaaaataaacaataataatttgctcacttaatattcccagaaacaatgccttagcccgtgtttgttcgttttgttttgttggtattttttctttttcttatttctttccaggtgaagtagaattcaccaatttttaggaagatgtatattttccccaggacatgttagctggtgttttcttctgttgttgactagcacttttctgaatctctcaaggtatagcaagagccggttgatgtaaactatactttataacatcttattttccagaactccatgagtgctgctgctgcttttgttgttgttgttgttttaaaagcataccccagccaccgtttatggcatcaaaagcattataaaatatgtgtaattatttcttgagtacccccttcctcctcctcctcctcctcctgtctccctctctctgtctctctctctgtctttctctctgtctctctctgtctctctcgtctctgtctctctgttggtgtgtctctgtctgtctctgtctctctctctctgtctctcttgctctccctccctctctttctttttaaaataagctcaggtagatctaatccatttccaaggcctgaattcttaactttagaaaccccagatttcatctccatacagaatcctgtacaaaactgacgagttgatttctggacttggatgcctaataggtattacctattaataaagacccaaccctaaaatctgggtttgcttctcccttgactcacctgtgatccagacttaccgtctcaataaattgtaccactgttcacctaggattctgggaggattttcccaatctgtatttccccgtgtcctaaaggacccatgaccaagccctgtccgttctgtctcaaatatgtatctccaaacacttctctcaatttccacaactacccgcagccccttgtggaacaactggctctttgaaaaacatcccagaagttgtttcagctttttgctatgaggcctaagcctgaggcctaagacgctctctgtctctttttctctatctctgtctccctctctgtctctctctctgtgtctctctctcttgtctttctgtctttgtctctctctgtctctgtctctctctgtctctgtttctctgtctctctgtgtgtgtctgtctttgtctttctctgtctgtctctctctgtgtatttgtctctctgtgtgtgtctctctctgtctctctgtctccccctctgtctcagtgtctgtctgtctctctgtctctgtctgtgtctctgtctctctccatctgtccatctctctctgcctctgtctctctctctctgtctctccctctcttggtctcagtgtctctctctgtctctgtctctctctctctgtctgtctctctctctctgtccatctctctgtctctgtctctctttctctgtcactgtctctctctctgtgcatctgtctctttctctctctgtgtgtgtgtctctctctctgtctctctcctttcctctctttctttttaaaataagttcaggtagatctaattcattttcaaggcctgaattcttaactttagaaaccccagatttgatctacatacagaatcctgtacagaactggcaagttggtttctggacttggatacctcatagatattacatattaatagagacccaaccctaaaatctgggtttgcttctcccttgactcagctgtgacccagacattctatctcgatttttttttaaaggaagaatttatttaaatcatttttatatttagtatatattcataaattcttattttattttattaaatagattaaaatatgttactgttctaatttatgttgatgataaatttgtatcagatttagccaaagggagctcttcaatcttgttccaagatccttttgacatgttcctatcattatttgagcactttcttactgaaaacagttgtgaaggaagagttgtaatttcccaggaaaataaaaggatgagagaaaaattactctaggcagaaacagcatcatatgctatggcagaaaactatgaaatagtacagtgtattctgatatctacaatattatcaattttctgagtgatggaataatgagagatgagactgaaaggaaagcaaataagggttttatatactattctaaggaactgaaattttatcctgtaagtgataatcaactattgatataaattatgaagctaacattttgggacagcaatgcctattttatcatctttatgtacagaaatctcaggagaacttccatattttttaatcagccctagtaaataataattctttcagctatgcttttttggttttgtcagaaatgctttgaggctcattgtcttgaataagcaagtagaaaagttgtaaaactattagattgaagacaatatgaaaattattttcagatgtacaaagtgccctgtagtcctgagcctacaaactctaccattgccagtgtttccctagagctttggaaccactttctcctaattggagagagttatatgaaagtctaaatgctttgtatatctgaacacacattctttaaattaccaaggaccctaactatttaagctgaccatattactattacctatctttgctctttaagtttcctaggaaagctattccttatcttaggcggtttgctcttcagaaagatccaggaaatagaaatacaaggaattgaagctgcaaataccatgtggaatagaggcagtaatattaataggaacagaacaagtctcctgatatttgcagtatatccaaaaaatgaataatgatttacactttatgtagtttagggagcttttctactgcttgttttgaaaaatgaagtttcttgaggttctgaatttaatcaagaaggacctgcatgaacatcagaacatcttgtttctgctatgttctctcctatgatcaaaggcatcttttcttcatttattttgtgtgtgtgtgtgtttgtgtgtgtgtgtgtgtgtgtgtgtgtgtttgtttttttttttttttttgagacagagtctcactctgttgcccaggctggagtgcagtggtgcaatctcggctcactgcaacctctgcctcccggattcaaggaattctcgtgcctcagccttctgagtagctgggactacaggctcctgacaccatgcatgactaattttttgtattttaacagtaatggggtttcaccatgttacccagagtggtctcaaactcctgagttcaggcagtccacctgtgtcagcctcccaaagtgttaggattacagacatgagccattgcacccgacccatttccttttcattttaaaaatggattttcagggaaggccggtcatggtggctcacacctgtaatcctaacactttgggaggccaggggtttgaaaccagtctgagcaacatagggagaccccatctgtgcaaaacatcagaaaattagccaggtatggtggtgtgcacctgtggtgccagctactcgatggggtgagacaggaggatcatttgagccagcaggtcaaagttgcagtgagccgtgatcacgcaactgcactccagcctgagcaacaaagccagaccctgtctcaaaaccaagatgaaacattgtatattaagaactgactggtttaagaggatgcattttaactgagaaaaataatttcattggtataaatagctccatttcaagatgaccacaccacaaaaaaaggttactgatagataacaaagatccatattgttactctgctcagtagaaaggaatccatttgtactttctgtgaccctttggaggctttctacatcatagatagtgtcattagtatttaaccatgtctttgatgatgacaatcctgagtgaacccctattcattttgcgctgagttcttacatagtcttttcagtgattataactgtaccatggaggataggaaatctcactaacatttttattacttcctctgcaaaaattctgaactaaaatatagtcaacctcatctctggactaaactggaaaatgtaagagacaagttaagttgtacttatggaactgtaggctcattagagaaacctgtagcatcaatttgtgcccactttagaatagctttaatcctacaaatctacttaagaaaagtaaacccattgcaggggaatgctgtcagtttagatgttataataattcagtctgtcactcttagctccttagctcagttcagacagctatagtggggaagatgtctagactccctcccctacctctgccccaactctcaaataaaaatcctatatcctaaagaaccttgtagtttatttttaccaaacaagctagtctacctgcaaattaacagtaacagtgatatcaccaggtaattttaatattgtaaattaaagtgagtattctcttgaatgctatgatcttctcagtgggacatgtattttcacatgttttgtaatacatatgagtttaataaagctaatgccctcgcagattctctttgtgaccattagtaatcatttgtaaggtagctatcagaatatatttgtggccatgaaatagttttgcttcataggaaactattttttctatccaaaagtaaaacttatttttcattataaccttaccttttttaaaatgtttcattccttcctttcctgtttctgcctaaaggggttttatgggctaccggctgctaggtgataactcactggggccttcaagaggaaaaagtgcatacttttttctcaatttttttttctcttctaacaaacttctgttctacagtcacaatcaacaagagaaacaatcaacattttttggtcctttttcctgctgattaagtttgttgttgttgttgttgttgttgttgttgttttgagagagagtctcaccgtgtcgcccaggctggagtgcagtggcaccatctcggctcactgcaagctccgcctcccgggttcacgcctttctcctgcctcagcctccggagtagctgggactacaggcgcccgccaccacacccggctaatttttttgtatttttagtagagacggggtttcaccgtgttagccaggatgttttctaatggcccaagacagtaagaggtgctttgggtttgtaatttacaaaataagagaagtctgtgacaacttttttttttttttgagacagagtctcgctctgttgccaggctggagtgcaggggcgtgatctcagctcactgcaacctccgcctcctgggttcaagcaattcttctgcctcagcctcccgagtagctgggactacaggcatgcgccaccacgaccagctaatttttgtatttttagtagagacggggtttcaccatgttggccaggatggtcttgatcatttgacctcgtgatccgcccacctcagcctcccaaagtgctgggattacaggcgtgagccaccgcgcccggctgaagtaggtttttttattggcgaagtagctaattactgtataatttggggtgagtcttgagtgggaagaagcctcgtggcacataaaaaggtgcttaattgatattgaaaacacacgcacgcacacacatgcatgcacacacaaccctacctgctgatgtgccagagaattacaatactcctcctttgagacattgcttttagttaatttgttatatatccaaaggtccttgtgttaacatgcaaatagtttaaccaaggaccggtatcaatccaatagcaccacagtatgttaatttcttcaattaagttattccacaatgtatgcatatctcaaaacatcatggtatacaccatgcatatataaaatttttgccaattaaaaataaattttaaataaaatgtttatactataggtctataaaaaagtacaaattatttttccggtgaggtaatcactttatgacaaagactttataaatattcagtggcttagagaagtaaaatgacagcagaaagcactgctttactttttgcttcccaattttggactttgtttgaaagatttgccattcattaaataccccaagtatttactgagtatctactataagtgtaaggaaggcactattctaaaagtgacagagaatacaaagattaataagacataggctctgtcttcaatgagtttaccatctactagcagaggtaaggcaaatatttaaatatctatagcataagatggagagtgatagataccagaagacaaatataaacaaggtataacattactttagtgatggaagagattattcctgccagtagataaccatactgcaatttccaaacaacaagaaaaaaaaacaaggaggggccaagatgaccaactaaaaacagctacggttggaggctcccacgtagaagaatgaaaacagcgagtaaatcctatgccagcaacttgaggtatccaggttctctcactaggactgaccaggcagttggtgcaacccatggtaagtgaggaaaagcagagtggagtgacagccaacccaggatccacacaggggaaggggaactcccactcccagccaagggaggtagtgagtgattgtgctaccccgcctggggaaccatgctttttccatggatctgtgcaacccacagatcaggagattcccctcataagtccacaccacccaggccttggttcccaagcacagaactgtgcagattcttggcagccgctcaggtggagactgcctaagacaaccaagttcctaggggagggggcggctgccatcactgcagctgcctgctgccagagatgactgagctcccagtgggaggagtggctgccatcactgcaactgcctgctgccaagacaactgagctcctgcggggagagacggctgccatcactgcagctccagtctgccagtttagagaggaaaataaataacctgatggagctgaaaaacacaacacaagaacttcataatacaaccacaagtatcaatagctggatagaccaagggaaggaaggaatttcggagcttgaagactatcttgctgaaataagacaggcagacaagattagagaaaaaagaatgaaaaggaatgaacaaaacctctgagaactatgggattatgtaaaaagaccaaacctacaactgattggggtacctgaaagagatgggagaatggaaccaagttggaaaacgtacatcaggatatcatccagaacttccccaacctagcaagataggccaacattcaaattcaggaaatccagagaaccacagtaagatactccatgagaagaaaggtcatccccaagacacataatcatcagattctccaaagtaaaaatgaagggaaagtattaagggcagccagagaaaaaggccaggttacctataaagggaagcccatcagactaacagtggacctctcagcagaaaccctacaagccagaagagattgggggccaatattcagtatccttaaaagaaagaatttccaacccagaatttcataaccagccaaactaaacttcgtaaagtgaaggaaaaataaaatccttttcagaaaaacaaatactgagggaatttgtcaccaccaggcctgccttgcaggagctcctgagagaagcactaaatatggaaagaaaaaaccaatacctgccactacaaacacacactaaagtacacagaccaatgacgcttcgaagcaactacatcaacaagtctgcaaaataaccagctagcatcatgatgacaggatcaaattcacaaatatattaaccttaaatgtaaatgagctaaatgcctccagttgaaagacacagaatggcaagctggataaagagtcaagacccatcaatgtgctgtattaaagagacccatctcatgtgcaaagacacacataggctcaaaataaagagatggaggaaattttaccaagcaaatagcagagaaaaccaggggttgcaatcctagtgttaaagtcttacaaaacagacattaaaccaaaaaaaaaaaaagatcaaaaaagacaagggcattacataacggtaaagggctcaattcaacaagaagtgctaactatcctaaatatacaggaggacctagattcataaaacaagttcttagagacctacaaagagacttagactcccacacaataatagtgggaggctttaatactgcactgtcaatattagatcactgagacaaaaaattaacaaagatattcaggacccaaactcaactctggatcaagtggacctgacagatatctacagaactctccacccaaaaacaacagaatatatattcttctttgtgccatatggcacttactcctaaaaagattgcataattggaagtaaaacactcctaacaaatgccaaacaactgaaatcagaagaaacagtctctcagaccacagtgcaataaaattagaactcaaggttaagaaactcactcaaaaccacacaactacatggaaattaagcaacctgcccctgaatgactcctggataaataacgaaatcaaggcagaaatcaagaagttctttgaaaccaatgagaataaagagacatcatgccagaacctctgggacgcagccaaagcagcgttaagagggcaagttatagcactaaatgcccacatcagaaagttaaaagatctcaaattgacgtcctaatatcaaaattaaaagaactagagaaccaagagcaaaaaagaaaaaaaaaaggccaaagctagcagaagacaagaaataaccaagatcagagcagaactgaaggagatagagacacgaaaaaccttaaaaaaaatcaatgaatctaggagctggtttgttttttttttttttggaaaaaaaaattaataaaatagactactagctagactaataaggaaagagagaagaatcaaatagacacaataaaaaatgataaaggggatatcaccactgaccccacagaaatatgaacaaccatcagagaatactataaacacctctatgcaaataaactagaaaatctagaagaaatggataaattcctagacacacacaccctcgcaagacagaaccaggaagaagttgaatctctgaatagacaataacaagttctgaaattgaggcagtaattaatagcctaccaaccaaaaaaagcccaggaccagatggattcacagccgaattctacgagaggtacaaagaggagctggtaccatttcttctgaaactattctaaacaactgaaaaggagggactcctctctgactcattttatgaggccagcatcatcctgatatcaaaacctggcagagatacaacaaaaaaagaaaacttcaggccaatatccctgatgatcattgatgcaaaaattctcaataaaatactgacaaaccgaatccagcagcacatcaaaaagcttatccacatgatcaagacagcttcatccccaagatacaaggctggttcaacatatgcaaatcaataaacgagatttatcacataaacagaactaaacacaaaaaccgcatgattatctcaatagacacagaaaaggcctttgataaaattcaacttcccttcatgttaaaaactttcaataaactaggtattgttggaacatacctcaaaatataagagcaatttatgacaaacccacagccaatatcatactgaatgggaaaaagctcaaagcattccccttgaaaatcagcacaagacaaggatgccttctctcaccactcctattcaacatagaattggaaattctggccagggcaatcaggcaagagaaagaaataaagcatattcagataggaagagaggaagtcaagccatctgtttgcagatgacatactcctatatctgaaaaccccatcatctcagccccaaagcttcttaagctgataagcaccttcagcaaagtacaaaatcaatgtgcaaaaatcacaagcattcctatacaccagcagtagacaagcaggaagccaaatcatgaatgaattccctttcacagttgctaaaaagagaaaaaatacctaggaatacagctaacaagggaagtgaaggacctcttcaaggagaactacaaactgctgctcaaggaaatcagagagcacacaaacaaatggaaaaacattccacgctcatggatgggaagaatcaatatcatgaaaatggccatactgcccagagtaatttatagattcaatgctgttcccattaaactacccttgacatttttcacagaattagaaaaaaactactttaaagttcatatggaaccaaaaaagagcctatataatgaagacaatcctaagcaaaaagaacaaagctgaaggcatcacatatctgacttcaaactcaactacaaggctatagtaaccaaaatagatggtagtagtacaaaaacagacacatagaccagtggaacagaatatagaagtcaaaactaagactgcacatctacagccatgtgatcttcaacaaacctgacaaaagcaatggggaaaggatttgctatttaataaatggtgctgggagaactggctagccatatgcagaaaattgaaaccggaccctttccttataccttatacaaaagttaagtcaagatggattaaatatttaaatgtaaaacccaaaactgtaaaaatcctagaagaaaatctaggcaataccattcaggacatagatacggacaaagatttcgtgacaaaaacgtcaaaagcaattgcaacaaaagcaaaaattgacaaatgagatctaattaaagagcttctgcacagcaaaagaaactgtcatcagagtgaagagacaaactacagaatgggagaaaattattgcaatctatccctcagacaaaggtctaatatccagaatctacaagaaaaaaataaccccatttaaaagtgggcaaaggatatgtacagacacttctcaagagaagatatacatgcagccaacaaacatggaaaaaagctcaacatcactgatcattagagaaatgcaaatcaaaaacacaatgagataccatctcaggccagtcagaatggcaattattaaaaagtcaagaaacaacagatgctggcaaggctgtggagaaatgggaactcttttacactgttggtagttcaaccattgtggaagacagtgtggtgattcctcaaagacctagaactagatataccatttgatccagcaatcccattactgggtatatacccaaaggaatataaatcattcctttgtaaagatacatgcatgcgtatgctcattgcagcatttattcacaatagcaaagacgtggaatcaacccaaacgcctatcaatgatagactggataaagaaaatgtggtacctatgtgtccagaattggtgagttcttggtctcgctgacttcaagaatgaagccgcggaccctcgcagtgagtgttacagttcttaaagatggtgtgtccggagtttgttccttcagatgttcagatgtgtccagaatttcttccttctggtgggttcgtgatctcactgacttcaggagtgaagctgcagaccttcacagtgagtgtcacagctcttaaaggtggcacggctggagttgttcattccttccagtgggttcgtggtcttgctggcttcaggagtgaagctgcagaccttcaccgtgagtgttacagctcttaaaggcagcacggacccaaagagtgagcagcagcaagatttattgtgaagagtgaaagaacaaagcttccacagcatggagggggaccccagcaggttgctgctgctggcttgggcagcctgcttttattcccttatctgacctcacccacatcctgccaattggcccattttacagagagctgattggtccgttttcacaggttgctgattggtgcgtttacaaaccttgagctagacacagagtgctgattggtgcatttacaatcctttagctagacacaaaagttctccaagtccccactagattagctagacacagagcactgattggtgcatttacaaaccttgagcaagacgcagagcactgattggtgcatttataaaccttgagctagacacagagtgctgattggtgtgtttataatcctttagctagacacagagtgctgattggtggatgtacaatccgctagctagacataaaagttctctaagtccccaccagattagctagatacagagcgctgattggtgcatccacaaacccgagctagacacagagtgctgattggtgcatatacaatcctccagctagacataaaagttctccaagtccccaccagactcaggagcccagctggcttcacctagtggatcacacgccagggccgtgggtggagctgcccaccagacccacaccacgtgcccacactcagcccttgggcagtccatgggactgggcgctgtggagcagggggtggcacctgtcgtggcaggagcccacagtgggggtgggggggggtcactcaggcatggcgggctgcaggtcctgagccctgccccgcaaggaggcggctgaggcccagcgagaattcgagcgggcgctcgcgggtcggcaatgctgggagacccagcacaccctccgcagctgctggcctgggggctaagcccctcactgcagggcccgccgtacccacgcccacccagaactcgtgctggcccgcaagtgccacccacagccccagttcccacccacgcctctccctccacacctccctgcaagcagagggagccggctctggcctcggccagcccagagaggggttcccacagtgcagcggcaggctgaagggcttaagtgcagccagagtggacgtgaggccaaggaggtgccaagagtgagtgggggctgctagcatattgtcacctctcacctatacaccatggaatgctatgcagccgtaaaaaggaatgagatcatgtcctttgcagggacagggagggagctggaagccattatcctcagtaaactaacacaggaacagaaaaccaaacactgcatgttctcacttaaagtgggagttgaacaacaagaacacatgggcacatgggtggggggggcaacagcacacactgggtcctgtcagagggttgcagggaaggagagcatcagaaagaatagctgggcctaatacctaggtaatggattgatccgtgcagcaaaccaccatggcacaagtttacctatgtaacaaacctgcacatcctgcacatgtatcctggaacagtaaataaaataagtaaaataaaaaaataaaacttaacagaaccatcaggtggtttactaccctctttttctttctccttcttttcttgcttccttccttccttcctctttctctttcttgttctctttctctttctttcattttcttacctttctgctggactgttacattcttcatggcaggatatattttactgtcagtatcccaagtccctaactgtttctggttcataaaatgcagtcagtaaatatttgttgaatgggtatgtgtatcactgatcatcaaacttgctgtttaataagaaaatgcctattacaaagcatattcaacagataaaacctatgtaactaaaaagtagaattttcttctcagaaactaaacatatttttaaaagaaacttttgtaagattatatccagtttgcaccataaagtgcagcctatcacaaaaaaaaactgtctgatctgagacctataaagctgaataagaagcagaagcagcaatatcattctgcctagttacactggttgtgaatgatttttttatatttgaatgagtaggtcaagacctcaatgaaaatgagttataaataagtttatatttcaatccttttttaagtgttcacccacaatttgaatagaaaattctgtctagcaataaataatctctaaggtttttcaaactttgaaaattttgcgattttgattgaccatgagaagaaatcacatattaatagtataagcaactttgtatatatttttcttaggtgcctatgacaatgtcattagtcttagaatgaaaaccctttggggtagtgcctttaagtcagttcattgaacatgtctggagcagccactgggttttgacacatgatgtaacattgctaacttgatttaatgttccaccagagcaggctgtattttggaggcaggagaaacagtttcttacctgctaatcttcatctggggacatttgaaattgggagttgtgatattataagtcattgccactttttaatcagtgttacagcatcatattcttagttaattatcttactgtttaggtcacagtgctgtcgatatcaccaaggtggctagaagacatcgcatgtctccttttcctctgacatctatggacaaagcctttatcacagtcctggagatgactccggtgcttgggacagaaatcatcaattaccgaggtactattatatttgaccattgccctttcttttcttcatttttttccaaataagattcatgtaacattaatgcacagttttcctgaaaaagaaagattattaaccattattacagttatcatcattctttttttttcttatttctactcaataagaaaaaggctaagggttcagccttaacagtatacagagtaaaatccatgaaactgccttttcattaaaaaaaggaaaaaaaaaaaaaaaggaagaaaatcagctgtgtttctgctgtccatgaaaataccaatactgcaaactaaagaaagggttctcagcactgagtgaggaaagtagttaactctgagtctgtatgatgtcctttctgtcagaaatgggagacaactaatatgtcttgtaatcatctttttctgtttggaaaacctgtatttaaatgtaaaaatgtaaaaaaaaatattaatttatccatggatactaagacaacggaaaggtagcattccccagtattttgtttttaattaacaacttccatttctaaaaattcagcataggagttgtatttaggcatccagttccaggagaccaggctcctgaggagaacttccagccaataaagcttgtggtttctccccaacaccaaaaagagaagttgtatttagtgcaatttgaataaaatatagtttcttaatttgttatgcagaaacaacacaacagaattaattttataaataaaaaactttatagaatcataaaatattcaaactacaatgaacagtagagagcacaaacaccctaatttttttgtcaaggaaactcaaactcagaatagcagaaaatgaataggattaaggtctcaagatttacattcttccttttactacataattgtgctcttcttcaaccattaaattataaaaaataatggcagctaacttactggtgccagattttagctctttcgtctgtgtccccacttagacaaggattgttattatacagtttgcccttatcctacgtctttggttcacattcttttagatatgcatatcattaggcttaaatcgtttgtttttcttttactcctcaataaaggaaagattagaaaactcactagagtaggggattagtcaggaattaactatgtgatttcagaacaattttaatggaatagttttgtttattattaaaggtagaatgttgagatatttattggtatcagtagaaaccaagacattttcagaaaatatgaatgtaaacttaagttataaaaaaattaataatactttacctgttataaaaataaataaaccatccctggttttttcttttttataatttcagaggagtttcccttaacatcagtccttagaaaaatctcaccatgtattccaggtcacatttaaagagacattctaatttaaaaaaaaaaaaaaaagagttggaaattgccatttcatttttcctccagagaaaaatgctgtcatatgtattctcttttcccttcatgtgcttgtttcccattcatttgttcatcaaatcagttgtcacttgtacttgagcagactcttcatagatggataactttttgtcaagtgtttccacctatgatgatgaaaaataataatgaggttcacattaaacctttgaattggatcaaactcaattttttgtgcaaatgggtattgtaattagaccccctaggcactttgattaggtgtttagaaaccatcatacatagaaacttaatttactttgttcaacaaatatttaataaacatcaagtaaatgtcagatactatgttaagtcctgtatttgcaaagatgaataaaaataaaactcctgccccatggatttcataggctagtgcagaagagatgggtaaattaatgtggtacttgtctcctttaattggctcctttacaggcttgccttcctttgtcaattccttgaaaagctttctttacagttttttttctttggctcttttcacatcttgtccattgacttcagatggcctcatgcaggctagtagtttcagataccatttataaagtgaattgtaagtctataccattgcccagagcttgtccaagctccaaactcatattctaaatgtattatgtatctgctgccagtaaatataacatgacaaatactaaacttattttgtcgacaatacttgtttttctacatcctcttaaaactgtcccttgttctacattccctctgttactgttttagtttaggtgttttttttcttttttttatttttctgagatggagttttgctcttgttgcccagtctggagtgcaatggcacgatctcggttcacggcaacctccacttcccaggttcaagtgattctcctgcctcagcctcctgagtacctgggattacaggcatgcaccactatgcccagctaattttgtatttttagtagagatggggtttctccatgttggtcaggctggtctcgaactcccagtctcaggtgatccacccacctcgacctctcaaagtgctcacaggagtgagccaatgcgcctggcccagtttaggtctttattattaacttcctggacaattgttataggctcccctccccccagttaacatcttcccaatccgttctccaatttgatgccaaagtaatctgttcaaatttgctaattcgttattaacactccctacacgcaactcttcagcagttttttcataacctcaagataaaattcaaactccttaacatgtcatgaaaggccctttataatctgatttcttctaatatttttgtttcttctcttacctccttatcatcagaccttgcttctccctaaacctgacatgatgattcttacttcttattctctcttacctctaaggctttatttatatatcctttttttttaagagactaggtctcactatgtttcccaggctggccctcaactctcagcctcaagcgatcctctcgccttagcctcccaaagtactagtattacaggcataagccaccatgcctggcccctttgcttatatagtttttgcttggaaaaactttatcttacttctctacatattaactactgcctaactaccacatattctttaagatcaagcttaagatgcttctcctttatgaagaagtctttcctgatgtctgcttccccctttccctagctgagttaaacactcttcattcgtgttcccatagcaccttcttcatatgttttgtaagacaactgactgaaatatttgttcactattaattttaaatgccctaataaataacatggatataaaaaaaaagcagagttctgtaagtgtgaatcactgtaaattgaattgtcataagtaaaataaagcctagaaaaaaaggtagaagttcattctcactacactttagaatattttctttaccaagtgtatttgcgttttaatgagcaaacctttatagtttgttttgatttcagctagatgtacctctaaactatttaatatcattcattaatcactgagtaggaaaaagtatttgggggaaccaaaaggccttcacattctatgaaattacaaatactttgcctctgcaaacactctaacacctgcaatcacagaagcccttagaggaaagccagtgttttgtaaggaaaatctaggaccaactgaatccatgcatttgaagctgtgacatctctaaaatgatttttatatgtctaagaaggttcaataataatcccagaaaactaaggacttaacatgtagagaaaatgctgaaagtgattgttgtgaaggtcatagacacagggaactctatgaaggaatttcagagtatagtacatgaaacactttagatataatagtaagactaagagggtaacttgagatcaaatgagcattttttcttgtgtctgttggctgcataaatgtcttcttttgagaagtgtctgttcatatcctttgcccactttttgatgggttgtttggtttttttcttgtaaatttgtttaagttcttttagtagattctggatattagccctttgtcagatgggcagattgcaaaaattttctcccattctgtaggttgcctattcactctgatggtagtttcttttaccgtgcagaaagttctttagtttaattagatcccattcatcaattttgcttttgttgccattgctttttgtgctttagtcatgaagtccttgcccatgcctatgtcctgaatggtattgcctaggttttcttctaggatttttatggttttaggtctaacatttaagtctttaatccatcttgaattaatttttgtataaggtataaggaagatccagtttcagctttccagtttcagctttctacatatgcctagccagttttcccagcaccatttattaaatagggaatcctttcccatttcttgtttttgtcaggattgtcaaagatcagatggttgtagatgggtggtgttatttctgaggcctctgttctgttccattggtctatatatctgttttggtactagtaccatgctgttttggttactgtagccttgtagtgtagtttgaagtctggtagtgtgatgcttccagctttgttatttttgcttaggattgtcttggcaatgagagctcttttttggttccatgtgagctttaaagtagccttttccaattctgtgaagaaagtcattggtagcttgatggggttggcattgaatctataaattaccttgggcagtatggccattttcatgatattgattcttctatccatgagcatggaatgttcttccatttgtttgtgtcctcttttatttcattgagcagtaatttgtagttctccttgaagaggtccttcacatcccttgtaaattggattcctaggtattttattctctttgtatcaattgtgaatgggagttcactcgtgatttggctctccatgtgtctgttattggtgtataggaatgcttgtgatttttgcaggttgattttgtatcttgagactttgctgaagttgcttatcagcttaaggagattttgggctgagacgatggagttttctaaatagacaatcatgtcatctgcaaacagagacaatttgacttcctcttttcctaattgaataccttttatttctttcttttgcctgattgtccctggccagaacttccaacaccatgttgaataggagtggtgagagaagacatccttgtgttgtgctggttttcaaagggaatgcttccagtttttgcccattcagtatgatattggctgtgggtttgtcataaatagctcttattattttgagatgcattccatcaatacctagtttattgagagtttttagcatgaagggctgttgagttttgtcgaaggccttttctgcatctattgagataatcatgtggtttttgtcattggtttggtttatgtgatggattacgtttattgatttgcattttttgaaccagcctttcatctcagggatgaagccgacttgatcgtggtggataagcttttcgatgggctgccggattcggtttgccagtattttattgaggatttttgcatcgatgttcttcagggatattggtctaaaattctctttttttgttgtgtctctgccaggttttggtatcaagatgatgctagcctcataaaatgagttagggaggattccctctttttctattgattggaatagtttcagaaggaatgataccaactcctctttgtacctctcgtagaatttggctgtgaatccatctggtcctggactttttttggttggtaggctattaattattgcctcaatttcagagcccattattggtctattcagagattcaacttcttcctgctttagtcttgggagggtgtatgtgtccaggaatttatccatttcttctagattttttagtttatttgcatagaggtgtttatggtattctctgatggtaatttgtatttctgtgggatcagtggtgatatcccctttatcattttttattgcatctatttggttcttatctcttttcttctttattagtcatgctagcggtctatcaattttgtcgatcctttcaaaaaccagctcctggattcattgattttttgaagggtttttcgtgtctctgtctccttcagttctgctctgatcttagttatttcttgccttctgctagcttttgaatgtgtttgctcttgcttctctagttcttttaattatgatgttagggtgtcaattttagatctttcctgctttctcttgtgggcatttagtgctataagtttccctctacacactgctttaaatgtgtcccagagattctggtacatcatgtcttcgttctcattggtttcaaagaacatctttatttctgccttcatttcattatgtacccagtagtcattcaggagcaggttgttcagtttccatgtgcttgtgcggttttgagtgagtttcttaatcctgagttctaatttgattgcactgtggtctgagagacagtatgttgtgatttctgttcttttacatttgctgaggagtgctttacttccaattatgttgtcaattttagaatacgtgcaatgtggtgctgagaagactgtatattctgttgatttggggtggagaactctgtagatgtctattaggtctgcttggtccagagctgagtttgagtcctggatatccttgttaaccttctgtctcgttgatctaatattgacagtggggtgttaaagtctcccattattattgtgtgggagtcgaagtctctttgtaggtctctaaggacttgctttacgaatctgggtgctcctgtcttgggtgcatatatatttagaatagttagctcttcctgctgcattgatccctttaccattatataatggccttctttgtctcttttgatctttgttggtttaaagtctgttttatgagagattaggatggcaacccctgcttttttttttttttttgctttccatttgattgttagatcttcctccatccctttattttgagcctatgtgtgtctttgcacagagatgggtctcctgaatacagcacattgatggggcttgactctttatccaatttgccagtctgtgtcttttaattggggcatttagcctatttacatttaaggtccatattgttaggtgtagatttgatcctgtcattatgatgttacctggttattttacctgttaattgatgcagtttcttcatagcattgatgttctttacaatttggcaggtttttgcagtggctggtaccagttgttcctttccatgtttagtgcttcctttaggaactcttgtaacacaggcctggtggtgacaaaatctctgagcatttgcttgtctgtaaaggactttatttctccttcatttatgttggctggatatgaaattctgggttgaaaattcttttctttaagaatgttgaatattggcccccactctcttctggattgcagggtttctgcagagagatccgcagttagtctgatgggcttccctttgtgggtaacctgacctttctctctggctgcccttaacattttttccttcatttcaaccttggtgaaattgacaattatgtgtcttggggttgtttttctcgaggagtatctttgtggtgttctctgtattccctgaaattgaatgctggcctgccttgctaagttgggaaagttctccttgataatgtcctaaagagtgtttttcaacctggttccattctccctatcactttgaagtacaacaatcaaatgtagaatttgtcttttcacatagtcccatatttcttggaggctttgttcgtttctttttactcttttttttctaaacttgccttctcactttatttcattaatttgatcttcaatcactgatatcctttcttccatttgatcaaatttgctattgaagctagtgcatgcctcccgaagttctcgtgccttggttttcagctacatcaggtcacttaaggtcttctctacactgtttattctcattagccattcgtctaaccttttttcaaggtttttagcttccttgtgatgggttagaacatgctcctttagctcggagaagtttgttattacggaccttctgaagcctacttctgtcaacttgtcaaagacattctccatctagctttgttccattgctggtgaggagctgcgatcctttggaggagaaaaggcgctctggtttttagaattttcagcttttctgctctggattctcaccatctttgtggttttatctacctttggtctttgacgttggtgacctacagatggggttttggtgtggatgtcctttttgttgatggtgatgctattcctttctgtttgttagttttccttccaggagtcaggtcgctcagctgcagatctgttggagtttgctggaggtccactccagacactgtttccttgggtatcaccagcagaggctgcagaacagcaaatattgcataacagcaaatattgctgcctgatgcttcctctggaagcttcatcccagagggacacctgcctgtatgaggtgtctgctggcccctactaggagatgtctttcagttaggctacacaggggtcagggactcacttgatgatgcagtctgtccattctcagagctcaaacgacgtgctggtagaaccactgctctcttcagagctgtcagacagggacgtttaagtctgcagaattttctcctgccttttgttcagctatgccctgcccacaaaggtggagtctgtagaggcagtaggccttgctgagctgtggtgagctccgcccagttcaagcttcctggccactttgtttacctactcaagcctcagcaatggtggatgcccctccccccgccaggctgcagcctggcaggttgatctcagactgctgtgctagcagtgagcaaggctccatgggtttgggacctgccaagccaggcatgggagagaatctcctggtctgccagttgctaagactgtgggaaaagcacaggatttgggcaggaatgccccgtttttcgaggtacaatctgtcacggcttcccttggctaggaaagggaaatcccccaaccccttgcacttcctgggtgaggtgacgccccgccctgcttcgactcgccctccatgggctgcacccactgtccaacccatcccaatgagatgaactgggtacctcagttggaaatgcagaaatcacctgtcttctgcgtcggtcatgctgggagctgcagaatggagctgttcctattcggccatcttggaacagagtcccagtgatattcttaaagttagacaaatagttatggttacaacaactggaacccgggatccttaactcccagtctggtgttcatttcactatagcatactgcatctcaaatcaatgtaaacattattcttataaagcaagtgcctagacgtgtttgcatgtataaagtgttttctgtttttctattttgactaccgatgaattttctattttctctggtctgtcttttagcctattactattttcagctcctatctgcaagtgaggattttaaggaacaagtattccactgataggcattcctggcataactatggatgataacatttgtaagactaacatttatgattcattttctttatttgtaaaatgcatgacatgaataaattacaacttcacacttggtacagtatcaacttctgtaaggcagattaaaatattctggcaccattccctgaaattcccaatctttttctatatacaatggaaaaactatgagcttttttttaatagaaaggattttgctttcttgggaattttatgttagattataagctgtaagcttttttatttaagattacatgattaaagacttcagtgtctctgacctaggttctctgcttttccactttagcagttctagtcaaggaaactttaagttttgctgttggaagtaagtttggagcagtgaaatatctcttttagaatactgaccacagcacaaaggcacatgttcccgtctctgacttctagctagttagctgcctgagcataggcagttatcttaagctgagattggcttccctttagaagaaattctgaagctcttgattccaagcagtaggaagtcctcaccaaggtcatactgggagttcattaactcttcctgatggttcaggggctgttagagaataagggaaaaggaaataaggtatacttagaagtagctttgtcaagacactctttggctcttttacttgctctaccttttactagccaaatgaccctggacaagctacttaacctttctaggtcttatctccctcctatgcaaaatggaaataatgtctacccaatgtagggttattgtaggatactattaaaggagataatattgtgtaaataattttattttcgctaacatgctctatttggaattcagcaactgcttccctttcctctactctcctaacatggggattctaagatcataaccctgagataagcacttgtaaattacagagtatttacagtatgaccttggtgaggacttcctactgcttggaatcaagagcttcagaatttcttctaaagggaagccaatctcagcttaagataactgcctatgctcaggcagctaactagctggaagtcagagacgggaacatgtgcctatgtgccgtggtcagtattctaaaagagatacttcactgctacaaacttagttccaacagcaaaacttaaaggttccttgactagaactgctaaagtggaaaaacaaagaacctaggtcaaagacactgaagtctttaatcatgtaatcttaaataaaaaagcttacagcttataatctaaaataaaattcccaagacagcaaaagctaaaattggctcaactccatttgttggcctgcatctggatcctgtatgcattttgatgtaatcaaattttaattccacccacccaggtcattcaggaatatatctctgtctcattagaaaatttaattaagcagcagtttttattttattttttatttttgctcttctctgattgagctgtacaaaattgaagcaaagaattgagatacctattcaaatatttcaagtgaaagcatatatttttattatccaaatcactgccttaagtttctaccttcagtctagtaaggtcttcacttagaatgattctacttgcaaagggatgttggtctgtgctggcatttgctgtctattttttaatttttccatgaatgtggcctcttaaactcattcataattcccttcaggtattcatatctctttagactcatcattccatgaacttcattacactgctaaaatatgcacatctcattatatccttctacttctgcatcttattatatcattacctttatactccctgcattcttcaaaatgtatatcttaatccctcaatatatttttgtgacatatatgtgtgtatatatatgtttgtgtgtgtgtgtatatatatatacattttaaatatttttatatatatatatatacacacatatatatataaaatcacaacttgtaactaatcatggtatcttcatattcaaaaattatattaccggccgggcgcggtggctcacgcctgtaatcccagcacttcaggaggccgaggtgggcgggtcacaaggtcaggagttcgaggccagcctggccaatatggtgaaaccgcgtctctactaaaaatacaaaaattagctgggtgtggtggtgcacacctgtaatcccagctactggggaggctgaggcagaagaattgtttgaacccgggaggtggaggttgtagtgagctgagatcgtgccattgtactctagcctagtgacagagtgagacttcatctcaaaaaaaaaaaaaaaaaaaaaatatatatatatatccaatcagcattctgtatatgtgctttcaggtgctttttcccccagtactgtgggtcccacttgtgtgcttttaccaccgtacttattaagccttcttgtttaggggggttatttttatagctatgtaattgaataaaattacctattcacacagaaatcaggcctataccatcagagaaatgcaaatcaaaactacaatgagacaccatctcacaccagttagaatgccagtcattaaaaagtcaggaaacaacaggtgctggagaggatgtgaagaaataggaacacttttacactgttggtgggactgtaaactagttcaaccattgtggaagatagtgtggcaattcctcaaggatctagaactagaaataccatttgacccagccatcccattactgggcatatacccaaaggattataaatgatgctgctataaagactcatgcacacgtatgttgattgcagcactattcacaatagcaaagacttggaaccaacccaaatgtccatcaatgatagactggattaagaaaatgtgacacatatacaccatgaaatactatgcagccataaaaaatgatgagttcatgttctttgtagggacatgaatgaagctggaaaccatcattctgagcaaactatcgcaaggacagaaaaccaaacaccgcatgttctcactcataggtgggaattgaacaatgagaacacttggacacaggaaggggaatatcacacactggggcctgttatgggatggggggagtggggagggataacattaggagatatacctaatgtaaatgacgagttaatgggtgcagcacaccaacatggcacatgtatacatacataccaaacctgcacgtggtgcacatgtaccctggaacttaaagtataataataaaaaatttaaatttaaatttaaaaaaaaatcaggcctataaccttggcctaaattgccctatgtcgcaatcaggtagactgatcttcctttttcacacttccttctatgcataccattatatatgttcctatacatattcactcttaaaaaaaataaagtatattataaataaaaagtaaagtaggaaaatgaaatagaaaattgaaaaaagcacattacaaatatatctctttaagcaattttagtagaaaacaatacttaatccaaaaaggaagggggggttaatttttcaataggatttttaaagttaatttacacagcttttattgactatacttgtggttaaaataaggtacagtctttagatatgattcttaatatttccattatttataggtacctcattatgttttcacattttctatatacatgtcttatttgctgtagtttatcttgcaatttttaaattctgtatctattttgaagttccttagtctatagaattacatgaggattcagaatgtatgcagtggaaaaaaatgttttaagttaaaatggaaaaaaatagaaattttctcagaagtaatggcataaaaataccttattccagtaaagaaggatctccaatatttttagaaattacaactcatccctgtctattcctaatgttttattggtggaattatgaaaattagtgaaaattaaaagagaaaaccttaggtgacagtaaaggatttgccagtaccagcagggttatttttttaagtttgagtgattcactttctcattagagcacctagtgctgcaagaattacctttttgactgttttctcaagtaaagactttgcaactcctaggagaccattagctcatcccaagcagcagagggtaagtatcagggaaacccagttcttccttttatttaattgtgagacaaaagcataagaagaaaatcagagacacaaagattctaatcaacaatactctttcttatgtgtctgaatgtgtataagaatgtaacttagttgcaataatctttaatactttaactcaattttccaaaaatggaatttattgactattttctaaaatctcgttttcagtttctataaactcctcttctgcagaatcccagtctccttggttaacttcctaaaaaaaaaaaaaatacaaaccattaatgtcttatcatttggatataacagtgaatgatttggtaatactgttgcaaccctgtgactataatgccttgctaatttccttactttcattctagcaatatggaaataagccaccagtatttcttcaaagtcagtatcatagttggcatattggtatgtatttcttcttacatcccatctaggagctttgtttcatcatgcattttattttattttttattttataaaatatttcctgcatataaactttgtttttttaattaatggccacagtaatattctaacacaggaccactctttgtgggaaaaaacttaacagttatttttagaatactaagatccagggttcaaaaagaaaagtacatggttcaaaattataggacagtgactgagaaattaccattaaagaagaatttaaattattcagactacagagtgaacattttctttctttctttgcacaaaatcctgaccaacaaattcacccattggacgtaagtgctacccatttatcagtgatatcctactcatttgaccagggtgtggcaaggttttcatcattaagtactgaaaaaagtaggcatttgctctcaattgaagcattttctgtgacctcaaggacattttagatatttttaaaaattattcttcctaaaaacgtacccctttcatgttaattaagttaaatgctttttatatttacacagttattttaaaagtttaatgttttatacatagaaatgaatatatgtaacacagatggaagttgtagtgataaaataaacatgaaacaccaacccaacttaataactaattcattaccaattctgttgcatctttttgtaccactaaatcatggcttaatcatttctggtaatcataacatttgtatttattccaaactctataaccttacataaagcttattttattttatgacataagaactgtaattgccagataatgagcatctttagatggaaaaaagtgcacaacacaatagcactttgagaaagctatgtattttataagcataggaattttattattccattaacacaacttctggagtaactagattaatgaatgtactggttttcaacaaaggagatcttaaccctaaatgattcaatctttttcactctacgaatatataaagcctgtaatacataagcaagacctgcagtacaccaaagttttgtctagttggtctttcaaataaagaggtgaggaataaattatactggaatagacttgagggcatccaccatgttaaatgtttattttagtatctcataaatagccgtgaaactttccttatgaatgttatacatgcatacctcactttattgactttgcagatattccttttttttttttttaacaaattgaaggtttgtggcagtcctacattgagcaagtctcttggcaccatttttccaacagcatgtgttcctttatgtctctgtgtcacattatggtaattctcacaataattcatactttgttatttttatatctcttacagtgatctgtagtcagtgatctttgtttttactactgttattatttgggggcaccacaaattgcacccattataagatggcagacttaatcgataaacctgtgaattctgactgttttgccaattggctgttcccttttctccctctccttgggcctccctattctctgagacacagcaagattgaaagtaggccatttaataactctacaatggcctctaagtattcaagtgaaaggaaaaattacatgtctctcattttaaatcaaaagctggaaatgattaagcttagtgaggaaggcatgtcaaaagccaagagagccagaaacctaggccgctggtgctacagccaagttgtgaatgcaaaggaaaagttctttaaggaaattaaaagtgcagtagaccaacattcccttaagccaaagcgtaatccagagcaaggccctaactcttttcaattctgtgaaggttgagagaggtgaaaaaggtatagaagaaaagtttgaagccagcagaggttggcttatgagctttaaggacagaatacatctccataatataacaatgcaaggtgaagcagcaaatactgatgtagaagcaacagcaagttatccagaagatctatctaagatcattgatgaaggtgactatgctaagcaacaggttttcaatgtagatgaaacagtcttatatataggaagaagatgccttctaggactttcattgctatagaggaaaaattaattcctgtcttcaaagctttataggacaggctgattctcctgataggggctaaagtagctggtgactttaagttgaagccaatactcattggccattctaaaaatcctagtagctttaagaattatgctaaatcttccctccctgtgctctataaatgacaaagcttggatgatagtacatctttttgcaggttggtttactgattatgttaagtcttttcttgagacctcttattcagacaaaaagatttctttcaaaatataactattattgatattgcatctagtcatccaagagctctgattgggatgtacaagattaatgttgttttcatgcatgctaatacaacatcccctctgtagtccatagatcaaggagtaatttcaatattcaagtgttattatttaagacatacattttataaggctatacttgccatagatagtgattcctatagtggatctgagcaaagtaaattgaaaactttctggaaaggattcaccattctagatgtcattaagagcatttatgattcacgggaggaggtcaaatatcaacattgacaggagttgaaaagaagttgattccaaccttcatggatgactttaagtagttcactgcttcagtggaagaagtaactacgatgtcgtcaaaatagcaaggggactagaattagagatgaaacctgaagatgtgactgaattgctgcaatctcatgatgaaacttgaacagataaggagttacttcctatggatgagtaaagaaaggggcttcttaagatggaatctactgataaaaatgctgtagacattgttgaaatgatgacaaccaaggatttagaatattacataaacttagttggtaaagtagtgacaggatttaagaggattgactccaattttcaaagaagttctactgtggattaaatgctgtccaacagcattgcatgctacagagatatctttcatgaaggaaagagtcaatcagtatagcaaacttcattattgtcttattttaagaaattgccacagccaccccagccacaagcaactaccacccagatcagtcagcagccatcaacatggaggcaagaccctccaccagcaaaaacgttacaactcgctgaagactcagataattgttagcattttttagcaataaagtattttttaaattaaggtatgtacattgttattttcacataatactatttcacacttaatagactacagaatagcgtaaacataactcttacatgcactggctaaccagaaaattggtgtaaatcactgtactgcaatactcagtttattgcggtagtcttgaactaaccctgcaatatctctaaagtatccctgtaattcactttaaagtttttttaatgatgtagagactcaaatctgtacatgcttcacctttcatagtaaccctcttaatccttagccttagttaatattgttcctactgatggtcattttagcagagtaaatatatgttttgacattgccttttcagctcttttggtaagcgcagtgaatagttgttatgtgaaaaaagatcttacagtaacctctcacatagattatgtataatggtggcttttaaatgttgcagcatcaatgccgttacaatgggcatgagtaaacttttgaagaatttataatcaatagcagatggatttatgtccacattttatatttgaaaggcttaggtagtatgttttcctttcagcattctattacctaccacactctttctccactctcgattcatataaatgataaatcttggttagccaaagtgatgacaaggaatcaatttcctggaccactgaacttagagctctcccttaactttctaaaaagcctcttagagctaactacacagggaactttataactgtgggattattttgataagtgactttgagaaattagaatgcttttcactcttatatccaaaagcctttcagttcttctaacatcttaacttggacagtaagaagaaagtatagacagtcactgacttgtgataatttgacttgtgggttttgttttgttttgttttgttttgttttttacttacaattatgtaaaaccatcacaatttcaacatacttcaaattttgcattttgatatttttgtggtctgttgatatgtagtacctgagatattcaacactttgttataaaataggctttgtgttagatgattctgcccaactgtatgttaatgtaagcatcccgagcacatgtaaggttaggcaaggctaggctctgatgttcactctcttagctctatttgaatgcatttttgacttgccacatgttttcaacttaaaatgcgtttatcaggatgtaacctcattgtaaatcaagaaacatctgtattatctgtgtcagaataaatgcccaaccaaacaaattaactattaattttcccctttagagaatatatttgagctcaatgctcacaaatcatacttaattttagacatagttccctgtctttatttttcttgtgtgtatgtccattgtcagccatttgaatcgataaagactttttctaaagataccttaggccagtcatctcagttttaaaaagccagtactccagctagtggggaattcattaatcactgttatcatatggaaaactgaattttatatgtgtactactaacaacataaaaagactaccctttttgatccaaccagactgccactgttatcttgcagcacaagtaagcatggcacacaaaacaatgtatcagccagtctttttccactctttcttcttgtctaccgcctgagatcacttaattgtatatgtggcccagggtgcccagtgttacatagccttgcctttaagatttctgacactctgtagaatccgtaaatatgcatgtgtgtttatggtcttcatcttcatcaaattgaagacattattttacagaatttatgcaatacaatatgtggaagaaagtagaacagaataaacattgtctagtcagaccatgaaagcaggaccatagcttcttggcacacagcctaaccttcagcaaaatgaaatgctcacagcagtctgtgaaaagctgcaaattcccgacatcaaatgttcctaagcaagcatattagttatattaatcgcctattgggaaagccatcttttgcttattataaatggggctcttcctggaatggggcaactggtaaaaggaaattttgcttatgtttttctgaaattacatttttcagtaagccctttggctcccactgcttcagctgctcactgctgtttctctaccaaatgctaaacttaaaacagtcataatatccaggtgagaagttactgctccccggttcccatttaagtttgaagccttaggatacctttctaaaatcacaagcacaagttttatccaacactactgcttagcttctacctatgggcaaagggaagggatggtttcacatctgtgtaagtatctgtacgaatgcaagagagacagtcccatgtggttaagtaatttgcagtactattatattctctttacattccaaatggatcatttggcttgacattgaatgaagtctaatactgactggttggaaaagctagaaaattgtttagtcctaaactttaatgagagatacggatatagcagcttgcagagaggtatatctggcatttattccttcaagattccttttgtatctgctgccgactgggagcccttaccattttccacttgattgcctatttctctccatatttttttcccttcccttaagctctcagaccaaaacttgaggtcatgcatgcttttctctttgaggagacttaaatctttgctgacaagttgactttataccaactccaaaatcaggactaatccactagggatctaatttaccttaaatatagcaaccactatatatagcgtgagttcaaaataaaaagctggttggttatatatattgtaaattttatattaataatattaacaaaagaccagatggtatatgtgtgctataaatatgactttcctaaatatcacatatagaaatgaaatatgcttctttaaaacaactcttgtacttgcctttaaaaaaaattatcaagataaaattcaaagtattcagtgtttttagtatattcagacatgtgtagccatcaccacaattttagaagatataattcatatgctatacaattcaaagtattcagtgtttttagtatactcagacgtgtagccatcaccacaattttagaacattttcattaattcaaaaagaatgcctgtcccttttagcaatcatcctcctatcccctcatcttcacatctagccctaaataaaccactagtctacttcctgtttctataaatttgcctatttgggacatttcatataagtaggatcatataatacatggtcttttgtaactggctttttccacttagcttaatattttcaagattcatccatgttacagcatgtatcagtaattcattcctttgttgtggtggtaaaaacacaacacaaaatttatcatcttaaccatttttaagttcagcagtgttaagtatattcatatttttgtgagacagatcttcagaattgtttcaattcgcaaattcaaaactctctatccattaaataactcttacacctccctctagcgtctgataactatcattctacttttttctattaatttgactactttaattgtttattcattcacctattaatgaacatttgagttgcttccacctcttgactattgtgaatatagtttctatgaccatattcaagaccttgcttttaattcttttgaatacatacccagaagtggggttgttggatcatatgatagttctatttttaattttttgaggaacttccatactattttacaagtggttacaccattttataaccccaccagctgtgcacaagggtttcagtttccttattcatgccaaaacttttctgggttttttgatggtagctatcctaataagtaaggtgatgttctcattgtgattttgactttcatttttctgacaattactgataatgagcatctttttatattctcattggctatttgtatagcatctttgggaaaatgtgtattcaagtctttttttcattttaaattcatgtgattttttgttgttgagttgtaagagctctttatgtattctggatattaactcttactagatatatgatttgcaattattttctctcatttcataggttgcctttttactctgttgattgcattctttgatgcacaaaatatttctgttagatgtagtcccatttgtctattttgctttagttgcctatgtttttggtgtcatatcccaaaaaaaaatcattgccacattgaatgtcatgaactacttcctgttttcttctagttttatagttttaggtcttacatttaggtctttaatgcaggttgagttaattttctttgttgttgtttttttcactgtcttcttcttattattaatttccataggttattagggaacaggtggtgtttgtttacatgagtaagttctttagtggtgatttgtgagattctggtgcacccatcacccaagctgtatacactgtacccaatttgtattcttttatccctcacctgcctccgaccctttcccccaagtccccaaagtccgctgtatcattcttatgcctttgcatcttcatggcttagctcccacttataagtgagaacatacaatgtttggtttttcattcctgaattacttcacttggaataatggtctccagttccatccagtttgctgcaaatgccattatttcattccttttttggctgaatagtagtattctgtggtatacatataccacaatttctttatccactcatggattggtgggcatttgggctggttccatatttttgcaattgcaaattgtgctgctataaacatgcatgtgcaagtgtctttcatgtataattacttcttttcctctgggtagatacccagtagtgggattgctggatcaagtggtagttctactttcagttctttaaggaatctccacactgtttgccatagtggttgtacaagtttacatttctaccagcagtgtaaaagtattcccttttcaccacatccccaccaacatctattattcttttattttttcattatggccattcttgcaagagtaaggtggtatcacattgtggttttgatttgcattttcctgatcattggcgattttttttatatatttgttgaccatttgtatatcttcttttgagaattgtctattcatgtccttagcccattttttgacaggatagttttttcatgctaatttgcttaagttcctcgtagattctagatattagtcctttgtcagatgtgtaaattgtgaagattttctcccactctgtgggttgtctgtttactttgctgattgtttcttttgctgtgcagaaactttttagattaattaagtcccacctatttatcattgtttttcttgcatttgcttttggattcttggtcatgaagtctttgcctaagccaatgtctagaagggtttttctgatgttatcttctagaatttttatagtttcagttcttaggcttaagtccttgatccaacttagttgatttttgcataaggtgagagaggaggatccagtttcattcttctacatgtgacttgccaattatcccagcaccatttgttgaatagggtgtcctttccccacttttatgtttttgtttgctttgtcaacgatcagttggctgtaagtattggatttatttctgggttctctattctctttcattggtctatgtgcctatttttataccagtaccatgttgttttagtgactatggccttacggtatagtttgaagtcacgtagtgtgatgtctccagatttgttctttttgcttagtcttgctttggctgtgtgggctccttttttggttttatatgaattttaggattgtcttttctagttctgtgaagaatggtggtggtattttgatgcaaattacattgaatttgtacattgcttttggcagtgtggtcattttcacaatattgattctacccacccatgagcatgggatgtgtttccatttgtttgtgtcatctgtgatttctttcagcagtgttttgtagttttccttgtagaggtatatagtataattgtaagagtccaattttattcttttgcatttgggtatctgattttactagcaccatttgttgaagagactgtcctttccccattgagtggtcttgacacccttatcagagatcatttgactatacacatgaaggtttatttctaagttctctattctattccattgatctatatgtctgtttatgccagtaccatactgttttgattactgtggcttcataatatgttttgaaatcaggaaacatgactcctccaactttgttctttttcacaattgttttggctatttggagtcccttgagattccatataaattttaggatgagtttttctgtttttataaaaaatgtccttgggattttgataggattgcacttaatttgtagattgctttgggtagtatgaacattaacaatatgaacacaggctgtctttccatttacttgtctctgttacttctttcagcaatgtttagtagttttccaaaaatacatcatttctttttatggctatgtaatgtttcattgtatagatgtaccacagatataccacagtttgttcattcatcagttgatggatatttaggtttccatcttttggctattatgaaaaatgatgttaaaaataattatgctcaagtttttgtgtggcatttgttttcacttattttcagtttgcccttggtttttaagaataattgaacttaaataaaagtaaagactgttctggaagtccaggatagaaaaagacattttgagtaagacctatatttgttgctttgagtagacacaaaggaaataaaaattgcaattctttcaaaagcttgaggaaccacacacaccaacgtgagacctcttacatgtcaattttgcaaatagttgctaactgattgatagtatttggatctatgcccccccccctccaaatctcacgttgaaatgtaactcccagtgctgtgctggaagtggggcctagtgggaggttactggagctgtgctgtcatcatgatagtgagttctcttgagatctggttgtttaaaagtgtgtggcacctgccccctctctctcttgctccttctctggccatgtgaggtgccactctccctttgtcttctgccatgattgtaagtttcctgaggcctccccagaagaaaaaagccactatgcttcttgtacagcctacagaactgtgagccaattaaacctcttatctttataaattacccagtctcagtatttctttatagcagtgcaagaacagactaatacactgatatattacaaattgaatatatagttgacaaaaaatatatacatgagtagtattcagagtggcaatgatcaaggagaacttactatcttgaatgaagtcttgatatagataacggatgtagactggcagcaaaaaggaaaataacagtctgggtttagggaagccttgaccatatgcatggaggtgagcaagtatatacagaaacatgacttggctagagagggggtacagcttcaaagaaatgagattagagattagcaaaatatccttctctattttatatcctctttgatcgaagctggttgtatttgattgatatgacctttttctctacttatctgatattttcttgtagtcataatcattaatgcactcattcattgactcagtcattcaaacagtgactgagtgccttttacataccaaacactgtgcttgatactagggttacaaagatgaatgatatatactgtgacaacaaagaattcaaagcctgatgcagaagtcaagacaatttcacaaacagccacaatacaatatgaaaagtgtgcaaaaatagatggttacaaatcttatgcaaatattaagagtaaatgtagtccttccaaccaattctctgttttatcaccaaagaagttccaaaaagacaaatctcattacctttcaagagacttaaattatgctagtaaattaacttgaagtcattagtctgcttaaaaatcccttattggattcccatttttacaaaattaggtttaaactcccttgatcctgtttcatttgtctaaaacgcccccctctcctacctggttttgagttactctttaaaactcagctcaggtgtttatctcttctaggaagattttctagatgttccacaagtttttggttaggtgattttctgtatgtctcccatatcaccctgtacattttcctgccactgtctatgtcatactatcttgtaatcatctctatttctctgtctttctctttctctcatgcactgtgcttgtgaattccttgaggacatcagccaggccctacgggtatttttgtctccagtgtctagcatatattatgttcccagtgtttgatgaatggatgagcaaatcagtcagtgaacttgttggccttggtaagagacagaagatcaaagaggtaacatctgagctgaaccttgaagaatgcatgatacttactaggaggagaaaaaggaaagaaaaaaggccttcctgtccaatgcaacatgatctgcaaaagcacagactagaaaaagcccagaatgtttaagatgtgacaaatcatactttgtatcagaaactggacatttgtcagaaataaaggtcaatcgcagtgtaaatatttcccacattgtgctaaacgattcttaaactagcactgcagaattattataataggatatgtttattaatttttagcctactaaagttttggtgggttgtagcatttaaataactacattattccttgtcatacatacatttttctcatttgagcctcctcagaaacttgagggttattttttagtatttatgtgtatgttagaatggggagtaaatattattgcaaactaccagaacaaagtttttagattccagaatcaaatgttatcaaattattattgagtagattctataccataggaaccttccagaatggaattgcacaataagatatatgaacaactcaggcattcaagacagaaatcaagtgagctgatattcttttatccaaattgtcagtgagaccttactccactttcttctacttccacgtatctaaatcttgcaaaagcagaagataatcattatttctctcctcagagtggtcaaataattcattcatgtgcatttcaagacactgtgagatctataatacagctgtcagtatcaactgtctttcaaacttagcatattaaatataaagcccctgtcttagaatataggaagaaagagagccatgctgagcctgtttctttggggctactggcaagaacttagggtgtaaaagtgactatactaactgttgattcttatggcaaacagatttgtagttttttgttgttgatgatggtgtatgtagtgataacatatacataacataaaacttaactattttaaccatttttaagtgtatggttcaatagcattaagtacattcacattgttctgtaaccatcaccaccagccatgtctagaactttttggtcttcccaaactgaaactctatacccattaaacactaactcttctttccctcctcatcccagcacctgccaccaccattctactttctatctctgtgatttgactactctatgtacctcatgtaagtggaatcataaaatatttgtctttttatggtcagcttatttcacttagcagaatgtcctcaagattcatccatgttgtagcatagtcagaatttccttcctttttaaggctaaataatatttctgtatgtatataccatactttgcttatccattcatctgtcaatggatacttgagttgcttccaccattgattattgtggataatgttgtgaatatgggtgtacagatacgtgttcaattcccagcttttaatgttttggatgtatacctggaaatggaattgctggtttatatggtaattatgtttaattttttaacttgcaactttttaaatgtgagagatataaaggaagagcagtgggtagagggaacatgagtggtagtagttattactatggtggtagtatggctgaaaagttctggtcgggcgcggtggctcacgcctgtaatcccagcactttggaaggccgaggcgggcagatcacgaggtcaggagatcgagaccatcctggctaacacggtgaaaccccgtctctactaaaaatacaaaaaattagccgggcgaggtggcgggcgcctgtagtcccagctactcgggaggctaaggcaggagaatggcgtgaaccccagggggcggagcctgcagtgagccgagattgcgccactgcactccagcctgggcgacagcgagactctgtctcaaaaaaaaaaaaaaaaaagttctaaaatctagtttttccatcttactttagccacctatgaaatatattgctgtgggtaagtacttactgtatttaaacgtctcttccggccaggcgcgtggctcacgcctgtaatctcagcattttgggaggccaaggtgggcggatcatgaggtcaggagatcgagaccatcctggataacacggtgaaaccccatctctactaaaaatacaaaaaattagccaggtgtggtggcgggcgcctgtagtcccagctactcgggaggctgaggcaggagaatggcgtgaacccagaaggcggagcttgcagtgagccgagatcccaccactgcactccaacctgggcgacagagcaagactctgtctcaaaaaaaaaaaaaaaaaaactctcttccttcacctgtaaaatgaacataacagtgctctactagattttcatgggattaagtgagattatatatgtgattcatacagtgttaataaacatttactgtatcattggggctagccaccagaaaaactcagcccttgtgctatctctgataattaaccactattagtgcactattcaaaatcccagcaaagtcattcatgtagattctgagctgatgtatagcttacattttgatctacaccccccagtgccaggacaaactacttccagataaggaaccatcccatgaggtttactgtgatcctggacaagcaccactgggcccactgctagggactatatagcttcaggttcatgtgagagttaatgttatatatgtgaatacaaactagaccctatggtcccaccactttgcttgtctgacatagtatggcccaaacctccagtatagctccagaatagcttcaacatcctaggagtatctgaaggtagaatctgctaagttctcccttccaattcaggtgccaaaagggaagagtcaatatcactataggatatagtgatattcagaatagaaatttgaacatcagatggtccgaatataaatttaaaaatctctctacacttacttctaggtcctaggatctggaaatcagagaccctaggtggctaagaaggtcaaagataaaaaacacagactcacttatccagctccggaaacaatgaaattttataaattatacaaatacttcatgtaaatcaagtcctatattacttgtcttggtttcttttcttccttcctcttcctctttttttaacctcatttatttttgctttcctttttttaaattagcaataaagacagtttctgactagaggatttcaggaattggttatgactcctgaaacttttattcttattggcactagttcaaatttctgagccaaaagtgattttcatccagagtagtctgaatacttacttcacacaaaaggttactagtgctcttcttataggcactaaattatttcaattaatgaagccaaaatcaaaggctaaaactcaaatggaatgactgggatattccttcctttttttttaagctttctcttcttaagaaaaaaacaactttaggattaaaaaatgatgcattcattgtagaaaacgtggaaattttgggaaaagtagagcaaagggaataaaaaacataaatctaacattctgaagtaataaatgctttatattttcatgtatgttctttccttttctactgatatatacacatatatcttaatacagttaagactatatgctgcagatttgactttgcatgttgtaaaaatatgtatcataggaattttcctatgtcaatgaatattcttcataaatattactttagcctccataatattttaccttaagaatctatcatttcttatttaagtacctatattgttgatagtttggtttctttccattttttctattgtaagcaactgtgaaataaacatatacagaaacatttatccattttcctacgatagatttctagaagtgaaactactaggtcaatgggtatgaaaacgtttaaagttggctttccttttaaagaaaatcatatttgggttgttaaaggattactgacacatcaactgagcacatctttgattactgtatagcacctcatattcagataatctctgcaaacattgccatgaattgactgagtataatcttttatttcaggcaccagaatgcatctcttctatctcctgtttcttgggacagaaatcaggagttctgactgagcccatttacaagctgtgtcagacaagcactcatgcccatcttgtttatgactgcctgcttacccattgctctccatatttacattttccttcttttctcttccttcagatggaatggggcgagtccttgctcaagatgtatatgcaaaagacaatttaccccccttcccagcatcagtaaaagatggctatgctgtccgaggtaaatattttggttttcttaaacataatcaggcactgtatttttttttctttttttctttttttttttttttttttttttttcaaatttttggcttagcccaagcacccagcaactgttaggtttgtttccccatgactgtcaaaataacttcattcacagataaccatgttaatctgcacctgtaaattttctggcacaatcttgattaaaacttttgaggtaaagaaaagttacatgaaaattctcgttttaaattttttatttttaatatttgtggatacatggtaggtatacatatttatggggtacatgagatatttagatacaggcatacaatgcataataatcacatcagggtaaatgtggtatctgtcacatcaagtgtttatcctttgtgttactgaaattcttggctacaaataaatatataggaataaaattaaaacactgtacttcaatttattctttccgttcctacacatgccagacagcatacattcttagtgtgaaagttttccagatgttttctagttgaaaacatctgatggtctaagaaaaaagagcagattcccaacacaaggataaagttgaggtggtctgttctgctttcaactcaaacatcagtaaagggcttcatgaaaagcggacatgagggaaacctctaattctctagaagacatcatatttcaaaattctggcgccccagcagctcacacaaagttgcctgagattgcataaagcttaaaagcaaatactaaatagcatttttctgcctaaattccaatctaagaaccccaaatgtaaattctgaattgcttagaaactgttgttgatttttttggttttgtttttgtttttccatgtacaacatgatattttaaaatatgtagtacacattgtagaatggcttagttgagctaattaacacatgcattacctcacatacttatcatttttgtagtgagacttaaaatctactctcttagtgattttcaaactatgatacattgttattatgttattggttattaattcaaggttgatatcattgaagaaacatgtttaaaaagtttttcagtttatcagagctgttaagcatgccaattcctttttaatggggtacatgagatatggagttatggagtctcttacttggttttggttttggtttttttagctacatttagccatgaaaatacaggttgggcatccctaattcaaaaatccagaatttgaagtactccaaaatctgaaattttttgcgtgttgacatggcaccacaagaagaaaatttgatacctgacctcatgtgaagggtcaccataaaaacacactcaaaactttgtttagaaaaattatttgaaacattgtttaaaattacctaccttttggctatgtgtataggatatatatgaaacataaattaattttgtgtttagacttgggtcccatccacaagatatctcattatgtatatgcagatattccaaaatctgaaaaacatcaaaatccaaaatacttctggtcccaagcatttcatataaaggatggtcaacctgtaatttcctttttcctgtaattaaatacttcattaatctcctctgtattccatcatctcttagtagttatctttttatgttggagatagcatagcaaatgattaaggctacaggcattgagcaaagctcaagtgatctgggttttagtaccagttccatctgtgtaactttgagcagctcacttaaattttttagcttcagttttcttatctctaaaattatgataattacaacaatacttaccccagcaggttgttgtaagaattatattaaaaattaattgtagaaattaattagttgtagaaagccttagtaaactacctggcacacatttaaaaaaaaaaacacttgataattgttttttaaaatatttaatgatagtaaccattattatcatattataaatacattttcttaaactatctctgaaaaatggctaacatttgaattgctactctcattttctgtgtaaataaaatggtagagagattgagcttatgttttttcatttccactaatgtattctttctcaggaagattatcttggattcacttcattcagcttgatctcactagattagaatacttctgaaattggcaaagccaaaacttaaataccaaattcccaatggctcctatgtttttttctttcaaattgattccttctacagtgttgattagaataaatattatccagacagaaaattattttattcttgtgatagcttcactggctcttctagtttcttttttttttcccaatgtcattgttggcttgaaatagtttcttattgcccatctaaaaagtaaattctgtgttgatcttacaatttgtagccatacaggattactataaaatgacaaagaattcttacttccagagtagagcaaacagctacagtagatgaaacaccagagacaaagaagtctgttttttatagtctttgtaacataatgtgggagagagtgagaaaataaattatttgaggcagaattattcccaaacagaatattgttctgtgatttttacatgagctagcagcagctcaattaaaaaaaaaaatggttgctgttagcttttcttgttgccaaagggagccattagcccttatgagcttttctgacactgtacaactcatcaaaaaatttttatgtaaaattaccatttagtatcctatttatgcttttgtttgagaggtttttttttttgttatttcaccaaaaaaaatctaaaatggtatctcacattataaacagtccaagagattatctaccgtgaagctgattcacattgtttctttcttgcaaagggttggtacttctccaagatatgtaacatataagagcgacataagtgataatcattgcataaatggttaaatctcaaagtaggaatggttagtatgtctgtgtatacaatatgaacatcataattaaagaagcaaaagtcttctgtagacaagtggcatggtcttagaactatgctgaattttccagtttatacctcctcacttttttgtctgtaattcaggaagataaactctatgaatcctaaaagtgatttttactgtatttagtaataaagatgattttcatttctttaaaggtaaatgtattcattagcctcttttctgttataaataccacccccaggcagtgttttggtaaagaatatccttgaggccaattattgtggctaagaccctcctttgagtacctccttctctctacccctgtcttcctttactctggttcctttctccctgctcccttgattctccctattttcttctcctctgcctttaccttaggccttccagtaataaccagtggcactcgtgggcattgctaaccctctaggtgtaaagatgttgctaacttgctctggatcactaagcattagccagtatccttcagaaacatgtgggataaaactccaaaccagttggaggatcacttgctttaaggtatgtgagttcaaaaatcaagacagtaataaaatgactaaggaaataagtagaaacagctcaaaataaaacattaagaaagaatagaatgtaaagaaggcaggaataaagtaatgataatataaaataataggaagacctgtaaacctaaaactgcattcacgtgggagtgaatttgaaagataaaagtagataaaataaaaatgaaagtggcatatttacaatttgaatcaatacagtatttttattcttcacatttttcgattttgtttctcccttcacactgatgaagctaatcatcctcttgatgcattcacatcctcctatatagatgtaggtgactattttatcacactttctttgtggatattaataagggcaaaaatatgttagaactccaagttcagctttcttgaaaaagttcaatttgaaaggtttatcccttcagagcttattttgggatcatttggaaaaaaggaatattttgaacaaaccaggaattattttcagagtcataggtaacatacagttctgaaaagatatattaagagaaagttttgccatttgggtagagagaatttaaaaatttttttttcttgtttacattctgattgaaattacttatgaaaaatgcaaaaataatgaaaaagaacattttaaaattacccattaacttaccccctggccactattagcattttgtgcatttacctcacatacagtgggttagaatacaccaaaattcaatatagacaatccacagccattgtgacttagacctagttcttattctttcaacagtaatcatatttcagggcttttgttgtatccatttgaatcctctttcgctacaactggttctgcaattcatttgacagcctattttgccctctactataggatactttcagtgaaaaagagggccttatgatatgggagtaatactcatgtgaatagataaataatttggaataatttagtttagttaattccaaaaagaaaatatttctgaaaataatgccttctttcccaatactaacaattaataggcattttccctggaagataatggtaaagaatacacgatgccttcttactcatgtatcctatgcccacctccctgcgttccataggaaaaggtagccagtttaaaattccaaacaatttacctaatgtaatacttgagtgtaattgcagcaagtatgaatcctcttattccagctttgtcaccttctcttgttacctttccctaccaacccctcctataatcttaactttagtatgcatataaatactattaccctgtgcccttcttgcagtctcagacagtgtagttctataagcagagcagacaaattactattccttctgccttatttctctatcaactatttcctaggacctctgaaagttatgccatctctatgtgctctaatttgttcagccttaaagtggaaatgatgagactctttagtattgaaaataaatgactagctatacagtatttcaagagacttaaagaaagatcactatggctggaaaatgaaaatgaaggataattccatggcagatgatttgaagatcatcgttttctgtgtacacaatgagtagttatctagtgttatcaatttcatatcaaataatataaccagaaatcttcaaataaatgggtgaacagaactaaaagtgttttctggatattagaaaaaggaggaataagaaggaacagcttcagggtcttgcattaaacattaattgtttacataatgcatatgccattagggtttggtttatattgcttttatcacttctttcaaattaaattctacagttgcaaagcagaaaagaaattcattagcagatatgtcagaattacaagggaaacaattctaaatctgcagaagtccttcaaatctattcatcttttctaatgacgtactgtggtttactttctttttttctttccaagctctaggttcatgtgctatcatgcctccgcttctgccctctcctacctaaacttgtagaattcatcttgaaaaactgcaactttttaaaacctgtttctttcatagatatttttaaataaatatagccatgcaccacattagcatttgagtcaaaaacagactcttacatgatggtggtcccatgagattacaatggagctgaaaaattcctattgccaagtgagattgtagccattgtaaggtcacatagtgcaacacattacctttcctatggttagatatgtttagatacacaaatacttaacattgtgttacagttgcctatagtatttagtattgtaacatgctgtacaagtttgtaacccaagagcaataggctataccatgtagcctagttgtataataggctataccatctaggtttgtgttagtacactctgtgatgatgttcacacaacaaaattgcctaacaatgcatttctcagaatatatccccattgttaagtgactcatgactgtatcaggaagttagatagattgatacttatttttctgtcttcataagacaaaccttggtgttaatgtaaaatttggactcctgtagttcactaatttttttattccttaaattttctcttagtctgaatttgtctatattcagtttgatcttatagtgctctgctcctcaaaaagggtaatccatggaccagcagcctcagcatcagcttgttagaatttagaatctcactgttggtgggactgtaaactagttcaaccactgtggaagtcagtgtggcgattcctcagggatctagaactagaaataccatttggcccagccatcccattactgggtatatacccaaaggactataaatcatgctgctataaagacacatgcacacgtatgtttattgtggcactattcacaatagcaaagacttggaaccaagccaaatgtccaacaatgatagactggattaagaaaatgtggcacatatacaccatggaatactatgcagccataaaaaacgatgagttcatgtcctttgtagggacatggatgaaattggaaatcatcattctcagtaaactatcgcaaggacaaaaaaccaaacaccgcatgttctcactcatagatgggaattgaacagtgagaacccatggacacaggaaggggaacatcacactctggggactgttgtggggtggggggagcagggagggatagcattaggagatatacctaatgctaaatgacaagttaatgggtgcagcacaccagcatggcacatgtatacatatgtaactaaccggcacattgtgcacatgtaccctaaaacttaaagtataataataataaaaaaacaaaaaaaaagaaaagaaaaaggcaaaaaaaaaaaaaaaaaaaagaatttagaatctcagaccttgtcccagccctactaaattagaatctgtatattcacaagatctcgagatgatttgcatgcacattaactgttgagaaataagagaaataagaaaaatgactcctctcttggtaccaagaaacttctatgtagttgtttgactgattcttccttagctagcaatatagagacacatttaccaactggaaaggttcagagtaaggttgagaacatagtgcaagtgagcacatattctctccacaattggtatactttccctgataacaaagaccttgctccttagaatcgcttcagagtactttcacatatggacctccctggaactccatactaggcttgccccagatgacctccccagatgacctccagctactcattattcagtttatttagaggattatgcagaatattgatatgagcattttgagtttatgtgcatgtgtgggggaacaggagaaaagagaaatacttcccaccaaaaactttttgagaatgccaacttcatttctttattcttttaacaaatatttattatcagcgatgacttaggcactatgctagacagaataatgacataatctaagttatacagaattaatcaaagcagtctttttttttttttttttgagacaggatctcgctatgttgctctggctggagtgtagtggtacaatcccagctcactaaaacctccactccccaccccccacccggttctcaagccatctttgtgcctcagcctcccaagtagctagactacaggcacacaccaccacacctggctattttttgtatttttgtagaggtggggttttgccatgttgcccagctttgtctcaaactcctgagctgaagtgatttgcccagccaaagcagtctttctaaacattcttaagatgttgactcaaattttgaaggaaacaatatatatggatcagcaaaaagtatatataacaaatataaaactttgtgttagaaaatattacttatttggtcattcgtgcatgaatcttctaagaacgtttttgtagccacattcattcgtctgccaaccatttttgaatacttaacatattgaacatttatttaacacctattgtacagcaagtgccagggattagcaaatactgtaaatatatttagaagccataattgatttcaggctacactggggaaacaaaagaggatgcacgcaactcttgaggggagaggagtcagatatgacttcacagagaagatgacacttgagctgagtcttaacagctaaaaaatctttaatcagaaggcaagaataagaaaaggacgctttaagtagtggaagtagcacatgtcacggagccaacatatgagttatcttggtattctcagggatagtactagcagttgataatagctagagtataagatataaggaagacatgaaccaaggcctttgcacatatgttctctttgcacacaatgatggagcacttccacttcatgtctatcttttcctctctctccctctccttctttccctccctatttccctccctttgtctctccccacctacatacctgcacacacacacccctacttagctcttactcattcttcatattcaaatcagaaatccttttatcatgcttttcatgactctccagtgtagctcaggtactttaattatatactctcataaaatcatgtttctttgctttggagtggttttcttaatttgtatttatatattcattaatgtgattatttgattaatatctgcctctcctgatgcatcagtggctttaagagttttattttaaccacacccatgggaagaaatacattaaatatattatacatcaaaagccaatgatatacacacacatatataacatatacagtacatataaatatacatacatacacgtatataaacaaaaataagttttatgaaacaagagtcatccttaccatgtgtgttgaaatatatttttatccttttcattagaaaattgttcacaagttgattttacagcctatctccatttgtcatccagagtttgaaaaaccttgtaacacacaccatcatggcacatgtatacatatgtaacaaacctgcacgttgtgcacatgtaccctaaaacttaaagtataataataataaaaaaaaagataaacctaacctggaaaaaaaaaagacaaaccttgtaacaggttggcactgcactaaaatagaagcagcgtctaggtttaccccctactctctctccagcccttagtttaacacttggggcataaaagacactcagtagacatttactgaatgaataaaaggaataaagagcttcaaaggtattgttttaaaagtgtgattatccccatttttaccaacaagaaaactgaaggtgagagaggtttagtaattttgctgagagtccctgaagctaacaataaacagaaccaggattcagattcaggtttttttactctaaaacaatgctaatttcccccttgtgcaggaagtaaaaaaaaagaaaatgggtcaggcgcggtggcttatgcctgtaaccccagcattttgggaggccgaggcaggcggatcacctgaggtcaggagtttgacaccagcctgaccaatatgatgaaaccccgtctctactaaaaaaataaaataaaatacaaaaattagccgggcatggtggcatacgcctgtaatcccagctactcaggaggctgagacaggagaatggcttgaacgcgggaggcagaggttgcagtgagctgagattgtgccattgcactccagcctgagcagcaagagcgaaactccatctcaaaaaaaaaaaaaagaaaaagagagagagaaaatacctaggttgctataggaggtagcaagctgataattatttatctagtagagaaacaattttaaataagtttattcacgtttgagatgcagttggtgtggaactctgaaagataattgatgttttaattttctacagtaagaaaattatcatttgctctgaaagatggcaaaaataagtggggggatagatgaaacaagattggtaaaatgttgataattgttgaagcaatgacgtctatgtctgttgtaaaaacttttttttttttttttgagacggagtttcactcttgttgcccaggctggagtgcaatggcacgatctcagctcaccacaacccccgcctcgcaggttcaagcaattctcctgcctcagcctcccgagtagccgggattacaggcatgtgccaccatgcccggctaatttttgtattttattttgtatttttagtagagacgaggtttctccatgttggtcaggctggtcttgaactcccgacctcaggtatctgcccgcccgggcctcccaaagtgctgggatgacaggtgtgagccaccacacccagcctgttgtaaaaacttcttaaactttaaaaaaaaaataacccatgaaaatggcttaataaaataacattacaataaaactcttctataatactttttacaagtaaaaactgaacaatgtaacaggattcaaaaaaaaaaacacaagaaaggcaagagtttattaactgagataatatctgtaaagcataaaatacaacatcctgtgacagaagggacccagtgttaatttttgtccctcttcacatcaggctaaccaaagccatttatgcaaaaaagggatgacttcattataaacggtgttttatataagcctttagaaaaaaataacactttatagctacataaacgagcaattaatctaatgtccttttaaaaagagaaaatatcattattagtatgattataaatgtaatctaaatattcatatataatgtatatattttttgtagatatgctcccaaaactctgctgtttgcagataacatgaaggtaatggtcatgattttaaaacttactagataggcacttttgcccagtcgtattggtctgaaagccacatcatatgtcaagaaaactctttgaatctccaagaatgtttcttcatctagccattgttatactgtacatattttttaataaattttttatcccaattatggaattttttttttcaatttaaaaataaatagccaatggaaaatgtgatgcagtactgcctatgtattctaactcataaatagaattttgatacattattttaaaaaactgtgctacaattacaagactggattttagtcctagctctaccattaaccagaaattgttcagagtactttaccttttctttccacctgaattctttcattctataattcatttccttcagctgtcaaatgaagaaaggaatgttcttcctatttcacatcaggaagcccagactgggagacaaataagaaaacagtatgaagttgttaaaatgttatagaaaaatggagacatatggatatgtatacaaatagtgataaatccatttatatatatatatatgtccatgagtgtacacacacacatcacacatacatacacatggataaggtggcatttatttaggaagattggctagaataacttattagaaaagcacaagtgtggaaattacgaggtgacaggaagaccacctccagtgacaccatggcacaattaggcaccagtggtacaattaggaccacttctatcagtgcatgtgagttgcggataccaaacattaaatcagtcgtaacaaagccattgtcaagtctaggagatcagaaaaatattccacttctctaagccttatcaaataatttgagtcaaattttagaattccaattttaggttcttgttccatgctgtaggtccatactgatgtttgttcttggctctgttccatctcacagctgctgatggcccaggagatcgtttcatcattggggaatcccaagctggtgaacaggtgagattgataggcctgaaaggcactgaagatttcagcttcatggactttgggcatctaattctaaatttctcctatcagtttagtggaaattagagagagattagtcagaagattatcaaagggatgaaagtatagttcccaggagaaccaaaagaattatttcttaattgaaagtatctacatctattaatatatgtcatagtattattagtatgtctcacagacatgccttacaagcattttccagacctgtgattgggtgattctttttttcctgaaaaaaaaaatgttctgaatagaacaatttctaggtagtcttctcagacttttccccaacttgtgttacaaatggggaaacttagaagtagattatttaaactttttagctaattatttaatttaatttttctcacttgggatctagccagggaacaggtttacatatatttttattaagaaatgaagcaataataggccacattggaaatacaagtccatttgacactttgagaccagtaattggccacttaattgaaaaatcagttaaagtgggaaattattttatatatttaaaataaatataaatttaacttaaatatttattagtcaataatttgatgaagaaccaaggtcttccttttaaataagtatgctgttttaatttctatcaggtctttcttacgtaaaccacacaaaaggcaatgtctctgatttccattttgatttcttcaaagtagaaaaaaactgaaggatacttgcaatacatagaagagcagaatccttttagggttttattatattttacactcttttagtttcctcactcacacctaattttacagcatttctttttagcagcatttttaatggaggtttccaaaaggttttacttaatttttataggaaaaaaataacatatatcattggtttatgtattatttatttatttatttatttatttatttatttatttttgaaacgtagtcttgctctgttgcccaggctggagtgcagtggcgcgatctcggctcactgcaagctccgcctcccgggctcacgccattctcctgcctcagcctccccagcagctgggactacaggcacccgccaccacgcccgcctaatttttttgtatttttagtagagaggggatttcaccatgttagccaggatggtctcgatctcctgacctcgtgatccgcccgcctcggccttccaaagtgctgggattacaagcgtgagccaccgcgcccggcctggccattgttatgtttaagaggaaatagcatctgtcaatccggtgagttacgaaggttgatcaacagagctcctaccttattaaatggaactagaaggaaaccaaagaacttttttcctttccctgctgcttcccttcaaagtttcctcttcctgagatggaatacccaactgctactaccaagcaatatataaaaataaaagtggcagcgggcgtggtggctcatgcctgtaatcccagcactttgggaggccgcggcgggcagataacctgagttcgggagtttaagaccagtgtaaccaacatggagaaagcccatctctactgaaaatacaaaatgagccaggcgtggtggcacatggctgtaatcccagctactctggaggctgaggcaggagaatcgcttgaacctgggaggcagaggttgcagtgagccgaaatctcaccactgcactccagcctgggcaacaagagcaaaactccgtctcaaaaaaataaaaataaaaataaataaaagtggcaagaaataaataaataataatttttaaaatgaaggcagcagtttggcaaacgctatgttccatgcctttcttccttggcttagcatggactaacactagaaacgagttgagatatataggagaaggatgatgccaatggtgttgacactagcttcttcattttagcatccaaaaattgaggagattcgcatgcaactctctgaagctaagttggcactatagtgatacatattctcatccatactgcaccaagctggatttcattaccatgaccatttttctgacaaaaagaacagctaggcttgattcttttttataaatgacttgtcttgtttgtttgtttgtttgggtttttttgaggggagggaggttgttcttggttttgggtttctgggttttttcttgagacagagtcttgctctgttgcccagcatgatctcagctcactgcaaccttcaccccagtatggactctgtgtgggggctccaaccacgctgggttctctattctgatccattggtcaatgtatctgttttgctgtccaaaccatgctatttcagttactatagctttgtagtatattttgatttctgacagtgggaagcctccagttttcttctttttattcaggatagctttggctatttggagtctcttgtggtttcatacaaattgtaggattttctatttctgtgaagattgtcattggtatttttataggaattgcaatgaatctgtagatcgcttttttcgtagtatggtcattttcacagtattaattcttccaacccaacgacatgggatgctgtttctttctcttttttttttttttttttttttttttgtggcctcttcagtctttttcatcagtattttatagttttccttatacagattttttacctctttggctaaatttattcctaaattttttttgtagttattatacatgggattgctttctcattttctttctctgctagtttgttcttggtgtgtagaaatgctattcatttttgtgtgttgattatgtatcctgcagctgtactatatttatcagttgtaagagtttttggtggagcttttagggttttctatatataagatcatgttatctgcaaacagggacaatctgacttcctcttttcccctttggataccctttatttctttctcttgcctaattgttctggctgggacttccagtactaggttgaataaaagtgttgaaagtgggcatccttgtcttggtccagatctcagaggaaaagctttcaactcttccacattcagtatgatgttggctgtgggtttgtcatctagggccttcactgtgtacactcattctttctatacctaagttgttgagagttttaaccatgaaggattgttgaattttatcagatgttttcctaagtctgttgagatgatcatatggtttttgtccttcattctgttggtgtgatgtatcacatttattgatgggcatatgttgagccacccttgcatccccacagtaaatcccacttgatcatggtaaatgatctttttaacgtgctgctggattcagttgcaagtgttttattaagcatttttgcaccaaggatattggcctatagttttccttttttgtgttgtatccttttatggtttgagtagcagaataatgctgacctcatagattgagtttggaagaattccttcctcttcagttttccagaagagtttgagaagaattagtatgagttcttctttaaatgtttggtaggattaagcagtgaagtcatcagatcttgggcttttcttcagtgggagactttattacagattcagtctcattactcatgattgatctgttcaggttttctattctttttggctcaagcttggtagattgtatgtattgaggaatttactcacttctgctaggttttctaattttttggcatgtagttcttcatagtagtctctaatgaccctttgtatttctgtagtatcagttgtaatgcctccttttccatttctgattttgcttatttgggtctttttttattagtctagctaatgctttgtcaattttgtttatatttgcataaagtcaactttaatttcattcatcttttgtggttttttagtctcaatttcatttgtttctcttatctgtattctttctttccttcttctgattttggatctggtttgttcttgcttttctaatcccttgagatatatcactatgttgtttcattgaaatctttctactgttttgatgtaggtgtttattgctataaacttccctcttaatgctgtttttgctgtatcccataggtttttgtctgctgtgtttctattttcatttgttttgggaaatctatttatctcttaatatatttattgatccattggttgctcgggagcatattttgtaatttctacatgtttgtacaattttgaatgttcctcttgtattgatttatagtttcagtccattgtggttggaaaaaaattcgatataattttagttcttttaaatttgttgagacttcttttgtggcctaatatggtctatctggagaatgttccatgtgcaagtgaaaaaaaaatgtgtattttatagctcttggatgaaatgtactttaaatatctgttaggtccatttgatctaaaatgcagtttaaatccagcgttcctatgttgattttctatctatatgacttgtccaatgctgagagtagggtgtcaaactccccaaatattattgtattggaatctgtctctccttttagataaataatacctgctttatagtgggtgatcccatgttcaatgcatatatgtttgcgattattgtatccttgtgataaattgatccctttataattatagaatgacctctcatatttctttttacagtttctgacttaaagtctattttatctggtataaatgtggctacttttacctgattttggtttccatttgcatcaaatatcttgattcatttcttcactttcagtctatatctgtataggtgaagtgagtctcatgtaggcagcaaatagttgggttctttttttttaaatccattcagcttgtctgtatcttttaactacggaatttaatctatttacatttaaggttattactgatagatgaggactcctgtcatttcattgtttcctggttttgcttaccccttgctccttctcttattgtttatcattgcagttgggtggttttctacattgatactgttttattcttttctctttctcctttattaatctggtctaccagtgagttttatgcttgtgtgtgtttttatgatagtgattattgtcttttttgcttccagatatatgactcccttgagaatttatggtaaggccagtgtagtagtaatgaattctctccatttttgcttgtctgggaaagactatttctccctcatttccaaaggatagctttgctgcatatagtattcatagttagaaatttttttatttcagcactttgaagatgttatctcctttcttcctgtcctgtaaggtttctgcagagaaatctactgttagtctaatgtggatttcattatatatgacttgatttggagacctttggaattcctggacctggatatccatacctttccccagacttgggaagttttcagctattattttattaaataagtttcttatgccttttcctttctttttttctgaaactccaataatatgaatatttgttcttgtatggtgtcccataagtcttacaagctttcttcactctttttcattcttctgtttctctctgtctctctctcttgctgggtatttcaaacaacctatcttccagttcaaagattctttcttctgctttatcaagactgctattgaagctctctattgtaattttttatttcattttttgaattattcagctgtaggatttctgtttggttcttttttatgatttctctatctttgttgaatttatcattcttatgaattgttttgctgattttgttgaattatcgctaggttttgtttttgtttttgtttttgttttatctaattgagtttccttaagatcattattttgcaatttcttttccaggagttcattgatttccttttcattggagtctgttactagagatgtattcctttagtggtgtcatatttccttgcttttttgtgtttcttgtgtccccatgttgatctgtgtgcctagtggaacttttgcttctttcagactttctgggtggttttgtagagacgcctgtagttgggctttagtgtgttggttgcaaagggtatggtgactttctggacaggtgcaatggtgtagtctccttgcagctttttcagttgcattcaatgtcagtaataactgtgagtacctcagtggcctaatccatagaagtttgtgtcagtggtagtagtggcataggctgttaatatccttggtgtcaagggcttttagagtcctcctcttcttgttttccacacaatagggagaatcagctgaagggatccctcttggtgttaggtctgacatgccctccaagcagctacagtggcactgggctcaaaatatggtgcttggagtgactgtggagccaggatccaaggctcagggtcttgtgaatccattgtggcacctggttcttggggttcaggttcactctctgtggcagagttgggtgtaggttatccaaagaaccaaggtttatgactgaggcaccccctagcagcttggacccaggtgccctggttgtacctgtgattttatacctcatgggtagggtgtagtactgaccaaactccaaagaaaaaggttttggccaggggagcagggtatggccgcagctcaggaaccagagccagtagggctcagcagcagctcgggtcacagtggataaggtactgtgtagtagtgaccctagacccctggatggtggggctacgcaggtcctcacttcagactctgaggccaggtgcagaagcagcagataccttagaatggcagagcgcagctgtggtttgatccccgggggggccaaggatcaacacagaaatgactcaactccccagagaggggggtatctcagcagctcagactctaaggggctatagtctagctccagagaagcagggtactagagttatttggcctgtaggtcaggatatcttggctcaatcagcactctgtttccctaggacatgagtgactacatcagctcagcctgggatgcgtaggtgctcagcttggcaaagtgtgtgcaacatactttctaagccttgccataacagagcaatatgtctggaaaaaggatgattaaagaagattagaaactatctccaatgtctggatggagttaagggaaaccaataaaggaatctgcagcacccaggagctagcaacagtgagatttccttaccacatcttagtctgaaggagcaaagaaagacaatggtacctgaacctgggaagattcatatctgtgggagaggactgcccaacagcagctcttgctctcagtaggagagatgccctaaccatcaccaaactgcagcccaggaggaaaagagcaaggggaatgaaaactctacttttctgtctctctcctaccctctacatctcttactgacccctccctttggctgagtctcaccagacgccaaagtggtgggaaactggttaaaatagtccatagaggtcagcttctggaccacagcacagagtagagaatgatgatgtgatctggagaggcaaacagaaaatgaaacaaatctttgtctttgtaaggcttatattctgtaatatataatgcacttaacattgtacctagcatagattgtgggttcaataaatattagttattggtagtattgcttacagtaataatattatggagagaagatttttaagacttttgtaataaatttcctgttttactttgattgtactttcagtagtaaggtatttttttttcttaaccattccctaaggggtgtgtgtgtgtgtgtgtgtgtgtgtgtgtgtgtgtgtgtggtttattttactttgtcttattttggtggttaaaataacaacaatgacaaaacatacacacacataacattaaatataccatcttgacagtttttaagcttatagttcagtagtggtaaatatattcacattgtagggacttaagattttaaatagagtcatgagttacttaatgaagatatattctgagaaatatgttgttgggcaattttcttgttgtccgaccatcatagagtgtacttacacaaacctgcatgagtagcccactacacacctagcctacatggtgtgacctgtagctccgaggctacaaacctgcacagcatattacagtattactgaatacgtaagcaattataatggtatttgtttatcaaaacaaaaagtacagtagaaaatatggtaatcttataggaccaccatcatatatgcagtccaacattgagcaaactatccttatgcagcacgtgactatacttatgaggcagacatctttagaaaggaatcttttggcaggggggattaatattgtctcaggattttttcttagggagaatttgaagcattcattttccaaactccagtctaaatcattgcccctgacaagtgactttcagatcacttctctatcagatcaaatctatcagatgaatcttacagaaaaatgcttttcctcatgttgtaagaagttagcagggaaggttctgtctcttataccatcaatatgagagcacaaacaatgaaaatcttgtttttcattttcaaaagtaatgtttaacctaggtcattacagacactggaatcatttttaaatgatttaattatatttgctcaacctctattattaattgataggtgagctaatgtgttttagaatattttcaaaggcaataattaaaatatttctggcttgcctttatttaaccaaaaagtttagttaataaagtactgcatttctcaaacattagaacttcaataagttatgaagatttttttttgtaattgttattcacaatgtatgtcctagcaatttttttacttacagactctcaaatcactttacatatattaggaaaatgtacattatttgagaggcaaaagtggcaaatgtaaatggcagttcttcaaaagtaaagcagagcaccaagacaccgaatagtcattaccttaaagtacacataaaatcagcttaaatgaacctaaagcccctttagtgtgagtgcacctgtttgtggatagcttttattacactggcccaaaatgaataagactgtaagactttcttttatggtttattttttaatattaaaaaaattaacatcctctgcagacttttcctttgcagcagcaaagtacatcaactgtctttttcatctttatttccagccaactcagacagtaatgccaggacaagtcatgcgggttacaacaggtgctccaataccctgcggtgctgatgcagtagtacaagtggaagataccgaacttatcagggaatcagatgatgtacgtcatcaccaagtcttactgtgctgttgttcctatggcagtattatgtcacaaccattttctgcagtgtttgtgagattaacccagttttttgggttgtttagttttgttttgtttttgcttatggtgggatcttatattgtagtatatgagtctccagtaaataagaaatttccttaatcttgaaaatctgttgttacaggaggggtttctatgatcattgctgttatagcagaatttgaatcatatttgacccaagcagtttcacatgcaaacaacgaaagaaagtacctcaagaaagaaatgcagagatattaatggttgacataccttccagagcagagatattaatggttgacataccttccagctgagaaatttgccattgagactagcttctgataaaatgtcaaggagttcatgaaatcagaatttactagagaagaatttaacaaagagcacttgggcaagttcttgaatattacactaagccaagcatttgaaccaaatgaccctttcacctctggttttctgtaagtctggaaaaagctgtgccaccaaatgacagcctggaaatattaagtgtatgtcagttctccctccattgcctcaagtaaaagatgctggaatctttttggacctaagcaagcctttatctcactgaaaatagtggcaggttattgaaaccagagtataagccagtaataaaagtagaatagattcaactgaggttttaataatcagctctcttacttgttttatgaagaaagtaaagatatattttaaagctgaggtgaaaaataaacatatattctcccaagccgagtagatagtaaaattggccatgccaagagacagacactttccctgatctggagattttctttttaatcacctttccatatgtaaggcttataaaattcaacccttggcaaacagatcacattgcctgctgttaaaactgcctaagcagatttattggcatcagggaagccagcaaagcactgaattccagaacacatacatccacagactctgccagatgacaagacacagttccaatgtcacaatattattcacagcccataaatgtaaaattgattactgcaattaatggacagaaatctactaccaggcaaactataagtcctttactgaaatttctgcaagtatttggtaaccttggcatggtattgaacccatgattcatgggaaaagaaggaagatattacctccacacacgttcactttattagggtagccacctacatatgtatataaaaatatataaacaaattctatataatgtattagttcaaatattaaatcttataaacaagatttaatatttgaattggtacattttttaaaagcataaaaattggagaaaaaaattttttatttattggcaccaaaccttctaatttttcaggaacctgtgttagaaattcagtgttttcaaagggtgtagcaaatagttttctttttgtctatatttgtatatatcctgggcctatctgatggtaaaagtatcggagtaactaaattctactgctcagaaattctgtttgaaattacatgaccggctgttattatagggcactgaagaacttgaagtgcgaattctggtgcaagctcggccaggccaagatatcaggtaacttcaaaacacatagaatatatagcctacttttgtttctacatgatcatttactcaggaaaccctggctactataaatctgcagccatgtcagttagccattaattttcagggctttaacaaaaagcaaaatgaatgttatgaattctgtatcacatatctgccctgcctactttttaatgaagatggtaaaggcgagttagtcaaaagcaagatgagaaagaggtaaagtcatgagcctacatattctacagttaattctacttctagataatccagaattacccaatcccatccctaaataatctggaatttggtatcaactcagataataccagaattgggtatttacacaattaactaatagcatatgctctagtgactaccaataataatggaataatctgttccttgttatatacaaagatgaggctatttgctatgataaatagtgcatataccttaaattatttttcttaaaatggaatatgtttaccctgattccattaatactaatttgctgaacatccctttgtaacgaagctacacttctcccatccctatggcagcacaccaaggttaatgtacctcagtagccacagatcaggaccaacctaagtggtccatatggaaattacctctatgactgtagcctcattagcattattctccttgacaaagctagccagctgtggacctcttatcattaatgccgctagatattgccatacaaattcttgccttatcaaagaaagtttacaattggtatttttactataatgtaacataaaacaatttgtaaagtaattttattcacaggtactcatgaaaaaaaatttcaaatatgaagtaacatgtttttctttagcagtaatacattcaaatcctatttctgttttctgttgtgtgatttaacttttaaaattaaaaaagcataggatttttagaatcccttcaattcattgttttcctactactttatttctagacttttttgtcttcttgaatgtccttttttgacactaaagtttccctctgagttgagaaaatgttgttctctaatcacactgcttatggttctgctttgactttcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgaggtattaaaaataaaaatggagggagtggggagagggcccataagataaaggtatttctgacatatgttctgtgttgtaaatagaatgttgtagattatagatcataccagtggatccacattcttataacagggaaacaataaattggctttaggatagtttcaagttcagaatatgagaacaaagaagaactagtaaaaattatgtattatgaaatgttctcttctattagaatgaaatattataaccaatggcctttccacaaagtcagtacacataagcaaaaaactttagctgctagctatagatattaaactatacaaactcagtactgtttctgtttagacaatgaattgtgcccatcctgctgctgaaatgatgagctacttctgtgtgggaagtatcaatgaatcaggacatcatggctagcacttcttgtgaaaagttccatttgatctttaatcactaagagggatttgataatcaggttttttttttcctctctctctccctaaagatagcatctctagtggcatgatatttagaatgggtcaaaatgtcttttcattcctgatttagaaaagagaatttagtccatctctttctgagaactcttgaaaaacttcctattgcttgttttgcttaggttgtgcaaaacttcagtcagaagctccaaggtcaaatggagaatactaaaaagtgaatctgctggaaactcaaaaccttataaaagaatcagaaactattgagatttttaaaagtattaataattcctttgaccttactattaaagaaaagattagcgggattttttaaaaatctctttgttctgaaaataaacccatcattatttttaatttcttgaagtcttggaaatgaaaattttcagaggtctttttatgacattatagtccttttggttaaagcaaaagaatagactgttttattttgcaaatagatagctaaatcaacattccagatgtgcttacttcccagtatatatgcactagtcatttccaaaaactattgattgacaaaaaacattcttttcaatttgatctacatagtaatgattttaatatccttagaaccaaataacactatatatagcatcagaaataaatttttgttaaactggttgactcagtgaactattcttttttatgatatacttacatgctttgtgcaacaagtaagttcatggagtttgagaaagctaaacagtagcacactcatggaccaggcatggtggcttattcctgtaatcccagcatttagggaggctgaagcagggggatcaattgaggctaggagttcaaaaccagcctgggcaacatagcgggaccctgcctctactaaaaaattaaaaatagctatgcatggtagcacatgcctatagtcctagctactgaggaggctgaggtgggaggatcacttgagctcaagaattcaaggctgcagtgagctatgatggcactactgcactttagcctgggtgacagagtgagaccctatctcacaataaagtaaaataagaattaacacactcataataactatttagttaataggaaactctgtttaagcgatattgcttatatttctctctcatgcttttgtaggtctggactcatcctctcaattatccacagagtatattgttagtgttttgtttaagctaccttttacactcaattaaaactatttactggaagtaggctaaggtaatggggtgagaatagagatggtattatatcatgaaatctagggaagagtttgtagtcttagttccctgcccccacagagcttattactcttgaagaagctttgactaattctacatgacttattcccctactttaacagacctgctatactaaactataccacagttttccaagagaataatgcttctaaattatattatctctggttccatatagctcaacattcctccctttctcttattcaaagttagtttttattatgactctatgatcatatagtttagttttgttcagcagataattgggtacctctgtgccaggcactttactggaaattggtgataaaaaaaaaagagataaataaagcatattatctctccagaaggcttgaaattctcagatacctagaaaacaatagcaaaaaaaaaattacctattttcagagagggcaaaagaaattgcacttaatgtagcaaggccataatttacccagtcacagtacaaactttccttaagtattggttttagtttcctttgatacatatggtttcaggccgggcatggttgctcacacctgtaatcccagcactttgggaggccaaggcgggaggatcgcttgaggtcaggagttcgagaccagactgaccaacatggtgaaaccctgtctgtactaaaaatacaaaaaaattagctgggtgtgatggcacatgcctgtagtcacaactacttgggaggctgaggcagaagaattgcttgaacccgggaggcggaggttgcagtgagctgagatcgtgccacggcactccagcctgggtgagagagagagactccatctcaaaaaaaaaaaaaagatatatatggtttcacatatgtccacttcttgaatctcatatgacatattggtaagcaggacagttgccttggcaacccaaagagtgccgtacaagatgtctatgtatactctaaaacttgccccagtattttattactgtatgagcttgttaaggaccagcaaattatttcaaaattggggatatagagttatcaactatagctaacatggaatagctgatttctgtattcgttgatttcaacaaactgtgcatattaaaatttagatatgcaacctgtggtgattcatgtctgtaatcccagcactttgggaggccgagatgggtagatcacttgaggctaggagtttgagaccagcctgggcaacatggcaaaaccctgtctctacaaaaaatacaagccaggcatgatgctatgcccctgtagtgtctgctactcaggaggctgaggcagaggttacagtgcgcaatgaccattccactgtactacagcctgggaaacagagtgagacaaagaaagaaaagaaaaagaaagaaagaaaagaaaaagaaagaaagaaagaaaaagaaagaaagaaacagaaggaaaagaaaaaggggaaggggaagcaaaaagaaaagagagaaaagaaaagaaacaaggaaaggaggggagggcagggcaggactgcttaggagatgggtgcaccaaaatctcactaattaccactaaataaattattcatgtaaccagataccacctgttccccaaaaatctattgaaatgaaaaatgtttaaaaaatagaaaaagaaaactcattcataatccaaaaaagaaagaaagagtctcgccattttgcccagactggccttaaactcctaagctcaagtgatcctcccacctcagcttcccaagtagctgagactacaggcttatgctaccatagccacttcacaggacaggttttaagccaatcaaatctgtccagagtcatcttaatggaaatattatattaattattttctaatacaatttgtaaacctctgtatttctaaaccaaattcttaaagactccttaaattgtttaaaagatctaaatgtttctcttcccttcttatcttgtaacctagtaagccaggcaattagcttaacgatcagttaaacctttttttccccagagttgtgttaaaagctatttgcaacaggaacattcttcatgagagctcattgacttttctccctctttttgtgttagacctatgtatctgaactatctgggtgtatccataataacaagaattgagttttgatcaattaatagattaagttttctagaagacagagaaagaaagtgagatgattaccacaaatatgtaaagagttactgaccactataaaagtcaaatcaccttctctttgcaaagagtgggaaagccttaaatgcaagcaaacccatttcaatacatgagaaagaaaggaagtcattacaaccagttcaaatagtatcttgggcacttgataattccatcaagactataggattaattaagtctttaaaagtactttcaagtgaataattgtagtcatatcaaaagtacttcaaaatgaccactgcaattccaggttgtccttgatgaaattatgctttttagaaagataaatgtgtgaaagagaaaacagaagccagagttatgcctggagatagtgcaagtttattattaaatgaacccatgaattcattagctactggtcattcaaaagggaaaaatagcacttaaatattgtacctaaagtcctcaacagtaaaggttgaacccctggcagctaaccctgaaacctaacaagctagaatgggtagagaggaaatctctcccaaagccagtttctcatagacaaaactaagaaaagttcttataggcacacaacaatgtggccaactgacagataggatggccagtttcaaatctttactaagaaaaacaaaaattagtataaatccaatcagataaccaaacaattctggaaaccttataacaaaaacaatatcagctgtctttgggagttcagcaaaaaaacgatcagacctcaaaacaagggctggagttaatctaagcatcatagacaaggaatctgcccaagcaaaaaggcagaagagacctcactgaaatacagtataaccaataatataactggtggcaagagttcctgcctaagtcttggtaggattttcataataccaaaatcctaatacaaagaccaccagggaaacctgttgatcatacaaaatggttatattaaagtttctgagaaaaagaaaacatcaccttgacaatgttggggagggaaaaataatttttcctctacccttgtgagttcttacctgggacctctataaacgatagattaacaagaaaaaaagagaagttagttaacatgtatacctcgtgtatatatgggacatacccaagggaaaattagtaactcctaaagtgatggctgagaagtctggcttaaatagcatcttcagcaaagaacagtacattcttagagaagtgatgagacaaaggaccttgagtctctagggccggcaatttgtgggaaggcaaatatatgggaaactaatgatagattaaaggctagttaataaagtttgatatataaattcctctggcgccatctgcaggctgataagtgtccaaagatttatccctcgggccaggcgcggtggctcacgcctgtaattcaagcactttgggaagcctaggcgggtggatcacaaggtcaggaaattgagaccatcttggctaacacacggtgaaacccctactctactaaaaatacaaaaaaattagccgggtgtggtggcgagggcctgtaatcccagctactcgggaggctgaggcaggagaatggcgtgaacccgggaggcggagcttgcagtgagccgagatcgcatcactgcactcactacagccagggcgacagagcgagactccgtctcaaaaaaaaaaaaagattcatccctccaggggtcgcggggggagttacctttcttaatttatgtcctacttttaggcaaacaggagaaaagcagagagcgtttcttatatttttcttctcaagtgccttcggctaaaaaatatttgttatgctggcatattttggggtagtatattctgctacccttcaacagagtctcagtggtgtttcacaactgggaagtcataagatttttatgagggtatttataggattttgaggactagggttggccatgggatagttttaaggtagaagttattaagcaaagtccgagcagagattggtcggaatttgtaaaataggtgaattggtggatcacagtcagtcttatcttcagagcatatgaatccatgtggaactactgttaaaacaagttgtccatgatcttatcttaaagtatatggatctgaacaagcttgtgttaaaaacaatttatttcaagttacatgtcctggtttggtacagtttagctgttatgcaaataatggtatagttttgcaagttgatgtttctgttttatttctcagaaggaaatagtttgtaggcaaggcagccaattataaggctttcacagaaattcagacataatgtaatgaatgtctagaattgttttgggaggtagtaaaagagtgaatgaaaatgtagggtcaaggaagagatggattagaatattcttaatgattgaggcttttgggaagagtgggctacaaaggggaaaacaaagttaaatgtttaggccaggcgcagtggctcacgcctgtaatcccagcactttgggaggccgaggtgggcggatcacctgaggtcaggagtttgagaccagcctgaccaacagtagagaaacaccatctctactaaaaatacaaaattagccgggcgtggtggcgcatgcctgtaatcccagctactcgggaggctgaggcaggagactcgcttgaacccacgaggcagaggttgcagtgagccgagatcacgccattgcactccagcctgggcaacaagagcttgatgctgtctcaaaaacaaaaacaaacaacaacaaaaaagtttaatgtttaaaaagtgggaagatagtggccaggtatggtggctcacacctctaatccaagcactttgggaggctgaggcaggtgaatcacttggggtcaggagttcaagaccagcctggccaacatggcaaacccccgtctctactaaaaatgcaaacattagccaggcatggtagtgtgcgcctgtagtcccagataggaagctgtggtaggaagatcgcttgaacccagggggtggaggttgcagtgagctgagattgcgccactgcattccagcctgtgcaacagaataagactccatctcaaaaaaaaaaaaaaagaggtgggaagatagtggtaccattgataataccaaaaatgggaaattgaacttggtgacttgatatggagatgatgggttatgttttgttttacctcatatttttttcttttgaaactgtaataaatttcagacatcattcccaagatgactggaagtataacagaaaataagattcagttttaaaaggaaaaattgtgagtttattctagtatatttagccttatactcttccatttaattctgtattgttttatttgaaattatttaaaatacactgtaaatcccacaccctcatttaactagctattttttcgttatgtcagttttacagacaaataatgggttctccagtgatctctaattttccgttatttctggaactgtttgcagcaaaataacagagaggaacataaatagcaaagaaaacaccctgataacagaggaatcttacttagttcgtggtcaataccctgctttgaaaaaaatgatataatcacacatttttctttctaaagcaactagtttgattaatggagttaaagagctgcaagccttgccccttataaaattataatcactttaataactgtgttaattaagatcagaaaattaatctatgttagcattgcagtagcaattttccaagtactgccagggagtaagaatgaaagtgggttacaatgtcacatggcatctgattaagttaaattagtaagtattcgaagggaagactccctggtgacactgaataagatggtcacagttttcctgtagcctattgtaaggggacagttggttgcaaagctactacttttccaatataaagtcaaaaatctggccacatactatcactaatgagtctgaaggaagattaggacttgtggttattgtctgggagaattcatataataagctctggtgttggccatattagtagctaaaacatcttaaatgtgcaggcttgcctttaacctcctaaaataatagtccaggttttctcacttcaagtaagtacttctttttttactttataatttctgaaatcaaagcatatcttaaaactgatacataaattgttgtaagaatgtatctgtgtatgtgaaggaccccctactcttaggtattttataatctaatagtctatgttcacattataaactgatgtcatctgtactagcatctaggggtaacaatatgagaacaattgggaggaaagtaggtgatcctttgacgtcatatgtcataaagaaaggaaagagaatcacatttattgtacatttatctgcataaactgaatgttcattatctcactcctaacaattaccttgcaaggtagttattattactatattttataaatgagaaaattacgacaaagaattttgtcaacttgaatttgaaccctgttggaatccaaagctcttcctactctacaatctgactacctcattggaacatcctaaggtagaataagcttcgttaattttcttcgtagacatagtagatattaaatctctaaagattaattcagttcagaataatggaattgtgcatacatgtagctaagtattacttaagtttgctagtatcagagacaaaacatctgtcttcctctccttcacataagcttagcttctttgatactgttgaccccacttcagaaaagagacaaaaaagtttgaaagaaaagataaactattattctgttcagacttaaggatatcatgtcacacaatctatacctcaaatattcccaatggaagacaaattggaaaataatattgggagaaaaaaagataattgttttatttagtttggccagtatctccagagcattattatcaaattggagcccaacctggtgggatattttgcatgcagttcaatcgccagtgaaatttcagagtgttttttgacttccataggaacattttctcatcctcctatactttcaatatttatttaaagatcctttgggcattcaccttcaaaatgccagataccattgtaggtgctagatatgctaaactcagtttagtagatttttttttcattagaaatatgcaacattaacctaatagaataatttgtggtggttttttggctttgtagctgctaaatcctgaagatgacctcttaccagggaagattcgagacagcaatcgttcaactcttctagcaacaattcaggaacatggttaccccacgatcaacttgggtattgtaggagacaagtaagtatttgatgtcattctgaaaagtttgtattgtacaaatacgagtttttggaatactcattaggtggagttgctgctaaagagacagaaatttaatgtcataattttcacttatctcattcttcagaagccaaagaatattgaggtatctatgtcctttagagataaagatttcttggaatgtctctgaaaacaagagaaatactttactttcctgtagtatgttaggtttcaaaggatgtttttgtaatagttttggttttatcccaatggagctaacagtgatggcattattctgatgcacatttttacttctttcaagaaagacaggaaaagcataggtaagaagagaaagagagattgtcaaaagtagcactacctaattctttgaaatttaagtacaatttttttctaggacttctatattgatttttgtgtctttatgtaacctgtttctccaggctttacctacttgaaagtacaaagggaagcacaatgactataattactcaatttttaagagcctattacccccatctactgaattaactcagccctctgctaagttttctaagtatttctgtgaatctccagtgctgtctcatgtgtgatcaaaagcaagtctacactttctaaacatcctagtatcatgcaacactgctgcctggctgtctttcaaaagtcaccctttccatttcactagagctacacctgcttttagtaatactcaaatatcaacccaatggagacaaggctcagagacagatctgagtgataaatactcatgatgtatctatcacccataatcccctttctctcttatcactacctcatcactgtgtagacctcattaagcatggatccttcttcccttatgttgagtactttcccaaaactcagatgtgcttttgaagaggttctgacctaccattcacaaggtaggatctgacaaggcatgctgtgaactttatcttaggctcacactggacatagtctaacctaagcttgtccaggccaggcacagtggctcacgcctgtaatcccagcactttggaaggccaaggcgggtggatcacttgaggccaggagttggagaccagtctgactaacatggagaaaccccatctctactacaaaatagaaaaattgcctaggtgtggtggtacacatctgtaatcccagctactcgggaggctgaggcatgagaatcatttgagcctggggggcggaggttgaagtgagctgagatcgtaacactgcaccccagcctgggaaacagagtgagactctgtctcaaaaaataaataagtaaacaaattaagcttctccaacccgtggcccatggaccacgtacaacccaggacagctttgaatgtagcccaacacaaattcataaactttcttaaaacattatgagatttttttgcgatttttttttttagctcattagctatcattaatgtattttatgtgtggcccaagacaattcttcttctgatgtggcccaggaaagccaaaagattgaacacccctggtctaaaccttggacacaagcatcttgccagtaacctgaaaggtagtagcttttatgtcatctaaccttttgaagttctcttctttcctcctgatttttttttctttctctgaggacactggagtggaagctggtgtattttcaaatgtcattctttttaaaatcttcaccatttgtatttgcatggatgtttagctctaaagaagtttggccaggagtggtggctcacacctgtaatcccagcactttgggaggccaaggcaggtggatcacctgaggtcaggagtttgagaccagcctggccaacatggtgaaaccctgtctctactaaaaatatgaaaattagctgggggtagtggtgcgcacctgtaatcccagctactcgggaggctaacacaggagaatcacttgaacccgggaggtggaggttgcagtgagctgagactgcaccattgcactccagcctgggcaacaaagcgagactccagggcccctcgtcctaagaagggaaagtaaagccagtgtacaggaaggaaaggggggaaaaagccagttatttgaatttgggccttagcagtaacctatcctttaagatacaagtacttaaaaactatcctatccagatacagcttttccaaagaccaaaatcaacttctgagaagagaagtgataaatccaagagtttgaaaacacaaagataaggcaagcaggcttgaaacttcatggaacaaacaccagattcttagggttatttccctcctaccaatggctctggccctacctctaagtgcgttaatgagctctaagaaatagtataaggaaaaagggagcttttaaattgtttttaccctaatttgttctggactataattctgcccattctccctcttactgttatacttttttttttaaagaggttacttaatatactgtatatactgccattatcttgaagtactctaaaggccaaaacatcattgaaaggccaacatgttggtatgctgatatttttctgggatccacactgttaatttgtggtggacatttcctaataatggtgatattgcatttaactccaaaatatactttgaaaacagtataaagaacaacaaaactataaacaggttaaggcaattcagtgaatgtacaaatctctagtgtatacccttttcttgaatagtaataccttatatcaaactgagaacaatttaaaaaaaaaagaaattgatgcaaatctaggctttcttagtcttagagtgctatattgaaggggtccagagtgaatggtgtagaatgcagaggtggaatgtgggaggaaagaatttataattgttctaatggaaatctgtgctgggagtttagcaaagaaaacaaggtatttaatctacagcctattgatattctgtgaaggctaccctccttcattcttcttcatcctattcagccatttgctaaggaaagcaaatattgtcacacagaagcatctgggtaaagctctccagggaaacaagcagagtcatgggagaaactgtaccctaggtttaaagcagggagagaaatagctcaagaatgtcaataagggcgaggtgcagtggctcacgcctataatcccagcactttgggaggccaaggcgggcggatcacctgagatcaagagctggagaccagcctgaccaacgtggcgaacccccgtctgtactaaaaatacaaaaattagctaggcatggtggtgcatgcctataatcccagctacttgggaggctgaggcaggggaatcgcttgaatgtgggaggtgggggttgcagtgagccaacatcgtgccactgcactccagcctgggtgacagagcgagactctgtctcaaaaaaaaaaaaaaagtcagtaagcacagaaccttactcaactatgacagataagggtagagagtgacagctctatttgtatcattaaaaaaggtttgagtctggtttttaaattctatatgattctatttctcagctcttattcttatcacctgccataattttgacaatcaaagtaaaaatagaagaataagactttgtagctctttgaagtgagttggactaaatggcctttgcttactataccttttattttaaaaggttaatttaatagtactatgaagattactggagggatgcttcaaatacctgagaattaacaactgtatttgaaaatcattcatttgtaaacattatatatatattaaaatacatttcttgttttctcacactgtttggaacacagtactgttggagttcctatagtctttttctttaaagagacacattttgaaacccagagatattaagtaacttgcccagcattatactactagttagtggcagagataaaaatggaatctaaatttcctgagattgacaatccataattctctactatcattataaagacaagatattgtatacctgtgtactactgtgggctggattggtcagacagagttttataaacctctagtttcaagctagaacttaaaagaatgagtaggatttagataggaaaagagagtgtgttaatccaagtaggaaactgaatgcacaaagtagagaagtagaaacaaatagtgtctagagaattagaaatgaacaagagattcaggtagaaggataagacaggtaaattgagtagaaatttgaaccagattttgaaaggatgtggagaaataggaacacttttacactgttggtgggactgtaaactagttcaaccattgtggaagtcagtgtggcaattcctcagggatctagaactagaaataccatttgacccagccatcccattactgggtgtatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcctgtcctttgtagggacatggatgaaattggaaatgatcattctcagtaaactatcgcaaggacaaaaaaccaaacaccgcatgttctcactcataggtgggaattgaacaatgagatcacatggacacaggaaggggaatatcacactctggggactgttgtggggtggggggaggggggaagggggagggatagcatcgggagatatacctaatgctagaagacgagttagtgggtgcagcgcaccagcatggcacatgtatacatatgtaactaacctgcacaatgtgcacatgtaccctaaaacttaaagtataataaaaaaaaaaaaatggctttgcaatttaggctgccaaactacccaattcagttaaatttgaagtttgggtattttttggtttgtttgggtttttgtttttgtttttgttttgccgaattgacataaaaaacaattattttaaaaagatcaattgacctagatttatcatataagctaatgatggagactggaaataaggagaacaatacaatttgtttactcattgtttaatcagtcaccaggaagtattgattgtgtacctgtgagtcgtctggagatcttattgaaaatgttgattatactttaacaaatctggggtgggctgagattttgcatctctgacaagctccaaaattataccaaactgcaggtctgtggaacacaggaagtatcaagaatatagtaagatcagtcatgcgtctgctatgaattttaagccaaaggctatggaagatacaaaattgaaacagatattgatcttacttttgaagaatcacaaattccaagcagtaaaaatattttagaaggttccagaacttaaactcaaatttggaactataagaagaaagagattaaataaagagaaatattgaagtctattatgtagaagagagcagtgtcactgttgaattatctttgtctggattacaaagcctcaaaatggtatgtgtatgtaaacacaaaatgcctggaaaagcaagctgttaggcctctttaccacaattttatattcctgtgtagcaacatactatttccatgtcttcattctccactcaaaatctattatttcttggcttttatagctctttttgctatgctcattcccctaaatataggtctccccgtggcttacccttggctttctgtccttttcattctgtatgctaatgactgactaccaaatcttatatccccagcccaaatatgaaactagtaaagcctagatattctgaattggcacaaatttatgtgagtttatatacttttaagcacaaccctatttctacttttttttttttttgagacggagtctcgctctgtcgcccaggctggggtgcagtggcgtgatctcggctcactgcaacatctgcctcccgggttcaagtgattctcctgtctcagcctcccgagtagctgagacgacagacacccaccaccgtgcccggctgctgtttctacttttttcccaaaatacattttatttgaaaaaagcaagttgcagaataacatgtttaattttatctcacattgaatagcaactgaacaaacatatatttataaatatggtatatgcatgggaaggtatttatatgtagaaataccctatacacccaagtgttatttctagtagtaagagtttgcatatggggtagaagttagagaattaaaagtgatggtaagggccagccactgtggctcgtgcctctaatcccagcactttgggaggccaaggcaggtggatcacaaggtcaggagttcaagatcagcctggccagtatggtgaaacgctgtctctactaaaaatacaaaaattagccgggcgtggcggtgggcgcttctaattttttttttttttttgagacggagtttcgctgttgttgcccacactggagtgcaatggtgcgatctcagctcactgaaacttctacctcatgggttcaagcgattctcctgcctcagcctcccaagtagctgggattacaggcatgcaccaccacacccagctaatttcgtatttttagtaaagacagggtttctccatgtttgtcaggctggtctcaaactcctgacctcaggtgttccacctgccttggcctcccaaagtgctgggataaaaggtgtgagccatcgtgcccagccacttctactttttttttttaatatttctgaaatacttgaatatttttaccctgaggatatactgtatttcttttgtaataaaagaacctcctaaaaattccccttatgcattattaaaaatttggtggaccagtattgacaactgtaatcaaactttccaaaacggacaaaagaggcaagcagctcatctaaggaatctgaatctaagtaagagctattaatactattaggtgtgtaatgccataaacatagtgataagtaggcaaattaaaaagaagccaaagtcttgctgcattttaagtaaaattataatattttgtaatacaacaaaagtttaaatcaaaagattatagaaaacatacttaaatgcaaaatcttaatgtctatattgactttgaattttatttctcatactattttgcaattgctcaaataataagacttgaaaatttagccatagtatatatttgtagaacttgacagataactaatgtaatagaaaccttagcctacctacattttgttttctccaagcataaaaagtatttcatagctatgttttgttttccagaacccatggtgataaactgttcatattagatattttcccccaatagatgataggttggcagcatcattgactagaaagaaagaaagaaagagagaaagaaagagagagagagggagagggagggagggaggaaggaaggaagggagagggagggaggaaggaaggaaggaaggcggagggagggaggaaggcaggaagaaagagaaagaaagaaagtctttaatgttacccttgacaaaatatcaactattttacctcatctagaattctacaaaataataatgtaatatattggctttgaattttcaacctctcattataaattctttttcttcattttcatgtcgttctttcttcttttgattgcacagtgcctttctattctttctgttcttttcactcaaatgcattctttatatatttacatattttctactttttaaattttagatgcaggggctaatgtgcaggtttgttacatgggtattttgggtgatgctgaggttttgagaaccaatgatcacgtcacccaggtagtgaggatagtacccaatagttaggttttaggccccttacccctctccctccttccctcctctagtagttcccagtgtctattgttgccatcattatgttcatgagtacccagtgtttagctcccacttacaagtaagaacatgcagtatttggttttctgttcctgcattaattcagttaggataatggcctccagctgcatccatgtagctgcaaaggacatgatttcattcttttctatagctgtgtactattccatgatgtatatgcaccactttttttttatccagtccaccattgaagagcattctatgtctctgctattgtgaataatgctgcaatgaacttaagagtgcatgtgtctttttggtaggatgatttgttttcttctggatatatacccagtgatgagattgctgggttgaatggtagttctcagttctttgagaaatctccaaactgctttccacagtggctgaaccaatctacactcccaccaacggtgtgtaaatgttctcttttctctgcagcctcaccaagatctattatttactttttagtaatagccatttggactggtgtgagatggtctctcattgtggttttgatttgtatttctctgtgattagggatatgttaaatgatcatatccctaaacatatgttcatatgtttgttggctgcttgtatgtcttcttttgagaagtgtctgttcaggttttttgcccattttctaagggatctaccttaaatatggaacagcagatgtcctagttttcttttccccgaggctggttcaataacctattagcctcctttagtcctcctagacagtgtgagctactgtaggggaagagttgaagacaaagaaatgtagatgggtaaataagtactgaatgctatatgtgctagccaagcagttgtggccagaacttagtaagatattggtcatttgagcacatatatttttctctgttactgctttttttttttcttttttctcagtttcctaataaatttgctttgagaagttgttgtcttgtatggcttaaacagggtggaaaaaggatttgtgagtattgggccagggttgttttctttcccaccagataagctccatgaatactaggacaaagtgtatgttggtaaacactatatccacagcacttagtagggatacattaaacagccctgccatcttttcctataccattctctctttccatgaaacctagaaactttcaattatacaacagtccagaagaatcttacagggccccttcaaagtaagtccaaaagccttgaccataggagcaggccagaaagtatggtactgacagtagagttgcattcctgagacacatccccaaaaaatgtacagtgtaaagctttgtggctgggtggttcattttatatttctgaagaaaagcatcttgggagaaattccaaatagatttagcaggcttttaatttaaaaaattgaggagcagctctctcaggcttgaaaagatcttacaaatttacttcttgaatataacaagcggtaatcattatccaaatagaatccacttggggaaatttttttaaataaatttcagcattaattgagtttatataattcctcaaactgattttaagtattgaataaggattcaactttatgacagctcagcaatatagcttctgaactgccaacttggaccttctagcctttcaaggcctgaaggaagggctgggaaattcccatcattaagaagatttcccccttctggaaaattgccatcacagaagcctgccccactcaaatcctgggcttacttgactatgtcatagattgatgttttgtatttgaactgcctcctcttgctgctgcgaatttgtgaagctacctctttatattaaagcaagaagcagaaggacaaatactgagatagaaaattgggttcttaaaaacctggcacatttagcaggaattatcaagatagacttaacagcacagtgattatttgggcaaagccgagtgccttacaacttccaatttgtgaaccaaacacatcctaatttttcattgcttacccaatgttcttaaagtaggagttttctaatcatcaacgataatttagatctgaatttaattggttcttgtcatttttataaactatctgctctccttatggcatgaacctccttttctgctcaaaatgcaaagttttcatttttgagtcaacataatagatttattttcttctttttttttcttttactcctagcaagctgggatagatttattttctgatcatttttcagcagaggtttctcattttctattggttaacaaagaacattctttctaccttaacaaacgtgtttaatgacgagaggttctttccgatctcagtgatagactttttatgtagctgttagagttgccctcctttatctttaagcgttgctattgcagttgacatttctgtttcttctatgaataacctctaggtattactgtagctttagacattgttttcctaccccaaactcataaaaagtaatgtcttccagaaagcctgtcctaattatctccaactaattctaatcattctatcccatttaccctttttgtcatttctttatattatatataaatatatgatatatattttttcattttaattaatgtatttgaattcaacagatgatattaatgtcattgcttatttcactcatttttctaactttttttcactgatgagttttctgcactagcttataaacttaaaggcaagaaccatgctttcttctttctttacatgactccatggtcccagaacacccagtgagactggaaaagaatgaaatgatggctatatgtgtagtatgtagtttgattccatacgtgaagtagacacccagaaaagatttgtagttaatgaatttatctttgacctctgaagaaactatgatatgataatagatgtcctcagctattttttgttaccttggtatgattaactgccaacattctttaatccacacatcctagactttttctctgtgtcatcttcactcatcttaaaatgatgcagcttgcagttggtgtaacagatgaaacaggaaactaattagcagctgttgtccatctgtgtgtttatattaaatattttaaaatagaaatgtatttgcattctgaatactgtttctgaaattcataaatcctaaacttgggtaaatgctgtaaaattcaaaaccaagacagagcctttaccatttatcttcatgataaagcaaaaataattttatgccagaatcaggattatagtaatttgaggcagatgtaaattttaaaaagcaaaaaaagtcttaacttttttaagttgctttggaattgagcccccaaagcaatcaaattgaaatctgaaaagatacagtgttcaaaagatgtcataccctctgaatatattctttcttcacagaaactgatgagtacatacacttttgagaaagctgcattcattctctgacagatttattttgaaacatgctcctcctttctctttttctacctttctattaagtgcgtggttctttgacatgtgatcaacttagaactctacagagagtgctattaatattggtagccatcttccaagttgaagatgaatgtcatggctttaggaagaaaagataccgttattcatttcactcaagtcaaataggcaaatgtttcttatgttcaaaaatgaaagggagaagagtattatctacaagacaagtatcaaattgcatcagtcaggtcagattggtgtttccctctatgcttcagtttatatgtgaaaagaaaatagtcattgtgtttatgtaactttcagtatttccatagaatcacagtatcttattctgatgttagctagtccagactttcacccaagggggtgttaaggaaaatctgcaacaacttagctgttaggtttttgtttgaattcttttagtgagaaagatctctactgcctcatgaggtagcacattctattgttcgatggctgttaaagtaagtatgtttttccattacacagagccagtctttcttcctgtgtctttcatctgttagccctaattctgccctccaagcaatgccaaataagttggcttcctcttttacatgatatttgaatatacagttgtttcaccttaatcccttctcaaagtactgtttatgattatatgtttagcagtatcttttctttcatcccagacaatattattagcctatgatattataattgagtaactaaactatttactcccaaagctactgtggatagactgacttgaaatcaagtttcattcagcccatttactgagtgcctacaatgtgcaggaatttggtgggacaatcaggaagtctggatgaaatgagacgctgtcttgtgagagagttgtatactgctgcatcacctttacaaagtttccttttatcacaatttgttgtgtctctttattcttttttttaacatcaaatcccgttttgacattaatattactactcctgcttttttgcttatttacatttgcctggtgactttttgccctacttgttattttctttctttctttctttttccttctttctttctctttctctttcttttttaatttttcttttctttcttttttcttctttatctttcctttctctctctttctttctctctttttttctctttctttctttcttcttttttttttttttttttttttttttgacagagtcttactctgtcacccaggctggagtgcaatggcacaatctcagcttactgcaacctccatctcccaggttcaagtgatcctcctgcctcagtgtcctgagtaacgggcattacgggcacctgccaccacacccaactaatttttatatttttagtagagacagggtttcaccatgttggccaggctggtctcgaactcctgacctcaagtgatccacctgccttggcctcccaaagtgctgggattataggtgtgagacaccatgcccagcctagatttagctatattttttataaaggactgtgtgtgtgtgtttcactactgttttctctcctccaacttcccctaccttgaagtctatgttctgaatcattttttcatttacagtcatttttccagaacattacttggtgatttgtcatctgaatctttgcattctaacaagtatcattcttccattttgattagtgaatgactggatgtaagatttgagggttgtatggcttgaagagatatgttgatgttaatttactattttctagtttttggtattgtaggtaagaagtccaaagccaatattactttttcctttgttagtaacccaatcttcctattaaatatttggtagcttgtaagattttctgtttatttttgaaattccaaaattgtaccaggacatatttaggtttatgtttttgttttgcttttttttttaaatcaatcttggctggaacttagtaaaccttttcaatttccaagtccaactcttctcaaataaataaaattttcctcttttcccccctatctcttcctttatttccttatggaattcctattggtagtatgtcagtctcttgctctgtcttcttattattttctgcatgacttctatcttttgcacttttgcacaatccttggagatatttctaccacttgatcttccaagcaactaattgaatttttgacaaggactgtaattaccttcatctactaaatcttaaaatttgaaaatcacatattttgttccagaacacagtgttaatgtcataattgaatctgtattagtgttttaattgcttattattgttattaaaattatctattgccccagaagttttatttctctaggtatcctaaatattatgctcattcttccactctccagttggttgttacttaggttgctggtattttcctctccctactgaaagttcgattcaccctaagggttctggaagctgctagggtactttgggcctggtgagaatggagttacagtgggaaagaggatcatgagtggcaaaaggaagagaagtgtcaattcctgaattagcaaagcacaaaatggcaagctgctagtcttctattaaagtacaaaaaataaacagtccaagcctctgtgcttcctggacggttttgttgtgaaggctggactttcccagcctttaaaggatagggcagtcttagtattttttcaagtagacttcagacttctgggtcaacctaaaaaaatttatagctttgcccttgatctggatcccaaccaaccacaaattcttagaatcagtgaatgttagagatgaaaaagacatactccaaatgtcctcattttatagataaagagaataatacccccttccccaaaaaaatgatactagtttttcaggatcatctaggtagttagcagtagagataaaacaggattctagactttgtgacactcaggtcttcaattaatggctttatcttctgttgcctagtacatacattcttagcattaaagcaattgtcttacagaatgttttcatgtaatattggtactctaagagaacaatggttaggtatttaattattcaaatgaaaatgaatgggaagtgttagtaaatcaagattcatgttagtattagaattatttttggctaggcgcagtggctcatgcctataatcccagcgctttgggaggccaggagttcaagaccagcctggccaacatggcaaaactctactaaaaatacaaaaaattgccaagcatggtggcacacacttgtaatcccagctacttgggtggctaaggcacgggaatcacttaaagccaggaggcagaggttgcagtgagtagaggtagcgccatgcactccagcctgggtgacagagcaagaatctgtcttttttttttgagaaggattcttgcactgtcacccaggctggagtgcagtggcacgatctctgctcactgcaggctccacctcccaggttcatgccattctcctgcctcagcctcccgagtagctgggactacaggtgcccgccaccacgcccggctaattttttgtatttttagtagagacagggtttcaccatgttaaccagaatggtcccgatctcctgacctcgtgatccacctgccttggcctcccaaagtgctaggattacaggcatgagccaccacgcctggctgactctgtcttaaaaaagaaaaaaagaattatttttcggccaggtgcagtggctcatgcctgtaatcccagcacttttggaggctgaggcgggcagatctcttgagcccaggagttcaagactagcctgggcaacatggtgaaaccctgtctacaaaaaacacaaaaaatattatccaggtgtggtggcgcactcttgtggtcccagctactcaggaggctgaggtgggaggatcgctttagcctggtatgtggaggctgcagtgagctgtgatcacaccactgcactccagcctgggtgatagagtgagaccctgtctcaaaaaaagaaaaaaagagatttatctttaaaggaatggctaagcaccatccaaattaaattaaaactgcagttgttaatgaagaaagatttaagtgatatcatgatatccctttaagatatgccactctttgtgaaaagggaaactactgatatatacctagaaaacttaatctgcttaatccaatagcccctctagtggcagtggtgagaataagtcaaattttagaagtacaaattttgtttctatcagtatttggtatatacaaataagatttatatatttatataaatgctgataaatagcttttatctgaaggtgttttatgtgtaacaaagtgtctttcataatgcaaatattactatatttagaagaagaatagagaaaacacaggatgagtttgaacctaatactacctatgtgaacctcagtgtcctcttttgtactgccttcctcacagagttgtgagattaacacataggtgtgaaaatgtattttttaaaaacattagtattgtcattaattatatttcttggatattaattgatcttatatgtgggaagttctgtcttaaatataaggtcagattataatgttttgtagttttagcctcctatcattgagaaaattaatataccctgcttgctttatgtgagaaaactgagaaaatcatgaactgttttctctctattatattattcatgattataacccttgttacctatttcctcttatcactattcagagtaatctttgagttttagaaagaaaactcagtttttatatgttaaaaatgaagagtctgggggaaggaatatgaagtaaatattggaaaatattagcatttgtcaaatctgagcgatggatacatgggtgtttgttatactgttatgttggaaatgttttataatttaaaatatagcatgaatcataaaaaagaaagcaaatttatgatgtgaataggcccttaagctatggttaaccaaaatcatagttttcatctgaacatgggattctgaatcatgttcatttcattccacagagtgatagtaaaatgttcacacatgcagttttctgctggttacctcagacaaatccatacctcttgccacagcatcctctcctttttttttttttttttttttttttttttaaattattaagagactaggtctagggccaggcacggtggctcatgcctgtaatcccagcactttgggaggccaaggtgggcggatcacttgaggtcaggagttcaagactagcctggcaaacatggtgaaacccatctctactaaaaatacaaaacattagccagccatggtggcggacatttgtaatcccagatgcttgagaggctgagacaggagagttgcttgaacccaggaggcggaggttgcagtgagccgagatcgcgccactacactccagcctggtcaacaaagcaatactccatctcaaaaaaaaaaagagagagagagactaggtctcactacatcacccaggctagaatgcagtggctattcacagatgtgataatagctcgctgcagtcttgaactccggggctcaagcaatcctctcacatcagcctctcaggtagctgagactacaggtgtgccaccgcacttggccagcatcctctctttctgatgattctggacaagggtccgttctcattagactctttcttttatggtatattacatgcctttaaaaaactacacaatcacttctgattaggcagggagtggaacaagcatttaataagaagccagagtttgtagtcctggctctgccatttactgctctatctacactttgcctctctgaatataacttgccttttcttaaaatgagcatagtaataccttttcagtctagcatacagatttgttgagagattatagcatgcaacataaatgaagttatagatcccctggctgttgtcatatgttggtacctgtctctctagtaaggcaggatgtctgatcaaatctccagaagccagaagcgtacaacagaaaggagagttacagagagtagcaaagggggatagagtatggcaggacccaaataactggcccagcagtgacaatggacaagataacatttacaactttgagattcaatgattttgtgaatatactacccacagagtacaaagtatcattgagcatattctttgaaacatgataaatttcagtaaggatttggaacaaaatccctttcagctgatttctgcaaattagaaaatttcatgtagagaattgatgtctctgaggtttcacaaaataggaaaaaaacatgtttcccagataacatgaaaataatgagtaaggctggcacggcggctcacacctgtaatcccaacactttgggaggccaaggcgagcagatcacctgaggtcaggagttcaaggccagcctggccaacatggtgaaaccctgtctctactaaaaatacaaaaattagcctggcatgttggcaggcacctgtaatcccagctccttgggagactgaggcaggagaatcgcatgaacccaggaggcagaggttgcagtgagccgagattgtgccattgtactccagtctgggcaacaagagcaagactccatctaaaaaaaaaaaaaaaaagtacgataaagcactgaaaagtacttatttatagtaatcagctaggctccagaacctttatccccctacagagatgaataccatgatggtgtgcatctcactgctgctttgtttacagtagctttacaataattctatagaatcaacatattgtagttatatattacaaggtttgtaaaattagctaatatctttttctactaacataaaattatatttgttgatagtattcattacccagtcagtattttgaaccacattccatgtgatgctgtgtttgggatgttttttccatttactccatagtaaatgaggaaccattggcttagcataatgataatatgatccagcaaggcaaggagcccagaactctgggcatcaggaacccatcacatgcatattgtgtagtatttcaatacaacagaataatttgctgtcttttttcctaaatcgaaatgaaaaggatagatgagaaatctgttcaaaatacataggtcaaaaatacgttaagtacaacattattcaaaataattctgagatgtttgcccaactagtttaactttgaaatttatgtcagggtttttttttttaagtctttaatgttttacacatagattctaccttcagttaatacctgggcacttttttggctgcctatgcaatgactgactgaatgactttaaagggtctctatgttggtaggctgaaccttatatgagccatttttcaaacttttacttttggcccttctccttgggagcttgcttcccagagtcagagcttgtggacaggccagtgctagaggaaagggagaattttacccagaccctgtaagagaacctcatagtaaatgaagctattcaggttggaaccaggcctaccttgccatttggacctttcatatttagctctgtgaatgtatttaagtcccagtctatgattttcttgtgtgttactcatgagtattttccagaataaaaatcccaagcatgctatagtcgaactttgccagtttgttgggtatgtttgtgtgattaacttgttaacatagcagcaatagtaatgacatatgactttcttgaaaacctagtttgttccaggtactattccaagtgttttatatgtattaataggatgtcatttaatcctcataacaaccctattatggctactttacagatgaaaaactaaggcaaagagaagttaagcaacttgtgcatggttaaacatctagcaagcagtggtgctaggatttccactcaggcagtctgactccagagttcacattcttaatctctgtgctatgccacctcctgactagcttatctcttatagagtctgtgaaggttgtgtctctggtaggtctcaagttctgcctacctctgtcacacctggataaaaattgaaattatatcctagttacaaatcatgctatcttgagtcactaactttccttcttcctctctcatcaaatagtgcattaaggtaagggggcatgaataaacttcactgccatgagatatttgtgagaacatatgctgtctcgttgagagatcatttgttttcaagttaacaaaaacctgctgaagctagtgcaagcaaagaagacatttatggaaggatacaaggttatctcatagaacccaagagcaagaatacagctgggcctcaagggggatgaaaggcaggtagccagggttactccctttttagttgttctcattagatgtccatagggaagaaagggaaaggaagagtcaggcggtataaataggtaagaatttttcagacaacaagagtatggctagatatatactcctcaaaaagtatattttctgtactgcatcaattgaagggaaataccaattacaggtcgcattgcccagtagatttgtatggatttaaagtaataactaaacaatccctttcaactattcccaatcatcctgtcccttcataagtcttgattcttggcattttgtttattctcacttgatcagtctcaagttaggacttttcaactgttctgacacccaaagataagacccctgttttcatctcttctccccagaccttcaacctgtaccatcaaagagcctgttgcacttgccttttcaagtgacagtcaggaacctgcctagcttccattcctaatattaatatcctatatgagtagttcataccatctctgctttccttgtccttttccccctaccttttctcttcccaacattatgaatacctactggcttttcctatttctagggatcctcccccctccatttcctattagataaactccaaattcatcagcttgagggttcttcaaaatcatgtcccatcctaactgtcccagtcattcccactcaagtccttcactctaagcaggccattttccacagtgacctagaaacagcacaggcttaaccattattccaagcctttgctagtacagatcctcttgattacaaagctctttcccattcctttcctttccacctctctgaatccagctcatttctcagggcctcacctaagacattctctctaaagagtcctatgtgatctttccaacacctcaggtaaccaattgtccaggattgccttggattcctaggacatctgactttagtactaaaacaggaatattcctaggcaaaccaggatagttagacatcctccaacatctcattgtctcctttcattatagtggcttgttagaataaaaagccctgtgaaatcgccagtagccactacttcagcatgtacaaggtcctttctccataataagacttaatgctcctgttaggcagagacccttttgattcccacttcatacagaatatagtgctgtactcatgttaatgcctattagtgaataaggcgatgtagttttaagttggcactatatctaaaatcttttccttgtgtgttaatttctttgtctttatttttttccagcccagatgacttactcaatgccttgaatgagggtatcagtcgtgctgatgtcatcatcacatcagggggtgtatccatgggggaaaaggtatgaaagatagggctcgtgaaaatgtatctgctgtaatgttcttgcatatggtcgattaactgtggtctggtaggcatctgatattcataacgaggctcccacaaagctgaaaatccatggggcttcagaaattactggtctctttaaaagggatacaatgtgggtaggtcagggagcttaccctcaggagcaacctggagaatcccacaacttacagaatggtttttgctattcctgtggaaacttctgacctgtttctcactctattttactacattaggacatcctttatgcatgatatttaccaccagggtaaaactctaagatccttccttctactcaaatttaaacatgactccccaggagccaaccaattcacccaccatatattccaaatctaccaagaatgcttagctccccttccccacaaggaagaaagggaggattaggcattccttttgctcctccttacaaaataatataataataataatgaaaatatggccaggcacagtggctcaagcctgtaattccaatactttgggaggctgaggtgggtaggttgcttgagcccaggagttcaagaccacctgggcgacgtggtgaaaccccatctctacaaaaaaaatccaaaaattagctgggcatggtggcacgcgcctgcagttccagctacttgggtgctgaagtgggaggatcgcttgagcctgggtggtcaaggctgcagtgagctgagatcacaccactgcactccaacctgggcaacacagcaagaccctgtcttaaaaaaaaaaaaaaatatatatatatatatatatatatatatatatatatacacacacacatacacaaatattttataggactaagtgtatttgtagatggtatatacttgttcctataaagaccacaatttgaatatttcagtaacactaagtttacatttcttaatgaaatgtgttagtttacgatgactattgggtctactgaataatgttataaaagtaaaatattgtttactaaataaccaagcttaatttttggctcaaagatatttcagtgtaaaatgttttgccagctgataatccttttccatgttttctctcacattaatgactaaactgaaaaattacaaaaatactgtcatagcaatttttaccaaaattcatattttctaagagtttgatttattttaaactagatcttacgtatatgattgttcttgatctctgtcctcttgtagctataaaactgcctaaatttataacctgactctttggacagtgaactctgttggctcggagaacaaatgtcagaacttagcaacctgaacagaagaatgcctgccttccattcacaaactttagtgtcagagcctttcagaatagcactgcagatgctaaaaagtttggaagaaaaaaatctcacattacatccaggagtgaaagtgttgtagtgtgtgtaggtgttcttaaagcagacaaattgctggattagtgttccctcaaagtctcccagagtctttagccccaggtagagcaaattgccgcagagctctcctgagatcacaaaggctaggggctgagatctgcactgtagtacagctgaaagaaataatttgcaacttgtctgttttcattaccatcaaactgcctgtggtactctcaatattacaagagcaaaccatgaagtcaggtctatttaaatgttaaatttgttatttccagggtttgtgtcttgttataatttctcttagtttctgattaacctaattgtgggataatagctatttggcagaactaaaacgtttatcttttctagtactctggagaggtaacaaactcatagcatacataggcttggcaattgtggctcaattgtggtaaggacagaacacttctcaacctaaccttctttattagtgctaacaaagatgtcagttatgccagggatttgctcaccagtaaacaaagccaatatagttaagcatattggttttattttttttactctctgtataataagatacttacactaaacctttaatttactaggaaagaaattttagaaactgggcatcccacggtattccttaggagctgctaattgtcccttcctacctccttgagtgggaatgagatgatagaggaaccaggaagaaagagataaaacatacatgcagcaaattcctgccagcaaacaagttttaattccaaaaagaatttagggtacctccatagtagaaagaaaataataaaagacagaacatttgcttcagcccaggagctaagcctgaaaaccagttactaaaaagacagggaaatcaaggaaaaattcagaagtattatgtagcaggcatgaatattaagtgcagaacctcaggtatgcaagaaatgtatttaattccatttaaattatactctaagtgcctatgctacaggactggtgggaaattttattaagccacaactggagcttactatctccaagaattatgacaaggaacctgaaggtacttaagcagcaccaaagcatcagggagacacagctggtcactggtctgcactggatacatctagagtattcttatagtaccattagatctcaagtctttgctcctttgggccatgctaggagcactaagatcaggtagaggctggaaacctcagagcagctagcctctttgggtgtatttcacagccatcccttctaaagtctgaccacttctccaacatactgcatgctaaacagcgaggaaggggccctgctgcttgttggactcatagaccagtaccttcttcccagccaaggagaaatgattcttccacagttacttccctaaagatctctcccctccttcacctcaccctgccctacatactcttttcaaagagtttcatttttacaaaacactgaaagcttgttaaatagttaaacagtatctgccttttgccatgaaaactaaagaatcatatgcattactataagttttcttcgacctacaaaattattaaataactcaaagacaatgaaaggtggcaataatccagaaggatgcactaaactggacaccagtgaccttttttgctcatttctaagtctcttaagttttgctaatagtgtctccaccaccccttatgatcaaagtaatcacatagatgataaccgatcacaaaaaaggctggtttcatgaggtttgcccagttatttagcaataagagtgttaattaaccatgtaagctccttgatttgttttgtaagtctagagccatgtagccttagaatatttaaaagtaattggctgggcacgttggctcatgcctataatcccagcactttgggagcccaaggtgggcagattgcttgaggccaggagttcaagaccagcctggccaacatggcaaaaccccacctctactaaaaataaaaaattagctgggcatagtgacacatgcctataatcccagcttcttgggaggctgaggcacaagagctgcttgaacctgggaggtggaggttgcagtgagccaagatggcgccactgcactcctgcatgggtgacagaggaagactctgtctcaaaaaaacaaaacaaaacaaaaaaaactaatcaatattccaaacatacacataaaaaaattttctttaatatttcatttatcctacatcattcttgttctgctaaatgttgagttagcagtctgctttcctgaagccatcagctttgatactacataaaagttagctaagctatatcacctcagaagcctgtactcaagaggttattgtttgatatctcaatagcaatgttaaagtgcctattactctccttttccctaatgctctaaatctgtctctgtttcgggcataaactattgactatagcttgtagcaaagccttcaggcaagcaccagagtaaaacagaaattctctgtggatgacaaatacttgagagctgtgcttaatttgcttccataaccaataatatcagaatagaagataagtgacattctcttttgagatacatatgtaagtatttcacagtagggttttttgttttgttttgttttgttttgaggtttttgttgtattttgttttttgagacaaagtctcactctgtcacccagggtagagtgcagtactgccgtcatagttgactgcagccttgaattcctgggctcaagcaatcctcttgcatcagcctcccaaagtgctgggattataggcgtgaaccaccatgccagcctagaagttttaatcagcgtttcctctgagggtaaaacagcaaaggcattgtcaaatttccaggaacttcccgtaaagcaaacaatttctgaaatatttctattaataacagtttacctataagaacctaacctagggcagactgagtatctcttctcagatatggcagctcctctcatgaaactttaaacaaatctaattattcccagcatttctttttatagatgaaaacaaacctgggattttctagaggccctctaggaaattttaaagatgagttttggtaagaaaagcacattttttcctaaattttggtctgatctttaaaaggcaaaaatcaaaaaagttattaaaaaagaatggggcacttgatgaagacctgagaaactacttggttacctaatttttcaaaacaataaaatatttgaaaatgaacatagaaggtaacatgactgtaaataaccttggctcaattcataaataaggaacctttgttcttcgcttttttatttctttaaataaagataaacagcacaaaaaggcaaattacacaaaaagaataacctttcttattgtaggacaggcgttaatcagtaccaaagaaagaagcacatcaaaactcagcaaactcactaaaattttaatatgtttctcagcttcacttcaaacacagttactagaaaccagggcaaatacaatctcatgaaagtttgtcctttattatgctcttttatattctggaacaaattgacactttagagcaaagaatagtcttcataaccgtaagggtccttgagaccttttaagaggacctgcaaggtcaacactattttcataataattttaagactttatttgcttttttttttttttttttttgagacagaggctcgctctgtcacccaggctggagtgcagtggtgccatctcggctcactgcaagctccgcctcccgggttcatgccattctcccacctcagcctcccgagtagctgggactacaggtgcctgccaccatgcccagctaattttttgtttttgtatttttagtagagacagggtttcaccatgttagccaggatggtctcgatctcctgacctcatgatccacccgcctcggcctcccaaagtgctgggattacaggcgtgagccaccgcgcccggccagtttgccttttttattccacttctctcattctctttccttttctcatgagtgtatgcttgagttcttccagcagctaaatgatgagtgatatctcatcagattgagtgaatcagatatgagaatctgacttctggtaacccagaagttaaagagattttcaaaattataaaacaacgcattgaaaataaattactgggctgggcgtgtggctcacgcctgtaatcccagcactctgggaggctgaggcgggtggatcacctgaggtcaggagttcaagatcagcctggccaacatggtgaaaccccgtctctactaaaaatacaaaaattagctgggcgtggtggcgggcgcctgtaatcccagctacctgggaggctgaggcaggagaaccacttgaatccaggaggcagaggttgcagtgaccccagatcatgccattgcactctagcctaggcaacaagagtgagactctgtctcaaaaaagaagaaaagaagttacttatgttaacatgaaatggctttattgttgttattttcaaatgaaccaaatgtttttttaatttcttagttttaatttctaatatagtaaatatccatagctatagctcacataaacaaaaactcttagggatccttaatgaattttaatttaagaatatgtgaaggggtcttgagaccaaaaattctgagaatcgggccttaagaaaaaaatattatttttccttgaaaaacaaaagaacacttatagttatacttctctgtcattattgttccttatataattgcaactacccatattaattatgatgtttaagaaaataactaatatctgtgtcatagagaaaactagggagcttggataattgagaaataatatgtaaccattttagcagactagcaaagctcataaacacaaagaacacaactttctactgcgggacacatcccttttacaccttagtgtagcaaagatgaatcaacacattcattaacatgacccaaaaatacagcctttccagcaaaatatattcaccttaagaagtacatagttactaactatatagttttaatttctatataattaataactatattctttttaaaaagctaataacttaaaatgatgcttaataataaatgctctaatactctatcttagaaattaggtatcttacgatgatttattaatcaattcagtttaatatcaactcaagattttaagtaaataaaaatcttaaattattttgaaactgacatactataaaacataataactattaacattgtaaggttggccgggcgcggtggctcacgcctgtaatcccagcactttgggaggccgaggcgggcggatcacgagatcaggagatcgagaccatcccggctaaaacggtgaaaccccgtctctactaaaactacaaaaaatagccgggcgtagtggcgggcgcctgtagtcctagctacttgggaggctgaggcaggagaatggcgtgaacccgggaggcggagcttgcagtgagccgagatcccgccactgcactccagcctgggcgacagagcgagactccgtctcaaaaaaaaaaaacaaaaaaaaaaaaaaaaaaaacattgtaaggttttcagaataattatttgattttgttgatcacagttttatacttttttataatcttaaatattatataggaaaaatgtgagattatttgataaataagcctatagaagtttaggaaaaacccaagtgaaataaaatgtatacttgtgttatacttaagattgatgtaaataagagaaagaacatggctgaggtttttttattattgttatttaagtttggggtttgttttttttctttgtttatatgtatgttttgaggcagggtctcaatattttgctcaagttggtctctaacttctgggcttaagcaataatcctcctgcctcagcctcccaagtagctagcattataggtacacgtcatcatacctggcttttgggtttccttaataactggaattattaagttagtctcatttgctacagatttatcctaattatatgaactcacattctcaaaattataagtagaatattttcagtgtagcatatttaaaatattgtaagttaaaattatttattatctaggaattttagaaatattttatataagaacttactatctctctcagccagttagaacagggcatctttaagagacgatataatttatgaataccttacagaaataggaaggcaaacacttcacactcacaaaatgaggtaaatgtttttctgtattacagacacgtgaacacacagacagataagaaacacaatagcttcagttctacttacaacttgagctgtaagtcaagagtaaacacagaaccataaatattcatcagtccactcataaagagctattttctttcctagagggcacaaaaatcttaattgatttggcctcagaatggacaataagagaaataaacaagaaagactaataagccagattctctgtcttctcttaaccaaacaaaatagatttgtatcatccttttacagagatcaccaaatgattagaccataaaaccaaatccctaatcattcctgccacaaggggcaataccttattggccgtgtgcagaaacaaaaacagaaccaaaatgaatacggaggccaaaatagagaaaccaaaagttaccaaagttacagttttattgctgcttggaattcactccaggaaccaaggaaagatgtaccctttgtttgtttgtttttgtttttgtttttttgagacagtgtcttgctctgtctcccaggctggagcacagtggcatgatcttggttcactgcaacctccacctcccgggttcaagcaattcttatgcctcagccccacaagtagctgggatcacaggcgcatgccatcatgcctggctaatttttgtctttttagtagagatgctgtttcaccatgttggccaagctggtctcgaactcctggcctcgagtgatccgcctgcctcagcctcccagagtgctgggatttcagacttgagccaccatgcctggcctgtacccaggtttaagccactcataaagtgtacttctctgccaatgaagtttaactggctctgtccaatgaatcaatggagcatctcagtggagcctctggaattgttaaagtttaactttttatagataaaatcattaatcttgattttgtctcctttcttggcttactcactgtacctcgtttttgtaaataaatttagttgtttcataagtgttcatagtatgtataacttctatattctacctagaagtgatattaccacttcgtgtatagcataagaatcttacaatgatatacttctgtttttcccctctcaacatctgtgctacacttgccataaatgtcatatttacatatattattgaaccttcactatatcattatgatttttctttaaatgataaattacttttagcaaatgttatatgatatttaaaaatcttacatatttgcctatgtaaaaaaattatgaatctcataaatatataaaatgaacatgtttccaagactttatttaactcaacaacgagcaaataagatgctatgacctattcaaaggagaattcaaagaatatacccatttcagcattcttgactacccaggtaatcaggtaatcaagaatgctgaaataatttgctaatagatgcaaaactgatctatacccaccacagaataatcaattacatctccactgggcagaattcatttgcatttctttggaataaaattatgttcactggcggggcgcggtggctcacacctgtaatcccagcactttggtaggccgaggcgggcagatcacgaggtcaggagattgagaccatcctggccaacatggggaaaccccatctctactaaaaatacaaaaattggctgggtgtggtggtgcatgcctgtcatgccagctactcaggaggctgaggcagcagaatctcttaaaccagggagtcagaggttgcactgagccaagattgtgccactgcactccagcctggtgacagagcgagactccgtgtcaaaaaaaaaaaaggttcactgtcttagcttaggctgctatttaaaaaataccaaagtccaggtgcagtggctcacgcctgtaatcctagcactttcagaggccaaggcgggcagatccttaagccaggagttctaaaccagcccaggcaacatggcaaaatcccctctctacaaaaactataaaaattagctaggcatagtggtgcttgcctgtagtcccaactagtcaggaagctgaggtgagaggtcaaggctgcagtgagctgtgttcacaccactgcactccagcctaggcaacaaaatgagaccctgtctcaaaataacaaaaaataccataaaatgggtggcgtaaacatttatttctcataattctgaaggttgggaaatccaagatccaggtgacagcatggatgggttctggtgagggccctcttccaggctgcagatagctgacttcttttaccctcacatggcagaaagagagctagctaactctctggcctcttcttataatggcactaattctactcatgagaactccaccctcatcacctaattacttcccaaagcccccaccatcacattgggattggagtttcaacatatgaatttgggggtggggagggacatattcagtccattgcatttactctcagttttattcagtttcattgctgtaaaatagctgaaaaatacaaataaccagaaagtgggtgttgcactggacacccagtattcttttctgcccatttcaaagttttgcacaatttttctgaccactggtgtttctccttacctgagttgaagaagagacttattccttcatccattcatttttcttcttctcatatgactctggggttcagaatatcagacaaagatccttgctgcttcaataggtaaacaaaaatataagaacaatgatgattctcagcctttatcactatgtctggtacaagttttctgtctgtcacaggagcatgaagcacttcttcatgttcaaaaagaatgaaaagggctatttttaaaaacaattttttgcaagaaaaataaaacactttcattcatttagcaaatatataagcatctgctttccaaactctgcatcataaccttcaaggccctgcaactctggcttctgcctatctcttcaaactctgcttatacctctctcctactcattcactaccatccattgccttttcagttccatgcacgctttgccactttggaagctttcatttgtatgtcccttctctggaattctcttccctccacacttcacatgcttgaatccttcttatccttcaaggcttagctaatatatcactacctcttctagaatgacctttcctattccccacaccctcatcattttctatcccagcacctgcttatttccttcatcgcatgtaccacaaattataattattttatttgttggtttacttgtttttggctatttctctccagtaaaatgtaacaggatatctttgtgtcagggactatgtctttcttctgtaccatgaaatgcgtagcacatatggaattcctaatacataataggcactcagaaatgtttggtgcactaacaaatgaatgagtgaaaggtgtatgctattcattaaggattcattatatagatatagatatatatagatatatataaaagagaagtttcctgttctcaagaactttatagtttaacaaaggatacatatcagctatcaaagcagttgctctataacctaagtgcataatgttagaagcatttagtgctataggagcatataagaaagacctgaagatttctgcttctgctatgatagaatagcatatttggaccaattctcccaccaagaacatctataaaaactatgtaaaattttttaaagaaaagcaaaagcagatgtctgaagaaaataaccaagacagccaggattccgggcactaagatcccagagaaaaagtgaaccacagagaagtaaaactggaattcttcaccatatttttcctcaaagcatttactaattcctaagccaggagtgaggtggggtgagagctattaatactacaggaggcaaagaagccaagcataaaaaagagtagctaagaagctaatgaaataagcagaattttcatgagtcttatgagttcaggacctgttatagaggaggggccctggtaaatatctcaggctttcagcttgaagggctatgctttaggaataaagacaatctgcagataaactagccttcacacggactgaaattcagcatcaaactatctcaatccctgattagatcaagataatctgagttttccttaactgccagaagacctcaaattctttttggaggaatatatcattgtccaaagccttttcaattttttcatacctgatatttgggcttcaatctgaaaagttgccagacatgctagagatagagcaaaatgactaaaaattaagataggaaacaattgataaagtagacctaaaaatgatgctgatacttatattgtctcacatggactttaataaccattatatgtttaagaaaaagggatgacaaagtgggaaatttcactagaaaactggtatctattcataagaatcaaattgaaattttggaaaagggatagaaaatatagaaatgagcataaaagacaaatgggatgtggtgaaaggtcaaacatatatgtagatgaagtctaagaaggagaggggagacagagtgagcaaaacgatatttaaaatattggcggatagttttccaaaatcaataaaagacatcaagccagaaattctaggagctctactaatctcgagccggataaataaaagaaaccatacctaggtaatcagcaaaactactgaaaactaaagacggagaaaattttaccagaaggacacattgccttcaaaggagcaacaataaaactaacaaatgatttaaatggaaatgatggaacccagaaaacaatggactgggatttgtaaaatgcaggaaaaaaatactgccagtagggaactctatagtcatcaaaaatgtacttcaaaaatgaaggtggagtaaagacaatttcagccaaacaaaaactgtgcggacctagactaaatagagtttttaaggtggaaggattatggaagcatggaaatgcagaaaggactaaagagggttaacatgtcagcaaatgtaaatgagtgttgatcatgtaaaataataatgtcttgtgaggcttaaaatatgaatactatatagtgaatatataaatatcaagtatatattgtcaacatagtatatgtagaaaatatatacaataaataaaatacatatacttaaaatataaacatatacatgcacatacgtatatgcttaaaatgcatgtaaaatatatacacacaatagcatgaaaggtagaaaggcataaattgagttgatatgttttaaggttcttgtattgtctgggaagtgatttttaaaaacccagttatgagtagactgtaataagtcaaggatgcatattgtaaatctctaaaataattactaacataataatataagaatatgtaactaacaagctaatagaggggaaagaatattaaataaaaaatatttcatgaatcctaagggaggtatagaagaaggaaaaaggaaatcaaagcagaagtgacaaatggtacagtgatagttttaaacccaaatatagcagtaatcatactacatgtaggccaggtgcggtggctcatgcctataatcccagcactttaggaggctgaggtggactgatcatgtggggccaggagttcgagaccagcctaaccaacgtaatgaaacctcgtctctatacaaaaattagctgggtgtggtggcatgtgcctgtagtcccagctactcaggaggctgagacatgcaatcgtttgaacccaggagacagaggttgccaacgtgagccgagatcgcgccactgcactccagcctgggtgacaagtgagactctgtctcaaaaaaaaaaaaaaagaaaaattatactaaatgtaaatagactgaatccttcagttaaaaattgtcattctggatttttaaaaaaacagctaatcatatgctgcttataagagacacatcttaaatattataaagacatagaaaactgaaagtaaaagatttgaaaaagttacaatgaaatatagctggtgtagctatattgataacagagaaaattctttttcttttcttataatacatttttatgtagagcaaatagagaaaattaaggtaaaaaggattactagatattaggagggacattttattattttaaattagttaattcatcaggaatatgtaagtaacatttgcaaatttactatatctaataatataacctcaaaatgaaaaatacgtgaattaattaattaataatcaacatttcatctagtcccccagtctttggagttcagaggaggctgagaagatgactgagactaagataaaggtgggatagacagtggggtagaaagagtattcaaggcagaaaaaagattttcaaagactggaggcaatagcttaagaaactggccagatgcggttgttcacacctgtaattccaacactttgggaggccagggtgggtggatcgcttgaggccaggagttcaagaccagcctggccaacatggtgaaacgctctctctcctaaaaatacaaaaattcgccgggcatggtggcatgcacctgtaatcccacccagctacttgggaggctgagggacaagaattgcctgaacccaggaggcgaaggtcgcagtgagccgagatcatgccactgcactccagcctgggtgacagagagagaccccgtctcaagaagaagagagaaagagaaaaagagagagagagtggcggcgggggtggggcaggggagaaggaaggaaggaaggagtcttgctagaatgtagacggagagaaagattgataggaatgtggctgggtgagatggatgagaacaatgattgggggggctagaaaatataggaatatttgatatttaaaagatgatatggcctggtgcagtggttcacgcctgtaatcccagcactttgggaggccgagacgggtggatcacctgaggtcaggagtttgacacaagcctggccaacctggtgaaacagtgtctctactaaaaatagaaaaattagctgggcgtagtggtgcatgcctgtaatcccagctactcgggaggctgaggcaggagaattgcttgaacccaggaggaggaggatgcagtgagccaagatcgcaccgttggactccagcctggaggacgagagcaaaactccatctcaaaaaaaaaaaaaaaaaaagatactttttcctaaaaaccagcaacttattaaagtattatatagtcacttgatcaaatttatctcagaggatctctgttactactgtggggagaatgaattggaggagggtggcactattggcaaggagacctatttcagcaatcccggtgagatgatgttggctgaggctgtagagatagaagggaacacatttttacaaataaaagtacctaatagtttgtgaaatatttaaaatgtagacaggttactggactcatttttagattagtaaaccaaaaaatttagtaatagacctaggtttttattatttaagagaaatgttaaggagtgcaatttttttctttctgtctacaacaccagctgcagagctgtgttatatttcatttccaaagatcagattttgtaatatcactgtgggttggtcatagccacaggttagttttgtttttaatactagaatataaagttggagtagttaaaactcccttgactttctgttttagagttcctttcctgtttttcattttagttgagctatttagatttgacaaatctaagtaatctgtgggcatatgttcaagtctctcttcaaggaatgtatatggctttaagatcattaagcagaatggtgtaggatacatacatgtaggtttcttgcccgggtacaacttaagacatatttgttaacatccttcttcagacataaaattctatcttagaagagaaacaataacgcaccagctaatgatattatacattaatgtagttgttttgtttttatctaacttctcctactagaatgtactttctgtgaggacagggatgttgtctcttttgttcaaggctgtatccccctacacatagactggtactcatcatataccaagtgttaagtaactatttattgaatgaataaatggataaatgaagaatgaaggaatatttgtgttaagcaaatcaactccattaaaataagaaagatgtttcttttcatttcaatcttattaatttaatgttcatttaaagtgttgaaagtctaatattaaaatgtttgaaagtaaagtgattatttttaatgtttgcaggactatctcaagcaggtgctggacattgatcttcatgctcagatccattttggcagggtttttatgaaaccagggtatgaaaatcatcttgttatctcatatatggggttggtttggcttgctttaactaacaaatttttaaatgccttctttttacatttcctattatgaattaactattccaaaaaaaaagaaatatagtattaggatcctttgcacaagtgcaggttctaatgaaataggaattcatcttccttatgagtcaatgagtttggtataaacaaaacacagcaactttccaaactttttctcctttttaattctcatccctagttccttcttcctctttttctctttttccccaaactgcttctttatctgtttttaaaaataattaatatgagaactctgaaatatacacaaaagtagggaacgaacccccaccccaccctgccttttagttgggagggagggctggtttgtttaaaagcaaattctagatatgtcattttggtatacatctgaaataataatactaacaacagcattctcttacctaatcacagtagtattatgtcatctaacaaaataaataatactttaatatcatctaataccctgatcatattcaaatttctcccatatatcaagaaaaagaatgcctttttataattgttttgtttgataaggattccattaaggtcgactcagtgtatttgtttgttaagtctctattaaatgagaacattttctgcccccaccctttttgttgttgttgtgccattgacttgctagagaaaatggatcatgtttcctgatgaatggatttggctgattacttccttaggttatgttcctctgtctctgatatatgctataaattgaaagatataaaggcttgattaaattcaggtttaattttttttttcctttgcaagaatgtttcattaagtaggctttcacactgtttcctactggcccctaggaggaaagaaaaataactaaggaaaataaccatgaatttgcacatctcttaaaaattaataatccctaaagaagggctgatggaggtcctgaagtcagttataaatcctcaaaggttgccaaacgttggtattagtgaaagatatggccatatctttaagaaatagtctatctgtttagacctttgctactctatgaacctatgatttcctgtgcagagacctcaactgtatggctgagagttccagcccacctccatgctgtcagggacaacagtaatgatgctttactgtcaatgaaccctaggagagaatggagtagaggcttctcagttgttgtaagtgagctatgggtaccatcaacaaatttcaaaagcctttaaagtatcaagctagccctcctaataagtacctcatgtcagttctaggatagagatcaggctttacctccacgatttggccatttttagtatagaattaagattattcctaaagctttgtccacaatttgatagaattcttggctttgtatttctgtagttgcatgttgagcatgccccaatatggctgctgctgatagggcctttttattatcgaaactgttgaattggggctgggcatggtggctcacgcctataatccccaacactttgggatgctgaagcaggcaggttgctttgaactcaggagttccagactatcctgagcaacatcgagaaaccccatctctataaaaaatacaaaaattagccgggcgttggtggcttgtgcctctagtcccagctacacgggaggctgaggctgaagaatcgcttgagctgggaagcagaggttacagtgagccgagatcatgccactgcagtccagcctgggtaacagagtgagaccttgtctcaaaaaagaaaaaaagaaaagaaaagaaagaaactattggattttgtcttacgcaaatattgttatgctattgggtataactgcttttttttttttctgagcccatgggcagtactaatctgattaggatacagaggatatcccaaaagcatatcagtgtgcttctcaaaacctcaaaaattgaattgggccgagtgcagtggctcacacctataatcccagcattttgggaggccgtgggggtggttcgcttgagcccggaagttggagaccaacctgggcaacatggcaaaaccccgtctctacaaaaaatacaaaaattagtcaggtgtggtggcacatgcctgtagtcccagctacttgggaggctaaggcgagaggatcacttgaggcggaggtggcagtgagccatgatagcaccactgcactccagcctgggcagcagagtaagaccctgcctcaaaaaaaaaaattaattgattgttctatttgcagagggaaagaagccaacacgacttgcccttacctctagagaagagttatttgtgtaatatctatcatttaaaatattctcagtgcctgtgataacttttatactctttttttcaatctgttatttaccactcacttcaactttagcagttcatcaattcctaacattttatttcctcccttaaaatcataacactctgacttcagccattgtgtaaatgctgttatagtctgagctcaagaggagaactgaataataggttttgagttccaaggaaatggcttccagagcttaaaaaaaaattcacagtttagcaataggacatttatgatagccatgcataataacaaaatatttttttgcaatggaatccttttttaaatgagtaactttacagaaattacattacctacctgcaagatgcaaaagattgcttaaattggccctataatttcaatgggctttaaatgcagtggaaggaagaaggtgttatacattctctcctcattcttattatctgtaggtttgctaaaataaagtagttttgaagtttaaatgggcttcttttagttcaccagaattttatgcttgtctaaaggtaataagaacttaaaggtaattgctacttaatattagaacaaaagaaatataaaacacacaaatacaatctggctttgctatttccacgtaacagtgctttcagaatgcaattaagctctttcattttagagacaaagatactcagaaaagcatttggagtatcagcaaccagatctaccaatcacggtttttattgcgtcatctacagtgagcatagctgttattaagaacaaatctttgaaattatttgcatcacacactaataatcattgccaaataacctatccataaatcagtatcaaaatcgaatctcatttttctaaaacagcaaagaatcaggaagtatgctaaagaaaagcctcagagtagccaaaatagatgtccaaagatcatgtactaacgctacataaccatcctgtgagatctttatccacatatcagctaaagttagaacaaccttggttcaaatctgtgttcctccacttagtagctgagtgacttggaccacattgcttaatctctctgaatctcagtttccatataaactgggattctaattgttaccttataagcttgttgtaagacttaaatgaaataattaatgtgatacatagatgttacttaaaaaatagatattttagccaggcccagtggcccacacctgtaatcccagtactttgggaggctgagacaggaggatcgcttgagctcaggagttcaagaccagcctgggcacatagcgagacctcatctctattaaaaataaaaaaaattaggtgggcatggtggtgcatgcctgtagtcctacctacctggaaagctgaggctggaggattgcttgagcccaggagatggagactgcagtgagccatgattgagccactgcactccagcatgggtgacagatcaagaccttgtctcaaaaaataaataaataaataaaaatagatatttttattattactgttattatgttcattctaacaatataactattgctactattctctggttctcaaacctaaaaccagctttaatggtcaagatgatagcaatctcgcattacagggtgccacaggaaaaaaaaaattgggaaggaataaaaaaacagaaacaagaactatagaaacatagcaatgtggggttatggtttatgggtgaaaacaacccatagtactcttgtgacctaacatcactgtattacagcagagtagtacacattaataatgatggctataaatcatcaaaagaagtcagtgtcactgtattattgcaaaaggtaaagagtgagagatctatttttgaaagatcaacctccaaaaagagtaaaaataaaacaatgtgagtgcttaaaaggttaatatttcatctgtatgaaaaaagtatgccctaagaattctgcattgcttaaggttcattaatataatgagatttattagctaaaattctatataaagggtaattaatagaaaaaaaaaacactattctcaactgcccactctatgccactcactccttccaccccacctcctatgataagagttcatgtcaaaatcttgaggaagtgtaatttgagaatatttttaaattactattaattgtggctgggtgcggtggcttacacctgtaatcccagcactttgggaggccgaggcaggcggatcacctgaggtcgggagttcaagaccagcctgaccaacatggagaaaccctgtctccactaaaaaaacaaaattagccgggcgtggtggcacgtgcctgtaatcccagctactcgggaggctgaggcaggagaatcacttgaacccgggaggcgggggttgccgtgagctgagatcacacccttgcacgctagcctgggcgacaaagagcaaaactccatctccaaaaaaaaaaaaaaaaaaaaaaactgttaattttgttctagtcatgatattttatttattttgatatttcaaaaataatgtcttgataagagggaagtgtttatgtctatgctaaggatagttttaaaaggctaatacagaaggagcaggattgaaagaaaaaggttaaaaaatactcattttgaacaataggcaactgtctgatagacatattatcaggtaatctgctttctttttttttgagatggagtcttgctctgtcgcccaggctggcgtgcagtggccatctcagctcactgcaacctctgcctcccaggttcaagcgattctcctgcctcagcctcccgagtagctgggattacaggcgcacaccaccatgcctggcaaatttttgtatttttagtagagacagggtttcaccatgttggccaggctggtctcaaactcctgacctcaagtgatccacccccctcagcctcccaaagtgttgggattacaggtgtgagccaccatgcctggccagtcttctgcttttaagaatgattgttgtaaatcgccagcaaaagtagtataaacattattaactagaggggtgggaaaacttggaaactccaagatttggagtacatttctatggcactggcaagaaaaaaaaaaaaagtaagtagttttctttaaaccagaaagtgtggttacttgaaaacaggaaatactaaaaacaaacttatttaagtgtctgtggaatacttcagagtataaagatgtaaaggcaagtcaacagaaaagtgttttttatatgataagtgtatggattacaaaaacactggagtacttaatgtattcatcatattgcttagcaatcactaacaagtgactctttttttcttctagcttgccaacaacatttgcaactttggatattgatggtgtaagaaaaataatctttgcactacctggtaagaataacaaattgtttcctttcctttttctggaaaaatagccaaaattttttggacttctcatgtgaccacctggtttgaaatctgaaagacctgggctcaagtctcagcttttctaaacgaccaatcacttaacctctctaggaagtttcttcacctataaaataagactaatatctacttcatagggttggtgtgaaagtcagattagataatatatatcaaagcacattccaaatcctatcaaagcacattccaaatcctaagatgatcatcaagtgttagctgtcactagatctttctggagcacctgctttttccttacaggaaattggtcgaagttagcagccgaatacctctcataaccagaagtattgtgctctagaggccaaaatgccttgagtcacccaagcaaataccaaatcaaaaaatacaaagctgcctctggtccttgccagatttgggctggttgaggggagggggaagaggaaaggccaggctactggaactagtgcttctcagccaaatcctactcatcatcagtctacaacttccccactcccacccttgtcccaacgtgagcagaaactcacatgttcagattatagaaagagcaaagcaggttcagttcacgatgattttcaaattcaaattttttgtgatttggggttatataaagtcatggtgaatcttgataaattttaaaataatttattgtgcatcttttttttaactttaaaattatcttctgatcattctgttcagttctctattttttggcacagattcctttagaaaataacctatttctttaagatttacaaatctcatggcttttggatctttgtttgttttttaggtcaagtatatctcaaaatggaaatgtaaagaaatggaagcaggcagaaaaatgttaaactttgaaaacattttaagcccctatctataagcataaaagagattagatttctatcatgtagaaaattttcagagagagaacatttaagtaaaatagtcctcagaatgtatctgtaacatgaaacgccttaggacctttcataattccttggatgctctgatagccattgtataaagaaatgtgctccttttcctagcttcatttagcctggaagagcctcttttgtctacggaagatatgacttaacctacagaccatcagtgatattataacaaagaatgttactgtgggagcctatttcaccattatgccaaagatgttataaaattaaaacctgttttcaaattcctacttttaatttgaaaccttatctgctcagcctgagtgaaccaacagagggcagcagaaactcacatgttcagattgtagaatgtgcaaagtggttccatttacaaggattttctttcttgtttttgttgttattggttttgtttgttttttgtgttttgtgttttttgtttgtttgtttgtttgtttttgagacaaggtctggctctgtcgcccaggctggagtgcagcagcgcgatctcagctcactgcaacctctgcctcctaggctcaagccgttctcccacctcagcctcccaggtagctgggactataggcgcttgctaccacccctggctaatttttgtattttttgtagagacggggtttcaccatgttgcccgggctggtctcaacttctgagctcaagccatccacctgtctcagcgtcccaaagttttgggattacaggcatgagccaccatgcgcagctttacaaggattttcaatttcaaaagtgtatttctgctttcctgtaggccatgcgtttaaagccatccctaatctcgacaagttttaaatcaaagttttgtatatttacttgtttttttggacatttttaacattgctagagtgacacatgctcactattgtaaaaatcagaaaatatagataagcataaaaaagtgttaaccataatcccccaacacccacatatggataaaccactattacaagttttttatatcagtccttccagtcctttttcgtacatagcaagaccctgcctctaaaataattagagcacttcattttttatacagtaatgttataaagtggtagtattacatggattttataatccttgatttacaatggcttttttatttgttggtttggggtttttttgcttttccagaaaaaaatattctatctacttgtattttgaagcaagggaaagtaattgattctttttaagagtctgctattctgtgggcaactcatttttccatcgaaactattagtatcacttgtcactttttgcaccttaaaaaatctattcttaagcacttttgcaggtagaagagaattggaggtatgattatagctaataataggctaaactgaccattgccttttgacttgatgatgcaataagcagtgtttagccatgccaagggaacctaaaaatctagtagcccattccccactccaggttatacattcatgcttacatagaactgtataaaagtattaaaacaactgaaattttagaaccagaagagatcttgagaatcatgtagtccaaacctttcatttcatagatgagtaaagttagactcaaaaaactttggaacttgccaagatcagacagcttggttagataataatgccacacaagaaatcaaatctgttatttacagcccagtggttgtttgcttcttcacagcccacccttcctcctttgaagtgtacgacacacctagatttcttcttggagtgatatagtggaattcctcaaattcttctcataactttaaaagaatgtggtatttgtattagtctgctcaggctgccatgacagaataccatagactgggtagctgaaacaacagaaatgtattttcttacagttctggaagctggaagtccaaaatcaaggtgccagcaaggttggcttctggtgaggcctctctccctggcttgtagacagcaaccttttcactgtgtcttcacatgatctttcctgtatgtgtgcagactcctggtgtctcttcctctttttataagggcaccagtcctattggattacggccacatctttatgaccttatttaccttaattacctccttaaaggccctatctccaaatatagtcaatcatattggagttatagctttatcatatgaattcaatccataacagtattcatcttcaggtccttaaaacacttcttaaatcatttggtgtttttttttaatttaaagaaatatccaggtagagaagattataaataagtttccttatgcttatctatgttttctcagtttgggaaccaagcttgtaatactatagtaatttttaaatgcttaaaaaatagcaaatagatatataaaacttgtaaacggctttaaaacaagattagtaatgagtaatcttgataataagattagtaatggctttcagctggctctcaggaaagcggaaataaatggcgttaaacagcttctgggcagcagaattctccattttactgaaagacgcaaatgtttacaccccctgtggcatttagttgactatacctctgttctggttggattcaaggtgattcagaagaggaaaaatagtgcctagtcacttccgtcacattctgatacccaaagatatagacagacataattatttggcaaattgttacacagtgtattataaataactgcttggttgactttcagggaatcctgtatcggctgtggtcacctgcaatctctttgttgtgcctgcactgaggaaaatgcagggcatcttggatcctcggccaaccatcatcaaagcaagggtaatgctttctaatgaccagaaaccaaaatggaagcctggtaacagttagggatatgatttcctaactgtccaaaataaacatctagagttttctattagttttgatggaaaatgtgattatattctccccctgtgtactagaaaatgtaggagaaagggtccctttaattctcctacttcatgacttctaaagtgaatcattttctccagatagaagtccatatacgagtccagagagcacggcttaaaaacttgagtgatacttaaggacaaaacagtcaataggatatatctggctctaccctaacactagacctgtctggaacaagggagaattttcttttccccatgcaaactcagagggacagcaattaacctgctcactttttctgtgacttcaacgataaattttaaacaattcagaagaagacaaaggactacaaagagaccctggtgattcagggaaagggtaaccatattgtttagaagagaactgctaaggctgagaaatataccatggtaaaagtcacctggaaattaggtctccttctccaccaacactaacttcaatgtgatttactactactcaactaattatgttatacactttctctgtgactaatgaataatgttcttagcagtataaactacagtaccaaaccattactttccaagtgttccgaagtaaattcaaatatggcagaatgctatgattagttgacaggaagagcaaaaaacataaaagataaaatattaggccaggctcaatggctggcgcctgtaatgccagcacttcgggaggccgaggcaggtggatcacctgaggtcaggagttcaagaccagcctggccaacgtggtgaaaccctgtctctactaaaaatagaaaaaattagctgggcgtggtagtgggtgcctgtaatcccggctattcaggaggctgaggcaggagaatcgcttgaacccgggaggcggaggttgcagtgagccgagattatgccattgcacttcagcctgggaaacaagagcaaaacttcatctcaaaataaaaataaaaagataaaatattttaaaaaattacactgagaatacataggataaaaacattaaaaaaatctaggctttcaatagtcttaacattgactgtttaaatgctaagaactttgtggactaggatatgaaacaatctccttttcttaaaatttcatgaaaaatttaactagagtttttttcattaatcacagtggtaatcaaatttgaaattaagtggaaaaagaaataaaaaccatccatgaacaaaaagtattctgatcaagtcagaagtcagagtcataaagcttagatttagacagtcaaaccaatagtactgaatttactatcttcatatttactaaattaaggaaataaaaattcacattattataagagagagagaaagaaggcttccctttgactttgcagatctcttatgaattctttcacttatttctcattgtaacatccaccatctcttctttaaaacagacatagcagccatctattctgacaacaaagatgagatggtactttgtaatcagactgatgcttgatatgttgttcctgatggtgtccatttcctgtcagcaaaggatgttaagaagtggtcaaaaaatcagtcaaatgcctttctcccacagcagtgtcactgggactgccagtatgggtcatcagtatgcttggctatttgtttcttttgtttcttagctttccaaatcatccccacatcagtactgacacaactgccactttaaagcataaacatatacttccttgaaacgtgataagtcttatctctcctttctgaccataaaagatgcagcttacacacaccacttattactgttcttcagaatagatgccacagtcattgcctttaccaatgcttgctgctttcaggaagtgggagtcagtgttaaatgctgctgttggtaaatcatactgttggactctgatgtggccattctgtgtgtcagtgcagaaaatgtcatccttgctaggcacagtggcactcgcctgtaatccctgctcctcaggaggctcaggcaggaggattgcatgaggccaagtgtttgagaccagcctgggcaacatagcaacaccctgcctctaaaaaaattaacaaaaagaaaatgtaaaaaaaaaatgaaaataaaatgtcatcctttcatatcaaagcattcagaagagcatcattttagaacaaacatttcccttatttccttggtcacttatggttggaggtgaaaatcttctcattttcagtacacaataagaaacacttccaaagcatctggtaaagaaaaaaaaaaagaaaaagaaaaagaaaggaacacaatcctagcaattcatcaaatagaattattgaccccgtgtttccatgcaaggaccttctatcatgtgtttccttaatatcccattaaagcactctaccacccttgttctcagcttttttcgctagaaacatacctggagtaactcccattagtattaacaacttatctcaagcagtgattaagagacagaaaagggggaaagcatgttctagaggatagccaactataagtccctcatgcccatccccccctcacaaacacagccagaacaatgaataaataactgcattttaatgaaaaaaaactgaagaagagcagcagagtgtatccgtggagtaacagaaaccctggtgagcacagaaactcaggatggtcacatcgagaacagaaggaaacaccaggcctccaccatcgcatcccccagctggatcagctgggaaccaggaagaactcccttggcaaggaattaagcagaggatcccagcaacccccatcaacactttggacacctacagacctcacaatgggaaaccctgcagccctcacaagcatgaagcccagctgaaggaactgcctggagtccacagagctatgctccccccagtaaaggagtcaacgctatgctccaacctctgtggcctgtgcaactactgcactacaccatgttggaattggaactatggctagagtttttcttgctctgggagcaagtagtcacagcaccccttcatccccaatgctaccccaacactgtggcctaacatccacaggctgagatgcaagcagctgttacaactttcccagtggagccaaatagaggtggagctactccacccagcccgccgcccgccgcatccccctcagccagagctaaagccatatacggcctcctaggaaaacagtatcttggctgctcagagcagtcatgcatccctaagttcagtcatgtactagcctaagttgagccagcacccagcatcccaggaaatgatgcttttgctgcccaaagtaatcatgcactctagtacctaagctaaagcagcaccctctatcccagagaaaaagtgccagagccacccagaacagccatgtccccagggcctgagctgaagcagcacatagtccctaggtgccctggctgaactgagcagctgggcatccagaactatgccgatgtagtacccacaacccagggaaacagagcagtggctgagctgagacacctcatcctacaggtcaaacaacttcctactctcctttcctgaagctagactacccccctagtgtctgagcagctgagaaacacctcttcctaggaagtgcagtcattgctatgctatttattgcccccaccccagggcccaaatgacagcagtgctccaccagtctggattacttattgctgctgcacctggctgcacaaagtctgggattctaccaagccccaccagcacagggtctgcagtcactactacatgctgcctcatcccctgggacctaggttgccactaagccctattgactcaggttcctagatagcaacaatagcctactccccagccccaaacgtccaggggcaacccttcttctctggagtcaggccagagctgtgccctgcccgccaggggcagaatcatagctacaactcagccacctgaacccaagctgctaaggggtacccaaagtcacagaccctggctctgtggacaacctacactcaaaactaccacaggaaaaaaacaagcaccccaagacccaggtgccacaatgggttcacaagacccttagcctaggaccctggccccacatccactctaagcacctgtaccaggaacccggtgctgcagtaggccttcttgaaggccatgtcagatttgacacaaagagggatctccctaggctatatcttcccattgtggagaaaataagaataaggaagacactaaaagcccttaacactgaatattagcaaactatgccaccaccaccaccacttccacaaacttctgtggactacgtaactgaggcacccacagttactgctcgccctgaaagcacctgaagatgctgcatggaaactataccactatacctattgaaaaagtcaccacacccttcccagctggcacactaaaacccaactgcaaatgaaagactttttctatggaaaccagaaagattggaagaaagaatagttctaccaggtgcacagattcatgcaggcttacaagaaacacaaaaaagcaagcaaatataacaccgccaaaggaacataatgggtctctagtaacagacccaaatgaaaagaaaatcaatgacctgctggaaaataaatgcaaagtaattatctgaaggaaattcaatgagatataataaaaaatatatacagacaagtcaacagaatcaggaaaacaatttatgatataaatgagaaattcagcagagttaggaatcataaaaaaaaacagaaatcctacagttgaagaattcaataaatgaaataaaaatgcaatagagagcttcaataacagactttgtcaggccgaagactttctgaacttgaagataggtcatttgaaattacccactctgaaggggaaaaaaagaaataacaatgaaaaagaatgaagaaggcctgtaagacttacgagccatcattaagtcaacaaatttttttattatactttaacttctggggtacatgtgcacaacgtgcaggtttgttacataggtatacatgtgccatgttggtttcctgcacccatcaactcgtcatttacattgggtatttttcctaatgctattcctcccccagccccccaccccacaaccccccgacaggccccagtgtgtgatgttcccctccctgtgtccgtgtgttctcattgttcaactcccacttatgagtgagaacacacggtgtttggttttctgtccttgtgctagtttgctgagaatgatggtttccagcttaatccatgtccatgcaaaggacatgaactcatccatttttatggctgcatagtattccatggtgtatatgtgccacattttctttatccagtctattattgatggacatttgggttggttccaagtctttgctgctgtgaatagtgtcgcgataaacatacatgtgcatgtgtctttatagtagaataatctataatcctttgggtatatacccagtaatgggatggctgggtcaaatggtatttctagttctagatccttgaggaatctccacactgtcttccacaatggttgaactaatttacactcccaccaacagtgtaaaagtgttcctatttctccacatcctctccagcatctgttgtttcctgactttttatgatcaccattctaactgccatgaggtgatatctcattgtggttttgatttgcacttctctaatgaccagtcatggtgagcattttttcatatgtctattggctgtaataaataccttcttttgagaagtgtctgttcatatcctttgcccactttttgatggggttgtttttttcttggaaatttgtttaagttctttgtagattctggatattagccctttgtcagatgggtagattgtaaaaaattttttccattctgtaggttgcttgttcactctgatggtagtttcttttgctgtgtagaagctctttagtttaattagatcccatttgtcaattttgacttttgttgccattgcttttggtgttttagtcatgaagtccttgcccatgcctatgtcctgaatggtattgtctaggttttcttctagggtttttctggttttaggtctaacatgtaagtctttaatccatcttgaattaatttttgtataaggtgtaaggaagggatccagtttcagctttctacttatggctagccagttttcccagcaccatttaataaatagggaatcctttccctgttgcttgtttttgtcaggtttgtcaaagatcagatggttgtagatgtgtggtattatttctgaggcctctgttttgttccattggtctatatatctgttttggtaccagtatcatgctgttttggttactatagcattgtagtatagtttgcagtcaggtagcgtgatgcctccagctttgttgtttttgcttaggattgtcttggcactgagggctcttttttggttccatatgaactttaaagtagttttttccaattttgtgaagaaagtcagtggtagctttatggggatagcattgagtctataaattactttgggcagtatggccattttcatgatattgattcttcctatccatgagcatggaatgttcttccatttgtttgtgttctcttttatttggttgagcagtggtttatagttctctttgaagaggtccttcacatcccttgtaagttggattcctaggtattttattctatttgtatcaattgtgaatgggagttcactcgtgatttggctctctgtttgtgtgttattggtgtatacgaatgcttgtgatttttgcacattgattttgtatcctgagactgctgaagttgcttatcagcttaaggaggttttgggctgagacagtggggttttctaaatatacaatcatgtcatcttcaaacagagacaatttgacttcctcttttcctatttgaataccctttattgctttctcttgcctgattgccctggccagaacttccaatactatgttgaataggaatggtgagagagggcatccttgtcttgcaccggttttcaaagggaatgcttccagtttttgcccactcagtatgatattggctgtgggtttgtcataaatagctcctattattttgagatacattccatcaatacctagtttattgagagtttttagcatgaagggctgttgagttttgtcgaaggccttttctgcatgtattgagataatcatgtggtttttgtcgttggttctgtttatgtgatggattacgtctattgatttgcatatgttgaaccagccttgcatcccagggatgaagcccacttgatcgtggtggataagcttttagatgtgctgctggattcggcttgccagtattttattgaggatttttgcatcaatgttcatcaggatattggcctaaaattctctttttttgttgtgtctctgccaggctttggtatcaggatgatgctggcctcataaaatgagttagggaggattacctctttttctgttccttggaatagtttcagaaggaatggtaccagctcctctttgtacttctcatagaattcggctgtgagtccttctggtcctggactttttttggttggtaggctattaattattgccccaatttcaaagtctgttactggtctattcagagattcgacttcttcctggtttagtcttgggagggtgtatgtgtccaggaatttatccatttcttctacattttctagtttatttgcatagaggtatttatagtattctctgatggtagtttgtatttctgtgggatcagtggtgatatcccctttatcattttttattgcatctgtttgattcttctctcttttcttctttgttagtcttgctaagagtctatctattttgttgaccttttcaaaaaaccagctcctggattcactgatttttttgaagggttttttgtgtctctatctccatcagttctgctctgatcttagttatttcttgccttcttctagcttttgaatttatttcctcttactcctctagttctttaaactgtgatgttaggatgtcgattttagatctttcctgctttttcttgtgggcatttagtgctataaatttccctctacacattgctttaaacgtgtcccaaagattctggtatgtcgtgtctttgttctcattggtttcaaagaacatctttatttctgccttcatttcattatttacccagtagtcattcaggagcaggttgttcagtttccatgtagttgtgtggttttgagtaagtttcttaatcctgagttctaatttgattgcactgtgatctgagagacagtttgttgtgatttctgttcttttgcatttgctgaggagtgttttacttccaattatgtggtcaattttagaatcagtgcgatgtgttgctgagaagaatgtacattctgttgatttggggtggagagttctgtagatgtctattaggtctgcttggtccaaagctgagttcaagtcctggatatccttgttacttttctgtcttgttgatctgtctaatattgacagtggggtgttaaagtctcccattattattgtgtgggagtctaagtctctttgtaggtctctaagagcttgctttatgaatctgggggctcctgtattgggtgcatatatatttaggatagttagctcttcttgttgaattgatccctttaccattaagtaatggccttctttgtctcttttgatccttgttggttatcagagactaggattgcaacccctgctgttttttgctttccatttgcttgttagatcttcctccaaatgtttattttgagcctatttgtgtctttgcatgtgagatgggtctcctgaatacagcacaccgatgggtcttgactgtccaatttgccagtctgtatcttttaattggggcatttagcccatttatatttaaggttaatattgttatgtgtgaatttgatcctgtcattatgatgctagctggttattttgcccattagttgatgcagtttcctcatagcatcaatgatctttacaatttggcatatttttgcagtggcaggtaccaattattcctttccatgtttagtgcttccttcaggagttcttgtaaggcaggcctggtgatgacaaggctcccagcatttgcttgtctgtaaaggattttatttctccttcatttatgaagcttagtttggctggatatgaaattctgggttgaaaattcttttctttaagaatgttgattattggcccccactgtctcctggcttgtagggtttctgctgagagatccactgttattttgatgggcttccctttgtgggtaatccgacctttctctctggctgcctttaacattttttcctccatttcaaccttggtgaatctgacgattatgtgccttggggttgctcttctggaggaatatccttgtggtgttctctgtatttcctgaatttgaatcaacaaatatttttatcatcagagtccagaagaagaagagaagggaaagaggataggaaatttatttaatgaaatactagctgaaaaacttcccaaatctgttgagagatatagacatccagatccaggaagttcaaaggtctccaaatgtattcaacccaaaagatccttcccaatttgtcaaaagttaaagacaaagaattataataacagcaaaagaaaagcatcaagtcacatacaaggaagtccacattagactagcagtagatttatctgcagaaaccttaaggccagaagggaagggaatgatgtatgtaaagtgctgaaagaaaaaaaaaatgccaaccagaaatactatatgcagcaaagctatccttcaggaatgagggagaaataaagcctttcccagacagacaaaagctgaactccagcttcttagccttcttttctcttttcaccagagcaacccaacccctagacttcctgtattaagaatataaggtggccaggcatggtggctcatgcctatgattccagcactctgggaggcccaggtggcaggatcgcttgagcccaggagttcaagaccagcctgagcaacatagcaagatgccatctctaaaaataaaaataaaaattattcaggtatggtggcacatgcatgtggtcccagctactcaggaggccaaggcaggaggatcactggagcccaggaggtcaaggctgcagtgagctatgatcatgccactgcactccagcctgggtaacagagtgagaccttgtgtcaaaagaaaaaatacatttttaattaaattttatttaaaaagaaaaagaacataaggtggtagtgacagcaacgacagaataccaaggttagtctccatgtccactgtattctttgcacaacccctactatcttgtatttttgtgagatgatcaggtgaccaagtttgttttcttttctactttattctgtagttatcatgtgatgtaaaacttgatcctcgtccagaataccatcggtgtatactaacttggcatcaccaagaaccactaccttgggcacagagtacaggttagtcattcacatctacagatattcctagacacctatcctgttaaaacacaaacttatatataatcttccttggttatgactgattttgtaattattatacatttttctttttgaaaagttagatgagttaagttattcctaaacagtatagcaaaagttaaaaaataactattagaagtttacttattttattgagccatattttctagataaacatttagaatgtccacatatcattgactaatgtcctgtaataaatctggaattacagaagatttgatatgtttgttcaaccaataagttctgagtataactttgtaggaaaaggaggagattctagctataccatcttgaaatgtgagatgaaagcccaatttataatttgattctctgtagcctctaccatacgctagttattggtaaatttgaagggcagagaaatcaatattgataatgcagagttctacagtaaccttcactagactttaaactgttattcccaacttccctactcatattttgcctaatttttgatgtgactccagaaaagttgtagtactctttaaacaaagatcctaccaagtgaaaacgtcaactaacagcgactaagttcatgggctttgccatcagagagaactgcattcaaactggccaccaacctacttagcaggaccctaggcaagttacctaaaaattttttgagtcttgtgagaatcaaataaggtgtttaagtaaagtgcctagtactttggcactcagtaaagaaatggtagctgctaccattattgtcattattattttaatactttttttaaagcctcccttttcagacacgcataacatttcagcctgaattgagaaattctatggcattttgcataatgctataaaatcctggttttactctttcaagcaagaatttctaatgtttatttttaaagtttgaatgagaaggtggtaggatataatagcatggccacctgaaaaaggtactggaaagtttgatcatcccttctcctcttgaagacccgcatttctgtctgtttacattttgaaaaggtctacaagggcccaactgtatacgccatgatgcttatgctgctgtaataagagtatttctttctaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattatttaaaaatgtaa

SEQ ID NO: 2670 - DNA, 674402 bp, Homo sapiens; identical to SEQ ID NO: 2669

SEQ ID NO: 2671 - DNA, 1460669 bp, Homo sapiens; identical to SEQ ID NO: 1928

SEQ ID NO: 2672 - DNA, 585108 bp, Homo sapiens; identical to SEQ ID NO: 2063

SEQ ID NO: 2673 - DNA, 585108 bp, Homo sapiens; identical to SEQ ID NO: 2063

SEQ ID NO: 2674 - DNA, 153887 bp, Homo sapiens
cggccgcggcgtcgcgtcggaacgtgactggatggtagtgtgctggccggtctgcctccgggagaaccgagcgcttccggtgcgtgtggtgagcggcgggccccgggctggaggggccgggactgggcagcgcctaaagcgccccgtgccgcttaacgcggtctctcatagccgctcgccttcctttcacttcctgttccttcagaaagcgctgtgccttggaccaaccttacttcttactattgacagctcagctaactcctattcatccttcaaaacccatctctggtcgtatcttgtttgttgctttcatcgctctggggcctccggggggatctgtgttttgtgtttgatttccacccacaccagacccagcatagggcttgacaaagagtacgtaatcaggaaatgtttgttgaatgggaatatcctatttcttttacttcctagcatctccccctcccacccgtttgcattccagaaatatttttagacgctgggcattgaatagtgaacaaaacacagaaagtcctgtcctcatggggctgacttgctgatagtgactgtcagagtcactcgctccttccttagactcttctccagtgtccctgccttcccttccatcttactgtctgttcctcttcgtttaatccctcatctccttccagagggagcacgggcaccctggtggtgggaatctgggtgcatggtgggtggtgcctgggcagaggagttgagagtggcctcgggaccaggcttagcatttagagaacagaaatgccaaattatttgcagtgcacggttccattagtttataattagtctttcatattatattagttccattggagatgagctggctggctggctttagaagttgttgttgttgttgttgttttttgagaccaagtctcgctctgtagcccaggctggagtgcagtggcgtgatctccactcaccgcaacctccgcctcccgggttcaagcaattctgcggcctcagcctccagagtagctgggattacaggcgcgcaccactgcacacggctaaattttttttttttttgtatttttagtagagacggggtttcaccatgttggccaggctggtcttgaacccccgacctcaggtaatccgcccttctcggcctcctacagtgctaggattacaggcgtgagccaccgcgcccggtcgttttatttaaactctggctttgcgtgtggaagttgttacctgcctggaatgggctgcgaacgggggcggcattactagaggaggctgactacagacatttatggaatgatgacctgacttgtagaccagtggaaccctcaggcgaatgatgccacttgggggaaaggtgtggaagaggttgggtggttgattccaggggacatagaaacccattgtctagaagaagagatgggtaataggctgtctggaatgacttagaaaaggacttggagggaatctgttgatgctgacctgactccacctgttgggggatggaggcggagcttggcgtgtttgattaaggttgggtgcactgggttttcttggaagtcggtctattgcctgagcgttctgtgctgttccaccgcgccctctgctgtcctaggagtgcctagcacccttctttttctctggattgtgcttggtgctaacagcacagaagtaaaaaattaccaaagcacttctttctgggaactaattgataaccatgtattgtgtatgatggttcagaatttcagaaagattttttttttttttgagacgaagtttcactcttgtcgcccaggctggggtgcaatggcgcgatcttggctcactgcaacctctgcctcctgggtttaaatgattctcctgcctcagcctcccgagtagctgggattacaggcgtgtgccaccacgcccggctaatttttgtattttagtagagacagggtttcaccatgttggccaggctggtctcgaactcgacctcaggtgatccgcccacctcggcctcccaaagtgctgggattacaggcatgagccactatgccctgcccagaaagattttttttaacaagtagaaattcattgcagtgtgaatctgtgtgttgggagtgaaatgggtggatttggatcatgccctcagaattgctccctgcacacttgggtagacggacacctcaggaccttagccttgtgctgtgggcctgtctgtccagctggctgctacagagatgggatacctgggggaagaatgttccaggcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaagaatgttccaggcagagagaaaagagggaagggctggagcacagggaaagggtgcaggggaaagtggcaggcctttcccaccatggatcctggacgtcttttgatttcagtattttcagacctaccctcgttcatgatgatgagcatatgttctcacttgttgctaataagcagtgcggcaggttttctttatacatttatcttcatggatttatacatctagcaaacatatgctagtatttgtgtaggataaagttctacagtggggttgctggggtgaaaatgatgtgtttaaacttgtaacacatatgaccaaaatggaccttccaaaggcatttttaaagtcctgtctctttctctgtaggcattgtctcttcaggtcttctttttttttctttttttttttttttgagatggagtcttgctctgtcactcaggctagagtgcagtggcatgatctcagctcactgcaacctccacctcccgggttcaagcaattcttctgtctcagcctctcaagtagctgggactacaggcgcctgccaccatgtccggctaatttttgtatttttagtagagacggggctttgccatattggtcagactagtcttgaactcctgacctcaggtgatccaccaaccttggcctcccaaagtgctgggatttcaggtgtgagccatcacgcccagcctaggtcttcttttatgtccttcaataaaagttttagttttctttccttttttttttttaattttacttttttgagacagagtctcactctgtcacccagtctggagtgcagtggcacaatctcggttcactgcaacttccgcctcctgggttcaagtgattctcctgcttcagcctcccgagtagctgggactacaggtgcgtgccaccacgcctggctaatttttgtatttttagtagagatggggtttcactatgttggccaggctgctcttgagctcctgaccttgtgattccccccgccttggcctcccaaagtgctgggattacaggcatgaaccactgcacccagcgcttttttcttttcttttctctttttgagatggagtctccctctggcacccaggctggagtgcagtggtgcaatctcaggtcattgcaacctccacctcctgggttcaagagattctcctgcctcagcctcccaagtagctgggattacagttgtgtgccaccaggcctggctaatttttgtatttttacttgagatggggtgtcactatgttggccaggctggtctcgaactcctcacctcaagtgatccgcccacctcagcctcccagaatgctgggattacaggtgtgaaccactgcacccagacttactataagtcttcatgtaggtcttgcttattttttacagatttacccccagctattccatagtttcaatttcaaaaattttatcttctaactaattgggcctgatatgtagaaaagccttttttgtttttgtatttattctttttctttcttttttttttttgagtcagagtctcgctcttgttgaccaggctggagtgcagtggcacaatttctgctcactgcaacctccgcctcccaggttcaagcgatctcctgcctcagcctcccgagtagctgggactacaggtgcctgccaccctgcctcgctactttttgtatttttagtagagacggggtttcaccatgttggccaggctggtctcgaactcctgatctcaggttatccacccacctcggcctcctgaagtgctgggattacaggcgtgagccaccacgcctggcctgtgtttattcttatgagtgttgagttattggatttcctaggtgacatggtttcttataactacatacatattcttccatgcacattttctgacggttgaccttgtttgatcttaggtggtttggctttgaatgacagcaagaactctgtctttaatggcttcattggtagcgtatgatgattcggactcggaggctgagacagagcatgcaggaagttttaatgctaccggccagcagaaagacacttctggtgtggccagaccacctgggcaggattttgcatctggtacactggatgtgcccaaagcaggggcacagcccacaaagcatggctcctgtgaagacccagggggctatcgccttccattggctcagcttgggagaagcgattggggatcttgccccagccagaggctacagtggcccgggaaggagcctcaagtcaccttccccatcaaagagccttcttgttcttctctgtggacgagccatgttccagccagccacatgcccctggcagctgcccgctttaagcaagtaaaactctccaggaactttcccaagtcatctttccatgctcaaagtgagtctgaaaccgtaggtaaaaatggcagctcttttcagaagaaaaaatgtgaggactgtgtggtaccctatactcccagaagactaagacagcggcaggcattaagcacggagacaggcaagggtaaagacgtggagccacaggggccccctgcagggcgtgccccagcccctctctacgtgggcccgggagtgtctgagtttattcagccatatttgaatagccattataaagaaaccacagttccccggaaagtgcttttccacctgagaggccacaggggccctgtcaacaccattcagtggtgtccagtcctttctaagagccacatgcttctctccacttctatggataaaactttcaaggtaagacttgaatgaaaacttctgctttcagatgctcttaggaatacactgctggaataatagtgaagtggagggaggttacaggctgaacttttttttgtgtgcagatttctgtaattccctttgttgcattccagaaagggtcatctgtggtcagctccgggttgtgggttccttctgccccaacccttccctgatgctgccttgctcaggttaccagaggatactgtttcttatccctctcggaggccgtgagggaggaggtgagagtgattagtgggagaagaaaagcaggcccaggaccaagccctggggactggggacatcctcggtgaccctgtggagcattgagccatgccagctctgtgcctggtgctgtgctggtttcaagggctgttgggagaggtaggtagacccagcccctggtgtcagggcttgcacagtgaggcgggagccgtggacaagtacacagactcaaccctgagctgtgaggacggcccccagtaggacacacaggtgctctgggagcccaacgggagggttaccagcccagcccggcagggctcagtgaaggcctcctgaggaaggggaaggttcgcttggggatgggggcagaagggcgtgcttggctgcaggagccctgtgtatgtgttggctccaagcatgagggcctgggagctggcttcaagcatgtgtgggtgagggacttgaggctggggaagcaaggtcagggaaggttgcacgtgcccttctggggacttctggttttacatggaaactcttttttgcattgtcttatttattttacaggctactgaagtgatagtaatgtagtcccccagtatggaggtacagtgtgataggtcgttgtgcccacctgggacctgtctccagcccttcgagctgtgcactgcatccctcctctctctcctcgcagctagcaaagcacctgatatgtagcgggtgccaactaaatgctagctgaacagaaagctcttggaaaggaaataacttcaagggacctggcttcacatccagctttgctgcagagtagctagctggtcgaccactggccggctgccttcctgtggagtctagtgtctcatttgtaaaagggcaaaatcatacctgggtcatgtgctcatgtgagaaaaatgctgaaaaagtgccttgcacagagccaggtacctcataggcgctcagtaaatggtggttcccttgcccttgtttcctcagagttctggaaccaactttcctacatcttttctcttgcaaattacattttgagcttttctccctcggaaacattttcttaagtgaagaaaggaagctccaagtatagagatgtctttgaaatgagctgaattgatgggtggcatttttaagtggcgaactggagtcctgaagtggcttgtctgtgctcttttctagcaagactcagagtcctgtgggagagaacgtcatattctctcttcagcctggagttccaggattttccacttaggtctttggtgcttttcctgccattccgggggctgtgaagtgtgcgcggaggcttctggcatccctggcgtggatcacagcatgctgggattgatcctgtggccccggggcttctctgctctccttcccaagtctgcgctgcaagggctggaggatgggaagcccatctggagggttgctggtgggcctgggcagtgtctgactggccctggagttcaagtggtggcccttgtcctccctgtgctcaccttcctgttgaggccttcttttacctgcccgctcacctctggagttctctctcctgatggtgaggggcagacctggggccctgtgggactggccttcgcctggtggcgtgaagtgctccctgggccctgctggcagagtggcagcttgggtcacttttgcctgggaaatttagatttcctaaacagaagcatccccatggtagtttttgagcagagagcacctgagtagaggcattgatttctggccttgtggagtagacaaatgtgccaggcacggtgccactggggacgtggggggagagacgtttctgcccccatggaggggaaactgtgagcagccaactaactgtgacacctcatgaccagaagagggcgcagtgggcccagcttggaatggcagtgagggtggctcagactgagggactgtggtaggaatgccctgctcctgggcgattcagagacctgggtccgggtctgtggggctgccctgggtggggccaggcgccgcagctgtgcccgcctgtcccgaggagactgtgtgtgctgcaggtgatgacactggcatgggccccttgggctgccaggcagcttctggggagccccacccactgcactgtgcaccctgggttccttcccagggcagagcacatttgctgtcatgaggttgggccagggtcagcatggctgctagggttggcatctcctgaccctctttttttactgtggtgtcgtgaacattagggcttttataagccatagatacaaatggtgggccagggccctctctgttttaagatatttgtcagttttcagtgatggggttatttggcaaattggttttgggcaaattgactttgaacaacttttcagtgtgaagagtgtatggcaggggctggaggagccaggatgggaagacagattgggaaccggcggggagccaggcaggagctgtggccagaagtcccggctgaggcctcaggcttgctgggccaccaggtttgtgcgtggcctggctgggaggcacatggtgttcttttccctccttggtgtcagaggtggggcagcatggcagatcttggggacctggtgatctggggaaggcagtgtgtgggtgtgggtggtgggtctggagtggggatagggcctcgggcacaggcaggagtcctggctggctgcagcccagtccctggaggagaggaaatggtgggtgcagcatggaatgagctcaaagaggcgggtgcagcagtacacccttcccagggtgctttccccctgccttttggttaaaatctgccagtgtcttctgggcccctgctggatcaggaaggagggaagagcttgggggctgggtgacaagacctgcttgggtccttcctctacggccagccccttggttgcgtggtctctggcaagttacctcacttctgagccttcatttgagtatctataaagtggagagaattaaacatgcctcgctgggtttttgtgaaaagtaaacgatattagttgtgaatcaccaagtgcaatgcctggcacatagcaggcacttagtgtgtgctcgagttcctgcttttccccaagaatttcctcctttccttgacttgtgctcatgtcttattttacgtaagtagccatggaagcatatcagcttcacctactagactttaagcttcctgagccagaacccatttttatattccccagcatctggcacaaaattgtgtacatgttaagtgatcgataaaaattaaaacaaattttttggattttatcgcaagcctttgggaagggattgtcttttgagtggataaatcatattcgccactagggtgcacagtaagacttaatataagcagctcatccaagcttctagaatgtggaagaatccttgattcaaggtaacatttactgaaaaatgatttctttctgatcaggagaaaaacaacacagtccaacttattaatctaaagaacatggagtgccagttccttcatatccttaaaacgtagcttcggaattcatacatttcaactggacacattacagtggaaagatacttattttaatatgttctaaatgttctgtgagctgtaaaatatgcttttattagttttgaaaaatttacagctagagaaattaagtaaaataaaacaatgactcataattctgcaccgctgctctttcctgacgatcccttcctccccttgtctgtgaacgtgcttgtttttttcatagctgtgatcccagcacggatacccttttatatactcttttcatctcccagtgaactcttttggcttaacgtgtttgaacacccactgcacgtaaaggtagaaattcagactttgatgcctttttttgaaggaaaacatgtacgtggcctgcgttaaccaaaaacacaaccagccgttattgaatgctcccatgtacagaaccctctgccaggcactgagagggagtcccaaaggaataagacctttgggtgggtgacagaagacccaccagggaccttctgtacctgtatgaaaacctgcagttctgaaacacagaaggtttttaaagaaaatatatgaattagatgttgtttatttgctttacagaataatttgctctagaaattctttcagtaacaagcttccttaaaatactttgaaaaaaaaccttttaatttttgaccatgaatgtaatagatgcttattgtgaaaaactttaatgatgcaggaaatatgaagtatgaaggagaaacagaaatcattgataactcccaaccccaagtcagtgcctcattaacatgaggggcctccctggtcgggggccctacattcctatctgtttacataattgggcttattgcatagtatgtgcagttttgaattcttcctctgctgcccaatcttctgtaacgtgtaaggggaatttttctaccttattaaaaacttttccccaaatatatttttataactgtctcaagtttcatactttgctccatcatttccatgttgtttcctataatttcctgcttttgtttaaaaaataatcagtattacagtgaatatggctatacataaatattgtctttttttgctgccttaatgcagttaagatgggctttgaggccaggcgcggtggctcatgcctgtaatcccagcactttgggaggccgaggcaggcggatcacgaggtcaggagattgagaccatcttggctaacatggtgaaaccccgtctctactaaaaatacaaaaaattagccgggcgcggtggtgggcggctgtagtcccagctgctcgggaggctgaggcaggagaatggcatgaacccaggaggcggagcttgcagtgagcccagatcgcaccactgcactccagcctgggtgaaagagcgagactccatctcagaaaaaaaaagaaaaagatgggctttgatttacacccaggcattagctaaagcccttgtgtgtggtgagagtgggacctgattagattggcaaaccttcagtaccactgttgtactccttggctcccatgccaaatcttctgcttggtagctgtgtgactttgggaaaatcacttagcctctctgatcccctagttcctcactggtaaaatggggataattggtaaatggccaccaattaaggttgttgctgtagagctgaaatgagaagatccagcctagtgcctgacaagggagaggctgaggaagcatgtttctgattcccctgtacctgtcttgattagttataaaacaaagtgtagaaaagacaaatcacccagaatcctccaacttactgtaactcttgttttttgtgaatcttttcattgtctctatgcacacgtttttaaagcgtttcaatctcagtgttcttgagataaatacttttagaatctaaagagtttgaggattgtctgtgccaagccattcatgcactcccttttcatgtactgaacacttggcaggtctgtgttggagagctggttccctgtccccaaagtggtcacatttaaagcatggatgagaggatggagagcgctagccattgctgagtgcttaccatgtactaggcatgttctaaacgctccgtctcctcttcattacaggcctgagaggccacttctgtcctcattcccattttacagatgaggaaattgaggcacagagaggtcaagagacttgtccgtggtcacacagctagtaaatgatagaggcaagcagggaagcttcagactcagagcctgagcagaaagagctaccaccactcacgctgccctcctgcctctgagaataagggatggaaaagcgcatccccttcacccaggtggtgtccaagctctatcccagcttccaaattttgtggttctgttaagggacatacagagaagagatgatttctggggtggtttggatttgcatttttatgtatcacaggatcctgttgatttatcattgttagtgaatctgattacattaagatatcttagatgtgctttgtagaaagtgatctatttcacattcaaagacaagggatttatggctctaagtgccagagtgagggtttatttcagttttgaaagaattattcttgatggattttacaaaatgagattgagaaatgatttgatgtgtggagtgaggagttgtggagcattatgcagatgattggcaatttattctaagcacgaggcaaatctattggcaatgagaggcgcagctgggaaggaggtttgggtggtggtagtgggcctttggtatttggggagtgaatgattaacagtgcatccagggtaattagatgaaggtgaggagagaattggtgatgtgtgtgtgcgcatgtgcgtgcatgcatagcgttcatctggttcatttgatagaggcccatagaggggaagacacgcccgaggacacacaataggtgtttggatgcttcctagtctggacactatatttgcttctcttctttcccaccttccagaggactttcagaatcatctgaattaccccaggattgggagtgtggggctttagactggttggcagcagagctgccgagcctctgggaagagccatgagattctgagctggaatcttctcttcgtgggaagtgaagtttttttgacactcctcctcccccatgtgaaagccgcgacatttctgaggccaacaaatgagacatttcccagttccagttgccttacaatcttgtatcttacagaaaaaaccttgggttgaagaggaataagaaaaggaaagtgtagcagaacccaagctgtgttttctgctttttaataacttcattccatttaacttaaacagttcagtgtaccaagggcggggccttgtgctcgccagaagctgacaggaagaaaacagccgtgtgaaggtgcagcctctgtcctcgagaagcaagcctcattcactctcatcccatgtcattaagggaaggatagagcaatttggaaaaatgcttttaatgtaattgaaaaatgcagattgcaaaattggcgcacttaggagtcgagacagtctagtaaattatttcttgttgcttttaaaactcggagacagtagactcttaaaggtgcttgtctaatgcccagtgatggcctgtgtccaaatgagttgttttagatttaatttgttttatcataaaagtggtaaaattttgggaaaaaatgcaagaaaatggcagaaattaaaagataaaccatagacccttcattcaagcctaatgaccatgaacattttgcaagcagcgtttccttctagtcttttttccctacatatatcaactagttttaatcatatggtaggtactttgtttttgtagcctgcatttaaaatcatagggtggtcatttctcccccagattgttagtattatttcctcttaagagaagggttaggtaagtcattccaaccttttaaggtttccttctagcttctgctgtttcttgtcaggtgttttcttttgtctattctcccagatgaacacagctctcatgcggacccctcatatactggggggagtggagcaagccgggggacagaagccctgaggggcagtcagaaggtacatgtgagtgagaccaactgtgtcagcccaggatagctggaagcctgccttcacctggcctcccctctggcaggcttcctgaagtttcctgaacttggcagaggacagcgtaccttgatcttctacgtggaatactgtgatactggctgaaatgcagggaggaccagaagggctttagaaacctacaaccaaagcggccctagaactctgctttgccagggcttgtggggctgttccaggcctgcctttcctcgccaggattggggcactggggagctcggcccccccatagaacgagggccatacagagatgagcggcaccctctggggctgctgctgctgaaggtcgttgactttgcaactctgattgcttgggcatcctggatgtccctggattgagcgtctcggtttctcctctttatttcttggcctttctgttttatttttctggggaatttcttccactttatctatctttcaatgctttttttgaatttgtatttctgctgtcataaactttcaaattgaagaataatatatattcagggaagtgttctgtcatgtttttacattccaagagctgtttcttattttctgaatgttcctttttttaatatagcatattgttttttattgtatatttacaaggtcttttcttagctctttgagttctttgaaagttttcctgttttctgaaatgtttgtctctttcttatctcctttggtctttttttgttttggtgtctgtgttccatgttagagatttcctgctgctcattccaattagggagggaggacctaaaaagctgacctgaccaaaagctgtgtgtgtgtgtgtgtgtgtgtgtgtgtgtgtgtgcatgcacacgcccttgtgtgggggcaaagggactttgtttgcagcgggccggatgtagggttatgaggcagcaggctggcgctcatcataggaacccacttgtgattatttttatgtatttccttgagcctggtcagcttctcagggaggtgtcttctctgggtgggctcttggcctgctgccagccttccggcatctgagctggggaagagggtcaaggtctctgtgtttagtgtgcagactgcactctccatcctgtcctccagcttggttttctcactgtccggcacatcttttcccaccagtgtgcagatctgtgccgctctttttgggggctgtgtagcgctcagtgtctgacacacaccatcatttatgcgtaaaagtggctgcgtcttctcaccctccacagcggcagaattattaccttttgaaaatgtctgctaatttaatggtgtcttgtttgagaaccaagtgagttcatttacgtacagctcttttagaacgggccggcacttcgttcattctaaacaagcatttgttatcctgattcttgtccattcatctcctgtagtcttagcgtttctcttatctgggcaatttacgtacttacaatattgacctttcatcatattttaccctcttcccccccagggtgttgtgtgatgttgagttttggtatttcatgtatttttttttaacagagaaaacctgacatttttcgctgtcaagtctctggccctttccctttgtaattgtccatggctctagagcatggcatgtcctcccccaccctgagatctgataaatcgtcacctatatttgaccttcatctagtagtgattagcttgagccagtttcaattctcgtcagtgggtccgaggcaggccctgcgccaccatgatgaatgtgtgcgtggtgccagggatcgatgggcatattaaggagcagcgccgcggtccccggcagccagcttcgtgatgctcccccacactgacgctggctattcatgatttaaaatgaccttcttcccatccggcttattccgcagggcatgggtacgccacagcttcctcaacctttcctcaaaaaagaaatgttgtttttgaccataaaagaaatgcaatctggaaagaacagaaaggtataaagaagaaacaaattgcccattttctctccacccagaggcaatgactgcagactttttggtatattttcatccagccttaaaaaaaaaaaaagattcaacatagttgagctccaactatacatctaatttaaacccttctttccctccacatactgcagtagcagtttttaatgctgtaatttattgctttggtttttagtgtggtctccaaatccctggggggcctcaagaccctttcagggggtcaaaactattttcataataatacctaggagttatttgccttttccattctccttctctcctgagtgtacatggagttttccagaggctatgaggcgtgtgcttttgcagtggattaaatacagacgcagctttgagaacccagctgtcttgtattaagccagacattaatgagatctgcaaaaatgtaaacaatgccttcttactaatttttcttggtcttggaaaatagagttatttttataagaatgtgctatttctgttaacatgtggggggtttgttactgttacttttacataaattaataaatattttaaaatgtcctcagttttcacttctaatacgcgaagtacccatagctataatccgaaaaaacaacagctctttggggtcctcagtcattttagacagtgtaattgaggaccacagttttctttacatctgtaattacattttggggaatctcactattgtgttggtaaaaacgtcagcacatcctagttctgggataagtgagtgggttcttttccagccacgtctctgtcttcttctgcttggttagctctccaaactgtgtgatgaaaacgtgatcccaggggtccaagcctctgtcaccctcttgccccttctcctctgcccttcctttggccctttgtggagatgactcagcagcattacaaaaccataagcaaaatccaccaactcgaccatacactgaaattatcattatcctttgaacaccctcccatccatttctggtccatacgggctgtgtttgtcagagtgtgcgtgcagctctgcagcctgtctttccatttaacattctctcccagccctgcccgcgccacactgtgccaccagccgcctctgcgtctttggagggccgtcaattttcactggttccatgacgctctatcgagttgattaactgtaatttacttagccgcccttggacacttaggtggtttctaatttttgctattatatagataatgctgaagtggttatcttcatgcatgaaacccttttctgttggattatttctttcggattgattcccagaagtgggactgctgggtcaaagggttgtacattttcatgggtccagatacgtctcttgtcagattgctttccaaaaggattataccaatttgcactgccaccgcaaagcttgcggtgttggtaataaccaactattttgcttaactatcatgcctagaattttcccttgaagccccaagggggcaaaggcccttatctaagtgaatgtgatctgtaattatttagactaacaccaaaattgctttcagaacattcttaacctgctgagtttagaattctaatttgaatacatgctagcattaaaagtttcacaagtagcaatttctctctccctactcacagtgtatttacacagcctgacaactgtagggaaaatgaaagagattttataaacagaagtgctctctttctgaactagttgaaatgttattttgaaaggtacaaaaacacaaattaaaacagattttcattgtcacctttgcttagaaaagttgtttgttttcgtcctgggcttcttttcatgttcttttctctcattcaagtgtgttctgatatggttctgatacggttccggtacctgggtgtcctgctgtgttgctgttagcccgggggcggaggattggtggctgtcatcaggtgctggcagggctgctgtgggaggggaacgaggtgtattcgggtttgctcccagggcagaagtaggacagatggtggaaggtgtgtctgtggggggaagaggtcagcacatggtgaagaactttccggtgctcagagctgggcaactcgggcagtagactacttggaaagggagcgagggctgttttgcctggaggggtgtagtgcaggttggagcccatgttgctggagggctgggaagtagatgcaggcattgggtcagccactcagaccttgggctccaaggccgttaatggcttgagtgtcctgtggtcagggccaagatggtggctgtgagctgctctgccctgaaatactgcactttactgcacttggggccccgcctgagtggagcacagcgctccacacactgcgtattcaaaagagagtcaggcacattcctcctctaatttctctgagcttcagcattctcatctgtgaaataattatctcacagggctgtgaggatcagaggaggttagatgtgtgaaaccactctgtaaacgataacgctcttacaaatggaaggtattatcaagaactccaagccggggtttattctgtgattgcctcctaagccgtgttcctaagggtgtgaggcttgcaatccactttgcctccagttgccttgattcgttgatcaaataatccggtgcgcacccagtgaccccagcagactcttgaggagctcaggtccctctaggtgtggcttcttgtcttccagtccagcagtgtgacatggctggcagtggttgaggtggtggacttgggggatggctcagctgatgggccttgtgacgtctccatgagccaggcttctggacttgctgctgtgtggcctgtgaattcctcgggccttgctttatgctgtctctgctgtgagcagagaaagcactcagtggcagtgtcagcagggctgttcctcacttctttcttcatttggtcatctgtatggctgtccagccatcagttaaattctggctctttgccaggccctgggatcagaggggaccagacccactcttgctggtaaaaggtgaatgaggcacagacatcaaagcagacttgagagggatgatgagaaaggccctccagggctatctgtgctgggaacaggaatatatgggagagtgtgctaggtctgtcagtgctggaggcagaggacaagaaaagcctcagggaaggggaaggacgagttgggtcttagaagatgaggagccaggatttcggggccagcctggacaaaatagggaggcctatctccacaaaaaattaaaaaattggctgggtgtggtggcacatgcctgtagtcccagctacttgggaggctgaggcgggaggattgcttgagcccaggaggttaaggccacagtgagccatgattgtgccactgcactcaagcctgtatctcaaaaaaaaacaacaacaatgaaatcgatgaggggcagccaggtgggtggggaggacagccctgtactgtgcatgctgtggggcggggacagtgaggacggccaggtgaagtgcttgggctggtcatcagctttagccctggatggtcagtggcccaaggccagatggcgcttcctgtacttgtgctgggtcaggcaccacacaggggtttacatctcatttgccctcagctgggtaatcatcagagctcagggagtcttatttcggtgttcagtcccagcccctgtgctttctgtgtggcttagggtaagttacttaactctctggaccttagtttccccatcgtaagtcaaggacaataacagcatccacctcagtcttctgaggattaaacaagagaacccacggcagactctcaggagagtaccaggcgtatggcaggcactccataatgcaagctggcagcagcatcagcatccgtatgccccctttacagatgacaaaactgaggaccagaggggcgtattgaaggacatgtagctcctaagcacggggctggcatttgaactcacctttgctgcctctgctttctgggattgttctagtcacttccctgcttgggggctccaaaagtgtagtcgtgtaactgtggcaaggcctttaatctttttgtgtcttaatgagctcgtctgtaaaatggcaggagctctgatataagttccatgagggcagggaatttgttttcttcccttgttttatctccagtttgaatgaatagcacctgctcagtcgaccatgctctttgtgggcctacttgaattttgggatgtagagaatcttggaggggtccaactgcactcccccacccacccctcacctccagtctgtgcaggaggcatccctgtggggattcgggattggttaaatgtcgccaggtttgtgaaagggctttggaaactttgctgggagctaaatcaaagtgatgattgttccacatctgtgaaatgttttttttttttttttttttttgagacggagtctcgctctgtcgcccaggttggagtgcagtggtgcaatctcggctcactgcaagctccgccttccgggttcatgacattctcctgcctcagcctcccgaggagctgggactacaggcgcccaccaccacgcccggctaattttttgtatttgtagtagagatggggtttcaccatgttagccaggatggtctcgatctcctgaccttgtgatccacctgcctcagcctcccaaagtgctgggattacaggcgtgaaccactgcgcccggccgaaatgtttgtatttacactgtcaggtaatggtcatgggcttgcagcttgtacatttgtttattatttatttataaatcttaaatccagaaaggacttgaggaagcctacaataaaagatacaaacacagtgaagctattaaagcaagacagaccatgaaaagccaccccaaaaggagaaggaagcctgtcaatcaagcgcagagctgactgctgttcccagctggtgccttgcgtcttgttctgtgtgctgtgttctcgcagacccaaggcaggtggcacaagtttgcccagttcttgctgtccaagagaagccaacacaagtggcctcacaaaggcatgtgggatggcaggacagtagtgctcagaggaaaggcagttagcttcttgtctcagctgcccagggaggagatgaagatcataggagaggccaggggaaatctctgtccgaatcaagctaaggagaggtcacatgttctttctagggtgggctgtggcagggccacaggtccctgggccagactgccagagttgttttgctcttttctgtgccttggtttctctcctgccaagtggctgtaacaatacctatctcacagacctgttgtgaggataaatgttgtggttttggccagggaccttgcaaagtgcttttgttaacctgacctgtatggtctgtgtttctcatggtgaatgttgtatttctcaaatggctcaagtccttcaactcaggtccccgagttcagaggagatgctgctggaggggtggcaaggtggggtctcccctcatgcccttggctctgtccatactgacgttgtcaagtgtgacctgtttgttattgcctaaaaacacttaacgagttcaaagcaaagggaacatactttttaattatttctctgcttgtctccagcaatgctgttgtcaaggaaaccaaaacctttggaaagcttttcagcttctcggtcggaagaggatacttgtacagtgcgtatattgtcggtggaaatggacctgtcgttctgtaacaaaatctgtttcttttaaaagggcttacttccttcacttcttacaaatggactctttttggccttttaacagaagatggaaagttgttactggtattttctcttttaaagaattgcctgcattcttgacatagtatttcattcattcaacatctgttgtgagacttgggtgctagggatgggagtgtgatacagagatgaatatagcctttctggaaaggctcctggctcattgaaagaaacaggtggacagatcattatagcgcagcatcatgactgctctgaagggtgttgggtaaggtgctctggggcataaagaacagcctgggaggggcagtgtcagcaagtcacaggagtcctagaggatgggtagccattgctcagcagcaaagcgatagaaaagcattccaggccaagggaacagagtgtgcaaaggcagggaggtgtacaagagcatgctgccatcagcaaactgcaaggtagctggacgaggctgggcattggatgcataaggcatgaggagcaagacaggctggagaaaactttttttgtttttgagacggagtcttgctctgtcgcctaggctggagtgcagtggtgtggtcttggctcactgcaacctctgcctcgcaggctcaagcaattctcctgcctcagcctcctgagtagctgggattacaggtgtgcaccaccacacctggctaatttttgtatttttggtagagacagagtttcaccatgttggccaggctatctccaactccttacctcaagtgatccacccgccttggcctcccaaagtgctgggattacaggcatgaaccaccacacccggcctggagaagacttctgatcaggagtggggagtgtgaagaggttgcaatacatgctcttcgaagtgcattccatttccgcctgacagagccttgcttcttgacatgcagaggcatgtcactccttttgttcttgcttcagagggaagggacactgctaacacgctggagtttaataatttacttttgctgcaggagtatggccttccttgtaatgtttcagccagcattccagtaaaattttatgatagttaagccctatcggagcattggttttatatgaaaaagataaatcattgttagaaaaacaggagtcttaacttttaaacaccccttgttatttttcttgtaaaactttaaaaaataatttcagatttatggaagagttataaaaataatacagagagttcctatgtacccttcacccaacttcttcgaatggtaacatcttgcataacctggtgcatttatcaaactaagaaattaacattggtacaactctgttaattaaactatggactttatttgcatttcaccaggttttccactaatgtcctttttccgtttcaggatccaatctaggatgccatattgcatttagagagctcttgctatttaataagtaatttgtttttttggggggtggactgggcagtaaggaatggactggagcttgtcctggccactaattttgagttccctgttctgagcaaaccctgcacatcctggctgatgtcccatatcaggagaccagagccttgaagctacagttaagctcgtactggatgtcttttggttttcaagacttgcttcctagttcaatcatgaacaagacaagcagaagatttgcaccttaatgaggcttaaagagcactcacttataaagtgccattagtgacttgtccttaatggtagctgtttagtgataacaggtttctcattccttttttcttttttttttcttccttttttcctccttctggatttaacccagccagccttttgggctaatgttgacattagctagaattcgaatttagactgcttaccacattgatgtttttacacaaccttcctgtggtttatcggataattgagtgtgtcttgaggcagtaactgagttgaaatgtgttgcatttaatgagtgaaactagagcatgctttgcataccgatagatgcacatctgtaggtgatttttccgacaaaagtcccagcctaggacgtttccttccattcctttcccttccttctcttgcatttccccccttttcctttctctctcatcctttctctcatgtctttttcggtacttttttcactatgctctcctttggccttgcacctggtcctgtctccgcctgccttttctcctttgcatttcctcctttccgtccccctgtgcccctctcgctctctcttgccaattcccatcttctatgcctttccctgcaacaggccagtgaagctgttgccacggaaacagaagcccagcagaagctctgttctgctttccggatgcttctaacgatgatgacgcagataatattgatttctagaatcagctaagccctggcctgtggcctctggagtcccttcattttccaaaggccaagctgatgccacagctcatcattctgttcagtagatggtcatttttgatttcaaaattgaaacttcaaaattttgagtaatctacttccctgtggctccagaagactgggtgcaaccatgtgaaaaagacttacttgaatttacttacattaactgagggaaaaataccagatgaggagggtacgggtgctgcaggttccaggaataacttaagttacacatgggagagggttagatgcatttgttgaattactgggctgaatgactgcttttaaaggacttgggggaaagagaagtacagttgaggccttaaaaaagatacttaattcaatgaatgttcagtgaggactggccatttctgagacatggggtcaggtgctgtggggcaccaggagtgtgaaaagcacatttcctcctctggaggagtggctttttaagtgacagagctggggcatgtgtgtcctgtaccgcagtgacattccttgatacttgtcatggtgatccagtgagtgcagctgttgtcagttctgccgtacaacccacatggctgcacattaactgggctttgtggtcccctcggagggctgttggcgcctggtcctcagtggagctggtttatgatggtggcagccttgctgcacctttccgggtttgactcaggcccagcttgttggcattagctaggatttggagttttgccattcagccagcaccagctaatagcccagcaaggaagagttagttcatggattatatttaagttagtacttattcccaaaggtaactttgtttaataaaaaccttaagcccttattactgtgcttctgggtatcctggctccagtgtgtaaaaataagacttataaaattcaaacattatttgtgaaaatgcaaaaacattttcattaatacagggcatgataaaaagcaaaaggcactttccatctgtggctaagtggtctttctgcactggggtctttttgttttcataatcactttgcgcttatttaaatattgccctttcagtcgtgaattttaaagggaggaagctttggtgtgtgaataactttacaactacccacagtatttccatccagttgctatgacttaagttgataatggaccccacacagtagtcactaatggatgataatctaggagtgtttttgttattgtttttattttagaagaaaggtttgaaattagcatagtaaatctctgtgggatctttgcaaataaaagaatgttcacgttaaaaacaattttcaagaaagatgtatggtaatgaataaaacatcagtgagtgaaaataagcgtgtttaattattcaagtagaagtagtaatttaaactaattattgcttgcggatttcataattcagtttttgtctcacaataatatttcctctgggcctccggggcgcgtcggcggctgctcgctgttcctggggcgggagagacctccccctccccgtggctgcagcctctgccccaccgagccagagccagagaggcccagtttctgcttctgccggcctcctcgtggtctcagtccacatctatcccccttgcactgcctcattaggcatttccttgcttatcaccttctctggttgattcgggcatctcagaccagttctgtccattgaggtctgagtgtcgtggaggctggtcccctgcctcctccccggtgtcttagacttccttggcaggggtggccctgagcaccctgcccatgtccccaggaggcaagtccttgccgttcagggctgcctcaggttggatcccctccaggaggctcccctgcctggggattgatcacttcttcctccccagtgctttgtaccagcaggttctggtggtagtaagagaattacagagagaatttgttggttgacatttttcttttttgggcttctttttactttgtttctgatcctaaaggaagaaaaacatattcatacagaggaatggaaaagtaccagagagcctgagaggcagtggggaggacacttcatcccctggaacttgcacctggcttctctgctcctgggtggctctgcacgtgtcttagttctgctcattctgtgtatgcaggcacttgccattttctctgtggaatttgagggcttggatgtgatttttagcatggacactttggaggggctcagttacattctccttggtgcacctcctggggtacaactggcattagcaggtgctgatgaaggagtaggaagtgctgcaaagcacttttgctcaatcgtgcgaggcttttaaaacccagttattactgctactcccatgaatgcccataatggcacaggaggttttctgaacctttctttattgcacaaatgctcctggaacagatcttgacaattcaggtgaattattattctacccctcagaaggtaaagggaaagctttctgtttgtaactttttcttcccaagtgtcctctgtcaaaaggtagtgacatcttctctcctgatatgtgacgtccattattacctcggtataatcataaagctcacacccaaaagctttccatccagcacgtcagagggacaatctttatttaagacacactcccccacttttctttgttattgctttctcctaaaaaaaaaaaacaaaaccaaaaaatcaaaaaattcccttggctttaaaggcatgatctgggctaggagtgactcgttcttttgcaaggttattgtcataggcaggaacaagacaggtgggacatgggggtggacagagtgatgcgctgtcagccaggggccaggggtccaaatggggttctgtcattttccagctgagccctcggcaggccaggcaatttctgggtgttggtttcctctcttggcaaacatagaggctcaactgtgttctctgaggcccttttaagctgagtagttttgtgatctccaaactaactgtagctaaatgaggtaatgagagaattacaggtgtcccccaaactcttcctgcagagtagttgaaatgagcattcatgattctgaatcggttttctctccctgtgagctccagaggaagtcattaagcagagaaattactaacacctcgtgaccaccgtggagcagagccaggggcacgaaataaaatgccatagggatgagacccgtgcagccagccagcacttagggagatctgctaggaggacacccttaggttgtcctcctgagggtccagccctctctgaggggttgacagctgagcttcattacgttcttgaccctgtctcgctgacctcagggcttctgtattagcagtgtccaacaaatggttgttggggtgaattaaattttctcttatggatagtgtcctatcctttctaccaagtaagcttcctctcggggaagagaccattcttctttatttctttgaaaactgattttttaagaatagaaatacaaattggtatttgatgtacagagaaaaatgagtcgtgctcccatgctctggatctggagaggccacatctggctcatctctggatcctagggagcatcagccttgccgtgggaagcaaagcgggcctgggctgccttgaattagaatgacctggctgcctttccaaccaaagcacatatggccaaatgttgggagagtgaattggaggcaaaagcctttggaattattgggatcgttgggactcctgggaaggaactgggcagatttgtgtttgagccatggctctttctaccctaggtctggggaaggtcctctgcttctcccccactgtttcttgtaaagtggtgctggcatgcttagcccgcagggctgttgtgtatggtcaggagatagcagccctgagtagtgcccagagcttagcacagatacagcaactctggttcctttgaagatggaaaatgaatatgtatcatttggcaatgataatgtaaaatcagtgtggaggtgtgattccattaatagattgctgatgaactcaactttttaggagcccgtttgttgcttagagtgaagctggctggaatgaggcagaattagaatgacaggcccactcttctaattgaaatgcacatgaagtgcttggccctcagacttccatcgagatgattgcagtgatcaatattccagtttgcttggctggcagcttccggggaataagaatggatgatggacccagggaaagtactgccaaacagagcattaagttaattcctgtttgcctgggttctggcctgcctgatgaagtgccttgagtagaatgaggcaatgttggtgtggactttatcatgggctgtacccagtatcacaagagctcaaggtggctgctccctgacattcacttttggtagcaattagaactcccatttgctgagatcctaccatgtgtccagcccagtgctgggccccatacgcacatgattggtccccctgaaacctctgaggtgccgatggcatgccccaacctgcgtccaaggacctggggctgagagggcctcagggcacggtgctgcaaggtgcggagctgggaatggagtccagggctgtttgctcccaaagtctatgttcgttccactctcccacgccagcccgtaagtgtaaagcagatgtttggaacctgggttctcattttcctgtagaatcagtgttattcatggcagtgagggcctggtctcaaaagctgggtttaccactgacagtgtcatttctcatgtggttttcaccttgaccttaccaccatgggaggcagagcgcacacccctctggtgttcctggctgggaaacaggggcccctacctgtgggctgcgtgggccaggagggtcagcaggcccttgggggaagtgcaaatgcatccttatctctgtagtgcttcctcccaggcatagggtccgctggaggcctggcgttcccatggggctcactgtgtgtgcaaatgttctgtcccagttcagtctgctgactgggagatgctgacctgactctgtttctctagggccatgatcctgactctgaaatgccaagtatacacccctccctcctcctgcctgcattctccttctgctgttacatgggggcatgcacccctctcccctgcagctctggcctctgctgggcccatccctcctgtgagtgacatggttattccttgtatcattgtctgaacttggcactggtgtgtttgggcccttcctcttaaccctcctaccttgtgtccccatgctagttctgtctttcctgtgctcgcagaatctgtctgtcctcttgcccccacctcagaggcttcttccagtctcaccccctcattctcagaattgaattttttatctgtggaaggtggcagctggcagccaaaccaggagcctaagtcttgggcaaagcttcaacaaggatgctgagctcaggggcctaggaatcctctctctgccccatcttttttttttgagatggagttttgctcttgttacccaggctggagtgcaatggtatgatctcagctcaccgcagcctctgcctcccgggttcaaaggattctcctgcctcagcctcctgagtagctgggattacaggcatgcaccaccacgcctggctaattttgtatttttagtagagacggggtttgtccatgtaggccaggctggtctccaactcccgacctcaggtgatccacccgcctcagcctcccaaagtgctgggattacaggcatgagccaccatgcctggcctctctgccccatcttataggcaccctggggcctaggatggggctggggtgcaggggatggggagggaggctgggccccctggaggatcagtaactctgttatatgtcttcactataatctcattttgggctgcactctgcttttgtttttgtttgggagcctgcttggaggccagcactaacagaaacatgcaagggcagaagcagagctggccatcgggaggtgggtggcctgcagggcctagctctgtggcgcatggattggtgtgtcagtcgcccttcctggcagcagctctcagtgattaggcttggaggagccttggctttaagttctctttggggaagggcggatattagtgcttaagaaacgccactcccgaggaaacccacctggatgtttttctctgtaactggccatttggagacagggccaggctgtgcataggcttttgagtttctcaggtgcctacatggggctcaaaatgatgatgcaatcaatccgtttcttgacttttgggcctgggtccagctcagaatggaggtgtgctccatgggcttgccttcggagaagatggttagcagggctgtgggaagggatgtgtggtggacagaggtacaggctccccaaggcttagaggcttcagaagcccatgtcaggcacgtggggcccaggttcaaagcagaggatggagaagggagggttaaagccttccttctgacgttgatatgtgtgtctcagcactgggacctggagcagtcggcttcggaggcccgttggactgttgaatattgatggtgtgggtttggctgaggagcataggcaggtgtgtttgccattcttatgtactcaggaggggtatgaagggcaagtcagtggcacaattcaagcaaagtgctgctgttactcgagcatttgctgtgtgccaggatcttcacacggacagcctcagttttcataggagtcacttttaggcattttatctccattttgcagttgaagcaattgatacttaagatggtagtatctttgtttagtgtgaagagccaggaattgagtggggaatgcccttatggcagcaagacagtggcaccaagtcctgcctaggtggcttgtccaatgatcagagtccaaggccacattgctaccaagtggcagagctggaatcagcgctactcagcctcacacattttgctccctgtgcctcttcagaacttcggcctgtcacatgtgtgcagctgtgggagcccagattgtgagttgatcaaggtcagggccacaccctgcacttcctgcctgacacagagtaggtgctggacagacatttgtgttgtgaaagagtgagtgagtgaatgaaagacacaccatggggatagaaaaataaggggcaggccccagggcggttggcagatgtgaaatgtggtttaaagacttggcagtaaatctgtggctaggccccccttctcctttcattcccttcttccttccttcttgggattcagaattgctctctgggcagagggctgcggagcaggagcgaggctgcaggtgtgagaaggaccccgccgtgccagggcagcctcaaggagctgttgagcgagttgagcccagaagacaaaggtcgctgaagtccttccaggagaagaagatcaatgcctgggctgagcctgcggttaacatcttaatagtaaccggagagtttctgagagattaggtgatgatatatactcagagctcagacagttaatttgcattgtgtcctatattcctgaaaagttgctttcagattcttattgatgtgctcacattttttggggtaattgtcctcctttgacattaataacccccctgtttactctcaggctcacatacctctcagagtccaggaggcagtgagggaaagcttttaattcaaagccctatccatcttcccaactcaggtgagatggggactagaaagtcggtctggctgaagctaagtgaggccagccttctgggtgttgggtatcaggttctggacggggctggcagttgtgtgtggggctcatggatggttttaggcccttctgccccctttgtcagtgtgcccttgtgggaagccggtgcgtttccaggggagctgctggaggcttcttatggcatgcagatcaaggaagacctgtagactacatgcaccctggcgctctgggtatgttgtttctgcaggtttgggaggcagctgtcctccaaagcatacaattactaagaacagggaccatagtttcacacttcagtgcctaaacaggccctgacacccagtttggctaggttgagtctgggtgccagagattagagctgggattggagatgtagcccgtccccgttcaggagcctctcacgtgtattgcctctcacgtgtattgtctgtgagtgtgctgggctcccagacacatatgtcacagtgagctgtgggaatgacccttgactcctatcctgatgggagtgggagagggtgcaagaactggccctggagacaggggaggggttgtgagagccagagcacagatgcctgcacaccaggcactgggggcgggggttgggatggagagtgtggtgatggtaatggcctatagtcgtgggggcttggggacttctgagggatgtgggtaaatctggagtttttcctataggaacggggagccatggaacgtgcgtgaagcggtgtgtaaaactggagagaaaaaccctaaggagacctcatcggacgttcctgtgataatctaggcctcaggacaggcagactgggatgcttgtgttacccctaactttagattactctcccactgctcccctccttcactgtagattcccacaatttcagtatcaatgtaattacaatttaggggcttagaaactcctgtatttattgagaacccacttaatttacatatattgagtttcaatattgcacaactctgtgtggaggggttagggtggaggagacctgagatgacagaaggccatgttctctagggatggtctgcagccctcagtgctgtctcttttccctccagcgccccctctgtgcccccctccaatccctgctccccccagtctctatagctgaaggctaggacgaactgtggggttgtgaatatttacgcaggcaggcataggactcagtgacgcagctgagagccacgcaagtgtttggtgactcatcagaccttctccaaagacttgtgatatttttctcctctgaagggccgaaagcaatttgcagttaatgatagtatatgacgccagaagagtacgcagaccttccggctcatcttttctgtgccttgggtgttttgtttttgaaaaaacctatgtgaattattttccctttagtaatgtttattttattctgattattaaaataatgtatgctcattgtagaaaatacataaatgcattaaataggaaataaaatgcatgaattatttttccattacagtgttattaggaatgttttgcctgtgcaaaggagatgtggagcgctagacttattttatttgaggtgcttgtcgagataactgagatcagtgggttgcagcctgtgctctggggactccaagggcttcatagaaatttctagaggctgcctccagggtgggggatctggggagcttgagactcactcccaggttcctccctccaaacaactctgccgttttctgtctcatgactgggccttctcacagggctgcctttgagcttatcaaattggagacccagtgatccggctccagcctctcattttacaagtgaggagttgcaggccactggttaagcgtgtctggcgcaaggtgatgtggtagcttagggctggtcttcatgcgttgtaggcctgcattgccttttagtatatgaatcagttaggaatattggcattttaactttaatgccattgtcacaagctatgtcaccatgcagaggacccccccccacccatcccaggaagctgatcgagggtctttaaagggctctcttttgagggaaggggacacctcagagcacctggcacttgaaaagatgaaaagtaagagccccatcattgctgttaggcacacaaaggaggagaaattgctgtgggtgatccctggttgtatgaatattgagaagaaattaagtaaaggctgtgtttcctgacactgatgtattagaacatggagtaactttctacaggaaattggaacagggatccctttaaattgaatttgaagctgtgaatagcaaacctgcacttggccctgtgtgtcctaatgcaagttaagtaagcagtttcctgggtgagagttaagtactttagggatatgggttaatgttgaggccaatgtggctcaagttaataaattgcctctcgcgtgtattgtctgtgaagatgcagaagagtaatttgcttcctgcagagctgctccagaattctcatacttagtttattagatttttggcccaatacattttttccctctcattggttttgttgataataattactcacccccttccatctctctatggatttctcttggttttaattgttttcagtagccacaaaagtttaccatttcagaaaataagtgttttaaaataagaatagtcttggccaaaccccatctgagtttccagagggagacagtcaaagctctattgttaaagtgattctgggggcagtggccactgagattaggaaaaagccagcgctcccttcgtcaaacacgtcagtgctcgtccctggcctagggagctctctgggaactggcttcctgaggtttttacatatgctctggaatctggagtgagggtgtatgcgtcaagggcctcccagggagacggtggaggatacagaggaccggctcccccatgctgctggtgtttagttcttgaccctgtgggctcagggggtggagagaacatcgagaattgtacccaccactaggcaccatgtgaggggccagcaatacctagctcacagtctaataaatcagttaattaacagggtaattataagttgcacagtggtatttcctgggaaatggagaaaaatggctgggtgggtaggggagaagacagcatgcaagctgaggttggaagcctgaggaagacatgggtccgtccttgcacggaggacagcccgtgccgaggctgagaagagcttggtgtgtggcaggaggtggaatgcaaggcaagatttgtcttcagattattccttataaagagagtgttcactttatacttgggtcttttagaattttcttaaactacaggacactcacttttggatgcgaagtttaagcagatttttttttttttttttttgatacagagtctcacgctgtcgcccacactggagtgcagtggtgcaatcatggctcactgcagtctctacctcctgggctcaagcgatcctcctaccttagcctcctgagtagctgggactacaggtgtgcaccaccacgcctggctaatttttgtatttttggtagcaatggagtctcgtcatgttgcccaggctggtgtggaactcctgagctcaagcaatccgcccgcctcagcctcccaaagtactgggattataggtgtgagccaccctgcctggcaaagcagatcttttgatactttgtccagaacataattggtttcaaatatttacccatcacacatttaaatagtctctggtaagccatttaatggtagatccattcctgaaggccatgttgctttgtgctaggctcagaccccagcttcctagctctgtgatgctgggcaagcaaccccaaggtgcctctgtttccccatgtgtaaaacagagaaaatagtacagagggtctcatgctcttgggtcacaattcccttagtgccactgtcacatttttcacagcactcctaggccaaaacaaacaacttaattaacagtcctgtttactaaggagtgaggaccaaacaacttaaatacttatgttgtaacaacacctgttggttctcaaacattggaagtaggttggatgctgccaccctcatggtctgttccacattgattttcacttgctttttgcttttttttttttttctcgagatagagtcttgctctgtcacccaggctggagtgcaatggtgcagtcttggctcactgcaactgctgcctcccaggttcaagccattctcctacctcagcctccctagtagctgggactacaggcacccgccaccacacccagcaaatttttgtatttttagtaagacaaggtttcaccgtgttggccaggctggtctcaaactccggacctcaggtgatccactcaccttggcctcccaaagtgttgggattacaggtgtgagccaccatgccctgcctggtttttgctttttatcacggcaactattgaaaactcagctttgcagagatatgatgtcatctaaagaaatgcaaaaagatctaatgttgaatgtaatgttgaaacctcagctagcagtctgcatgttgtctagcagatattgctgtttcccttaaaatggtaaaatatcccagcctgggcaacatgggtgaaaccccatctctacaaaaaatagaaaaaatttgcctggtgtggttgtgggctcctgtagtctcagttactcaggaggctgaggtgggaggatcactcgagtccaggagttcaaggctgcagtgagccttgattttgccatcgcactccagcctgggtgacagagtgagaccctgtctcaaaaaaaaaaaaaaaaaaaaaggtaaactatcccttggtgcgttattcgggaactgtggtgatagtattgacgtgtttggtttagtgaagatgaaggaaatggtgcacggaaagtgctgagggcagtgctcggtattaggtgctcaggaatcattgttgccctcaatctcaagggttccctttagtagacctagaaacgtgtctttaggagtggtgaaaacacggctcttggagacgtctagggagaggtgcatttagttgcttcatgagatgacagtggaaatatacagtctttctgtgttttgtagtaagtgattgtaagtatgcatgtgcgtctacgttaataagttaaacacaaatacagacatccagttgtttcttcaacgtctctacatgtatatgtgtttaggtatttgtctctaacctttcagttgtgtttttaatcttcttgttgggaaaatgggtaatgtctctgtggtttgccttatatttgggatattagcaaaggggagagtgttttgagatggggttgatgccacaggcaggccagatcacgaaaggccctggtaggacacaataagccttaaggttttattcagaatgaaatggaaagctgctgaatggttttgttgttgtcgtttttgagacagtcttgctctgttgcccaggctggagtacagtggcgcgatcttggctcactgcaacctccacctcctgagttcaagtgaatctcctgcctcagcttcccaagtagctgggattacaggcacccaccaccaggcctggctaatttttgtatttttggtagagacggagtttcaccattttggccaggctggtcccagactcctaacctcaagtgatccacctgccttggcctcccaaagttctgggattacaggcatgagtcaccacaactggcctgaatgtttttaatttttaaaaaggtaaattaactctatggagatataacttaacaataaaatgcagccctgtaagtacactgtcagatgagttttgacaaacctgtatacttatgcaaccatcgctccaatcaaggcacagaacctttcccctgacccacagtgttctgggtatcctttatcagcccatctgttagttccacccccaacctcagccccaggcagccacagatctgcttctctcattgtaggttggtacaaaagtaattgcggtttttgccattacttttttttttttttttgagacggagtctcgctctgtcgcccaggctggagtgcagtgccacgatctcggctcactgcgacctccgcctcccgggttcacgccattctcctgcctcagcctcccgagtagctgggactacaggcgcccaccaccacgcccggctaattttttgtatttttagtagagatggggtttcaccgtgttagccaggatggtctcgatctcctgacctcgtgatccacccacctcggcctcccaaagtgttgggattacaggcgtgagccaccgcgcccggccttgccattactttgaatggcaaaaaccgcaattacttttgcaccaacccaatagtttttcctgttctagaatgaaatatgtaaatggaatcatgcagggcgtagcctttagtgtctgacttctttcacttaacagaatgtttttgagattcatccacgttcagccatttatccctttttattgctgagtagtattccattgcatgaaaataccagaatttgtttatccattcttctgttgatggacacatttgatttgtttctagtgagccgttagaggtagttcatttttttttttttttgagatagagtctcactctgtcactcaggcttgagtgcagtggtgcaatcttggctcactgcaatctctgcctcctgggttcaagtgattcttctgcctccgcctccctagtagctgggactacaggcgtgcaccaccacgcctggctaatatttttgtatttttagtagagacgaggtctcactatgttggccaggctcgtcttgaactcctgacctcgtgatccgcctgccttggcctcccaaagtgctagtgctaggattacaggcatgagccaccgcgcccagcctagaggtagttctttttttttttttttttttgagacagtcttgctctgtcacccaggctggagtgcagtggtgcaatctcggctcactgcagcctccgcctcccaggctcaagcaattctcctgtctcagcctcccgagtagctgggattatagacgtatgccaccatgcccggctaatttttgtatttttagtagagatagggtttccccatgttggccaggctggtctcgaactcctgacctcaggtaatctgcccgccttggcctcccaaagtgctggaattacaggcatgagccaccgcacccggccgcctagaggtagttcttaaatgaatgttggtgtggactggacatgttttcatctctcttaggtacatatttgggagtggaactgcaggctcatatggtaattgtgtattcagctttgtaagaaaccacctgctttgagcaacgaggtgacaccatcttatttacatctttaaaagttccctttattgaggctgaggcaggagaatcgcgtgaacccgggaggcggagcttgcagtgagccgagatcgcgccactgcactccagcctgggtgacagagcaagactccatctcaaaaaaaaaaaaaagaagaaaaaaaggtccctttatttctagatggagaataggtcacgaggggctggggtgagagcagggggagcagcaagggggcagaggcagctgtcaggtgagcaaggccagtgcttgctgaggatgatggggacagtgaaggggctagctctcacggatggttggggacaggatgactgaagcttggtgatgaactggatgatgttgggagtcaaagatgatttcaggttttggcttaagctactaaggatgagatggtgctactcatggaaaagagaagacccaggaagctttgagcatgttaacttaatttctctgaggctcacttctattctgtccagcaagacaggcaaagaaatattagttttatttctaaactaaccagagaaggggaggaaatggctcagatgggcaataggcagtctaaagtcatatgtgtatgggaggtacgtaggcatgctggtcgtatgtgcacagtacctgcacaattctccatgggtctgtcatatttctgcacagtcttctgagcaagccacgaacagctgatttgctctggcctgtcttttcaaggatgtttgaatagcaagcagccttggagagtagagacagcatctctatctggaacagatttatttttattccaggataacaaagacaatgtctcccttaggagcagaggttgggcaggtttaccagcagctgcttatataagattggggcatcctaatgtcaggactcctctctgtaatgcatcccactgtgtgtacaggtaacaccttgccttcatgggatcgctatgggaactggggcttagggaactggtgcagcagtgttaccctggctactactactgctgtgagtaataaactgttttcagtctctgacccagggatctcatgccttctgctagtatgtatgaagctgtggcaggctaacttggtagtttgctagcagagtactgtctcaaagcccacacagttcatgacagtgcctctggttgccaagcacgattggcacagctggtgtcctccctgctctgccgctgtccttcttttcttctgcatctctgtcagtgcactgccacctgaatctttactgagcacctagtaggtgtcaggtccaggggcagcagatagagtgggaagccagatatggttctagccctcacagagcacgtgtcattcagcctctgctgtccaatcagccactgagttgtgacttctctacttagaggtagttctttatcaaattcatctcattcctcgctgccgtttggtttctccctgtgaagggtattcattttcatggttgttttaagagtaagaggcagtacaagggaagtgcctggtatagttcctggtaatcgtagatgcccaaattgtgactactgctgttgtaatttctattattacgtattctcaactctgattgtcattccttgatgtaaaaactttgctgtttgccctcatactacaatacaggttgcagcccaaacagtacgggatgcaaaccaacccatgtcaccggcccattcaccctgccccgatttctgttcctatcacaaactgcctgctgtgtgccttgaattctttccagctctttcccaaacatgacacacccttttaggccttttccctttccttccttcttttcaggcaaagtcttccttatccccctggacttggctcaagggtccccttctctctgtacccattccttgaggttgcctttctcccttgtctccagactgcataaatggcagtgtggcctgtgttgctgtagcaccatgtgcacctgggctgtgccccggcagtgttctgtctttgggctcactggggagggagcactggaccatcgtccccagatgcccagggagaagcttggtgctcgttactgactgtagggtacttttctgtagcaggcacttggggctcacttatgggacccagtaacttcacagtcatgaggtacttgatttgaactgaggagaaaatgtgtcaatacctttcccagggagagtcaccctcacaaaccttggtctggaaggcccatcttagcccaggggtgagatcttgcgtggatgattcagaagtcacagtattcctgaaaactagtgactcaacagaattatatggctttgggagaaagagtccctccaggggcaatccaactaccacaggccaggggccaagctttggtgagccgagcctgggccctgcccctcccttctctatgggcctagggttgctgtgctgtgtgtggcatggccagagtcctccgctcatctcctcaccatctgttacttgtgcgtgtctcctgtgccaggcctggtgctgacactagctcagggagagaggcagccgtacctggaggagctgcttagtaggacacttggcacatgccacatgctttgcagacttctcagtctcccagccactcagggatttgtgggactgagtatctcagatccaaggtggtcaggcgagggtgcagggagatggagccatgtgtggggccaggctctttcccatgacctaggtgccccttccaacccccaccatcctgttaagaccctgagcagccaggctggttgctccagccactcttccctggtggctcccctttccagttctgaggctactgcgagtcaccttcctcctccagggagggagagagctgcctgagcattacctctgcttgcggatgggggtgctagagaccgagccttttccttgttgtctctgccagtgaggctctggagagtgagtcaggaatacagctgcacaaatcgcccttactttgatactgtgtgattggtctgcaagacagacacagggctgacatcgcattttctgcctgacttcttcctggctgcagtgaccctgagctgttcctagccttccatcgtttctgttgtggacaggcgtgtcatgctgcccctgttcctcctgccctggcctggctacttaggctcttgtgcatgtgctcataggttctcatgaaggttgttcttagtttgcttatgtcttttttttttttttgagacggaggctcgctctgtcgcccaggctggagtgcagtggcaccatctcagctcactgtaacctctgcctcctgggttcaagcaattctcttgcttcagcctcctgagtagctgggattacaggcaccaaccaccacgcctggctaatttttgtacttttagtagagatgtggtttcaccatgttgatcagactggtttcgaactcctgacctcgtgatccacaccccccactcagcctcccaaagtgctgggataacaggcatgagccactgtgccctgccttcttacgtcttatatccacactgcctgtgattttgtacatgatacacacaatgtcacctagcactggcctttctgactttcatgcaactattgaaagtgaaaaatttggccgggcaccgtggctcatgcctgtaatcccagcactttgggaggccgaggtgggcggatcacgaggtcaagagatggagaccatcctggccaacacggtgaaaccccttctctactaaaaatacaaaaattagctgggcgtggtggtgcacacctgtacaagtcccagctacttttgggaggctgaggcaggagaattgcttgaacccgggaggtagaggttgcagtgagccaagattgtgccactgcactctagcctggcgactgagcgagactccgtctcaaaaaaaaaaaaaaggtgaaaaatttgcacaacagcacagtagtgcagcctgccagtctcagccacaacggtcagggtctatgctaaggtgagtttatgggacatccctgggagtttggggtggcggtggcgggggggggtcctactcacgccacacctactccgggagggacctggcattggactcaggttgccaggcaggggtgtggagtggtccctacacccacaattcctgtgactcccattgtctcacctgagaccctggccttgaaatgatgggctctaagtaagttctatttctaggccgggcgtggtggctcacgcctgtaatcctagcactttgggagtccaaggtgggcgatcacctgatgtcaggagtttgagaccagtctggcgaacatggggaaaccccatctctactaaaaatacaaaaaaaattagctaggtgtggtggtgcacacctgtaatcacagctacttgggaggctgaggcaggacaattgcttgaactctggaggcggagattgcagtgagccgagatcacgccactgcactccagcctgggcgacagaacaagactccatcacaaaaaaaaaaaaaaaaaaaatttatttcccgtctccacaggggtctctctgcggcttcctggggcctcgctccttccgcctacctctttcttccttctcctgctgtctaccctgtgatgtgatagctttctcggggagtgttcagatgaacagtgtttagaattgttgaatgctctgttggaaaacagaaaaggctatttcatgagcagatgatgaccttattaactataattaggcaattcacagaggcttccaatatagtccagcatcttttcttgttgagatggggggaaaattctatggtaatgtctttggagatgtaatagtctttatcacattactagtttaaattattctagaagttttggcagcctggtgttttcatttagaaagccgaggtatagttttacagttagccacattaatataataattataattttgagcaagtaatttcagacactgacatcaagagttgtttttatagcagagaaagatcacaggtaggaaggtggaacctcgcgtctaatctatctaatctgtcacaaataggatgatgttgtgaacacaggcagttcatgcccctggcccatgctttatattatgggacagagatgcaaatgcttagaaactccccctgtattaaatccccagagaacacgcacatttgaaattaatgggaaattgtcttttctaaagaatttggtatgcaggggcacatgatgtggaatttcccctgggttctttgtatcaggttgccccattgccttgggcttgtgtgagagtggacctgggagtgaacgggtgctcgcagggcccacctggtggtcagtctgtaactgtggctatgagcagcctcccaccctgtaggcccctcacaaggcctagttgcctggatctccaggggcatctggaagcctggaagctactgtctcctgggcaaggaggccttcactgcctccacagcccccatctgcacatgggccgcaggccctggcaaccccttcccccacttccctccactggcttggacctccaggcccacagcaagtaacttttggtttgtgttttacctttcacttgtaagcacattttttttttatcgttctatagggatttttcatatatcattttggatcctgtttttaaagctcagtatccctgtttttacagccttcaggatagtcatcttctatcatgtggttgtaccacaatttgctagttgtatccctgttgctgaacattgagctttttattccagcaggttttttattgttgttttataggcagtgctgcagtgatcatctttatgtacataatatttagcttctgtgcagttagtttcttagactctattgctagggttggaattgctagccaagactaagaataactttttaaaaatatattaaaatcttcttatagtaataatatttgaagaacagaaaaaggtagaaaaaggaaaataaagatgcccagctgtcccatgatgtggtgttcaccactgtattagctaggagtgtatgaggctgcagataacaggaaacccaactcgagtggcttcaacaggtggagagagactcgtttgtctcagggaacaggagacttgagagagagtccagggctggacccaggtgaagccatgctgtgagcgaccctggctgtttgcatctttctgtcccactgtcctggatgttgctggcctttgtctatgctatgctttcctcatctcagtcttcctttcttacctctggctggatgagtctttttatttctgtctgctgaaacagtgtatctcctgcatttgggtcattataagaagaaatatgattatttttcctgcatgtccctcgtctgcaactgcctgtgtttgtgacattccattcggccaaaactggaattttaacagtgtccagacagagaagaggaagagtaggcatcaggactaggaaagagctcctctttcttattaatgggatagtctttcatccctgtgtttcaagttcacagagtcccttgggttagaaaatatcctttgctctctccttgattcctatgaaccagagaaggggacagaatcttcctgggcttattggtcccccagtcagtcttgcaaagggaggtttattgagcacttaccatatgcagcagggggttgtgagccacagtcgtggcctttgggaagctcacagaagaggggaggaagcaggctgacttacccctgccctatcacactgttacccttgtgtcaaccaagcttaaccttggctgagtagaaatgagtgatttgtgacctatgttaatcctacagaaaagaacaaaaaaataaaataaacttccatagatgcaccaccaggttttagttattagcatttttccgtatttatactgggtacctcttttttgttttgtaaggaatgaaatatggcagatagagctaaaaccctacttcattccctttccattagtggccactcccctgacgttggtgggcatgcttttaaatgtttcctgcatatgttatgaatgacataaataatatgtaatacttttgtattttaaaggtttatgtacatgttattacactctgtggttttttgcaatttgcaaaacagtcaacattatgttttctgttatctctctatccatccatccatctatccatctggttcattcaattttcattggtgtgtgggattccactgtataaataagctcaagtttatttactcattctcctactcctggaaggttgtttttactttttgtctcttgcatacaatattgtagtgaacatgtgttccagttttttattgctgtttaataagccacctctaaacttagtagcttaaaacaataatgtttattttgcttctgaatctgcagtttgggcagggcttggtgtgggcagctcatctctgctccacttggtatcatgtggggcagctcaaaggctagaaatggaagcatctgcaggtctgttcgctcagcatccgatgagtgattctggctgtctgctgggaccctggctgtgctgtttgctggagtattacatgtggcctctccatgtggtctgggcttcctcatcccatggcagctgggttctaggggctagtgttctgagaggcccctatactgaaaccagattgctctgtgacccagcctcaaaggcaggcagcatctgttgacttcattctgttctttggaagcaagtcactgaggctgcctcccattcagggcaagggagattggactccaccttcaatgggacgagcctcacagagttggtagacctgttttcatactggcatttatagatgtacatccttgtacacccctgtgaaagcttctggggctgggacccctcatggtgacttgacgggccttcatgatggccctctttgacgcgaccacatgttgccagcttcccctcctgagtatttgttccgtggacgcccaccagcgtactgagcgttcccatttcttcacaccctctccatcatttgctgttagggattttgattttttgcccctctggtgggtgtgaaataggatcttattgttttaatttgcctgcccactggcgaggccaggccctgtgctccatcctgggggtggtgttttatttcctttcccagctgggtgccctaaagaagacagaaacgtcaaagtgctattttttggcttatgatgtcaatttttcaggattgaagtggcgagcgtcccacagagtttattgcaaactattatgaaggtcttggagttactgttggtatgactcatttatgaaaaaaatatgatttcagtaactgcaggctgtatttgtaatgtgatagattttcatttaatctctcacctctctataatttgcccaatttaaaaatgccctgaagcttgctttctctttgtctgggagccctgttcttggtatgtgttattacaataatagtaataagaaattgtgccaatatgtgtctctcttccagctcttgctgtctccttggtcatttaattacttctggtactgatttcccccagcctgatctcccctgttataatagcgtgtgcatgaagcttctgtggagaatgccactgaggatggaagctgtcggtggttggcaggccccagtgtgggcatacctggacccacgggctggctgtgggcttcctccttgggccacatagcacccaattagtcagacacaccttattccgatcgtactgtgaggttgtagaggaaagtcccttcagatcctggcacaaaggctggcattggggagtgtttaggaaacgtgttgaaccaaataattcaaaatgttcggttattataattatcaaggtaacctgctgacgtcactcaaaaacatctggaaaatagccatgtcagatcaagaattttatgatgaatttcctcgaaaacggaacttttgactacttttaatttaatctggttccatctgaacactctgaacactatttgcagcgtgctggagaacattatcttctctgcttccctcctaaggggtgtttggattcttatctgtgttgagaaccagagcctgtgctgcggaaatgagatcttgtctgtgcactgagtcagcccaggtcttttgcaggcactcaggaagcagcatctacatcttgaggggctacttttctggattgtgtgggtgcagcgtgtcctgaaaacatcactgggcactgctgtccataccttatgatggggcacgggccactccaggagtctcaggtggcacagctgcccaggatgggcttggtgctggtcccagggaggcagatgacacgtgttgcccctcagaacagtggggacagccaggtgtgccacaggccatctcgcagggcctccctgtaccaaccagattgggtataaacaaggcattcattacctgttgttttaaggggaggaaggcaccacgggcgaggcctcccaggctggctgggtgagtgttcctgagcccaggcacttcgatgcccacactacttccagggagctgagtttcagagcctgtggcgttttcacaccatgttctaggtgccagcagaagtctaacaaggagcagggcattagcctctgtttccatgacagactgttcacagcctcacagtttgcatcccgtgtaaacaaacatcagcacctgttatcctaattaaacctcagaccttgtttgcatgttaagagttagcaggacaatcctttgctactggggacccgccactgaccccagggctttcttgtatcaagaggaacaaaatggcatgagattgggacctgggagcaggccccacaccaggtgtgacatgcctgtgctcagccaaggggtttaactgcctgtggagtctggggcccagggccctgctgcctgtccagtgtttgcgtgggaatgtcttgggcctggggatgtagagcccaggttctgggaccagcccttcctgccctggtgtcttggtttcctagaatcttggtgcgattcggtggttaggctgatctcagggttcctttcagcagcagtggcagccgtgaccacctactatggaccagcttctgccaggcaccttgtagtctagcagagtaagtttgatcattccattccactgacaaggaaactcaggctcaacaaggtgatgcctttcccaggacatgtgctcctgttgccctgcccctcctggcataatatcccacttcctgcttggtggctcaggcctgtcagtcacacagctcgtggcttccccatgaagcatctcttgggtctgtctgtttctctcttcatccacaccttcctggcccaggctaccatcatatcttgccaagacaagtgcagcagcctcagaaatgttctcccctgcctccccttcatgcccccaggcagccaggatttttctaaaaactgtgcacctgggtgtgtcccttgctggccccatggcctgcagggctcaggatcaagttcctcttccttgatgtgggtcctgggtccttggaggctggttgtgtcagcccttctccatcctacctcccttaatgtgcacatcctgtcaccccatgggcctaagctgtaacggggcagggctgtcacttgcactgactcattccagtgcccagcacaggggtggcacacacccaggagtagctgttgggtggatatacaaatgttgccataggttgcagagctaaaaattagggaggctaggatttggacctacatttgctatattccaaagcccctgctctttctactccttcccctagactgtgaaatatgtttgatggggaaagatacccgggacagaacccgacttttgcacgttacagtagaggtccctggcagcccagctctcctaaacatgaagctcatcaggcagcaccgtcggacgctgatggtgggggctgggccctgtgctgacacaggctcagcaggctgttaatgaggtcctgacaagctttcgttttgaaggagttctcaaaaatgacaggttttatttcaagggtctttgttaatctaatagttttccctggctgaaatttgtggactgtttaccaaagctctggcatgtgatgacctagggacagaattaaagcaatttcagcttggtttcaggcacagatatgcagccagggaaatcacctggggcaagctgaccctcaacatgaggcaaggggtattcagtggggccagggcgagaccctgggccttgcgaggacgccgtcctgacatttccaccccaaatgggatttgcataagcccaaatgagtgcagggttattctccgcacgccgtcatcgtgaatatgcattccacagcttcacatggggtagtttaaaaaattaatagatatgtcctttatttctctctctacaagccaaagcttggaattaattttttctggcccactaactcttgtggttaaaagtacaaattaagttttctgggagaatccatcacaaaattattgaaaagtcagtgtagagaagataatgggctctgtattgggttatgtctgtagggttattgttttctgcaattacacttttctttgtttttctttttttgtgctttgggaaatcaacctgagaatgggcttccaactcggaagagttattggctacttttcccaaatgggattgcccttccaaagaactgtgggcatctgtttgacaacaagttataaatttgtgttccaagttctctgaagaaagcatgaatcttcgacaatggcactgtggcactgtatttcaggcaggcgtgcagagctgtcaaaagtcaataaagtactcagacgcctgcgtgcgcccagcccacatttgtcaagtgttctccgcgtattttgcgcaggattggaaggcggattagagccgagttctccagagctcttcactctgccccttccctgagccccacagctatcctagaatgggatctgttggagcctctggagcaagtttcctggtcccagagtccggctatccatctttcccatggaagaggaagactgctgccccccagccccaccccatttactgagaacctgctaggtgccaggcattgtgcaaggcaaccgggcacagagaaacaaaagatacgcccctgccccagcaatgccgcctggtatgggtgctgccctgccattagctatcccagccctaggaaactgccagctggggtccagtgtctattacttgtgtggtggtttctctagtggcagctagtgaaatctcaggcagaggggtttcatacatgagctgatcactcgggggcttgcttaaaacccttcagcaactcccccttggtctccagataaaagcccggtccatcaatgtgtcttccaaggccttctggaacctgtccctgccaccttggggccctcctcctcctcctctctgctgctctggctatgtggagccgtgctgtccttcaccctgcctggccagccttcacctgtgcctgtcctctgcctgggacattccttcctcctactctcttcttcagcttcatccttcctgactttgtgagacagcccttttcccacgaagccctccatgccccccagctgcattagatgcatccaccagtgtgctcccactgcctctcagtctcctctcttgcagcacttatctgtcccgctccaaatgtatcccgttcaccatggggcaggggcctgtgtgtcttgctcactgcattgtatccccagcttgatcacagtcagcagggtgcagtaggcactttgaaacatttgcaaagtgacacacggtgccttggaggaaggtgccatctctgtgaggcaagagtcctggtgccgagtaggtgcgggccttggaggccaccagtgtgctaatggcaggtgtccaggcaggagccgggggtgacgtgtgggtgaaggatgtgctgtggggtcccgtcatcacttgctttattaagctggttgtatcacttgacatctttcaccactgaaggaaatagagcttgttttaaggtacaaattcaggggtgtctgggctgtgagagaaatagcttctggcaggagtgctgggttgatgggcacctttgccaccaccccacccattgcccaggcagggacaggaggccagagctggggaggggctggagccctggcctcctggctctcagtggctctcagtgtcaggagatgactccctctgcacccctgctgtttctcctggtgatgtggtgctggagtgggtttctctggccaggacagccagtggaggccttgcagcgactgccgtgccctcaggctgaggctccttctacgaggctggaagccttttcctcctgagaccctaacacgctccctttcctttcctttttgagggaagccaggttccctgcagcagggcctcatcacagttccccctggagcattcacgcaaggtcacttttcccatctgaggaaacgtttgtcgtgtgctccgaccgaagcgttggcactgacccgtctagaattctgtgtgcggagtggaggtgagatgctgaggctgtgcctcagcctatcttgggtccccctctgcctacaggcagtgagtgtggcctgggaggcaggtggccctgtggggtgactgagctgggcgttgtcctttcctcttcctggtgtgtgtagcgagcctggtcagagcatggcgtctggagtcaggcggcctggctacgggtcttgggtctgccactcaccagcctggtgtgggcagccattttagcctttctgggcctcagcgtcctcctctgtggatgggggacagtgcctgagcgccgggggctgcacatggtgcctgtctctctgcgttcttagtggaggtggcccctgtggtggtccctgttgatgccgacctgctagcctgctccatgctgtccaggagagtactggggccttgccagcggagccccctcttccctggtcttatccctcggaggtgctctgctgagagctgcccctgtgaggagccatttcacttctttcttcaagtggatgtatttttgaacatttgataccttctttcaaaagtgctgtaccttcgcttttattctactttgaatgtaatttagttgcacattcatatttaaaatctcatatgaattaatttcatgaaattggtttgtttttcttcttccatttcatgaagcaatatcactcaagctcctcttgcgtctttggcaccagaggcgtcatcccccgagccactctgagtcatctaatatggtttcccgagcgtgtcagcttcacttcacataagtcatttcagatcctgcacttattgaatcagtgcatactgctgtcactgggaagtttccactgtgccgtagatactcgtttgtaacattttagaacattttcttccatttggcactttgtgttttgtcccccgggttttgatctaggctgcagaacaggacctgtcctgactccgtgctcaaagtgctgagtgaccctgtgctccactgaagttgctccatccaccttctagaactctgacgccagcttgtcatcagcttctcgtttccttgggagatggggtggtgcagcagaggccagcctgccgtggggaggtgggctgtgtgtgctcccatccctatgaggctaacaggagacttacctataagcaggcatgcaggacctggagtgaaagaaagaggagaagaagttgcctccttgggccaaggggctaaggtggctcaggatatgtctgttcatcttatatcggagcccactgttcatctgccctgaggcctttaatcaccaagaccccagtggctgggggaaggcctaggcagtcctatacatacagcttctgagaacgtcagaaaatcaaggattcaaccccataatataggtgacactgcttgtcttagtctgcttggactgccataacaaaataccctagactgagtggcccacacaatagatagtttatattctcccagttctgtagactggaagtccaaggtccaggatcagccagcagcattggtgtcaggtgtgggctttccccttgggttgcacacagccaccttctccactatgtgcacacatggcctttccttggtgtgtgcgtgctgctggggtggggcggtgggggcagggaattggggcagggagagagagggctcttatgtctcttcctgtaaagatagtaatcctgttgaatcagggcctaacttatatgacctcatttagccttccttccttccttagaagtcccatctccaagtgcagccacctggggagttagggcttcaacatatgaattttggggaagacacatccatgacacccctagtatgctgcctgacacatggcaagtgctcaatgaatgtttgttatatttgaatctgaaaggttccagaaagatgagatggacttggccccagaggctctaggcaaatcttgcagaccaagggggcctggtgtgtgtgtgtgtgtgtgtgtgtgtgtgtgtgttcccgggaaggcacatcctaagcttggcctgctggctctggctggtatgttgggtatagactggagatgagctccacctctgcccagccagtcagagtcacctccggacctcctgcttcctgatctcctcagccctttggggaaatggaggaattgtgacatttgccctaggtgatggggtgctgctactggggccatataccatgaagccgaaattcctagtctgtttattcataataataccttatagctgagtaatgaaagctgcatgagagcaaggagagtgttttatcatcagcacgtcagatggcgcctggcacaaagtaggtgctcactcattgggtgttggatttaattaaaataacggctagtcttgatgtgcaaaatggcttcatgtactgataacctcgtaccttatgccaggcaggactgtggtccctgtttgcagatgaggacactgaggcacagtgggaaccagcggctgttataggtgacccagtgagggaggctgcatctcgataggctgtggggaagggatggtggagatgcaggaagcccatgctgacgtgcggagtgggcctgcacagatgaggcttgcttcgtgctccccagcctggcaacgtggacatttctggctgtcgagaaggggcctaagaggtgcccactcccctccttgtgggtcatttcatccaccaactcctgcggtgccagaggtgtcctctggcctcagcctgcaggaataaatcgctggtgaagggcttccttctggcctcatcgttggcttctatgtggccggccttcagtaggtgtttcctgagtgagtcgatggaaggacacattaaccacacttacagattgaaatcaatgccctttctgctcagctagctaatctatcactctctttggcccctgacatttattatgaagtgtgttcttattttattagtatggctaattaatggatgacattaaaatattgacatgaattgatttgagtatctgtatccttggagcttcagttaataaaataacttttgataagactagtggttttagaacattgagacttaattatattttctaaaggatttctctagaatcatataactgcttggcaaggtactttaattccctagttaaccgaaagaaattggtttttcgtttgattttgctaaatacaaattaaaagtaatatacatttgataaaagcagttaaaggattatttataaaagcctccttctttatatattcggaaataatccataagaactgaattaatattgaggatgatatgcagagaatatgacagttggagagcctgtttggcctagagaaatatgcatgcatttctgttggtaatttctttttttttttttttgagacagagtcttgctctgttgcccaggctggagtgcaatgggacgatctctgctcactgcaacctccgactctggggttcaagtgattctcctgccttagcctcccaagtagctgggattacaggtgcctgccaccatgcccaactaattttttttttttttgagatggagtcttgctctgttgcccaggctggagtgcagtggcatgatctcggctcactgcaacctctgcctcccaagttcaagtgattctcttgcctcagcctcccaagtagctaggattacaggtgcccgccaccaagcccagctaatttttgtatttttagtagagatggggtttcaccagattgatcaggctggtcccgaactactgacctcaggtgatccacccgcctcagcctcccaaagtgctgggattacaggcgtgagccaccgcacccagccttgttggtaatttcttttgccattcttcctcaaagatgagtgcctttcttccttgggtttcttctgtgcagttgatgtgttacacttgtacatcccagtttcagcatcagcaagttgtgaattatgacaatggttgaaataggagcactaaggagaattcaggtgtttcattctcatcttacttaggttaggaagtctgccaaagctagcaatttgaaaagaaagaaaataaacaaaatgaaaggaaaggaagatatcttgcagaaacactcactataaaaatataataagtcaatgggtattatcccacttgtaagagagtcaactcctttcattcgttatttttagaaagcttactgtcacgatgcctgaatcttccaaaaatgtagcatgctgaaagagaccttgcaaataactccatcaagttcactagcctacaaaaaatccatcttctcacctttcttccccttttaaaaaatgttgatgtaatttcaggcttacggaagagttgcaagaacagtatcaagaatccccagacacccttcacccagtttctccaaatgttaacatcattttataacccattccacatatataagcatgcatatatacatattttttggtaccatgtaagagtaagactgatagtcctttactcccaaatatttcagtgtgtgtttcctaaaacaagaaattctcttatatagtcacagtgtaatcatcaacatcaggaaaataacattgaagcactagtcatgtgttgcttaacaatggagatatgttctgagaaatgcgttgttagacagtgttgtggtgggaacaccatatagtgtacctacatgaacctagatggtacagcctactacacacccaggctatatggtataacccattgctcctaggctacacagctgtacagcatgtggctgtgctgaatactgtaggcaattggaacacaatggggcatttgtgtatctacacatatctgaacttagaagaggtacagtaaaaatacagtctaatcttatgggaccactgccgtgcatgtggatcgtcattgactgaaatgttgttatgcagcacatgactgtattatctactgtacataccttattgatattttgtcaactgtcccaaaaatatcctttatagcaaaagagaattcatggtcatgtgttcccttcatcattctatctctttagtctccgttagtttgaaacagttcctcagtttcacaacactcacatttagagtacaagccagttattttatagaccttcaatgtaggtctgtctagtctttccttgtgattaggttcaggtgatgccctttggcaggagtgttccgggtgatgctgtgtttctcagtgcttcctaccaggaggcacatgttggttagtcctgttgctggcagtgttaactttgatcacttggctaagatgccaggtttcttcagtgtagttaatattttgccttttgcaattaaaaaatataatatggagaggcactttgagacaacataagtatcctgttattcctcaacctctcatcaactcgttttagcatccatccatgattcttacctgagtcagtccctatgatcacgcttgtcacgtggggatttctcatcctaactagaaagaagagttttcattccccccccattagtctgtttattttgtatccatgtggactcatggactcctagtttcttagtttaacagtaagttataataatacatttttatcatttgataagagaaatctcttcacgctagctgctgtctccatattctttgaacatgacttgactttttggcacagcaagatattctgggctcacttattcttttcctgccccagtcctagaatcagccatctccaaggagctctggttccttttagtggagaaaggcatttagaaaccaagattttggccaggcatagtggctcatgcctgtaatcccagtgttttgggaggctgaggcaggggggtcacgtgaggccgggagtttgagaccagcctgggcaacatagtgaaaagccgtttctacaaaaaaaaaagaaaagaaaaaaaaaccagagagagaaaccaagatttgggatttgggtattagatgtgctcattgcttcattgctactgggggtcactgcttctcagaagacagatcttggcgatagatgtctgcctatacatgcacacatgcctctattcagttatttccaggagaacctgtgagtttacactgatgtctctaatcctgatctagtgctgtggggttcattctgcccttttccatttccatatttgtcactcccccctccaacagtgaaacctggcttcctggttttcacaatgtatttatgtatttgctcaattctagaatgtcagaaagtagtttcaaaattgctaacttctgcaaaaagaggtctagtgatcagaattcagtattagagctcttttcgacttcagactgagagcatatagtccacatttcaggtgtttcttgggtttgttccctgctgccccctttcagtgtggttatgttattcatttgaaatacaatttggttcctttgtttctctttgtattctatttgagagatttccccaatcttagggattttctcttccctcccttttgtgtgaaccacggacatttccaaaaggcaggtctgtacaaaaagttctattcagagaggtgctccccctcctttccactccaatccctttttcctctctacccagctcccaccctgccctgtagggaaccagtctcattagtctgtgttttttccttctatgtttctttttgctttaatgagtagtttcttattccgctctttttcttcataaaaagtagaatattctgaatcctctttcacagtttgccgtttctcatttaactgtgcgcctgagcaggctacattagtcctgaggggtccctgatccttccttctgctcctgaggggtctgttgtggtctccattttggctgttatgtaggtgcatgagaactgtgcagtgtgcgtctaggtgctaatgacagcacagcccccaccaggcgttgtgtcttttccacctgactctggaagagtggtaatgtgggcagaggaggaaactgaggctcaaagtagtcccatgaccacacgtcacacagatgtgagctggtcctagaggttgaggccagactgtctggtgccagaactgaaacttgtgaatgacgggtgtacttgctcctcctgctggggttcattgcatgcctgagatgccaagagcagggctcgcatcaccctgggtgctaaggaaaaaggccccagggagggaaggataacccaggagaaaggaggagctattccccttataattgctttccttatcattcttttaaaatttgttgtgtgtacatgttttgtaatgagtataacacatcaatagaatagggtttatgtactcaaagttgtgtgctcagaaaaatttttaaaaatgatagtgatatgtgatcaaaaaagtttggagatcacggaaagagaagctcactcagctgtcttgaagtggagagagccctggcctggccttaacatccagagatgagggcttgtgatcccacctgctcctgctatgggggcaacaagacattcattcactcaatcattcgttcattcattcattcattcattcagtatggctgagcggtgaggttaacacagtgagcaggaaggtgctgtcctgacttcagagagcatctgcaagtccagatggggatcttcatggctggaaggacagtgaggcctgtcagggaaggacacagtgctgtggatcacctaggaggggcttgtaagtgaggtttgggggttagatgtgacttccagggagaagagtgacgcctaagtgtgtatgagagtcctctggtgtgaggcttggagaggagggagtgtagctgctggccagcaccgtggaagagttgactctgagcaaatcattaatctttttgggccttaattgtcttctctgtaatggggaaggatagtaccactggcctctccagcaagttctttgcatctgctgaggccagattcaggtgtcaaattctcagctctgctgttgactagccatgtgtctttgggatgtgttatgtctggagctttgctaacaaagctttctcaccttatctcattgagtcctcccatccagcattttccatatgagtgctttgagtttcagagaagtgaagcgcttatggagggtcccacaagcagtgggagccgggacgcagggctgactactacacctgggcccgccttttcaccacagactgtgtgtgcttgtcatacttagactttgcttgtacttgggaaaggagttcagtttgctttaatgtcactttaatgctttttagaattcatttcctttgtttattttgcagcggtataatttgcaatgaaatagtttcacattgagcttacatgttttgatggcatcttaatgttggctccatggatttgcagccagatacttttgtcattctaactttcctatatgatggcactatgtggcagtgtggccatgaactatggcctgggtttccctttaggccggccaggtagcctctgagtcaggtgttcggtgtctcttgggtcgtggaggactctgcacactggggacaagtgtcctgtgtgtcagtctcctgtgtagcttggttttactttgccatgtcattgggtccttcctggggttgggtttcacctaggaacatctggctgggcatcatatgtgcagaagagagcgtctcttcgctctcgccccctgagctgtggagggtacatgcgcaccccagaagcaaaagctctggctcccagagggccttggtttgctaggttggccctgctttcagttgctgtccttgtgccacagcatatgctgagccatctgttctgcctttttgttttggaaaatgtggcacaacagttagagtcttgcctagaagagcactgaaggccttttagcactggggctgtgccttagccatttgggtcccttcagtgcttggtgaggggctggagctggagtaagggcctggtacttgtgtgttgaatgcttgtatgcatgtttgattattgtggctgagggctcaggagagtggcaggaaaggaggaggtggagcccagagcagggacttctttccagggcccaacccacacgttggtcttgctcctggaagagcacctgcctgtagaaagcaggtcccttctgcccagccccccacggcccagccttagccccatcctctcctcaagagaccccacagcttggctttagcaagacccagacccatatctgagattccagtctgagcccgctgagtgttgagtctcactgtttcagctcttgggtttcagtgcccaagaagtggtactatagtggcataaaaaagccacccgaagctgggctcataccttagctttggcacttactagctgtgtggccttgggcaaggtgggttgcttaacttctggcagccttgatttccttactgtgaagcagagacatacctctaagcagagagtggttgtagggatttgggatgacatgtgtccagcacccagacacttgggcattggttgccattattattattagtattattactagtattattagtattagtagtattactgttactgctactgatgttactgtcaccaccactgttaacccccattctctccctctacctctccaaccctacgttcacccacagcactggtgttatacgcccccttagtgaagaagagaagacaggagctggctcagagcatttatctgcccagctgctgtgagccctgagctgaccaccaaggatgctaaggggttcaaggaggactgcacctccctctgtccttgccttctcatccttttttctcctgacacaccattgttttcgcaaaagaaagaagtagttggagtctgggaaagaaatccccagggccctgtttcagatgattgtcccatttctaaacttgagttaataagagtaaacaaagtagtaggtagatttgcacaggagaatattattattctcatgattatgtaaatatttatctgttctggctttcttattttgttgctggtgtctaatttccaagtcttgtaatgaagtgtaatttggagaagatttgcaaagacaggcacgtagtgaaataatttgatttgttcagtaaacttggtttcagttattcctttccatgagttgttttagaaccccttcaatttctttgtgatttgacaacagctttcagcccaatgaagatatgactcttaggcattgccaggaattcagaattggtttataatattgtcgcttaataagaaaatgcgttcattggcaggatataaaatttatgggcttcaaatggatttctgtttgtagttttagccctctgtgctcctgccattctcgaggctatgagtaaggttttttaattaagtcaaattgaattgaatgagcttttattgaacgcccactctgtgccagacaccagctccttaacccttgcactgccctgtaggtggctatggggagctgagccagaggaggttttgccccatgctcacgatcattcagctggcaaacctgggaggtgggatttgaagttaggtttgattctctggctttttcatccaaagctgattataggcagacttgattaaggagaagagagaggttgagtggctttcatgttatttcattgaatcttgtttagtcttctcagccaccctgtgaggttcattacattttccctattgtatatctgaggaaagtaaggctcagagaggtacagtgatatgctcagggtcacacagctggtaagaggcagagctgggatttgaactcagaactgcctggctgcaaggccagagttccttctagaacccctctaggggtctgcacttcctttagcacatggccaattgaccacctgcccacaaaaaatggcctggccctggtggctagggcaccctcctgcagatggaggcaaggagcagtagggagtggggctgggcatcagttgcccaggtacttcctagctctatgccctgggcaagtgaagtcctcctttctgaccctccctgcacccactggtgactggtggcagaataccctcctgggttattgttaggatcacagacaacatgtgtgaggcacctggcacttggtgggcactcaggaagtgaaggaccctgccctttggcatctgttgcttgtcagaatgcgtggtggatggctctggcctcggtgacgaagctgctgttgcttcagcccccggactcctgtgcatcacagagctgattcagtgcagacaggtgactcatctgatggcattttgtgtggcgttgtgcagttcagcctggtacagcacggcccgcccacagcaggtattcaagagccgttagtgtttatgaaggtgataaaattgcctagatggagggaagccgtcaaaataagagcctttgcctgtcttgtgaaagttaacttgcaaacctaatgcctgtggggctgctgaaaaagcgtcacctggatttctccttggagacagaactctctggaaggacagctgggcagcccctgcttgccatgtgggggtggacgctttttatgtgacagtgagttggagaaactaacagtggtcttcaaggcattgtgctcagcttaactctttgaattgccatagctttaaaatgaatactagaaacagttatatatttttcacactctccatattttctccattcaatataataaatgttatcttgaatgtttgagggttttatagcaaaaattcctcccatttgtaaagcatgctgcagtggatgggagtgaactagctggcagcgctctcgtgtgacgtggcagaggctgagggagttgcccaaaccccacttccagttggaggaagcctgggccctgacttccagtgcatgttcaggtccacttgtcaaggaaaggatccattgttaagaaacaaacatgggaaactgtcatgtgagcgtccctaaaagcagcatagtcattttcgagtcactctctgataaagatagaacacttcatttaggcacatttcaggatttcagaacatttggagtagtcctggggtggaaagcagcgttttcctttttcaatttcaacctgactccattcctctctttatgtgtgtcagtcatagcaggggagtgttttcctcttggatgcgtttgcacctggcaaatgaatgtgcaggaattctttgattgcaaaatagctactctcaaaatgcagacaggcagccacagtcagggagcccttcggccacggcagcggggtggcgccagacacctggctttgagtcccgtggaggcatgccacttagtctgttctgagcggctgtttacaggcggatagaaagggctgtaggatgggaccctcaaggttttggggcatgggaggggctggccgtcatgattcagcatgctagctctctggaggctgtgctgagcactgagggacactgggagaaaaacacaggctcctgctttgtccatgtggaaggagcccaggctgccctggctgctatacgcatccttccaggcaaccttcaccttctggtctatttagtctcattccctgtttttattcccttcttttatttagggagagccagagcagcaattctcaggtcaggattatttgggagatccatattacttctgattatttacgaagggacaggccgggggaggtaaccacctcgataaattcgtcagcgaggcagctggagggatgtgtgacaaacataccaggctgtcatttggccagagattgtctgcactgggattgttcccccaggatagtcctgatgacaaatgtaattgacattttttattaaccctgaaatgattaaagatgctgctgctgaatttgtgtcaaagtacccggtccctggcattttgagaaagggattctctgtggagccaataaacagcctgtgttttcttcctgttcatcactttaatcaactaagacatacagagccctgtctggtttggtcttgaaactgggccagggagataagactctgcttcctggcttaggtttccagaacactctggtatggacatcatgagggacacataggaggcactctgttcatttaccacacagtcatcaaacgtttgctgagctccttctgtgtgccaggtcctgtgtgtgatattgggcgctgtctccttgaagggtggtcgctgtagaatgggggctagaaagatgtttatggggatgattgtgagaactgagcattgtaggggaagactgggccaccctcactgcctagggggtggggtggggcagggaaggcagtgcagggggtggtttgcgtcttacaggaagggagtctcctctccagacaggtcttacctctggagctctccaggcagatgctggaagtggcagtgcccagagtgtgtgggtcttggagtgccagagtgtgggaacacagaggggcagcaggggagggtggaagacacacaggagagcttggctggggcctgcagatgggctgggggccacatggagcgcaggtggactttgctgcttcctagcctgcctgctgagttactgaagctcttggtcttggtttccttatctgtgaaatgggacaatcctactttcgcttctgtcatagggctgctgcaggatgaaatgacagtaggaggaaagcccctgattggtgcttggcatacagagcctagtcaacaagcatcggttccttcctagatgcagtctcagtagcagtggccaggtattgagcacctactgcatgccaagcgctgggctgaaggccttgcactgactctctgttaggtatttttattcccattttatagctgagaaacttgttagagggtaaagcagttgctcagggtcacacatagagagaggcagagagaagatctgacaccaggctgttgctcccaagggcttcctttcagcagtgcaggggctgggaggtgccaggaggagcaggaacatggagagggccagctttgactgtggccagagccatgcttgagctcttcttttggagggatgggcttgggttgcagagggtcttacagggagagtgtgcttatcacactgctcctggatggactgatgaattgaacacttcctgagcacctgttttgtggctagccctctgctgagggtgcacacattccctcagccacaaagccagtatttagtgagcacctactgcatgccatgtggtccaccaggccttgggtagatggtggtgtaccagaggcaggggtcttcaccctgggggagctcccaggctggcagggaaagaaggaaagaaaaagatcacacatctagcattgtggataagcaacatttcagcactgaaatagtgggtctatgttattaacattttatatgctaggctctcccacacaaaaccagatcagaaccctctctcttgcccctgaactgcataggtttcaaaggtgatctgtccccttgtatctcgacctgttgctcaggaaccattcccatcagtttaatttctttttccttttaatcctgtggctggcaggatgttgcaggggcagtaatttaataaaagtatgcagtttgtaaagcagctgctattctgtgtactaagcacatttgccaaccttttcagggaaacctccaagctgttcttggaacttagcgatattgcaggaaaaaaaacattctatttaataacatttcatcctttgggttctgcagctaatagaagcataaatggaggccatgtctgaaagccatttctttatgtgattcagagaatcaggacatagcaattacacagtgtatgggatttatggaaacattcatgcctaacaagaagaaaacagctcagtaagttatttaatttgaagtcacaggcccgctgactggttccccacccagacctaccgcactgctcggcaggccccaggcgctcgcacacaggtgcccactgctccctgtctctctgagtcctgcccggctgcaggtggaaacctgggcctgctctgtggggtgtgttcacaccttaggccagggcaaggtggagctgggtttgaatattgctcttctgactccaagcctgtctttcctcaccactgcatataacagcctcattaggtttgtaatacgtggcagctgcatgatctgctgggtaagagacacacatttagaaaaatttatgtgccacatgcttttcctttctttatttctctttcccctgaactgagataaaaaggagagtcacacacaagcagatgtcagaatgactgccttgcttcgccccatctactggaaaagccaccgactgaattcttcctaacaccgtttctgtttatggcagatatagggtgggggtggggggcagggccctccattctctgctttccgtgctagccgaagccttaattcaaaaacaaattgagtccttcagctgtcactcgattgttccctctgattttgggggataaatatcattgctgcagcctcatgtctcctctctctccttttccccaaagcttttccccttttattttctctctctgcccagaactcaacatatctctgacaaaagcatgcattatttagagcctgtcgcctcttgaagttctttaattacagaattaaaccaaagtaatgacagtttaatttgttctttcattaattgggagcgctccgggctgatgtgaaatgagcgcatttggaaggcatgaggaatatgtactgagtgattggagcatgagtaataataattgctgtcgtttagtgccgggcgctggctaggtgctcctcatgcatattctctgttaatgctccctgcaaccttgaggaggagataccaccttctctgttttgcggcttaggatcttgaggctcagagaggtgaaccaacagccacctgtcagccagaggaagagccaggcctagacaccaggagcccagccccagagccttatcctgtccatagccccacttggccttgagaccagcagctgtggcctcaggattctgcaaggggtggcccacaggaagatgggcacacctggcggggcatgcctgagaaggactaagttgtgtctggctgaatttgaggctgagaggaaacatttgaacccgtgaaaatggaaggaaattggcggtcagagggagctgaagcctcactggtgctgatggaaattttgctacttcgaaggtagcagtttgtcctcccgggagccctgcagccactgaggggcatgcctgcgagtgcatccgtgccacttagttgtgggtcagggaggctgctgcagggaaccgcaggatggacatctctaaagcatatagtgaagggtagaatccaggtgtatggggccccgtcaggcctgctggtcccccttaccctagctaaggcccatgccagagctgctacctttccatggacacgtctgggtccaggtgacttccttcttgcactggccccaggccccaggccccaggccccaccgtacctggcagatgaagtgcctctgatgcccctccgtggcctgcagaagttctgggttgggcctttggtttcaggcccctgggactatacagagggtggatggttggtgcattcacagtactagtggctcatctggagggctgtgtctagaaggaggcagcggcgaaacagctcatcgtcctcctcacgtccttagggacttgagcctggtgtgtaccgacactgcgctctcttggcagcaggcagtgagggacaggagaagaaccaaagttgatagtgccttctgtggcaccttctacttcgtcactttaattccctttaagcttccccaccactctggaaagtgggaagattagccccgttttctagctgttgaaatgaaagctcagagacaatggtcatttacccaggccacatggattgaaggggcagaacagagttaggattcaggggtgtctgaccctgaagtcccccatggaactgggcctctgtgttcttgctgtcaccccatatccccaccaggcaccctctcactcactctgttcacatctcccagcaacctcagagttttaccctatgagttctcagacaaaactttagaatttattatcaatgcatttctctgcagcaaagtctggatgaatttaagattaggggattcggttacactttattactgtttgtcattaaaaatcatgcaaataagccatggaataaagtaacttgtgttgttttggacaccagatttacatgtttactggaagaaaaatgatgctgaactccttcaaggtggtaataaaattttgcctcagagccttagctttgttggtctttttctataatttactccacaacttccaaaaaatattttaaactagtttatcataaaactcacaccaagggtttcaaaacatccttttgtaaaggtgaaaagaagactgagaagctgcataggctgcaggctgggagtggagaaggaaagacctgctgcagccatgtgactcaggggcctgagaggtgaatcaaagcctccttgttgccagggctgagacggggacaggatggcttctaggcttcctgtctttggattttagtaggaagtttccaggcttttgttctgaaacccccaggttgcttcatttagcttccgacctccctgtaggaggaggtgggcacagaacgtgtttggaagcgtctgggagaataaggaccaggctagaaagaacctttgttctaccctgactcaggcatcggccatcctttcagagcccatttccaccacagttggaagaagtagttggggtttagaaccctgtgattccaacccatgctgcccctccaagaagacacggggcgaggcccggccataccagtgttgaggtaaaggatctgaggctggccatcctggtagatgaaaagagggttcaacccaggatgaccccaagcctttgggttaactgctgagtttggtgtttgccccagatattataccccctgactgtttcagtgctgtgctccaccttcctcctggcgtggtggggaagggtagccatgaagctcagttggagtatagaggaggagccttctggctttgtgagctcctgcccctggggtcctgcggtggtggtcacaagtgacacagagccatgacaagtagcattgttgatgttgatgatcagaattagtaaaaatgggctggtcgtggtggctcatgcctgtaatcctagcactttgggaggccaaggcaggtggatcacttgaggtcaggagtttgagaccagcctggcccacatggttaggccatctactaaaaatacaaaaattagccaggcatggtggtgggtgcctgtaatcccagctacttgggaggctgtggcaggagaatcacttgaacctgggaggcagaggttgcagtgagctgagatcatgccactgcactctagcctgggtgacagaggaagactccatctcaaaaaaaaaaaaaaaaaaaaagtaaaaatgtataaatcacaacacatggtaagtaacacaataccaatcataattcacttcaaaaacagcagcttgaaattaatcagcagttgtgttgtttcttagaaatatcagaagccacacgctgtgtctgaaagcttgtgagtaagaatgaggaggagtgacaggcagatcagccaacgatagaggggcttctgtgatctgggcaggtgtcgctggtcactcctggctctgtgggcgtggttatgtcctaaccctgtgagttcttgctgctgtcagcaccgcatggatgcagggattcctggctgttagttacatggccaagcagcttctgaaaattatcgtctgtggccacagaaatccttgactaagtgctacggagtcatcattattatcccatcacatgattcttcttaatcctttagaatcacttgttaaactttaataggtaagataatttcatgctcattgaagtaatgtaattatacagactaattcaacgctattagaaaatttctgggctccatttataataacagctaatgcattctaagtacagtttgttagggaaccttgcatattcaacccaaaagaaccccaggtttgcgcgtgagcttggatgctgagcagtgttgagtgaactggagcctactggaagctgttccatttgtccttaggtgacttttttagaagtgattagacttggggattgtttctcagaaatggactggagacccataaatctacaacgattttaattttggacaccaacctggagcccacaaagacaacttcccacgagttagcagcagtgctgggcagtaggggggcacgtgtgctgaggcgtgggcgtgccagccttgcagtggaggaggggctgctctttgccacgtgtctgcagctctcttccggtctctggcttgaacagactggggagcctgaggtcacattttacttgtcttttgggagggaggttggggtaatctggggcaaggggctcagccagctgccacccagacttgagtgctctgtttggtggcaccagacatggtgaggtgggtggtattgagcagggtgggggaggcagcaaaagccaggcctacagaattacacttctgtggcctaatgattttcaaaaaccatttgcgagattgaggtaatgtatttcccagacttaagcaatttactccttcccaccgtgctgaatcaggctgttaaatcctcttgctgtgtgcgtagagctattggcaccagggaaaaatggtcaagttcaaggcccctgccaaatctgtgctcttttctttggaaagtgatgagtaactgcactttaaaaaaaaatgggctgggcgtggtggctcacgcctgtaatcccagcactttgggaggccgaggtgggtgaatcacctgaggtcgggagttcgagaccagcctgaccaacatggagaaaccttgtctctgctgaaaatacaaaaaattagccaggcgtggtggcatttgcctgtaatcccagctactctggaggctgaggcaggagaatcacttgaaccagggaggtggaggttgtggtgagccgagatcgtgccattgcactccagcctggaaaacgagcaaaactccgtctcaaaaaaaaaaaaaaaaaaagaagattttaggaacattggaaaatgttaagtgaagaaagcaggatgccagattgtacattcagtaggatctcaggagaaacaatgtctgcatagaaaaatactgtggaaactgccagcaggttgcagggcttacctgtgcttgagtgcaaggattagatccagtgtcccctctgttccttttcagcatcttacccgttgcccagggtggtgacacctgggccccaggtgagaagcgccccagaaagagaagcacatgcatgctggccgtgagtcatgggcctgctaacttgcttgtcctgtaaccttgggcaacttccttcctactgggagccctagtctcttcatctgtatagtggcccagttacactatctcagaggagtgagggtcactgccaggactccgtcacctgcgtaaacacctggcaatgtgggcatgtggcagtctagataaaccatagccttgtggtggtgatggggtcattataaaaatgcattgtttctttcacaaccaggaaaacattacacataaaagaacagggcaatgactggaggtggaaaaacaacgcagcctacctagctgcatggagacctatgggaacatccactggaccttaacttggcttatgggagtcaggagggcttcctggcggaaggagtgtctcatgggagacaggagagaagagtaggagccaaccaggtggagacagaggaatgtacttcaaacagagagaaggcatatgtaaggctggaggttcaaggaacagagtgagtttgggaaacgcacctagaaagtggcgtgcaaggacgatcgtgatgggagatgaggctgggcaggtgagtggggcctccggagtcagccactgactttcccactgtagctgtttacaaccccctaagcccttgggatgtgcttggcaagataaggccttatggctagaaggctcggagagcatcctttactgggcttctggatggaatttttggagcaaagggttagtactcatttttatgcaaattgagaaatcttgatgaaaacgatcacttccatcccagccccatcagggagggccagggagaaccgtggcttcgataatggtatgggcctgttggagcctggctacagggctgccccgggaggcctcctttgggagcagagacagcctggcactggcctgtggcggttgccatggcagcaggacatgagcaacctgactttctgagagtggtcacctctattccggggccctgccctggctggctgttgcattggggtgggagaggctgtctcagctgggtctctggaaaagctgaggtcaggaggcctgtgccctgggacatggctatgtatgacagccaggacactctgcctccacccagactgggccttcagaaggaattaagttggaggccattaaaactaaatcaggtgatgcttccaggagcccccactcagtaactgctgagagcatccctgagtccctgcacgtgcatgaagcagacagagtgattttaacgcagctccttgtcctggcttaggtgacgcctcccctcacttgtagaggtggcaccatcatgcggtcataggatgagacgtcccaggttctggctctccctgcctctgctatggtgtgatcagaagggggctgtctcctgctgttacgccatgtgccacgacaccctgccttctcccctgctccccttctgcctcactcccctctaatccacctgtaagtcccagtgattcttctctaaactgggcattcagtgcgtccacagtccggcggcccaggcctgctctctcccctctgcgcaccctcttcacttgtctccttgtgttattctggcctttcctatagcagctggtatgctctttaaaaacaaaaatctgcttatcactttgctccaatgcttaaaaaaccatccattttacatggagggaaaaattccaaacttttgcaagtgtctgctgagccctgggtgacctgcgttttgcccactcttgttgctctcctccttcacatagggctccagccacactggccgccagtcccccaggctgtgtgactatgccttgctcaggccctccccacctcaccccttcctctggagaagcctgctgacctccccagtggaaatcaaggtgaatctgttccacctgctattgtcatctcctagagccagttctgttcttcacagcactgatctgagtgagaagagctgtttgttgcttaatatctttctcttccactagactctcatgagctattttgttctctagcagttccagcagtgagcaaatttcttggcagatagcagactggcataaatatctgttgaacaaacccagcgagtgaatgagagtcactcagtcactctaagcctctctttgcccatctgtaaaatggagatgacagtttccctgacaaccttgtgggcttgtgtgaggggcacatgaatgtggaaagtgatgcacaaaaataaaggtataacattattactactcattctaaccaggtcacaacctcttcttccccgcagttattgagagagggagtatgtcttaggataagagagtaggagcagtccagagcccctcttactgtgtgcagattaagcacactgaggagggaagaggcctgtggcttgaggaaagatgtgacatgcaaccccaaaagcacttcacagtccctacaggtggggcaggtgtgaaagagcacctaacaacgtcaaagcagctcaggctttagacctcgggttccagctgtgcgggtccacaagagagtgctgagaaattacagagaatgggagggagctgggagactagaggtgcccaagtggaaaacccattttccaagagtgaaaaaaggtagttttggaagccccatgtaccatagtgactgagtcggggagggacgcttatactagagaaagagaaaatagacgccaggcaggcagtagaattcatggccttgcaggattaaaagacagacatgcttgccaggagccagcgttcattcgccaaagcattcttttttttttttttttgagacgaggtctcactttgtcacccaggctggagtgcagtggtgcaatcatggcttactgcagccttgacttcctgggctcaggtgatcctcccacctcagacacccaagtagctgggtctagagttgtgtgccaccgtagtagagacagggtttctccatgttgccccaggctggtctcgaactcctgggctcaaacgatctgcccgcctcagccacccaaagtgttgggattacaggcatcagccaccttgcctggctcattcattcttacgtgagctgttagacttataggatctgtgtgtattgaggccagaggctgagtgtgtcttgatttggaaaggtgctgacattcagagcctcaggcctttagagccttggtgattccatcccatccttgttttacagaagagcaggaaccagcctaaggttcttgtggtgccagagaggttcagactgttcttgagaaggtaagagagataaagaggtcatacagtccaactggatgacctatggcttgttgaacaagagcactcaactctgagaattaattatttactctcagaatagaggaggtctctcatgactaaaggatactatacttagcattcttttccacagcctaataataaataaattgggtaatgttacagaagggaggtccgctttccaatctgctgatgacccaaagctaggatagccattcttttgtccacatgtttgtccatctgtccttctatctgtccatcatccatccaactatccatcctccattaatcacccatcccttcatctcattcatttatccatctatttcattccattcattcatccatccatccgtccatcatccattcataacccatccctccatgccattcattcattcatccattccgttctgttccattccattccttcatgtatccatgcattccatccatccatccatccatttattctatctatgccgtcactcactcaagagacattgggcttctagtatatgctagactctgttcaagacactgggggatatagaagcgaacaaaacagataatgaagagatagtgtccttacccccatggaacttacattttagtgggagaaataaacaacaaataagcaaataaataaatatgttaggaagtaacataaagctttgaagaaaagtagagctggctaagatgaaggggagtgatgagagcagtgtttagatcgtgtggttcagggaacatctctctgagtagagacttgagggaacccagcagctgggtagagaagagcacctggacagaggagtagcaggtgcccaggccttgagggggaagatgctggagtgtgagaggccaggaggccagtgctgctacagtggagtcagggcaggtgacacaagatttattccaggtgtgatgggaagccactggatagtttgtggggtggggggctataactcgactctgatgcagaggtccagtctggctgctgtgtggcagtagattgtagggcaagagtggaagctgagataccagttttttgtttttttctaaaatgtttttactgtggtaaaatatacataaaatgtaccatcttagacattttcagcatacagttgagtggtattagatacattcatagtgttgtgtggccatcaccaccatcctctccataatgctttcatcctgtgaaacttgagacatcggttttgaggctgttgcagtggtgctggggagagaggatggtgctcagaggatggagccacagaggcaaggagaagtggttgggttgacagagctgacgagtgagggggaagggcataaaggaggacctcagcactttggaccatcaaattaggagacagggattcagtggggaactcaccacgagacaacctaaaggctggcagtaggaagaggggttagtctggctttgcattgtatttctctggagtgcaggactagggcagtgggttggaccttgaggggtattgcaggtgggaggtagaagagcattagtggtgctgaaacctgcacactttcgagccagagtgccttggtccaggtgcctgccccacctctcacagtatggcctgggacaggcaacctctctatgcttcagtttcctcatctgtaaaacagacctaattttctacttcatagggctgtggagaggattgagttaattcggttaactcagttcactcaactaactcaattgtaaagtgctgaaaagcatgtgtggcatgtagtaacatgctcaatacatgattattgctacctggaggcggtcccagaataatgccctggattatgatgctttcaaatgtcccggatatgaagttccagattatgatgctttcaaaaggtgcactggctcctcctgagaccattgtactcccaccattggacaggctctgcacctgctgggggactgggcaggctgtggagggatcttcccactctgcgaagtgggtgtagctgatggcccccagaagccccagcctccagctctccacactctcttcagccccttctgtgatatgtctcgctcttaatcctttttgctttaagaaaactcttctttgcccttttacatcttctgttgacatttaaaattccttccctttgttctgaccttattgaatagagagaataatttcttggaattctctgtataatgaatgttcaggtacttacagatgctgatcgagtttctcctcaacctttccttcgagagaccttgcatcatttggtgtagaaacactttaggaagcacttaggaagatggtgtaaaatgaaaatgctgctgctgttcttgctgttgctgcaaatgtgagccctttgtaacccagatatcagcttgggtaccctgcccttagagatgcaaatgaaattggctcaaactcccataccatgtatcctacaaaccctgaagtgttcccaggttctctgcaaatttttgtgaagctggtggtggtggtgttcagtggctcacccacagaataaatactctgatcccctcactctcctaaacattcctaccagaaggctgggtgtggagaagattttgactgaggtaatggggtaatggagtatgtgtatggcaggtgtgagggtggaggtgaggaggtggggtgaagtgttactttttaattactgcaaaacagatgcttaaaattgaaaattatgtttggcttccagtaatgaagcagtagttctggcagactaaccctcccacagctaacaactataaactgtacaacagcaacaacaacaaaactacctgaaggtattggagagcaaaaaaaagcaggcagagactggacagacgtctaccctccaaagaaggaaatggtactggatgagtttctgacttttatgattttgtctgtttgttttgcctaagcataggctccagtctgtgccagacaggctgctaaaaatttgtatagaaaatctgtagtgttactggcttgaagaaccagaggacagagtttggggtaaccacagcagctggaaagtggctataaactctacccaaatctttgaatgcagactctaagcagctcaactaaggcaaagagaactgaatagaaatttctgctgctgcacaccgcaagggaaacagagtttgaaatttgagtagagccaggttagctgcgtgtttttttttttaaatcaatattcttcagaggagcataaaagaatttagagataacatacattttgtaatgttcagtattccacccaaaattcctagataaagcaagaaacaggaagagggggcctatattcaagagaaaggccatcaaaggagcttattgccaagatgatcccaatgttgaaattagcagacaagtattttaaaacagttattatagatgtgctgaaggacacaaaggaaaatatcctcgcaacaagtaaaacaacggggaatctcagtagagaaatagaagctacaagaaaaacaagtgttaaattctggaactgaaaaatacagtatctgaaatgaataattcaccatttcgattccataacagagggaaatgacagagccagtggacttggagatagatcaacagaaagtattcagccttaaaacagagaaaaatgatggaggagaagaaggacagatactcagagaactgtggacaatatcagaaaatctattatacaagtaattgagctccagaagagaggagggagagaatggggaagaaaaaaatattttcaataaataatatcaggaaatgccccatatttggtgagtttcttttttaaaagaaaaaaaaaaatcccaaacatgtaaattgcaaacaggacaaatacaaagaaaaccacacctaggcatatggtagtcaaaccaaagatgaagagaaaatcttgaaagcagtcggagaaaaatgagtgtcatgtggaggagaataatcatgtgaaaaactactcactcttcaccagaaatagtggagtctagagacaatggaatggtatctttaaagatagaaaactaaaaatggtatctttaaagttcatacttatagtgaatgagatcagtttgtagatcactgctggccttcttgttatctatgacacagtggctcacccacaaaacaaatatttgggtctcctcactctcctaaatattcctatcaggaggctgggtgtggggaagatttgactgaaatggagtaatggagtatgtgtatggcaggtatgaggtggaggtgaggaggtggggtatctttgatggcatctttaaagataggaaactaggaacatgtcaactcatgattctgtatccttcaagaatgaatgtgaagccaggcatggtggtgcatgcctgtaatcccagctacttgcgaggatgaggtgggaggatcacttgaagccaggagttcaagaccagtctgggcaatgtagtgagaccttgtctcaaaaaattaggtaggcatggtgacatgcacctgtagtcccagccactcaggctgagacgggaggattgcttgagcccaggagttcaaggctgcagtgagctgtgattgtgccacccaggctggagtactcagcctcctgaatttactgtgtctagtatccaaataaagattacaaaacatgcaaagaagtaaaaaaaatatgaaccatgatgagaagaaaaatcagtcaatagatacagatccagaaatggcacagatgatacaatgagtagacaagaactgttcaaccaactattataaacatattacatatgtgcaaaaaggtagagactagcatgagcttattaagaagagacatgggcgatacaaaaaagatccaaactggacttctagagatgaaacaaagtcttcagtgaaaaacacagtacatggaattaacagcagatcagaaactataaaagaggttagcgaacttgaagtcatagaagctatccaaagtgaaatacagggaacaaaaagcttgggggaaaaatgaacagatcatcagtgagctgtgggacaacttcaggttcacccaatatatgtgaaagtggagtcctcaaagaagggtagaacagaaaaaatatttaaagaaataatggctgaaacttttctaaatttgatgaaaatcataaacccatagattcaagaatctcagtgaacccctggcacaggaaacatgaagaaaaaagttcaccaaggtatattataatgaagtttcttttcttttcttttctttttttttgagacggagtcgcactctgtctcccaggctgaaatgcagtggtgtgatctcgggtcactgcaacctccgcctcccagattcaagcgaatcttctgcctaagcccccaggtagctgggattacagttgcctgtcaccacgcctagctaatttgtatttttaatagagacagggtttcaccatataggccaggctggtctcgaacctctgacctcaagtgatacacccaccttggcctcccaaagtgctgggattacaggcgtgagccaccgcacttggcctgaaatttcttataactactgttaaggggaaaaaaacttaaaagtaaccagaagggggaacaaggcacattacatacagaggagcaaagacgagagtgacctgaacttctcattggaaatactgccagaagacagtggaacaccgtttgaaagcactgaaaggaaaagccaaaaccaaaaccactgtcaaccccaaatttaatatccagtgaaatatcttttaaaaaagaaaggcagattactttttcaggcattttaaaaccgaagtgatttcgccgtcagcaaacttgcgctataagacatgttaataaagggagtccttgacacagaaggaaaatgatgctagagagaaatctacatttgcagagaggaataatgagcactagaaatggtaaatatgtgggaaaatgtaagatgttttttgttcttatttaaaaatcactttcaatgatgattgactgtttagagtaaaaacataataatgtgccgtttgtaacatatgtagatgtaaaatacacaataacaatagcacaaaggctaggatggaggagattgtgtatattattgttacagttctcataggggaagtgataatattacttgcaagtagtctgtgataagctaaagatgtatgctgtaaaccttaaagcaactagtaataaaacagatttatggttataagtctaacaatgggagataaaataacaaaagatattcaatgcaaaagaaggcaaaaaaattaggaaagagggaacaaggaacagatgggataaaaacaaataacaagatttaaacccaaaccatatcaattatggatgaaatggtctacccatcccatttgaaagacaaagattgttaggttggataaaaagtcaagactcagtgcctataagaaacccactttataaagacacaaaaagttaaatataaagggatagaaaaagatatatcatactaatagtaataaaagaaagctggagttaacatagacaagagcagatttcagagcaaagaatagtaccaggataaagagactcataacaacaagggggtcagttcatcaaaggacataacattaggtgtgtaatgtcagctgcttaaacattaggtgcataaatatttatataaataataagcgagctctaaaatacatgaagcaatactgacagaagctgaatggagaaatagtaaaatccacaattatagttggagatttcaacaccccgctctcaataatcaatagatcaagtagacagaaaatcagttaagatttataagactggaacaacactgtcacccaatttggcttaattgacatttatggaacactccatgtaacaacagcagaatatacattcttttcaattgcccatggaatgtccaccaagagagaccatataaaacaagtctcagtgtatctaaaaagattggaatcattcaaagtatattctctgactactatgggattaaattaaaaatcagtaacaaaagtatctggacaatttctaaatatttggaaactaacacacttctaaatagcccgtgggtcaatgaagaaacagatagagacattagaaagtatttggaatggaatgcaaatgaaaacacaatataaaaaatttgtgcagtgttactagaagagttctcagatagtaatttatagcactaaatatctatattagttgggaagaaattttcaaatctgtgatctcagcttctaccttaagacaccagaaaaagaaaagcaaattcaacccaaataagccaataaaaataagagcagaaataactgaaatagcaaatagaaaaatagtagaggaaaatcagtgaaacaaaaagttggttctttgagaccaatgaaaggtatatttagcctgactcatgggagataacagagaaaaattgcaaattactaatattaggaatgagagaagtgacctaattatagatactgcagacatttgaaagacactaaggtaatgttatgaccacctttatgccaatgaattctacaacttagatgatatggaagagttccttgaaagacgcaaacaataaaagctcattcaagaagaaatagataacccccaaagcctcatgtttatttaaaaaattgaattcatgattaaaaaccttcccacaaagaaaactccagttgaatactcgctagtgaattgtaccacttaagaaattataccaatttatcatgggatgaattgtacctaccccaactccaaatttatattttgaaatcttaacccccagtgcctcaaaaggtagctttatttggagatggggtcatgactgaggtaatcaagtcaaaatgaggtcattaggggtgcatcctatccaattctccctctatgcatatctatctccgaatctcccctttctataagggagaagctatgtgaatacaaagacagccatctacaagtcaaggagagaggtctggaacagattcttccttcagagccctcagaaggaaccaaccctgccaacagcttgatttcagacttctagcttctggaactgtgagacaacaaaattctgttgtttaaggcactcagtttatggtactctagtcatggcagccctgggaaatggatatatatatatatccgtatatgtgtgtgtgtgtatatatatatatatatatatatatatatatatatatatatatatacacatacacatacacacacatatacacacaaactcttctagaatagcaaagaagggggacacttcccaactcattctatgaggccatgattaccctggtatcaaaccaagaaaaggacatcataagagaagaaagcaagagaccaatatctctcatgaacatagatacaaaattttttttttttttttttgagacggagtctcgctctgtcgcccaggctggagtgcagtggcgcgatctcggcttactgcaagctccacctcctgggttcatgccattctcctgcctcagcctcctgagtaactgggactacaggcgcccgccaccacgccctgctaattttttgtatttttagtagagacggggtttcactgcgttagccaggatggtcttgatctcctgaccacatgatccgcctgcctcggcctcccaaagtgctgggattacaggtgtgagccaccgcacccggctgatacaaaatttttaaataaaattttagcaaatcaatccaactacatatatgtgcatatcatgaccaaggaggatttgtcccaggaatgtaagcttgccttaacatttgaaaatcaatgtaactcagcattaatgactgaactataatgttaatgactaattatgaaagaaaaaccatatgaacatttcaatagatgctgaaagagcttttgacaatatccaacattcattagtgattaaaaaaaaacaaacttccagcaaactagaaatagaagagaactcctttaaactgataagaggcaccaaaaaaaaacattagctctaatgtcgttcttaactgtgtaagactgaccaccttcccagtgagatcaggaataggcaagggtgtcacggagagttatttagcattctactggagattgccagtgtgataagacaagacaagaaaaggatccagattggaaaggaggaagtaaaactgcctttatgtgcagataacatgatcatctatatgcaattccaggctgcgcacagtggctcatgctgtaatccagcctttgggaagctgtagctggaggatcatttgaggccaggagtttgagaccagcttgggcaacatagtgagaccccagctctacaaaaataaaaataaaaacatttagaagggtgatgtgtgcctgcagtcccagctcctcggaaggctgaggtgggaggattgcttgagcccaggagttcaaagttttacagtgaactgtgatcgcaccacttcactccagcctgggtaacagagcgagaccctgacttggaaagaaaagaaaagaaaagaaaattccactctgtctattttaaaaagcttctagtactaaaaagtgagtttagtaaggttgcagaatccaaggtcaatatccaaaattaattgtatttctacatacgagaaatcaacaatctgaaaataaaagttaaaaataccatttatattatcaaactatgaaataattagagataaatttgacaaaagacattcaagatcttttcatttaaaaaaccacaaactgttccttagggaaattaaagaagacctaaataaatggagagagacatcctgttcatggattgggagactcaatattattaaggtgtttccccagatattttagaatcagtgcaactccagctgtagaacacaaacatcatgaagggcttctcaaagatttggcaaatgggctgatcccatccgtttggtaaagggttaggcactggttgcacaggcttgtgctgaactgtgtgagtttgagaatggtctctaaaattattttctggggcaacagggactgtcaagaggtgggatgaggccaggagccaggcctgactaggagggtctccgagataagagtgagtaggatagggccacgagggaggcgaaggcttacccagaagtttgacagccaggtgatggggttatggatgactcttattttcgttgtatttttctgtttttttttgtttgttttgtttgtttttttttttgggcagagcacacatatttccaatgaaatcagagaaacaacaatcctatagctgtttcctttgggattttgtttttgcacttctgtatagtttgaataatttacaagaagactgtattttttgtaaccaaaaacgaaaggcaggcaggcagaaagaacatgacctgtggctagatcaatacttgttcaatctttggagactgtgaggaactcctggtggggccatgtcttggtaacgaggacacagaaactgtggtaaatatggcaccgacaagtgactgcaccatattttacttgtcatattcttttcaaatctgttacttttgtcggacacaaagaatgtctctagttaatacatgaaatcatcttggaacatttgacagaagatttaactccttaattctatgaaggcagtttgggatctctaattacttaattgaaaaaagcacgcacttcagtctgctgcaatgttggggaattaatctttaaaacctgacagtgaacattaaattcaattaaggagaccaattggcaaagattcttccctccttcaccctggatagctttgagaggtagctgactggtctgcattgattcagatgctgtcgttgtctgtgcatctactaggagagccaagtgtgcgtttttcacttcagggggagcttgtcagacgatttacagattgatggatctccttacatgtttccgtggctgatttgggagttcccctggacaagaattcaaacattccagtttgctgcttttggccttggacttcatagagttcaagttttttgtaatttcttctttcttgcatgagaccactatgttgcccaagctggttcttcctcctccctccgtcctctcctcctctccatcctctcttcccctcccttctcttctcttcttcccccttcctctctgcaccccccttcctttttcccttctctttccctctccccgcttcctctcccccgctccttcctttttcccttctccccttctcttctctcccccttcctctcccccttgctccttcctttttcccttctccccttctcttctctcccccttcctctcccccttgctccttcctttttcccttctcttcttctttcaccccttcctctccccctgctccttccttcctttttcccttctcttttcctccctttccgtttcccatcctgtgtttcttttttctctcctctccccaattcctccatcactccttctctcccttccttttttcttctgctcctcctcctctccgtcttggttaatttaactttttattttaaatatgaaatgttttaaacatactcaaaattatagaaggtaacagatacctatacacctgtcactgagattgtcaaatccccaggtgtgtctgttctcattctcagcggacccacccatcagcatttgacatggtgaccagcctctttgtcaaaacactctcttctctacgcttccaggactttcctcttctgtttttttcccacacttcactggcctcttcttagactcctttctggtttctctctctcctcccctggttcccagcctgtgaaacttggaggcctggggctgagatgtgggactcctctctgtcctgtctgcacttgctccctaggagagctcatccagctcaaggctgcggcacaatttccacaatggcatccacagctcagcctctaccctgggcctctcttttgaacatcacactggtacgggaatgagtctttatactgtctgctgtctgtcattcaaaactgagctccaggtcctccttccctcaaacttaccccttctgcaggctgacccatccctgcaactccacccctttcagtgcttgggccaggaactgcgaatgtgtcctgggcttttcccttgccctcatatcctacctccagtccagggaagtcctgttggttctaccctccaaggcaggccacttctctactgcctcccactgttccaagccatttcctctctccctggattcttgcagaagcctcctgattgtcttccttcatctctcttgcccttcattctcctccctgcatggcagctggagtggtcctactgcagtggaaccagccctcattcccctccgttccacctgcagaaccctgggatgccccaacggcttgtggttttccgacttcatccctttcttaccacctccctgccaacccccagccttgctcacttctctagctgcagtggcccttcttgctgttgcttgaccatgccaggcatactcctgtcactgcctggaagcttcttccctcaatttctacatagctggctttctcaccccttcaggacttcctccaaagtcacctcctcagagaggtcctccctggccaccatttcagccccttcccttgaccttatagagccctttcctggttactttttaatacttcagtcttcaccactgccttaaggactgtggatttttatttgttcagtgtctgtctccctcactagaatataaactctttgaaggcagagatttttgtcttatttgtttcctgttacacaatgcctggctaatagcaggtcctcaggaaatctttgttgaatgaatgaataaatgaatgagtttcagaggaaacatttgggcatgttttcttcggagagcattttccatctctccctctcctcatctcccacaccccatcgcatcaacccagtgcatttcatctcccccaccccatctcatctcccctacctcatctcccctccccatctcatcctcccctaccccatctcatctcccctactccatctcatctcatctcatctcatctcatctcatctcatctcatctcatctcatctcatctcatctcatcttcttttaccccatctgctctcccctatgccatctactctttcctaccccatctactctcccctaccccatctcatctcctttacctcatttcatctcctctacccgatctgctctcctctaccccatctcaagtcccctactccatctcctctcccctaccccatctcatctcccctgccttatctactctcccctacatgttccaccctctctttggaagagctgctgcttagtgttcatagcttttccctctagccctgcccctttccctcccttcctaggagtgatggccctcctcatgcatgtttttatagcctggctacaaattcacgtataaatgagatctgcttttttttttctttgtgtgtgtgtgtgtatttttaaaaactgtggcagaataatacacagcataaaattgaccatcttcaccgctattaagcatacaggtcagtggcattaagcacattcacagtgttgtgcagtctgcaccccatctgtctgcagaactctttatcttggaaaactgaaactctgtccccattaaacaactccccattccccctcccccagccctggccaccaccattctactttctatctatctctatgattttgactactctgggtacctcatataagtgcagttatatagtatttgtccttatgtgtctggcttattttacttagcataatatcttcaagtttcatccatgttgtagcaagtgccaagatttctttccattctaaggctgaatactattccactgtatggatagaacacatttttacaattcattcatccatccatagacacttggattactcccctcttttggctattattaataatgctgctatgaacatggatgtacagtatctttttgagaccctggtttcagctttttgggcatttacccagaagtggaatggctggatcatgtcataattctacatttaattttttgaggaaccatcatgctgtttttcacagtggctgcaccatttgacatgcccaccagcagtggacaagggttccagtttttccacatccttgtcaatgcttgttattttctgttttttgatagcagccatcctaatgggtacaaggtggtgtttcatgtaaaaacttaaatggcattgtacttcgtatatgcagcttgacttatgtacttaatattaacttttttaccatttaaccatgtaagccctgtagatctcgtttattttactatttaaataaaattaaactcatattcatacatatttttggaaaacagcagttccctgtgccccatctccctcccgtgaattcttattccactttgaagtcttctggctgtgtcttctggctgtgtcgtgtttctaaatgtaaatactgctgtttcttgattttttcagtttgagaccccagctattgacccttagtgaggaagaaaggaactgagctctcttcacattttttgaaggctactcttgaccttttgttttcttaagtgtagacatttacataatcccaggaaacaaggtttcagagctctgatcctttgcattctgagaacattcgggacttggcaggttgaattttcttgtctttaatgagaaggttatccctgggatcaggttggtagaagtgcatgggtgtactttgtttgggtttttctcttattaaagaaaatgaagcttggttttcctaatggaacaggtctggaatccacatccagttgtgtgccagccattatgccatgtgctgtgcagccattacctcctcagccttcaccactgccctcggggtggcgctcttcttattcccacttcagggaggagaggactgaggcccagagaggcaaagccactcagccaaggcccgaggcctgccagcagccgtatcaggtgggaggcactccgttctgactcccacacgctggctgcaagtgctcctctgcttctcgggttcagcctctgagccacctgggtggtaggtgagagcactgccctcatcctgcagtgacaagaaggtaggggactagcactgctgagtacctctgtgtgtcaggccctgggcctaccctgacatattccaaactctccggcagttcccctgggctgcacggtgtgtttggcggcatttgctgggagagctggtggaaagctaagctcaggggctctcacgtggtgtggccctggctctgggaatgtgcagttttatacttgatatcttagatcatttttcagaagtcattgagtgtaacagggttttctctcatgagcctcataccctcatgaaaggccagcatgggaaggagggaaagcaccttctctcctccaacaaaaggacagctgcccctacggcagatatttgtactttgactggttgtaaatacgagtgtagcacattcctttttggatctctgtcttacagcagaacccatgaaaatagcctggacttgggcagtgtccatggcaggacagatgccagggatgcaggcgagcctgggataagatgccagggatgcaggcgagcctgggataagatgccagggatgcaggcgagcctgggataagatgccagggacgcaggtgagcctgggatagggttgtgaatgctgagggtgcaggactcccacccggctgcagggatgaaacaggtgtgaagggctgggtaggtgaccggcagacacaggaatgcgttttcttttttcttttattttgagacagtctcgctgtgtcacccaggttggagggcagtggtgcaatcgtgattcactgcaacctctgcctcctgggctcaaacaattctcctgcctcagcctcctgagtagttgggactagaggcatgtgtcactatgcccaactaattttatgtagagaaaaggtttcaccatgttgcctgggctggtcttgaactcctgagctcaaatagtctgcccaccttggcctcccaaagtgctgggactacagatgtgagctgccatacccgtccagaatgcagttttcttaaccccagaaaaaatttggggaaatgatcctcccaacttaccaatcccaagcctttacatttctgcaatgaaaagtttaacatctagatatagatttgatggtaaaataatgagaatctaattccaccgagacctttttctttctacagtggggtcgagctgagccctggagatcaggcccttgttgtgacacctggtgctgtctgtgtttgcctgcaggtatggaacgccgtggactccgggcactgcctgcagacctactccctgcacacagaggcagtgcgggccgcccggtgggctccctgtggccggcgcatcctcagtggtggctttgacttcgcgctgcacctaacagaccttgaaacaggtgcgtttcttgtgtcacctccctgaggtgagctggcagctctctccctggggaaggttctctggtgggcacgcagccacaagctgtatacgcttgcgtggcagagggagaggggcctcagggtgggctcgtgctcggtgagagggcttccagactgcttgcccattggaactgcgactccccacagaggatgggcctctgccagccaacacagaggacagagccccaaggttgtctcagcctcaagccatggggctggataaagaggtggctttttaatctacttctgacatgcaatttgtgctgaaatagatttaactttatcattgtgtcctttggttggaatcaggttagaattcctgtcaattcattatcgttgaaagtctgtgagaaatgattccagctcataaggaaagtcttcaaacgagttctgctttaatgcccacactgaaaaggcacttgggtaggatggattcgtgccgggtaaatcctgagagggctcttgacaagcagggcgagaaggagagagaagtcagtggaaggaactttccttactcagcgctcctgtgcaacaggcactgtcaatacccaccgcagccacagcccccaggtgggctctctccggggtttacagtgaggactgccagggagtgacagagctgggattcgcacctctgccatctgcctcccagtccgagctccttcctctctttctcctttcccctcccctccccttttctttcctttcctttccctctatgttctctttcttttctttctttcctttttaaaaatgttttatccccctccatgagcaggatccagcttctttcagcaccacactacctcctccccagagctcctcggtctcatttctgctgggctccactgccaggagcccagggagaggccagacttcacaccagtccctggggctccccttgaaccctcaggccagcatcttgcctgcctagccccgcagtggtggtggctctgggccctgcctctcctagggtctggcaagaaggagatgataacttgctggtccaacccctgccactcatgcccagcagcccccaggagacgcagagggaaaatggagaaggtggtttgtttccaccttgagtgtgggcggccttgcagctccttgcatgctcagtaggggaggggacagtactaatggtcacagggcccctgccacgtgctataggctttgcacacagcatgtctaatcctcactgcagctgccagcagtgattatttccattttaaaggagaggaaactgaggctcagaggggcaaagcagcttgctcagtgcctcccagtggtgcatagccagcagggatttgaagccatgtctgtacaactacagattctgtgcccttcccaccgtgccgtgtgtggcagtttcttctcacaaagcacttccctggtcttactgattctcttaaccccttgcagagtggccagactcagggagtttgatgccacttgatgatggtgatgactgggctgatgatggcagcacttactactgagcactgtgtgctgggcattcttccacagcctctatacagcatcttatttaggccccactcaccctttgagacaggcgccatcagaatcagctgtacacacactggccaggggcacaaaccagcaagtgacagagccaggatgcacgcaggtctgctaggccccaaagcctgctgcctgactgttacactctgttgtctgcatgtcccataagatatgcttgataggcgagacagagctgaacaagacccagtgcctaccctggagaagctcctgtctgctggagaagacagaagtgcagagtcaatcccaaattgcagtgatggagaaagacacaggaattgcaagaacatctagattggaaaatcaaggaagacttcctggaggaagtgaaacctgagctgagccacagattaggtggacagagaattaggatggaggaggtatggttgatgaggaggaaagtaggttcttgcagatggaacaaggacagagctgacacaggaacagggttccatgtagtatgcatggaaaccaaagcaggatgtaatatggggtgcaggggctggggcagatgagtctgaggagtgcaggaggggaaaccccagcctgtgggtcaggtgagcacatgtgggtagcacaccgctcacagagtgacaagctcactcacacacaccgtcggattactcaaatcaaattcatttgatggcattgatgggttcatagtggcccttaagcattattctctcaatcaacagaagttaaacaaatgcatgcaattgtatgtgtgggtgggtgtgagtggggtgtcttgacagggggttctgaaatttttagacattcaaagagggtcctcctgtctgatgagtcagggactgccatagcagctggcgggcagaggccattgctgagtttgaagcaggcaagagtcagggcttggtctgtgctttgagtagtcctccttggtagctcccactggtcctgtgtgacctgcagcccctggtggagagttggaggagtgggaggtagaatgccttgcctggttggtgataggactgcgtttggagaacagcttgtctggccccaggcccaatgtgcccctctagctgtggtgtgttgggtgtgtaaagaaaagcatggccctgcccccagggcattaccatccagtgggggaggtgattgaggacttcttcactccatccctctgctaggaatggcgctcaccactgggttcattcaactgttgaatgaactgttgaattcaactcttgaaggccccgtttcgttcactccgcagttgcttattgtgcacccactgcgtgtaggacttggtgctgaggccacagtggagagtgtggtgggcccctgggagagaatggttgagggatttggacctcacccttggggaagcgctgcacacacagacagggtctctgctgctgagggtggttggtttccatgtccctctccctggctggcttgggagctccatgaggatgggagcctgtcctggtggtctttgtgtctctatcctctggccagggctggcttggagcagctgctcagtacctgtgtgggtaagatgtgctgagtttgtccttgccaggtcctcctatctgggcagtgaagcccatcagggactgccagggctggtcggggggcctccacctatgtctccccctatgtctcctaccttatctctgcacatcccacctccagcttttggtaagtgctctctttagccattggggtgggctctgcaggccctgtggctttcgtcccgctttgacttgtcttgtcctttctcttcgctgagtctgatctccctttctactggatctgcctttttccgcccttggtgatttggctttttcatttcaatctaattagggctccctgccaggagaaggcagtgcagggcgttctcaccgcagcgctttgggaattagtcacttggtgcccattgtcattaatttggcgccaaggccatttatcctggtgtcctcaatcaatacagttaaaaatctgtggattctgtaatgtcaatacctggcctgaaatacggagggccagcaccattttatctcattaatttatagttctgacaggttgttggcttatagaacaaccatgaatcaacacttaaataaaacttgctcacaattatttttggtgctcttgtttcagtctgtaatcttcctaacaaaacgtctgtggcacgttaggctgaggtggcctcagggaacgctggccgactccaccagggccctgagtgtcacctgtcttatgagtcagctgtgccacacgccagctcagccagtctcctcagaatcccccggagagctccctcagttctaagcggtcctgtcatgtttcttgcagactccaggccctgaggcaggtgtcccagcctgaccctcgaggctgcagctgtagaggcatgcagggcctctgtcctttacctttgatggctgcaaaggagattcctcttcctggagccctggagccccggctgggcagggaaccctgtcctccttcctgtgcatgggccggctctcctgatgtgcgctggctcctctgagccatctgtgcagtgccacctgggtctacctcccagatcctggaggcagcacgcgtgagagggcacatagacagggtacaggtgttggctcttctgcctccccgaaccaggcctcttcacctgtttctaccacaccacctggtgctggggctgttgaagggagcagctgtgataacacatatagggtgctttgcagaatgcctggcgtgtggtaggtcctcagcaaggaactcctctcctcctccgtcatggcccatgaggcccttgttcctgctaagctgtccagatggcccttgttggcaggccatttccccacatggggccacttttcgatcatcatccagaggcccctgctggtcccctcagtgagcttacagatgtgctgttggtcccctgcgtgggtcttgggggcagactgggaggaggccttgggccatcatgggttctcccagcatctcctccacattccccttcctcctggtaatgggacaacacgcactctttattagggctctcgagtgggtatacagacccccagcctgcccggcctgaccctctccagagccccaggcactcatggctgcaggaggcctatggccctcttccttcagatgcccacagcctgcagctctgctgtccccagcttttggctggctcctcctgccctgggtgtcccagtgtcttttggtgggagtcatgttgtgtggaagtgagcagccaactgggactgggctcataaatgaccatttctccttgctttccaagaggtgtcttcttgtctctcccttgttttcaatctatgactggggcttccattcacagaaatgctacaaggaaaaagagaatgacaggttatcgagcccttgctgtgggctgggccctgggctatgtgccctgggttccagcacgctgcctggcctgtgtggaggtgaaatgagtgagtggatggtagactctttgcttatgtgactcctcctgtgagaggagtgtttttaatcccatttcatggacccagaaactgaggcttagcatggtcagtgactttcttgaggtgacagaggtgggatccagtgctggcatgtgactagtagagctcctgctgttgaggtatggtgtggcatgccctccccacgtctgtttccctgctgtgaacaaacagggaaacaatggggaacccaacttaacctgactcctggggagcctgctgggcagcagctggccacctgcagaggataacatggggcctctgggaagaaggagtgctccagactcatggggactgatccctctgattaagtgggccactgagggaaagatgcctcttcagtgatggatggccacgctccaatgacgactttagaccacttggcatgggaagggtgagaagtgtccaaatgaaaaccatggcaaagagccccaagagctcctgggctttggagaaggggccacagaaggaggctccttgttgtgctaagcctttgaggtggtgctggctcctgccggtccttggaagaagtgccgtggaggggcctgggcttctccgttctttggctttctggcactgtggctggagtttcgctagcgtagcttaggaggacttgattaggtatccctcaggtgcccacagacccaaaggaagtagaagaaagcttgtgggcacatttacaaagcatctgatacttacatgtacatgctccttgagtcctagggactgttgccactgatccagaagtgaaggctcagaggggctccacagcctagcgaggtctgagctgatgagggttccctggctgccgccctttatgtgcctccttgtccagttagcagccgcctactttcttgcccacttgtgagtgggtctattttccaaggccagtctctgttgccacgaatatccttcgtttctcactctgaaagtgcttctcctctggctcaatcttgttttctctttccttacttctttggagtgagaagctgaccctagttacggatattaaatcaaatgttattaaacttcattacaacaccatgccagcccttaactgccacttggaaaagtgcctagagatccttcacatctccacaaacacagctcacgccagccctctaggcaaagaaaagatggtttctaattcaaattcttgttttgttcatgaccgtgactgcacagtagtgatgtctggcgtgtgtgtgtttggttgcagctgcatcacagtttggtgcccttgttaggtaaggctgccattattgactgactctggagcccaaacgtgtttacggcatgtctgctattggaatggcgagttccgagtttcagaaaaccaacttactagtaaagcactgggatacaccttgtttgaaagttgagaactcttattattattttttaaattttggaacattcggtcttgtccagagaattaaaagcagtggctgacaatggtctgggcaatgattttttggataggacttaaagcactggcagcaaaagcaaatataggcaaaagaattgcatcaaactaaaaagcttctgcacagcaaaggaaacagttaacagagtgaagagacagcccgtggattggaagagaaagtttgcaaatcatacatcttgtgaggggctaatatggaaaatgcatgaggaacttaactcaacagcaagaagccaaataacctgatttttaaaatgagcaaaggatctgaacagacttttctcaaaagaagagatatgaatggccaacagatattagaaaaaatgctcaacatctgtaatcatggggaaatgcaaattaaaaccacaatgagatatcacctcaaacctgttggaatgcctattttcaaaaagacaaatgatagcaagtattggtgaggatgtggagaaaagggaatccttgtacaatgtaaatgagtacagctattttggaaaatagtgtggaggttcttcaaaagactaaaaatagaattaccgtatgatcctgcaatcccacttctgggtgtatctccaaaggaattgaaatcggtgtgtggaagggatctctgcacccccgtattcattgcagcactgttcacagtagccaagatatggaagccacctcggtgtccatcagcagatgagtggataaagaaaatgcggtgaatattcacaatggaatactctacagccttaaaaaagaagaatattctgtcatttttgacaacatgggtgaacctggaggacattacaataagtgggataagcgaaggcacagaaagacaaatactgcatgatctcacttatatgtggaagctaaaaaagttgatctcgtagaagcgttgagtagaaaggtgttaccaggggtttgggggtaggggtggatatggaaagtggagatgttgatgaaagggtataaagtttcagttagaatgaaggaataagttttggtgatctattgcactgcatgatgaccacagttaataatgtgtatttcataactgctaaaagaatgcacttttaacattctgtccacaaaaaataaattagtgaggtgatagatatgttaattatcttgattaaatctttctacaatgtatatacagatcaaaacatcacattgtacccccaaatatatatatatataaaattatttatcaattaaaattaatttaaaatgaaacaaaaaagaatgggaaggaaagagctggtgtaagtatgttattagaagacaaattttaaaaaatgactgcaactactactatttcttctgttactactattattacaatgctacagctactgtttattgggccctatcagttgtctggggcttagctctcctacatacattattgctaattctcacaaccaccttttgtggtcctgagtctacagatgaggataccagggctggagaggattgctggccgatgcagggccacagctgatggggaatgttcagatgcaggcccagctggctctcaggccagacccttcccaggcctttgcccggattgctaagatggcccctgtttctgatgcataaagtttgatttgaaagttagtaagtttcttttctcgttaactttgagtcaggatggctaaatttatagctggctgaatacttcccagaggatgagtgtaacgatattgattttagcgaagtgagtcatatgcctactgcctggaaacacaagctcaattaccacaagccaacagcataagctttcccttgtcaacatttttcctacatgttcatgagtctgtggatgtgaacaaagcactaggagaagcaaaggtcacgaataactggcggcgatgcaaggtagggtgccgagagctggccttgagattagacagggccagtctccgtctcagtgtggctgactcatgtggctctgagcgagtctctcacctcgctgagcttccatttccctggctgtgagagatgggttaattacacctaccacccagggtgccgtgtgatgcgtgcaagctccagacaggcctggaggtaacaggctcctgataaatgttgttccccttccttgactgtgaactgctttgccagggctgcctctgagctccctggagaggggggcatgagcttctcttttctctcctggagacccatacttgggtttcatgtggcctggacgaaatacctattatgtgccaggaactaggctgggagtcagtcatgctgaatggaagaggaaggccctcacaggcctggagccctgcatgatgataggattcctagtatagacgtttgcaacttctatgttaactaagaacttcttagttagcaagatggacaggtggtgctgccccggccacatggttggtcactttgggaagctggatatctccacctgagaaaggaagaggggcagcttggaggagccactattccagagttcccagatgccttatcacagtcatacgggggtggaagcactggtcatagagtcagtagaacaaatggaatttctgcattgtgttttaaacttgtttttgctttaacaatttttttatttgtatcattattgattcaaggagaaaataagtgatttttcctagctccaagaagatccaaacagtttttacactggtttagctcattataatgagatcaataaagtcagtgctagtggattaaatattttaaaactcagtttcctataataagcatacagtgaataaacagaattttctataacaaacaggtaaacaagcaagatggtcttaaggttaaaggttatataacagctaaccattgcgctgaaagtaacattgcccaggagaacaagctccttgatttatgaaaaggtagagaggaagagcccgtctgacaagttaagaccttctcctctggcacagctagtgttcatgttcaagatatttcactgatgaatattttccagactttacccatatctctttaacaaatgtaaagggcagcccagggcgttgtattttcaaagcctcatgagaaaagctgaaaaagcattaatctgtggaggttattgctatttaaaaacctgtatcccagccgggcgccgtggctcacgcctgaaatcccagcaatttgggaggccgaggtgggtggatcacaaggtcaggagattgagaccatcctggctaacacggtgaaaccccatctctactaaaaatacaaaaaaattagctgggtgtggtagcaggcacctgtagtcccagctactagggaggctgaggcaggagaatggcgtgaatctgggagacagagcttgcagtgagccggatagcaccactgcactccagcctgggcgacagagcgagactctgtctcaaaaaaacaaaacaaaacaaaacaaaaacaaacaaaaaaacctgtatcccttggttttagtttgtaaatgaaccaattgtgaattcaataatttggggtttaattttgtaaactataatagctcccttttgttgattgctgtttgccatgctctttggaaggcttcatgcaccgcgttacatttagctctcatgacgaccttacatttgtaagagtgtgagacagagcagtgcaaggtcctgcccaaggcccctccactggaagtgacagagctgggatgggatctgggtctgcgtggctctgaactcctcagctataccatctcctgcttccaacattgtgccagataatgatggctatggccctaatttctgaaacaaagtcttatttgagaacttcttagttagcgagatttctaccttagtcttttcactaggtatccagaaacttactaaaaaatttaaaaatcttgtagttttgaacccttttaacaaagaaaagcagtaagggcctagttattataagtacaaataggaaaaatgtataaactacagcttatcttctaaatggaaatacttaaaagacagattttcaatctctttagggggttgaggaaaaaataacattcagattttttgtttgtttgttttagcagaaaaagttcgatcatcgtcttttagcaattcagctttcacattttctctcatctttcttccccattgttggcaagactgtatcactgcacttttgaaaaaaacatatggataattcactgccatttctgaaattaagcatatggttatatgctatggtctaaaaaataaggaacattttttctccaggcagagagagtttgtgtttccttttggatttaaggattggcaatgaattccaagtgagcaagaagccggccactgaatgttctcagcaataagcgcagttgtccttgtggggagaaagagtttggcagtcctgggccttctcggtggtgtggggactgcagtggtatccgtgtcctccttttctgtctaggggttgtgatggtggtccctgcctgcagtctccagatgacccccagccgcttggctgaagcgagtgtcctggggcctctgtgctgccacattgctgctctgagtccctggcataggcacatggagaccaaggggacagccctctgcctgtgctccctgagcagggggacttgctagttggtcatatcacggttggtttctgatcaccaattgtagcttaaaaggtggggtttgtcatgctctgtagaaggctttatgtaccaccttgagttccaggaaaggaaaagaagagtacattttttttttttaggaataccagatttccaattagatcaattcaccaagaagcagttttttggtttacttgagagagtcgtttgtctgctgatctaatgagagggacatagcacaaagaccatcatcttacaagtctgctcatctccttgatgacttaaaaaatctttatttattagaaaaacagtattacaacaaatctgttagtataatttaaaaagttatcttactacccctagaacaattcatttcatttcagtgaatctcttcccagtctttgtccatatcaacagggatccccaacccctgggccacggactggtacctgtccatagcctgttaggaaccagaccacacagcaggaggtgagcagtgggtgagtgaacattcccgcctgagctccttctcctgtcagatcagcagcagcatcagattctcatacgaacggagccctattgtgaactgcgcatacgagggatctaggttgtgctcttcttatgagaatctaactaatgcctggtgatctgaggtgggacagtttcatcccgaaagcacccccatcgcaacccctggttcatggaagaattgtcttccacaaaacctgtccctggtgccaaaaaggtcggggactgcttcgtatcaattcccattttatactcttgtagttgaagaataggaatcaagcattgtccatcttgccaaagactgctgtttgtgattccagttttcagtggcttttcagcatcccatcaggcagaaaaccacatttgtcttcactactcccctcaggctggaccgttagggtgttgtttacagtcccttctccatacgggttggatggcctaaagcagccagttcttgacaacattgtgctgacacaagagtgaccatgaaaatctcttgtgctatctgcactgcatcttgtagcaaaatagtcaaggggcttgtggagctcaaagaggtatagattcttcatttacagaaaagcaagtatttctaaaattttctctgttgataagtgactaccagttttaggcccctagaagatactagaaaaaaaagatcaacacactttattatccatcatggcaaatgtgatgcttgaacaaagggtgaaagagtaactactttctaaaaaatttctactatggagagaacattttgaaaacagatgtttttgtttccattgttatgtgatttttgttgccaaaaatgatctgtcacctattaaaatcttgaatatcttcacccttaacctgggaacagtgtttttctaatctgttttaaaatcctttaagtgaaaatttcagtggattttgagctgggtggttacaaatatgataatgcaattattaacctgattagttgcaggagccattatttgacattagggaaatggggctttactagcaaaatgttcacaaaatcctttgcttcgatggtggataaaagtggaaaatgtccgggcagcccagctttgcaaaggctctcgtggctctgcaggcacctggcatgcaccctccccattgccaggatacccaagaggaaggtcagctctgctgaaggggccaccaaggaagagcccaagaggagactggtgcagttgtcagctaaacctgctcctgcaaaagtggaattgaagctgaaaaaggcagcagcgaaggataaatcttcagacaaaaaagtgcaaaaaaaaaaaaaaaaaaaaaaaaaaaaagggaaaaggggagcaaagggaaaacaggccaaagtggttaaccaagaaactaaagtagagttacctgcagaaaatggggaaatgaaaactgaggagagtccagcctctgatgaagcaggagagaaagaaaccaagtctgatagaataccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgctttttttttttttttaagaggtgaaatcatttgctggttgtttattttttggtacaaccagaaaatagtgtgggatattgaattatgggaggctttgactgtctcgggtgtcagcttaacattccatacatggggggttagtttttatatcctataatacaaagcatgttaaatggccatatggagtcagtcctgcatttaacgtcttgaatgttttaaattacttctattcccttgttttttagtagaattgtttcctaaagaaaaccactccttggtcattgctctccctgtcagaattgtgtggactctgtaaatctttggttgtggtagtcctgttttcctaataactttgttactgtgctgtgaaagattacagattggaatatgtagtgtaggtgctcttcagttgtgagctggtgggacgtctgtaacagctgatcagcatgtgaagatactggtacttgatagcctcttaaggacaatttgcttccaaattttgacctggaaagtcactggaataactttcaaaaataattacaatacatggctttttagatttttgttacatgtgttaagaattgtgtacaaattgaaatgtctgcacgatcctcaaccaataaaatctcaattatgaaagagaaaaaaaaaaaaagaagtggaaaatgtctcccatgtggccagtggtgaatatcttccatctaggtccgggcatctctgcgtgcaagaaactttgtcggctttgatagagttcagtggataaactgaacctacttgcaaccagactacattcaaataactgaatcacaaaaagttccctacattaagaaaaatggaagcatattcaattctgttgctctcactaaaaatagtattacataactcagatgatttcagagaggttcattgattctcttaataagggtatattaaaatatattttaaaatattgacttttatccttgcatcatcctttaaagagttctatttttggtttttaaaaaatgtttataatatgttggtacagaggcacattattcaacttaacacagatatctatatattggtggtatgtgccttaggtttttcatggatggggcgtactgtcaaactataatagcttggagaccatggatctaggcagattgggtctgtgaaagccttctgctgggactgtcatgagtactcatgtgactgtcatgagtactttcatttccacacctggtgagctggtagagcccttcactaatgtgtgggggtcacagaacacaaagcagggcaaccttttgtgctttctgaattgaatgagcaagtgctgcttcctgggttcccgtgagtggaaatgatgcttgagacctcggtgtcttcatggtcttcttcgccaccagcttcccgtgtccctaagtagcccactgctcagtcccatgggggagtttctacgggtacaaggcagtcaaggttcttcctcctgcgctgtgggagcccttgtggcacctctgagcgaagcctcctccatgtttctggctgggtggcgtggggcagctgctgtgcctggtgtgtgagccctgcctgtgggggacatatacgggggtggcactcagagactcccacagtgagaacacctccccaaggccagtctgccttcttgatgcagtttcagatggatgaggtgtggacagacaagaatgacagccagtgctctgggacatgggggctgcactgggcagtggaaggaggaccagctttgacctgctccaaatgattgatgtttttgaagtttatatagcttacctctaaaagatcatagtgataaaaaagacgttttccacaccatacgtatatatatgtacatacacagacacttacctaatgcacataaatgcttgacaacagtttatgatgtatttataaaggacaaggactgcgttgtgtcctgtagagccagtgagacccccaatggcccacaccaccctgtccaatctgtgcttgggccaccatgatggccactctcatttatcgcccagcatctcaggccaccccacctgccatgctccatagcaaaccattcatccattattataaagtggctgattctgaaaagtatcaccttagaacaatcctgtttttggtttttagactcccagataaataatctactgtattaactgtagagccttggaaatgttccatgacctccctgggcttggtttttggctgttaggtgggcatagggtcgttgcatggtttatatgagctaatgcatgtcatgcttacagcaaatgtgaaaggtgcactcatcaatccacccatctaagctcagcccagggggaggggatgttcagctagtcaagggtgggctggccagagaaacagagaataagggcaaatcttgctgccaccgctgtcatatttccaaaaagtgtccattgggctacatcgggcccaggggagctgtgtttgctatgagccccataccagatggcatcttagttttaagatatttgttttgtgacctaagtactttctaaccctctcttctctttttgtgttgtaggaacccagctatttagtggtcgaagtgactttagaatcactaccttgaaattccatccaaaagaccacaacatctttttatgtggaggcttcagctctgaaatgaaagcttgggatataaggactggcaaggtaatagccatattcctaacttggcctttccacaggagagcttgtttcgacaatttgaataattgggggcaggtcagcatctatatataggacccttgaggtggaataattaccacttaatatttaatcagtgctaagcataatttttagatgttttgaaagaacattcttgagttgtcagacttaaaatatcaaaggtgcaattttatgcagcatattactaaaaatatttgttgaacacctactgtgcacaaatgcttccagatgatataaaatgaatctgctgggttactcaagggaataatgtgcgggtacagatgactttggtacagagaattggtgtgtgtgtgtgtgtgtgtgcgtgtgtgtgtgtgcgcacttgtttgcatgcttgcgagaggaagggagggggtaagtgcttttagcttgctgtgggaagacttcttagaggaatcacttttcctcagtcttaaaggctggttgtgatttccatccccatcctttattacaacctgctgtgccttttaccatcaccacttactagatggcagctccaccctagttgttcaggccaaaaacatcagaattagccctgtctctgctctttgcatcacattcccatacccaaaccattagcaaattctccaaaacttggacatttttccccacatcagctgttgtagctctgctattgtctctcgctgggatggttgcaggagtttcccatctgatctctcactttcccccttgccccttggaggctgttctcaacacagccgctagactggtctgttacagtgtgactcagacatgtcactcctctcatcagaatcctccaggctctgatcttacagtaaaagccaatgtctctgatgatccacaaggcctaaatgatcctccttggcctgggggtaggtcagcatttctcatcagtgccagccccactaggctccttgccttccctgaacataccagcacattcctgtctcagggcctttgcacctgctgctccctctgcctggaaggctcttctgcctgtttcctaagtagaggcttgctgccccctgtcatggggctctgctcacatattacctctcggtgaggtgccccctgcccaaaacccactagcatccgctagtcccctctgctatctcatttctctccatagcatttaccatcacctgacatattatggattttatgtgttcattcatctgcctgtttccctcctctagaatgtaagctctttgaaggcagagagttttgtttgctgctgacatctagcttctaaaacagtgcctggcacatagttggcactgtgtgaatcatgattgactgagtaaatgccagaggaaggcagtcatgcagacagggcagatacaggaggtgggaacacaggatgtctatggggacttggctaggcgtgggcttcacacagcgaggtggcctgggcagagagtctttcaacgctgtgtgtcttggtctcaacagtggggagccacgggaggtttgtgaacatctgccttggtcctagacaggtgcagcgtccaagcagatatgtcctgagtagaggctgtccatgtgttccagagggaggagggtgagacagagcccccaaggcctagattccaaatttgccttcttgcttcagactggctggcaccggaagaccctttcctgacaggcagttggaaggggctgctggtttgttgaggagagcctaaatgcagagacttttcttgacagagaatgggaagttttgtctgtacatgagatcttgcttaaagtactcacaagtgggagcatagatagatgtagtctttaaaaaaaaatcacacatttttcttttacaaaggaactttcttataaaaatatttggaaaagggaggaaattacccataaagaagtggacacagtggcattaaaaaaaaaaaaccgccaaaacacgttatatttaggatctaaatacatgacaagtgaaagaaaacatttgaacgtgccttgtgaactggaaactcttagtcataccgtttgaagtgggacctcctgagcacccagccactcctgacaaccacgtcccttatgggtgcgcttactgtttttagcctcaaagaccaaacacgtaagaaattactcaccaaggacgccatctgatttaagcatttgttaaaaataccggattttttcccagggcagatgccagctgacgagctctgaaaatgctgggggagaagcaattagaagcagatgttgctgtgactggtgttggcatgtttgcgagtctctcccaagatagtaatgtggctaagggatctgtgcagtatttgtttttacttcctttctaccaacaatcctcccccactgggtcacggggctcgttccgtttgcatcagttgggctcaggggacaacactctttcctgcttagacaggtgttgcccatgtgtctcaaatggactcggcaggaggaccagggaggaggcacagccccctgccctccagggactcccgcctggggctgctcacttcttatccctgtgggctcctgtggcgctgtcccaggtgctgaaccttctggctcagcctgggcgtgtatgtgaacatccagaagtgagcagcttggctttttccagctgctttcagggaccgcggtgggaatcgcaggtgtaagtaggagggacacagaccttagcttaaaccaagacaggccttcccttttaaatacagtagggaaggaatgttttgttgtaaaagtaatacagaatcatatgataacattgggaaattcaggtaaagagaggagggggagtccaagcagccaaaggtaaacattagcaacattttgatattcttctttctgtttttttttcctcttgtggtttttaaaaaaattataaaagcactatttggttttatttgtatacgcaattttgtgttttgcttttcatgtagcattagaaggatattctttgttagtgcagaccctcgtaaggtcgtcagtcatattcctttgactcagggtgttcctgactcactgccttgcttctccccaggactcagaacaatgtctggcataggcaggaactcagtaagtatctatggatcaaatgaatcagatgaatgctttaacatattaaaccatttccctgcattagacatgtaggagatttaaaaaacttttgccatttaaaattaatagatgtgaggacagagaccagcagtcagcaaactatagcctaaggctagtccagcttgctgccagtttttgtaaataaaggtttattggaacacagctatactcatttatgtatcatctgtggctgcttttatactacagtagcagagtggactcattgcaacagagaccacatagcccacaaaaccaaagatatttaagatctggctgaccttggtaaagagagatgtgattctgacatctgtcaccctattgattgtcaggactaatcctcctgagctggctgacaagttgggtgtcttaccccattctgtgttccttgcagaaaccaggtgctcagagaatgtgttttccaagtgggaactgttccttcagtcaggggtgtataagttgtttctctctcttgttacaatctccaaacaaactatcaaggttgactttattacacattccactgtaagaaacatctttttgcatatagctttttccacatttgggatttatttccttaagcttgaatctcagaatgaaaatttctgggtcaaagcaagcctacattgtgaaggtaaggagtaggtttctgccaacagaactgaggggagtgaggccagacaacctctccctgggatcttagggcacagtgagtagttggaacatacaactttttagttactttccagtcatgagattttatgattccttaaacgtagccaagtgctaagtgtcaagattctggacttctctagtctagcccaattcattacagcaaatgggctgtttggctccctgtctcctcttcttggtgatcttgggtgatctctccgcctcgggtttgatgtttgtagcacatctcattagtgcaaagtgcctgacttcatctccagaggtcggcaggatgtgttctgcacaagccagctgtgcgtacttacttgaaactggcttcctgccgctgctgcagcatcctctgacccctcttcctcccagcagtctgcttgaacatgggtgtggtctggaacccaggatgcctgtggtctgacctttatagtattgtgagggtcaatttctgcagaagcccctgagcctctagtgccgttggcctgagctgcaggagacctgggctcacgtcctccctctgctacttgcttggctgggtgatttcggccacattccttaagcaaaagcctctctgattcacaatttttaaattggtatcgtaaagtggcaggccaagccacgcctccaaagtagcgtttctcaaactcacctgtgtaggagagcacctgggctcttgttaggatgcagattctgtttcagcaggtccaggttgggataagatcctgcatttctaacaagctcccaggaaatgaaggggaggatagtatatggaccacattttgagaagctagggaccaaagggcctctgaagttaaaagtcccttgcttctctcatttgaaccttatcctcaattagcctgcaccatctgtgacctatctcagggacaacgatcactcttgatctgtgggcacttttatccacaggtgtttatttacagccgcttggtgtgggagcctgagtcacctctgtgcctggcatccccgacagggcctggaccagagcaggtgttcaggataacctggagtgagctgatggggtcagccgccactgtcattgtgatagaggcctgcaggagcacccacctgcccacaacctcaggggcagtggccaccctgggatcgacatagagggcatggcccctctgacaaatgggatatgaaggctagctggaattcagctgtagtgagtcattccagaagtgtggacagaggcaggaggacttgggagaccctgtgtcagatgagatatggtgtggccatcaaagcactgtagttctccactgaggctgagctcctctgctccccggtgtttggtggataacagagttatgagtctcttgcatttccagctttgcggtgctgtggctctgtgcccagcacagaatggaagctgtagaattgcaggagaagcctgtgacacggactcagctgtactgggccctctagcagtgtggggaatgttccaaggtagagccactttcaagttcactttaagatgactatgtattttgaaccaaaagttaggataagtaataaaaataaattctccttttgtaatatgaatcagatttgttaagaaagcttatatagcaaatttggtgaatcaccttttttgcaggactacattatggaaccccaacctcagcaaattacctctcagttaaggcaagattgaacactggaaattggagcagccctggaaaatctaggacatgtggctcctgcagctggcagcctggactctgccccagttcctcctctctttctatgtgcagggtgacattgggcaggctaggggtcgagtggttcttttgttgtctagctcctactctgcgcctgagaaaaagagttgcagatgcattcagatctgccaactttactcctccagagaaggctgcacctctaaaaccccgattctctgctcgctctgggactctcatgataaaaccagctctgacaggccagctcactttctccagcataccctggtgtcacattgacactaatcgtcaatatttcatgcttgttctacatcttttcttcctacttttattattatttttaaatttgtaaagggacattttgacttccagatcttgacttggtttcttgacctccttctctagctttgtcccacaccctctgcaggcacgtgtcctaacatgcaggtgacaggggagtgggtggctcacccttgggcctgtgtgggccctcagctcagcttcctatgatcctagcccatcactagtatgctgtagcattctggtagcatgtggactccctgagggaaagagttgtgcctcatttaccatggtattcccagcatccagcatagtgctaagcacatagtagggagggaggggaggcaggaagggcgcaaactgtcgcatgaatgactgatagctctaatcaagaccagttcttaaaatcacaagcaattatcctggccagttgaacggaggctgagccactgtcattaatttgcttatctccttcccctcctgtgggcatccttccttggatgggagtgatctcaggatgatagtaataggaactggtaaagcagcaggtggtggctgggctggcctgacctgactgatctagggcacgggccagagctacccagggagcattagaaactattgctgcccagggtggcctaggcctccaggtttttgaaaactctgcaggtgattctaatgtatagccagatttgggggccatggtatgggtgcctagtgaaaattcagagtggtttctgtggggcttctgccccagtgggtgagactgtctttgagatttgcactcctgtgatggtggccatctgagagatggcttcgtctacttggctcaaagtgccatcagttttgtggcattgtaggcaagttgcttatttgccttaatgagattttgattactctccatttgtctctttcatctgttttatattaaaaaggctttttatttggactttttgtgctttccacagtcctgactaagctttgctgcaagctaaactttgaatgcagatgagagtaggagcctaatggaggcaaagatgtaggacccgaggctgttccttgtctttcttggctcccatttcctcatctgtcaactggggacgtggtggagcccctgatgatctcgagagcccctttcagcagccagtgctgaccacagtgtgcctcctgcaggcatcacgctgtgcacgctgtgtgcgccatggctcatttcctcgtggcctcttgggaggtggactgggtgctgccaccatccccttcctctgtcagggccctgaggctcggaagggctcagttacacaccacaagcacacggccagttggtagtggggcaagactgtgaactgggggtggtttgatgcccaaaccctcacagatcctcttgttcacagtgtgaattcagctttagtcttgaatgaacatacagtcatgcaccacataatgacgtttcggtcaatgtcagaccatatataggacaatggtcctgtaagattatagtgaagctgaaaaattcctgtcacctagtgatcacctgcagtgttcagtacaatcacatgctgtccaaatgtatagcctaggagccataggctagacctctagcttagatgtgtcgcaggctataccgtcgaggttcgtgtaagcgcatgatgttcacgcaatgacaaaatcgcctgatgacgcatttcccagactgtatccctgtcgttaagcaacacatgactaaatatttatcagtgagggctgtgcgttttgttcttggagaagcctgcatggacagccctggcattcacatgctcactgagcactgccatgtgcagctccgtgcctggtgtcaggacctggccatggatgggacagtggtgggttttgttctgagggaccacagccctgtaacctcaggcctgaaaacagaacccaacgtatctgtgagagcagccttcctgcccccaaaatattggcaaggaaactggttctgaaaggttcagctgtctgtgcagggtaggcagccattgacgggattggatctgaacccaggtcttcctctaatttctgcttctccctattgcaggaagaggacgcatttcatttatccatgtcacaaacattttctgagcccccaccagaaaccaggcattgtcccagggcatggggcaacaaaatccagttagatggcgcatgccctaaagctgtagaagggactgctgaaaacatctgtttctctcaatattcagtggatccatcagcttcactggctgccttcacaattggctggggagtccctgtgtgttccctgggttgtctaaagtcttaggcagaagtgggcaattggttcccagaatctggaacctcagagacctgccctgcaacccagtcctcctcttcagcctccctctgcaccactttcactgggactgtgtaagaagacccctgtttaaaacccatgagctgccaacaagctcagtggatgacagtgggaggcccatggcactcaagagggcgatgttccaagactttcattaacacccaccccacttgataatttttgcccttaaaaatgcagcaggcagtttcagaaaatataaagcaggttctttggacctgtgctgattctataaatatgatgtttctgtaattctaatttataaatcttctataatacatattgccactaaaataagctctgtgctgcactgaacatgcttcttcttaaggtttttaaaaatttatttatttttttttactattgatttacaattcttgtacttgaaaacttattttagccttgccataactaatagtgtccaaaaaagtcatgggcttgatgccttagttatttttttgtcttaatatactttaactaaaaaaatttctttagagacatggtctcattctgtcacccaggctggagtgcagtggcattatcatatctcactgcatcctcgaactcctgggctcaaggtatcctccagcctcagcttctctagtagctgggactacaggcgcctgccaccatgcctggctaatttttaaattttctgtagagaagggtctcactatgttgcgcaggctggtcttgaactcctggcctcaagcgattctcctgcgtcagcccaaagtgctgggattacaagtgtgagccaccacattgggcctaaagtaaatactcattaaatgttttttggtaacagatttattctgtattgtacaactcactcattcactcattcactcagttcttagtgtgtttgcagggttatgcagccacagcagtcggttgagaacattttcctcaccccaaaaagaaaccacgttttttagcagccatgcctatccccccagtgccccagcccctggcaaccataaatctactctgtctgtatagatttgtctgttatgaacattttatataaatggtcttttgtaactggcttctttcgcttaacataatgttttcaagattcattcacattgtagcctatatcaggacttcactcctttatgttttttttaaaattagactttattttttagaggagttttatgttcacagaaaaaatttagcagaagggctagagatttcccacttgccctctgcccattcttatgcacaacctccccataatcattctgcatcagagtggcccatctgttacagatggtgaacccacagtgacacatcgttgtcactcagagtttatagtttacgttagggttcacttttgatgttgtacattctatgggtttggacaaatgtttaatgacatgtacaatagactgactgtttgtgtcctccccaaaattcatatgttgaggccctaatccctaatgtgatgatattaggaggcggagtcattgggtggtaattaggacatgagggtggagcccatagaactggggatagtacccctgtaagaagagacacgagagagatgaatctctctccaccacgtgaggatatggtgagaagacagatgactgtttgcaaacctgcaagagtgccttcaccagacaccagatctgtctctgttgagatatcctcaagctcaaagattctttcctcagctgtatccatgctactaaactcataaaaagcattcttcaatttttatttcttgtttttggagacagggtctcacactctctcccaggctggaatgcaatgctgtgatcacagcttactgcagcctcaatgtcctgggctcaagggatcctcccaccttggcctcctaaaagtgttaggattataggcgtgagccactacacctagcagtgcagtgttctttatttttgttacagtgcttttgatctcaagcagttatttttggtcttttcttagaatttctatctgtttgcttacagtgcccttctgtttttgcgtattgtctactttttccattagagcccttagcatgttgattatagttgttttaaatttgcagcctgataattccgtcatcactgccatatttgagtctagttctgatacttgctcttcaagctatgttttttgccttttattatgccttacaattctttcttgctagccagacaagatgagctaggtaaaaggaactgctataaaaaggactttagtaatgtggtgtagtgtcagggtggtggggaagtgtcttgtggctaggttagtcttttagagagtctgcttctggactgtgagctcacatgtacttcttagtcccctctcccctttaaataggacaggacagctagaatgggctggacctgggtgttttcttcctccacatagaaggctagaggggaaggaattgggcgtttcccttctcccatgtggaaggcgggagccagtggcggttgggtattccccttccccaaggtcagctaggctgtgataaacccagcaggttagactctggctaactagtttctctgcagtacagacctcattaagagcagaatgcactttaggaggctgaggcaggaggattgcttgaggccaggagttagagagcagcctgggcaacatagcgagatcatgactctacaaaaacaaacaaacaaacaacatagcaagatcctgactctacaaagataaatacataaaagaagaacagaatgctctgttatattttaaagtagttctggctgggcgtggtggctcacgcctgtaatcccagcactttgggaggccgaggagggcggatcacaaggtcaggagtttgagaccagcctggtcaacatggtgaaactctgtctctctactaaaaatatgaaaattagctgggagtggtggcaggcacctataatcccagctacttgggaggctgaggcaggataatggtttgaaccctggaagcggaggttgcagtgagctgagaccgtgtcattgtatccagtctgggtgacagggtgagactccgtctcaaaaacaaacaaacaaacaaaaaaaccaaaaaacccaaagtagttctttttctccttctgctggaaacataaggggattttctccagtcttcactgtgagaacctggtagctcctggaggtaaaatgcacaaaattttgggggccactgatgatcaggtcttccagagtttttaatctctctgacttgtccacaatgagcctctagcaatttgtcaattataattcagttttctggccctggttcctgtggaaatttctgctccaatgcattgtgattgtttattcacctatctatgtctccagttttgggggcagtggtttgccttacgatctcacttcttttgtggatctgagaagagttttccagtttgttcagctttttacttgctaggacagagttttgatttataagctccttacctgccagaccattaacaggaagtcttctgcttctttttatgaccaaataatattccattgtatggatatacacattttgtttctccattctctaggtgatggacgtttgcattgtttccatttttggacatttgtttgtaagtctttgtgtggatatatgttttcatttctcatggttcttcctagaagtagaattgcaaagtcatatggttggtagctgtttttatgtgtaatcttttgagaaactgctagactgttttccaaagtggttgcaccattttatattcccaccaacaatgtgtgagggttctgatttttccatatcctcaccagcacttgttcttacttgtcttttatattatacgtatcctagtgggtacaaagtggtctcgtttgatctctttgaggtttgatatagaactattcagattgtatatgtcttcatgagtgagacttggtagttgcatgcctcaaagaattggttcattttatctaagttgtgaaacttaatgtacatacactgatttgtaatattctctttttcttttgatatttttagagcctgtagtgatgtctcctctttcattcctgataatggtatttgtgtctttttactcagtcattgtgactagagttttatcaatcttactgatcatttcaaagaaatactgattttctctattgtttttctacttccttaatttctgctccaatttttattttcttctgtctgcttgctttggatttaatttgcccttctttttctgatttcttaaggaggcaagttaggccattgatttgagatcttttttaatataaacattttaatgctacacattttcctctcagcactacttcatctatatcccacaaattttagttataatatactggctgtattttaattttaatccaattacaaatactttctaattttctttagactttctctttgacatgtgggctatttagaagtgtattgttcagtttccaagcatgtggaaacatctggagatttgccagatttttctttttctttttttctttaattcttttttttttttttttttttttttggagacagagtcttgctctgtcccttaggctggagtgtagtggtatgattttggcttactgcaaagtctgcctcctggattcaagcaattctcatgcctcagtctccagaatagctgggactacaggcatgtgccaccacgcctggctaatttttgtatttaatagagatggggtttcaccgtattggtcaggctggaagatagctttctatcattaatttctagtttaatcctgttgtagtcagaaaacatactttgtatttcagttcttctaaatttgccaaggttagctttatggcccagaatatagcctgcagtgttgaatgttccatatgctccgtgcattttgctgttgttgggtggagtgttgtataaatggcaatttggtcaattggttgatgacggtgtctgttcttttacatccttgctgttttttaatctacttgttctttcagtgactgagagaggagtgttgacatctccagctatagttgtgaatttgtgtatttttctcttcagttctgtgactttttttgcttcatatactttgaagctgccagcacagctctactacagtcctcctctcaggtcaaagctgttagaaaaaataagaaaaaagaaacaaaacaaaaacaaaaacaaacaaacaaaaaaagaaatcaagttcccacctctgtactagtcacttctctgagtttctgtctctctctcacaagccacctgctcttgtttacttttcgagtcctcagggagttgctttttgtattttgtccagaatttcagttgtcatcagtggagaggtgggctgcaggaggtgtgctccaatttagcctcaggtcgattttgaacatatttttctttttcccttgaatttcccttctttttggctaaatgtcacctgtcctccaactctctagtgatgtctcctctccaggaaattttcccaagcccgactggattgtgtgtccccctccccccgccaggtgatgctgcttccacagctcgatagcctgggttgtagcccctggttgtcccccggtgggatgcgagccctgtgagggctgggagacatgatggtcttttccaacctggtatccccagactgtgtgtgtgctggcatctggtcagcagttcattcactgtttcttgaataagtgattgtgccaacctccatggacctgcagtataactctgcaaagattgtatgactttaggaaagtttgtgcaattcaatttgtgccccaacaaatagattcccagtttcaggagtgtgttgatggctgtgtgattttaagcacacggatgttccatgtaccctgtcagtgggcaggctttcctggcagccacagccttttctcacacccctgagggaagactgcttggtgcttctctgcaaatctggcgcggaggctgcggagggagatggatgtgctgagaggagactgagggccacgttccgtaacaagcgggccattgccacgcccagttcagaagggagatgaggagtggatagctctctttcccctctgcatgccccttttccaccaaacagatttcttggtttttaattacagtctttgtcttgaattttttcttttttttcaaaaaggtcggttttctggctcacctcactcatttgctcattgaacactgcggagcacctgctgtttatagggtgtcttcctagtttagaggattcagagaagctgcaggaaatgtctcttgccctgctgctggcaccacctccacccagttggtggcccagccagaaacctctgcagcagctttagggtctcccttctccaccacctcagtccctgcgtcctcctcttccagggccaacatgtgaggttgtgcagtctgtacagtgcagagaggcaccttgctgagggataggtggggtctgtattccattccaagccctgctggccaggccacgcccctgatttggaatggtttctactcgaaggggtatctttctctaataggaaccaaggtgccatgcgggccagtggcagccctgtccctccccttctgtctcttacttggcctgagtggggctgtgagccgatgagagggcttgtcgtggggtccccctgtgacttgggtgcaagcagggtgtaggggtagaggcaaaaaagggccttggagacctggagacccaagtgctgcccatgacttcagaatggagggtgaggtggttgttctctagatgttcgttttgattagaaaaggaatacatggtctttgttggctacttgggaaatggaaaaatataaagaagataacccattaaacttcaacccagccataaccaccactgacagttggtatccttcattcaattgttttatgcatatgtatttacatttttatataattgtctttcagcttattataatatcattagaatttcccatattgttaaaaggtttttggatgctataatttttaataattactcaatatattataccaagatgtatttaaccagccctctattgttgggtgtttataagatttccagtggttcccttattacaacactaaggcaaacttctctgcacaataattcttaaacgcagaattagtcgaaaggtaagcatggtttttaggttccggaaaccactgcctgcttccttccagaagtggaagtgccagctaaccctgaagaatgggttcatttgttagtttgcttgttttcagtgtaggtgagacttatgcatgttcacctgcatcctggaggaaggcactggtgcagagagatgggctggaggtggggtggtggctgagggagcagggtgggtatagggaagaaagccacctccttcttgagacaggaaggaagtggggctgggagatagagcagacgggccacaagaggcctccttccttccagagctcctgtcctgggctgtggaatgggtcccagggggtgaagttcgctgtgttctgctttgctcccagtccttgctaatcagcccagccaagcacctcagaactcaaaggggtggccaggattcactgcacacctggtgaatgtagaattcagtgtttggagtcaggtgggatacaaggactggaaattgacaccagatagctctgtctggtggggagacagagctgtccctgagatgggggatggtacaagcattgggaaatggtcttgcagcctgcctggccccgctccacccagaggttccctgggacctggttgctgtcttcctagaggtgccacaaccctcctcccctacttctctcttacctgctgcatcctctctgtgcaccaaggaggagggccagcctgactggatggggcggctccctcctagtgcattgtgtgtgcccctggtgtggacactggaggggcccgagagtggggtggcttgctcactcttacttctctcctgctgcggttctgggtggttcaggacctgcgggggctgcggggaaggccctgccctaattcagtggcctagaggcaggccagctcgtctcttctgctccttcttccagggacccgaggagggtgaagtggctctggctgtggagggtggagaaggaggggtggggatggtcagatggaggcatgccgggcacggggcattctctgtggcccagcccaaggccagtgcaccacaaagtggccttttttggtccctgttgaccctgtgcctcattagagagatagacccctcccctcagtgccctagttagtttctctggggctaggcagggcctggggttttggggccccccacagttttgacgctggctcagccaagcgagcctcaccatctccatctctgttcagagtaggcctgagcctctgtccattgtcctacgtggcttctttggggttgagggtgcgtggaggaggcagctgcaggtggtactgcgaggcaggggcctgggcttttcagagttgggctgctcttgggggtggctgcattgttagagcctagttttaatttgtgcctccgctataaagtaagggaaaccaatttttcacttgagaggatcaacacacaaatacatgtgtaattgtctatttctgcttttcttcctttcccatgtgttttgtatctgtaatttaaaatttcacagtcttcaacatgacagtttctctgtgggtatgtttagattcaattagattcaattcaaattcagcaaacactaattgagcagctactgtgtgcaccgggcgacctggtgtagtgcatggtacagaggggtccggcttgaatgtcaggccatggagtaggtgtgacagtggctctgcctgcacctcgcttcatgattgtgggcagggcacttcacctgtctgacctcagtgtcctcaactgtacagtgcagctggcgagcccaactttcccaaagtggtcacgaggattaaggaggtcacatgtaaggcacctagcaagacagatggcacttagagtgttcaataaatgctcctggccatcttgatgtcttcagatgatgatcacaacagggttgtgccctccacgagctcatgataattggccatcatgagctgtcttcagttttgctaaaagtggagcagagattgtaccttccccccagccagacagcatacctggccaaaacatcaagtgcctgtgctttcggctgaagatgttctaacccagtgcgataacaccggtcatctcaggctgatcagaagctcagatacacattctcccatgtctttgattaattttttaaagggagaagtgaattaattattgctgaataagtgtggacactcaggatgtgggggaaagaacctaaaatgggaacttaggagctgtcactgtgggaacccctgtgtaagccaccccaggagctgtcagaggccctgtgattcccacatggcaacaagccagtaaataccctccaagacagaggaaggtacagctcagcccttcctgatggatggagaacttgaggaccagagaatgggggcactgaatgtgggggctcacaaaggccatttgggccttttccttggaggaggatgctgggaaatggtccctcaggcaatgcagagaggaggatggtgcagtctgcctggagctgtgcagcagacaagggccagcttcatctcactctccaggagccccagggagccctccttccctgtccgctcctaccaccctttggtggatcctattccccatccctccccgggtcccgtgacctgtccccagacagctctttgggctgtttgatggggctcacacctaggaaggctgtccttggaggatatgttctgcttctgttggaagtgcctcaggcatggccccttgatagttgtgggaggtgcaggcagagccccccactgtggtggcccttgccctcccactcagctctgagcctgatgtcatccacctctgtacattgtccgagggacagtttcataacttccctgcttaaggggaaaggccttaaggctctcatgagccccccacattcagtgccctcattccctggtcctcagtttccccatctgccaggaataggctgaactccatgacctagcctgtgtagagcacaacccccagttgttagctgggaatggctctgacgaggccttcctgctgcgagtagtcagctccctctcctggagctgggggagctgggggacccaagacactcacaggctgctccccacctgccagctccagttccaccagtgtcctggagctgctcactttagagttcttcattaggggtcctatagacacttgctgaattaaccactgcatggccaagtggccacggcgtgggggaacatgaggtccctccctgcatggcgaggggaggagtcagtctccacagagtacatcgtgatgggaactgcttgggggctaatgaaagactcacagaagaaggagctaatgattttgcttgccacattgggaggcttggctggcagagggtttcaaaggatacataggagttttctaggcagcaagtcaaggtagggtattttaggcataaggaatgtataaaggcacgtaggcactaaagggcacaacatatgagggaatggtgagggttttttgttgctggagaacacgcagtgtgtgtctgtgagtgtgtgtgtctgtatgtgtgtcggtgcatgtgtgtgtgtccatccatgcatgtgtgtgtccatccatgcatgtgtgtgtgtctgtgtccgtgtgtgtgtgtgcgtgtgtgtgtgtgtgtgtgcatgcgcattcagaggagagttaggaaacaaggtcagcttggctgcccatggtggccagtgcagggcctccaccctggccatttttaggttgtgacccagagctgaacaccccaagggaggctttagagataagggagacctccccagtcacgcccagcatgctgtcaccattgcctttaaagcgtgtcccctgggagcctgagccagctcatcagttacacctgaatataaaagggaaaggtgtcctccccctgccccccgcatgtggttattaaagcgcgccatctttaagcctcattaaggagtgttaaatgctaatgaatttagagagaggggtgtcttggggcctctgtttccttggaaacatttgaaagcaggtgctttataatgagctgtacctatttaaaagtgagccgtgagggccactttgataagctggatctcagctgcagatgggcaagtgtgaacaaagccagtggaggccagtggagacgctttgtgctctgtgaaatatcatttctctggtggtttctatagaaaccactggcacctaggtaggagaattgccgggctccccggcttcacttacacatcacaaccttgtccccagccctggccacctcagcccccgtccccgaagactgctggattcccgttggcagagcggggttgggttctggacagatgggacagatgcatgctaccgcaggtgtaattcgctttaattatgtctgttctgtacgcactgcttgatttcagttggtcccacctctgcttatgatttcaggcccagctgataagaagaactaacatttgtggagctaattcctcccctcagagcactttaaagaaactttttattattgaaaaatgtaaatatataccaaagtagaaagactaattaatgaacctttatgcaaccagcatcctgttttaacaattataaaattatggccatgcttattttatccataatcctacccatttcccaatagtctccaccctcctcaccctcaccactgattattttgaagcaaatcccagacatcctgtcattttatttgtaaatacttttgtttctttaaaaggtgtgggcttaaaaaactgttatcccatctagtaatttggcaataattccttaatatcatccactctctaatccatgttcagatttccctggttgtctcataatttgctttaaacagtgccttgttcaaatcaggaccctaacatttgatttctaagtctcttaagtctatagatttctttcctactttctttttcttataacttatttattgggtaataaatcagttatttttcctgtatctttcttactgtatccctctgatgtaatttaacacattcctctgttccttctgtatgtcttatgaactggtggtttcatcttaaagcaggtcactgggggagcttgtgagtctgctgctgcttccaaggctcatccctattgtatgtatcagcattccttgttgctgagtcatagtccattgtatggacataccgcagtttgtttatccagtcacctgtggatggacgttttgagttgtctccagtttttggctgttatgagtaaagctgctgagaacgttcatgaacaggtctgtatgtgaatatacattttcctttctttgggtaaataactgagagtggaattgctaagtggtgtagtatatatatatttaaatttttaataagtcaccaaactgtttccaaagtggttgtaccattttgcatttccatcagcagtgtgggaaagtgtcagttgcctcacattctcaccaacacttggtgttgtcagtctttttcattttagttattttagtgggtgtgtagtagtatctgattgtggctttaatttcttctccctgatgactaatgatggtgaacatctttttgtgggcctattgaccatttgaatgtcttgttttgtgaaggatctgttcaaagtatttgcctatataaatttattattattgagttctaagagtctttctatattctggaattattttctcctattacataggtttttgtgttctaagaaatctttacctatcctaatgttgcaaagattttctcctatgtcttcttctagaagtttcatagtttttgccatacatttattcagggctatggtatattttcagttaatttttgtttatggtgtgaggtaaggtcaacagttatttatttcttttgctatgtgggatacccagttgttttggcagcatttgttgaaacgacattattttcctcattagattgtttttggagccttggtggaaaatcaatttgccacatgaggttctctttctggcttgtcagttctgttctattgattgatgtgtctatcattttaccaatatcatactcttttggttactgtagctttataataatttttgagattgagaagtttaagcctcaaactttgcttttctttttcaagatttttctggctattctaggttctttacattcgtatttcaattttacaatcaacttatctttttctacaaagatatctattgggtccaatctgtagatcagtttggggataattgacatcttaataatgttgcatcttcttatccatgaacatagcacatctcttcatttatttagctcttctttagtttctgtcagctgtgttttgtagttttcagtgtttgatgttacacatgttgtattaatttattcctcagtttctcatgtttttggatactaatgtgagtggaattttatattttatttcattttccagttgtttggtattagtatatagaaatactattaactttctttttaaaaaaataatttcaacttttattttagatccaggggatacacgtgcaggtttgttacctgggtataatgcgtgatgttgaggtttcgggtatgattgatcccttcacccagttactgagcatagtactcaacagttagtttttcaacccttgcccgctccctccctccaccctctagaccacagtgtctattgtgccatctttatttccacaagtacccaaagtttagcttccacttataagtgaaaacatggagtatttttgttttctgttcctgcattaatttgcttaggaaaatggtctccaacttcatccgtgttgctgcaaaggacatgatttcatccttttttatggctgcatagtattccatggtgtatatttgccacattttctgtattcaatctactgttgatgggcacctagattgattccatgtctttgctattgtgaatagtgctgtgatgaacacgtgagtgcatgtgtctctttggtagaataacattttcttttggatatatacccagtaatgggattgctgggataaatggtagtactgttttatgttctttgagaaacctccaaactgctttccacaatggctgaaataacttacattcccaccaacagagtataagtgttcttttttctctgcagccttgctagcacctgttatttttttgactttttagtaatagccatgctgtctggtgtgagaagttatctcattgtgattttgatttgcatttctctgctgactagtgatgttgaacattttttcatatttgctggctgcctgtatgtcttcttttgagaagtgtctattcatgtctttggcccattttttaatagggttatttgtttttttgcttgttcaattgtttaagtttcttatagattctggatattacagctttgtcagatgcgtagtttgcaaatatttctcctattctgtaggttgtctgtttactctctggatagtttattttgctgtgcagaagctctttggtttaattaggtcctgcttgttaatttttgtttttattgcagttgcttttgaggacttagcaataaattctttcctaaggctgatgtccaaaatgatgtttcctaggttttatttttataggattcttaaagtttgaggtcttacatttaaatgttgagttaatttttgtatatggtgaaaggcaggggccagtttcatttttttgtatatggctagccatctatcccagcaccatttattgcaaagggaatcttttccccattgcttattttggttgactttgttgaagatcagatggctgcaggtgtgcagctttattctgggttctctattctgtttgattgggctatgtgtctgtgtttgtacagtactatgttgttttggttactgtagccttatagtatagtttgaggtcaagtaataggatgtctccagctttgttctttttgcttaagattgctttggctatttgggctctttttgggtttcatatgaattttagagcagttttttctagttctgtgaaaaatgatattggtagtttgataggaatagcattggatctatagagtgctttgggcagtatggtcattttaatgatattgattcttcgaatccatgagcacggaatggttttctatttgtttgtgtcgtttatgatttctttcagcagtattttgtagttctccttgtagagatctttcaccttcttggttagatgtattcctaggtatttgtgtttttttttttttttatggctgttgcaaatggtattgcaaatgggattgtattcttgatttgttctcagcttgaatgttattggtgtatagaaatgctacagatttttacacattgaatttttatcttgaaactttactgaagtcatttattagttccaggagccctttggcatagtctttagggttttctaaatattgaataatatcatctgtgaagagagatagtttgacttattttttcctatctcaatgccctttatttctcttgcctgactcattctacaaagccaacatttcataccaaaacttggcaagaaaaaaagaaaactacaagccaatatccctgatgaacatagatgcagaaatcctcaacaaaatactagtgaaccaaatccagcagcacatcaaaaagttaattcaccatgatcaagtaggcttcattcctcggatgcaaagttggttcattatatgtgaatcaacaaatgtgattcaccacataaacagaattgaaaacaaaaataatatgattatctcaataaacacagaaaaagctttcaataaaatccaacatcctttcgtgataaaaaccctcaagaaactaggccttgaaggaacataccttaaaataaaaagagctgtctatgacaaacccacagccaacttcatactgaatgggcaaaaactggaagcattccccttgagaactggaataagacaagggtgcctactctcaccattcctaattcaatgtagtactggaagtcctagccagaacaatcaggcaagatacaggactcttttatatggactgtgtatcatgtgaccttactaaaattcacttcttagttcttgtagctttttcctagattacttagaaattttaatttacatgatcatgtagtctgtattattttacagctttctttctaatgcatgtgcaattatttatttttcttgctgtattacaatgactagaactttcggtacaatactgaatagaaattgtgaaaatggacatttttgtcttgtttctcattttgtagggaaaacaatcagtcttttaccattaagtatgatgttagatgttggtttttcatagataccttaagtcagtttaagaaagctaccttctattcttagttgtatgaattttttaaaaatcatatattggtgttgaattttgtcaaaaatgattttactacatctatatgttttcctatgttctgctaatatgttgaattacattgattttttttaaagttaaaccatatctttcctatttggttttatgatatattgtccttatatagagtttaattcaagttgctaataatttgttaaggatttttaaaatctatgttaatgaggattattgatcgatacattttttcctatattctttgtctcattttgatgtgagattaatattgacctcagaaaagtgaactgagaaatgttctctacttatgtttttgaatgtttgtataagattggtattatttcttccttaaatgtttgatagaattcagcagtgaagacatctggacacaagactttctttgtaggtagatattgaatcacaaaaaaaattaactatgtgtaacgtgggccattcaggtgtcctatttctcctttagttgtttttgttatcttttatcttctaaggaatttttccattttatctaaattgtcaaatttattgctctaaaattgtttttaactttattttttaatggctggggtgtcttcatttcttcttgttgatctgagtgccaatctggtatcactaccccccaggctgcagaacttcctttagcatttcttataatacaggtttgtggtggggaattctctgtttttgtttatcaaaaatgtctttatttttccttcatttttgtcgtgtcctgccctttttatacttttatggaaatataactgacatacaataagctgcacatattcaaaatgtacagtttaagttttcatatatgtatacatccatgaaatagttaccacaatcaagataaataatgcatccattaccttcaaaagtttttgtgcccctgtgtttacttctagaagttgtatagttttgggcttcatattaaagtctgtgatctatttagtattaattttttgtgtatggtacaggtatggatgtagtttcatgtttttgcctgtggataatcaaatttctgcagcatttgttgaaaacaatatctgtgcctttacctctctgtggaaatcaattggctaaatagatttaggtctattgttgtactctctcttctgttccattgatttctttttttttttaattaaaaaaattttttgtaggctggttatggtggctcacacctgtaaccccagcactttgggaggctgaggtgggtggatcacttgaggtcaggaggtcgagaccagcctggccaacatggcaaaacctgtctctactagaagtacacaaaatagctgggcgtggtggcgtgtgtctgtagtcctagctactcaggaggctgaggcaagagaattgcttgaacccgggaggcggaggttgcagtgagctgagattgcaccactgcactccagcctgggtgacagaacgagactccatgtcaaaaaaaaaaaaaattaatttttagagacaagggtttcactgtgtcatccaggcagtggcacgatcatggctcctgcagcctggaacttctgggctcaagcgatccttctgcctcaatctcctgagtagctggcactatagatgtgcaccaccacactcggctaatttaaaaaaaatttcttttggccgggcacagtggttcacgcctgtaatcccagcactttgggaggtcaaggtgggcggatcacctgaggtcaggagttcaagaccagcctggccaacatggtgaaaccccgtctctactaaaaatacaaaaattagctgggcatgatggtgggtgcctgtaatcccagctactcgggaggctgaggcaggagaatcacttgaacccgggagccggaggttgcagtgagccgagatcgcgtcattgcactccagcctgggtgacagagcgagacaccatctcaaaataataataataataataataataatgtaaattttttttttttttgtagagacagggtctcgccatgttgcccaggctgatctcaaactcctggcttcaagtgatcctctttctttggcctcccaaagagttgggattactggtgtgagccactgcactggccccattgatttatttgtctatctttataccattgttttcatcattgtaatattataatgaatcttgaaatcagctcgtataagtcttccacctttgttctgactactgtaggttctttgcatttacatttcagttttacaattgctttgccaatttatgcaaaaaaaaactggcttgaactttaaatggtattgcatctcatctgtagagcaatttgggaaagaattgtactgccaacaattttgtttctttcaacccataagcatagtatacttctctatttactgaagtctttaatttttctcaccaatgttttgtagttttcatagtgtaggtctttcacatttttttgtcagaatttatccccaagtatttatattttgatgctattgtaagtgatattttaaaatttcagcttctggttgctcatggttagtatatagaaaaattgtggctatgtgaattttcaccttgaattctgtaactcttctaaactcatttattagttctggttgtttctttgtagattctattggattttctatatagataatcatgttgtctgttaataaagtcaggtttagttattcttttccaatctggacactatctgtctatctctatcctctctctctctcatctattttctctcttcctccctccctcccttcctccttttctccttcccttccttccttcctttcttgtttccttattgcactggctcaaacctctagaacagtgttgtctagaagtggtgagagtgtgcatccttgccttatttctgatcatagagggaaagtattctctttcagttacatatgatgtcaactagttgttttgtacatgtccctatcagtttgaatgtactcccttttattcatagtttgctgagagttttttaaaaatcatgaatgaatgttagattttgttaaatgccttttcccatttattgaaatgatcatgtgtggtttttttattctgttaatatggtggattttgtcagttgattttcaaatattagaacagccttgcattcctgggataaacttcacttgatcataatatattattccctttgtataatttggaattatatcagctaaagttgtgttaggaatttttgcatctatgtttatgagggttattgatctgaactttttttattataatatctttgtatgggtttggtatcagggtaattctggcttcatagaacaaattgggaaatgttcatttctcatcaattttctggaagacttcgtgtaaaaattgacattattccttaaatgtttgctagaattgactagtgaagctgtcttggcctgaaattttctttgtgggaagatttgaaattttaaataaaatctacttagtaaatatagggctattctgattttctattaatctttgagtgacttttgatagcttgtgcctttcaagaaatttgtccatttcatcaaagttgtccaattttttggcataaagttttttgtaatgttatttttaaaaatctgtataatctgtggtgataccacctcatttctctcagtgctgatattggtgatttttgtcttctctgttttttactctgatcagtctagctagaggcttataaattttattgatcaagtatcagattttcattttattgtcttttactctttcttttctttttacagaactcattgatttcttttcctatcttatttcctttctttcacaaaaaccttgaatttaattttctttttctagtttcttaaagtgtaagctgaggtcatagttttgagacttttattcttttccgattatagatgttcaatactattgatttttctctaggtatttcagctgcactacccaagctgttgatatattgcattttcattttcattcagttcaaaatactttctgatttccttttggtttcttcctgatccatgatttatttagaagtgtgctcgttaggttccaaacacttgggaacttttcagatgcctctttgttattttttctaattcaattccattgtggtcacagtacatacattgtatatttgaattcttttaaatttatttagatttttttgatgttttaaaatatggtctatcttggtaaatgttctgtgtgcactgaaaagaacgtgtgttctgtggttgttgggtgcagtgttctataaatgtcaattacgtcaagttggttgatagtgttatttaaattttctatatcctttctgttttttctgtctattctataagagctgtgctatactttgaacgtatgtatccctccaaaatttatatgttggaacttaaaccccaaagggatggtattagggggtgggggcacataaggggtagattacgtcatgagggctccacctttgttagtgtagttaatgcctttataaaagggctggagggaacaaggtgggcccttttttactcttccatctcttctgccatgtgaggacaagcaagaaggtgcaagccctcaccagacactgaatctgctggcacctcaatcttggacttcccaccatccagaaatgggagaagtaaatatctattatttataaattgcccagtctaaggtattttgtcctagcagcaggaatgcactaagacaaggcttgcaatttgtgtctctaagagtggatttgtctacttcctttttcagttctgttagttttcctgcatttattttgaagttgttaccaggtgcatacacagttaggattatcatgttctcctaatgaattgattcttttatcattgtgaaaggaccctcttttttttttttcttttttttgaaacagagtctcactgggttgcccaggctggtctcaaattcctgagctcaagtgatcctcctgcctcggcctcctaaagtgctaggattacaggcatgagccactgtgcccagccatgaaaagaccctctttatccctttattctttactctgaaatctactttggtattaatatagacattcctggcttattttaattattgttagcatggcatatcttttttactttttttttttttttgagacagagtctcgctctgtggcccaggcaggagtgcagtggcgcaatctcggctcactgcaagctccgcctcccgggttcacgccattctcctgcctcagcctcccaagtagctgggactacaggcgcccgccaccacgcccggctaatttttttgtatttttagtagagatggggtttcaccgtgttagccaggatggtctcgatctcctgacctcgtgatccgcccgcctcggcctcccaaagtgctgggattacaagcgtgagccaccgcgcccggcccttttttacttttaacctatttgtatctttatatttaaagtttgtttattttaggcagcatatagctggatcttgcttctttattttaaacctgtctaacaatctcttctttcgaactaggttatttgtcctgttttaatttattatgattattgatatggttgggtttaaatctgctaccttgctatttttttttatttgttccatctcttctcccccatccatttttttcacttggattaatttagtatttttatgatttcatcttaatcttttttgttgctttatcatctgtggcattgtgctgtggggtttgtttttttaaaatgattgtctgcatttaagtcacattatatctctttttctgtaagaaccttagagcagtattcagattttcagtttctcccctcagggtctttgtgctattactgtcatacatttttcactcttacttatgttacaatctccaacattgttattatttttgctggaagtagccaataattttaaaaatattttaataataaaaagatattatctattttcctacatatgtattatttctattgcttttcatttttgggtgtaaatttagatctggtatcattttctttgtgccttaaggacttcctttaacatttcctgtatttttggtctgctagtgataaattatttcagcttttatttgcccaaaaaaatctttagtttgtcttttgtctaaaagatatttatgctaggtaaagaatttggggttgatgatttttttctcttccagtactttaaacatgtcactcaattgtcactagtttgctctgtttccaatgagaagtctgctgtatttctcatctttgcttttctgtatataatgcatcttttctctgtctgctttttaagatttttctctttaccattggcttcaagcaatttaaacaatgggccttggtgtaatttttctctatgtttcttaggctttgtttagtttcttttatctgtgagtttatagttttaatcaatgtattatagtcttttatctgtgggtttacagtttaatcaaatttggaaaatttttgctcgtagttttttcaattttgtttgtccccgaaaccccacccctcatctccctgtctcacttacattcatattcagggtttttggatttattccatagctcactgatcctctgttcttccatatcttcaaatttagtaatcatatcttatgcaatttttaatctattaatagcggggcattgttttatatcacttctacatgtttgatttgggtctttaaaagatatctttcatgtgtattatccttaacattctcatactgtccgctaccttcttgagcatacagtatatagtcataactgatttattgttcttttctatttattattagtattatttttgagactgagtctcactctgtcacccaggctggagtgcagtggcctaatcttggctcactgcaacctctgcctcctgggttcaagcaattttgcctcagcatccttagtagctggaattacaggcgcatgccaccacaccttgcttttttttttttttttttttgtatttttagtagaaatggggcttcatcatgtttgccaggctgttcttgagcttctgacctcaggtgatccacctgcctcagcctcccaaagttccggtattacagatgtgagccaccacgcccaacctcttttctatttattctatcatttgtgtcactcatgggtctgtttctattgacagattttttttttttcattatgggaagcattttcttacctctttccaggtctggtaacttttgattggatgccagacattgtgaattttactttttgggtattcagtattttgttgtgctttacatattttgagagattttttggatgcggttgtattgcttgataacggtttgatttttcagaggcttgctgttaggctttgtttggtggaacaaaaacagcctttagactagggccaattttgcctcatttctgaggttatactcttgtgagtactctatccaatgccatgtgtatttcaaggttttccccctctgactggtgggaaaatgaatgattcctagctctgtgtgaaacttggcaattgttttgcttattctcttttggtggttcctttcccggtttgtgtagtttcctcacatgaatgcactgattaatatttgtgttacttattataaagaaaggagtgttaatatctccaggtaaaatcgtggacttgtatggtttctcctttcaattccatcagtttttgcttcatgtattttgaaagtctgttattaggtatatacatatttaaggttgttatgtctgctagatgaattgacacttgtacgttttcattgtattcctcttattcctggcggttttccttgttctgaagtctactttgcctgctattaatatggtcacttcagccctcatttggttatttttaatatggtatatttttttatccttttacttataagctatgtattttattatatttaaggtggctgtcttgtagactagatacagttggatctttttaaatgttaatctgaaagccaattggacaatctgtcttttagttggagattttagacaatttatatttaatgtaattactgctatggttgactttggcctgtcatgttattattttattatttgtctctgttttttttttttttaaaggagatgggatctcactctgtcacccaggctgaagtgcagttgtatgatcatagatcactgcagccttgaccttctgggctcaagcagtcctcccacttcagcttcccaagtagccaggaccacaggcatgagccactgcacctgacatatctcctctgtttttttttttttttttttttttttttgagacggagtctcgctctgtcgcccaggctggagtgcagtggcacaatctcggctcactgcaagtcccgcctccagggttcacgccattctcctgcctcacgcctggctaattttttgtatttttagtagagatggggtttcaccgtgttagccaggatggtctggatctcttgacctcatgatccacccgcctcggcctcccaaagctcctctgtttttattccacttgctcttttcctgccttctttggattattttaacatttttattatatcatattattttatctattagctttttggttatgtctctttgtattatacctttaaattgttgctgtaaggactacaatatacatgcctaatttttcacaattctacttattgttaatattttaccacttcaagtaaaacatatgattcttctaggccaggtgtggtggctcacgcctgtaatcctagcactttgggaggccaaggcaggaggatcacctgaggtcagaagttcgagagcagcctgaccaacatggagaaaccccatctctactaaaaatacaaaaattagccgggcgtggtggcacgcgcctgtagtcccagctgctcctggggctgaggcaggagaatcacttggacccaggaaggggaggttgcagtgagctgaggttgcaccactgcactgcagcctgggcaacagagcaagacgccgtctcaaacaaacaaacaaaacaaacaaaacaaacatgattcttctaaccagataagcctttttaccccctaccctgtaagttaaaattgtgttatggattacatctacatacattgaagatccccttcccagacaatgctatatatttttttcaagagtcatacgtatttcatataacttaagtgaaaaaatgattttttatatctacctaatcatttaccgttttttgctgctgttccttcatccctgaagctccaagttttcctctggcattatttcctgtcagcctgaggaacttcctttagcatttgttttagatagatcaggtctgttcatgacaaattcacttagttcttcttcatttgtaaaggccttcatttcctctttattcctgaaagatatttttgctgtctgtaaaattttggattgatgctaatttaccactttcagtatgttccgctgttttctggtctccatagtttctgatgatacatttatggtatttcaaattgttctcctctgtgtaattcttcatttttttttttcctgggcactgtcaaggttttttctttgaggtttttagcagtttgattgggatatgcagaacatggtttgtattgtgttttttctttttaatttatcctctttgtggttgcagagtctcttgactttttaaccaaatttgggaacagtttactcaatatttccttaaatattctttcttttgggtactgctgtcttcaccttctcctttaagaactctgttgatggccagctgcggtggctcacacctgtaatcctagcactttgggaggccaaggcgggcagattgtctgagctcaggagttcaagaccagcctgggcaacatggtgacaccccgtctctactaaaatacaaaaaattagccaggcattgcaacgtgtgcctgtagtcccagctagaggacgggaggctgaggcagaagaatcgcttgaacctgggaggcggaagttgcagtgagccaagatcgtgccactgcatgccagcctgggggacagagcgagacttcatctctaaaaaaaaaaaaaaggactctgttgacaaaaatatttaagcttttgatattatctcatagatccccaaagctctgtttatttttttcttcagcttgatcatttgggcagaatgagggatttatttcagaatgtttggtgtccatgcccactatgtactgccttaatccagtcagtctttgggtcaacagcaggagttaaaacacaaaagtgaataccaactgggaacctcatctgccatactggtctttattcaaattttgacttcctttcccaacccacctgctattattgacttttcagagtcttcaggtagttgcttttaaaattttgtccagagtttttttgtgtgtgtgtgtgtaatttataggggggagagagagagagagagagagagatgcatagtgggtttactccatttcaggtttacattagatttgttcattttaaaatttagaatttttttctatctggtacatgttgcataattttaattgctatgtcttctagtttactaacggtttcttttgcagtgtctcatctgctgttaatcccatctaatgtatttttcatctcaaacattgcatacttcatctcttgaagtgtgatttggatcatatatgtatatatgattcattaaaagttattataactccataacatatgtttaagaaggtagaggagagactgaccatggtaagtagagatatggaagactatctctatatctatatatagtctttgtatcatatatgtagtctatatatatacacatatagtctatatataacatataatcatctatatatagtatatatagtgtatatatactatatatagtgtatatatagtatatatatagtgtgtatatatagtatatatatagtatatatactatactatatgtatatatgtatatatgtatactatatgtatatatagtatatatactatatatgctatatatatactatatatacactatatgtatatatgtatatatgtatactagatgtatatatagtatatatactatatatacactatagtataaatacagtgtgtatatagtatatatatggtatatatagtatatatagtgtgtatatatatgtacactatatatatacacattgatcatttgggcgtgtacatatatatgtacatatgtgtgtgtgtgtgtgtgcatatatatatatagtgtatatatatatatagtcttggtctattatctatgtcacttctggccagtttagctgggtttaagaactataatccaggtgttgagtttgctgattgtttccacactccttctgtggacagagctgggaaatatttttcttgtggagacaaaatatattattgtttatactgatttttccaattcaaatttaggattacagaattttctttacttttttgtttttatattttaaaaatctcttttatgctaacatttttaaacttccatctgccttaccttaacacatttcttttatatatattgacactaacaatgaaacgactgaaaacactttaagatttcttgcagttctctttgttcacagtgtatatctaattaggatttaccaccatattgccagttttctattaataatgtatattcaactaaggattgaccatgtaaatgtcagctgcttttgatagccaccatcctatgtgattggcgacttctgcttttgcgactttaaaccaaagcagtgggccctgtgctacctttccactttgccttgcatcttggcactggaagaagacaatgcatttattactgagagttgcccaagaactcacagctccatcctagggactctagctctggctggctggggaggagaaggtttacaagcatcgggctcgtatgtgtcaggcatttagctgggcacagcacccttagttcctcaggtggaggtcctgttgttacccctactttacaggtatggagactgaagaacagacggaagttacttgcccaaagtaactgtgcttcaggtcttttaaaagaaaccttatttgtgcagttaagctacgaaatcaatacatggttaattttgtttgcctaattttgctttcacattttagagattgctttttaagttaattttgttgcataatttaataaaatgtgtatatgagtccagagaaaggattggcaaactacagttgatgggtcttatcttgcctgtgacctgtttttatatggtctttgaggtgagaatggtttttacatttttaaccagctccaacaaacacacagacacacacatagacacacacacacacacacacacacagagagagagagagacagagagagaattatatataacagtgactacatatggcctacaaaacctaaaatatttactgactggctctttacagaaaaactttgtaacccttgttctagagtcaaatctgcaaaacaaggtacatttcgagaaatcatccatgttccacctctaaccctgtctcccccattctgctcccctcccttcctcttaaggcagtcttatttatttgcttattttagtttctagtttgtcttcttattgcttcttagtggaaacacacacatgttcacgtcccctcttctttacacagttttttctcccactttgaattttttttcactgaacaatgtgtcctggagatcgcttcatagcaggataggttcctcattcttttttacaactgcgtagtggtccagagtattaatgtactagagtttattcagccagtcctttctcgatgaacattgggttgttccctgttttttatttttacaaatagtgctgttttcagtggcattgtgcttatatctctttgggattttgccagtgtaagtttaggattagttcttagaagtggggttgctgggtcatgcatattgccgagtaacgatgcatatgttattttgctcaaagttgtctaaatcctttctgcacagggcttgtaccatttgcatttctggcagccatatgtagatacctaacacccccagagccacctaacaagggtgttgcaaaactttgggattttgttaatttgataggcaagtaatggtatctctgtgtgatttaaatttgcattgcttttgttaggagcaaagtggaaggaccatttcatttttttctgagctctgtttccttgcccgtttttctgtagagctattggtctttttcatctatttttagggaccatctgtgtattacagatagtgacctttgcctgtaatagaagttgtaaatatttctcctacttgtcttttttactttatttatttatttacttgcttgctttctgccatcccaaagtatttttttttaattattattgtttttatatagtccagtttattcaacttttcacttattgcttctgggtttggagtcatagctgggaaagttttccctagtcccaggttgtagagaaattcaatcatgttttttctcatagttatgttatactttgtttaatgtaaatgtcagttgcttttgatagccaccatcctatgtgattggcgacttctgcttttgcgactttaaaccaaagcagtgggtcctgtgctacctttccactttgccttgcatcttggcactggaagaagacaatgcatttattattgagagttgcccaagaactcacagctccatcctagggactctagctctagctggctggggaggagaaggtttacaagcatcgggcttgtatgtgtcaggcatttagctgggcacagcacccttagttcctcagctggaggtcctgttgttacccctactttacagatatggagactgaagaacagacggaagttacttgcccaaaattatgcagccagtaataggctgccacgctcaggtccccagggtgtctgcctaagtgcttgggccctcccacttggcatctcacccctgctcatccaagggccaggagaggccccacccacctctgggctcttgtgaggctgcagcgtggagcacagtcctgctgtgctcccacctcccaccaaggtcttggagcagctttcctttgtctccacgtctgaggcacagggcaggggctggctcaatcagggccaggggaaggacctgtgagtgaatgtcatctcacccgggggtcctgggagagccagtggcaaaggcttttgtgtgttgcctcagccctgcatgccaggatgttgctgggagccggaggaccctggattgctacttttaaagtagtcgaccttttgttcattcactcattcatttatgcatttactcacttatccagcatcaatttgacacaccttactgatgcctgcaggggcagacccagtgctagccaagggtgacccagaaatgtgggcagcagggcgtctgtgccaggagctcacagtcctgtggcgtaggcaggtggctgatgtgggcagctaagggagcacagggttgcgtgtgagcccagagcagtgcctccccaccccctgtccttcaggtctgggtgcagaggactggcagcatggggtgagggatagctgggtgcatccgccagtccttcttctttctgaggaccaggagtacttagaggctcagaggtgtggttggggccctcgtgttgatgactcaaaaactagacctaggaagggaacgaaccttccccaggcacatagtaaatctgtagtgggccaagattggagcccagtgaccacccccaaccccgtgcactctggaagtggcaggaacccaaggctgctctggacgagtcagcagcggcccagcatcccccaggtttgctggtgggccgagtggtgggcagattgtagggacataacccctgcatgtgtcatgatcgatcttctgctttccccaagaccatgtccctgcatctctaccaggggcccgcagttgccagaagagtctgagtgagactcccttttggatccagctcgttaggctcgggtagcagcgtcccatgccagctgttggtgtaattaaggttgccataaaacccaccagctagacacacaaatggctcctttgctctttcctggggcatgagcagttgtgaaggcgagtaaatcatgttcggtggcgatcacttcaaaggccagccttccacttgcagccacattattggcagggatcgcccataacacggcttgtttcccagccattcacttttatgacaccctaatgaattgggccatttccatccattctcagaaaatgtacggaacaactgttttggttctcctcaaaaagtttgtcttgggaggcaggtggtgtgttggcaggggcatgtaggtagttcttggctcctgggcaagttgcctgtctctgagacttcatgcccaccgagagaagctacctatggggctcttgtcatgagataacttatgtgaaccccccagccaaggcccagcacctaacgggcactcagcgagtggcagggagggccgtcatcttcctcatcctttccctgggtcagcctcttagggatcaaagtgttgaggctggtgggggctgtgatatcaaggccatgtgggaggatagagcaggcacaggcatgcagaatccagtgcgtggaggaaggcaggcagccgtgccgtgaggggcagcttgtctccctgttctgcattcagaaggctttttttttccacccctggatcattctttaggcttcagggggcccactctgaaatctccctggttgagggttgctttggaagaggctcagagaagagcggtcatctgttgcctaccctcccccaggaattacagaggcaggaattgaccagcaggagaatgaaccgtgggtcccagggaagccgtggaggtcggaagaggctccaccatgccctggccctgtgaccttgagcaaatccgtacctcttcctgggcctcagtgaacctcatccagagaatgggcctcaacctcctcctcctctaacctaaactgaaattatggagtgacacatttaatgtgaatttgatgtatacattttaaggaggatgacagaaaatatgtctgcaaaatttgaaaggtatgaactccaattaaaaagtcaaggtggctcattttgagctggcggggcccagggactgaactgtttatgctgcagccacatggtggcggcccaggaactggtaaagggaccggccggcccctgcgaccaacttgagaccttgctgcgcttccatggctgcgcgtgggtgcccagcatgttatttccatattgtcattaaagtcctgtcctctgtgagtttgttaagtggagctacttgctggtcctggtactgggacccttctccatcccctcaccagagctggatacttgagagcagaagctgaatgtgataaaatcctctaagaaagcaaaacaactgctcaatacttaataaagtcagtttatgagacagcagactgtgaagtatcggtgatgatgctaaaacaatacaaagtgtcgttaaagctaaaatatgtcctgtgattctggctttatggtctgtccccaagcacacttgctcctgcattactgtggctcctctgggacaacaatctgggactttgcaagctgtgaattatgtgacgtcttcagaagcaggacccactcaaagcatgaccccagtgttgatggatgtcaatatgctctcgaggtgcccttggcgagtcaaggcccttccctttgcgctttccctgggatcctgctgctctcaaggggtgatagggatgcctctctggacccatgtggcaatagagcaggggggctgagaagctgacagacactggactgggcatggggcaggagggtccatgattccatatatggcttgtgggtgctgctcagcctgggtgtgtgtggcccagcataaacttcactaaacctgcctgccccctgggtccttggccttccctgcataggcgcctgtccgtgctgccaggcctgccagcatgaccggtgtccgctcttgcaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgtaagaaatcccatttggcattgctgtcagtttcagccacagagcgtatccatgtagttctggtctgtctgaggtcccaggtcccttctgtgggaggaggctcactggactgaaatctccaggatgagggtagtcaggtctcagcctgccgcacacatggagagcttgctgtgggcttccagatgcaacctccttctgctcttcttgtgccagcacagcaaccccacagggtaagggtctggtggggggcggttcagtccagatcaatggggaacgtggcagtgcaacctgagaaaccccaccctcccactgccaccacaaccagctactcagaaggggtttctgaccctcagtggcattggcagttgatgtagcccaggagttcagagcaggggccccacagttagaacacctgcattaaggttttggattcactaggaccttataaggcggagagccttgggcctgctatttagcctctttgattctcactttcttcattagaaaatagttttgagaattaagagagagagagaatgtttgtaaagggtatagcacagtgtcaggcacggggaatgcttctgtgctttaactgtcattaccaccaccaccatcaacatcactaccaccaccagtgtcatcactgccaccatcatcgtcaccatcagtaccaccatcagcatcactgtgtctatagccaccacaaccactgttgtcattgtcactaccaccactactatcatcaccaccatcatcaccagcaccagcaccatcagcatcactaccaccaccagtgtcatcaccgccaccatcaccagtaccaccatcagcatcactatctttatacccaccacctccactgtcatcattgtcactactaccactcctgtcatcaccaccacaccatctctatcaccaccaccatcaccatcatcaccactgccatctctgtcaccttcactgtcaccagcatctttattgctgcaccaccaccatcaccactctatcaccaccaccatctccgtcactaccaccaactgtatcaccaccacgatcactgccgtcattacaccaccccatctctgtcaccactaccatctcttatcagtaccaccccaccatcagcaccacactatctctatcaccaccactgtcaccagcatgtctagcaccaccaccaccattaccaccatcatcaccaccgtcatctctgtcacaccaccatcaccaccgtgattgtcaccaccaccatctctattatattgttatcatcaccaccaccaccaccactgctaccgtcatcattgtcaccactaccaccgccatcatcagcatcatcttttgagatttcaactaacccaagactaatctctgaatttaaaactgtatgtcatgtgtatatgatatatgtgggtgtacatgaaatatctatcctgtgtacaccttcttttcctccctgccttttccttgttctcagtgggttctaagtggctctgagcaaacccacttctagacctccactgcagggtgtcccagggcaacccattgggcaggacaggcccttgtggggagctggaggggcacgtctggcctctgagggtgtcctgcctccaggagcccaggggaagtgaggcagatgaaggtgccttgcgcctgaactatagttacactccacactgtctgtgtggagggagcaggtgctcagcctggcaccatcacactgggagcttgttatctggccatggcagcctctgtgcctctgatggccacatcagcctgaagctgtgcttcctgctgctccccactttgccctctgagtttgggctcacttagagagtgtggcctagggacaatagttagaacaatgtaaagccagcttgagggggtagtttttaggggtgcttcctgtcaatgaagcagtgagatctcgcgccccctgtgttttgaggtttgtgcctgcatttcttttctcatttggccacttacctcctcacttactgtgcattttggctgtgtgggtccctgggctgggctgggctgtccctgagggctcattgtggaggtggggagatgggcatgtagattccttttctatccttgtgtgataaattacacaaacttggtggctggaagaacacaaacttattccctcacagttctggaggcccgaagttcataatcaatattaagtatgattgggctgaaatcaagatgttggcagggtgtgctccctctggagtgtcaaggggagaatccttcctgccctcttctggcttttggtgacagccagcattcctgacttgtggctgcatctctccagccctccaagccagcatcttcacaccaccttcactgtttgtcacatctctgcgccttccctttgtttctttctttcttttttttttttttttgtagagatggggttttgccatgttgcccaggctggtctcgaactcctgggctcaagagatccgcccgcctcagcatcccagagtgctgggatacaggcgtgagccaccacacccagccttggctttctttctatgaggctgcacgtgactgcatttagtgtaatataggatcatctccttatctcagaatccttagttatgtctgcagagacccttggttttgaccctgtaaggtaacattcacaggtttcaggaattagaacatgggtatattttggggggcattttcctgcctgccacagggacacaggcaggttgtagaagctgggaaacatggaggaaactggattcccctccagcctccagaaagaagtgcggctccgccaacatcttgacttcagcccagcgaggcctttttcagacttccgactcgcaggactgtgtgatgtgaaatgtgtgtgtcttgagccaccaagcttgtggtgatttgtcacagcagtgataggaaaccaatggagacacccagctagggtctgggagcaggccccaggccccagagcagagtgccaggttgggggtgtcttctctgacccatttgtggctctgctgttctcaggagaggttcacctgccccagcctcgccttgcacccgagagagcccgtgttcctggcacagaccaatggcaactacctggcccttttctccactgtgtggccctaccggatgagcagacggcggcgctatgaagggcacaaggtacttctgtccttgtcccccaggcgaatgctgagccccagccccaagcctcctggcagtcctggacatgggccctggggtgcatggagcctctgtctgggtggatcctgctttctgtttcctgggtgagcgcatgccatgtggctcactgtctcttcaagtccctgaaccacatctggtcctcaccccaggccccacgtactgggcaggaagcagtagttggctcacacagacaggtctcagaagtggggggcaggaacaggacaaaatggtcatgggtgtcatttctgcatccttccctttcctcactgaggccaagccttgctggggtggaaggggctgggtgcttagtgactgtcactgaggccagacccctcagctgggctggagctggtcccgctggatctgctgaactggccttgggatgtgggcccgcatcagggctctacagcctcatgggcgggacctgggctttggcctcagggacacgaggtgcgaagcccagctctgctccgtcagctcggggcttcagcctgctcctctgtagaatgggcatactcaccccggcttgacaggtgcggcttgctcacccactgtgtccctctctgcaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaagtgatttcagcaa

SEQ ID NO: 2675 - DNA, 153809 bp, Homo sapiens
ggtgcgtgtggtgagcggcgggccccgggctggaggggccgggactgggcagcgcctaaagcgccccgtgccgcttaacgcggtctctcatagccgctcgccttcctttcacttcctgttccttcagaaagcgctgtgccttggaccaaccttacttcttactattgacagctcagctaactcctattcatccttcaaaacccatctctggtcgtatcttgtttgttgctttcatcgctctggggcctccggggggatctgtgttttgtgtttgatttccacccacaccagacccagcatagggcttgacaaagagtacgtaatcaggaaatgtttgttgaatgggaatatcctatttcttttacttcctagcatctccccctcccacccgtttgcattccagaaatatttttagacgctgggcattgaatagtgaacaaaacacagaaagtcctgtcctcatggggctgacttgctgatagtgactgtcagagtcactcgctccttccttagactcttctccagtgtccctgccttcccttccatcttactgtctgttcctcttcgtttaatccctcatctccttccagagggagcacgggcaccctggtggtgggaatctgggtgcatggtgggtggtgcctgggcagaggagttgagagtggcctcgggaccaggcttagcatttagagaacagaaatgccaaattatttgcagtgcacggttccattagtttataattagtctttcatattatattagttccattggagatgagctggctggctggctttagaagttgttgttgttgttgttgttttttgagaccaagtctcgctctgtagcccaggctggagtgcagtggcgtgatctccactcaccgcaacctccgcctcccgggttcaagcaattctgcggcctcagcctccagagtagctgggattacaggcgcgcaccactgcacacggctaaattttttttttttttgtatttttagtagagacggggtttcaccatgttggccaggctggtcttgaacccccgacctcaggtaatccgcccttctcggcctcctacagtgctaggattacaggcgtgagccaccgcgcccggtcgttttatttaaactctggctttgcgtgtggaagttgttacctgcctggaatgggctgcgaacgggggcggcattactagaggaggctgactacagacatttatggaatgatgacctgacttgtagaccagtggaaccctcaggcgaatgatgccacttgggggaaaggtgtggaagaggttgggtggttgattccaggggacatagaaacccattgtctagaagaagagatgggtaataggctgtctggaatgacttagaaaaggacttggagggaatctgttgatgctgacctgactccacctgttgggggatggaggcggagcttggcgtgtttgattaaggttgggtgcactgggttttcttggaagtcggtctattgcctgagcgttctgtgctgttccaccgcgccctctgctgtcctaggagtgcctagcacccttctttttctctggattgtgcttggtgctaacagcacagaagtaaaaaattaccaaagcacttctttctgggaactaattgataaccatgtattgtgtatgatggttcagaatttcagaaagattttttttttttttgagacgaagtttcactcttgtcgcccaggctggggtgcaatggcgcgatcttggctcactgcaacctctgcctcctgggtttaaatgattctcctgcctcagcctcccgagtagctgggattacaggcgtgtgccaccacgcccggctaatttttgtattttagtagagacagggtttcaccatgttggccaggctggtctcgaactcgacctcaggtgatccgcccacctcggcctcccaaagtgctgggattacaggcatgagccactatgccctgcccagaaagattttttttaacaagtagaaattcattgcagtgtgaatctgtgtgttgggagtgaaatgggtggatttggatcatgccctcagaattgctccctgcacacttgggtagacggacacctcaggaccttagccttgtgctgtgggcctgtctgtccagctggctgctacagagatgggatacctgggggaagaatgttccaggcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaagaatgttccaggcagagagaaaagagggaagggctggagcacagggaaagggtgcaggggaaagtggcaggcctttcccaccatggatcctggacgtcttttgatttcagtattttcagacctaccctcgttcatgatgatgagcatatgttctcacttgttgctaataagcagtgcggcaggttttctttatacatttatcttcatggatttatacatctagcaaacatatgctagtatttgtgtaggataaagttctacagtggggttgctggggtgaaaatgatgtgtttaaacttgtaacacatatgaccaaaatggaccttccaaaggcatttttaaagtcctgtctctttctctgtaggcattgtctcttcaggtcttctttttttttctttttttttttttttgagatggagtcttgctctgtcactcaggctagagtgcagtggcatgatctcagctcactgcaacctccacctcccgggttcaagcaattcttctgtctcagcctctcaagtagctgggactacaggcgcctgccaccatgtccggctaatttttgtatttttagtagagacggggctttgccatattggtcagactagtcttgaactcctgacctcaggtgatccaccaaccttggcctcccaaagtgctgggatttcaggtgtgagccatcacgcccagcctaggtcttcttttatgtccttcaataaaagttttagttttctttccttttttttttttaattttacttttttgagacagagtctcactctgtcacccagtctggagtgcagtggcacaatctcggttcactgcaacttccgcctcctgggttcaagtgattctcctgcttcagcctcccgagtagctgggactacaggtgcgtgccaccacgcctggctaatttttgtatttttagtagagatggggtttcactatgttggccaggctgctcttgagctcctgaccttgtgattccccccgccttggcctcccaaagtgctgggattacaggcatgaaccactgcacccagcgcttttttcttttcttttctctttttgagatggagtctccctctggcacccaggctggagtgcagtggtgcaatctcaggtcattgcaacctccacctcctgggttcaagagattctcctgcctcagcctcccaagtagctgggattacagttgtgtgccaccaggcctggctaatttttgtatttttacttgagatggggtgtcactatgttggccaggctggtctcgaactcctcacctcaagtgatccgcccacctcagcctcccagaatgctgggattacaggtgtgaaccactgcacccagacttactataagtcttcatgtaggtcttgcttattttttacagatttacccccagctattccatagtttcaatttcaaaaattttatcttctaactaattgggcctgatatgtagaaaagccttttttgtttttgtatttattctttttctttcttttttttttttgagtcagagtctcgctcttgttgaccaggctggagtgcagtggcacaatttctgctcactgcaacctccgcctcccaggttcaagcgatctcctgcctcagcctcccgagtagctgggactacaggtgcctgccaccctgcctcgctactttttgtatttttagtagagacggggtttcaccatgttggccaggctggtctcgaactcctgatctcaggttatccacccacctcggcctcctgaagtgctgggattacaggcgtgagccaccacgcctggcctgtgtttattcttatgagtgttgagttattggatttcctaggtgacatggtttcttataactacatacatattcttccatgcacattttctgacggttgaccttgtttgatcttaggtggtttggctttgaatgacagcaagaactctgtctttaatggcttcattggtagcgtatgatgattcggactcggaggctgagacagagcatgcaggaagttttaatgctaccggccagcagaaagacacttctggtgtggccagaccacctgggcaggattttgcatctggtacactggatgtgcccaaagcaggggcacagcccacaaagcatggctcctgtgaagacccagggggctatcgccttccattggctcagcttgggagaagcgattggggatcttgccccagccagaggctacagtggcccgggaaggagcctcaagtcaccttccccatcaaagagccttcttgttcttctctgtggacgagccatgttccagccagccacatgcccctggcagctgcccgctttaagcaagtaaaactctccaggaactttcccaagtcatctttccatgctcaaagtgagtctgaaaccgtaggtaaaaatggcagctcttttcagaagaaaaaatgtgaggactgtgtggtaccctatactcccagaagactaagacagcggcaggcattaagcacggagacaggcaagggtaaagacgtggagccacaggggccccctgcagggcgtgccccagcccctctctacgtgggcccgggagtgtctgagtttattcagccatatttgaatagccattataaagaaaccacagttccccggaaagtgcttttccacctgagaggccacaggggccctgtcaacaccattcagtggtgtccagtcctttctaagagccacatgcttctctccacttctatggataaaactttcaaggtaagacttgaatgaaaacttctgctttcagatgctcttaggaatacactgctggaataatagtgaagtggagggaggttacaggctgaacttttttttgtgtgcagatttctgtaattccctttgttgcattccagaaagggtcatctgtggtcagctccgggttgtgggttccttctgccccaacccttccctgatgctgccttgctcaggttaccagaggatactgtttcttatccctctcggaggccgtgagggaggaggtgagagtgattagtgggagaagaaaagcaggcccaggaccaagccctggggactggggacatcctcggtgaccctgtggagcattgagccatgccagctctgtgcctggtgctgtgctggtttcaagggctgttgggagaggtaggtagacccagcccctggtgtcagggcttgcacagtgaggcgggagccgtggacaagtacacagactcaaccctgagctgtgaggacggcccccagtaggacacacaggtgctctgggagcccaacgggagggttaccagcccagcccggcagggctcagtgaaggcctcctgaggaaggggaaggttcgcttggggatgggggcagaagggcgtgcttggctgcaggagccctgtgtatgtgttggctccaagcatgagggcctgggagctggcttcaagcatgtgtgggtgagggacttgaggctggggaagcaaggtcagggaaggttgcacgtgcccttctggggacttctggttttacatggaaactcttttttgcattgtcttatttattttacaggctactgaagtgatagtaatgtagtcccccagtatggaggtacagtgtgataggtcgttgtgcccacctgggacctgtctccagcccttcgagctgtgcactgcatccctcctctctctcctcgcagctagcaaagcacctgatatgtagcgggtgccaactaaatgctagctgaacagaaagctcttggaaaggaaataacttcaagggacctggcttcacatccagctttgctgcagagtagctagctggtcgaccactggccggctgccttcctgtggagtctagtgtctcatttgtaaaagggcaaaatcatacctgggtcatgtgctcatgtgagaaaaatgctgaaaaagtgccttgcacagagccaggtacctcataggcgctcagtaaatggtggttcccttgcccttgtttcctcagagttctggaaccaactttcctacatcttttctcttgcaaattacattttgagcttttctccctcggaaacattttcttaagtgaagaaaggaagctccaagtatagagatgtctttgaaatgagctgaattgatgggtggcatttttaagtggcgaactggagtcctgaagtggcttgtctgtgctcttttctagcaagactcagagtcctgtgggagagaacgtcatattctctcttcagcctggagttccaggattttccacttaggtctttggtgcttttcctgccattccgggggctgtgaagtgtgcgcggaggcttctggcatccctggcgtggatcacagcatgctgggattgatcctgtggccccggggcttctctgctctccttcccaagtctgcgctgcaagggctggaggatgggaagcccatctggagggttgctggtgggcctgggcagtgtctgactggccctggagttcaagtggtggcccttgtcctccctgtgctcaccttcctgttgaggccttcttttacctgcccgctcacctctggagttctctctcctgatggtgaggggcagacctggggccctgtgggactggccttcgcctggtggcgtgaagtgctccctgggccctgctggcagagtggcagcttgggtcacttttgcctgggaaatttagatttcctaaacagaagcatccccatggtagtttttgagcagagagcacctgagtagaggcattgatttctggccttgtggagtagacaaatgtgccaggcacggtgccactggggacgtggggggagagacgtttctgcccccatggaggggaaactgtgagcagccaactaactgtgacacctcatgaccagaagagggcgcagtgggcccagcttggaatggcagtgagggtggctcagactgagggactgtggtaggaatgccctgctcctgggcgattcagagacctgggtccgggtctgtggggctgccctgggtggggccaggcgccgcagctgtgcccgcctgtcccgaggagactgtgtgtgctgcaggtgatgacactggcatgggccccttgggctgccaggcagcttctggggagccccacccactgcactgtgcaccctgggttccttcccagggcagagcacatttgctgtcatgaggttgggccagggtcagcatggctgctagggttggcatctcctgaccctctttttttactgtggtgtcgtgaacattagggcttttataagccatagatacaaatggtgggccagggccctctctgttttaagatatttgtcagttttcagtgatggggttatttggcaaattggttttgggcaaattgactttgaacaacttttcagtgtgaagagtgtatggcaggggctggaggagccaggatgggaagacagattgggaaccggcggggagccaggcaggagctgtggccagaagtcccggctgaggcctcaggcttgctgggccaccaggtttgtgcgtggcctggctgggaggcacatggtgttcttttccctccttggtgtcagaggtggggcagcatggcagatcttggggacctggtgatctggggaaggcagtgtgtgggtgtgggtggtgggtctggagtggggatagggcctcgggcacaggcaggagtcctggctggctgcagcccagtccctggaggagaggaaatggtgggtgcagcatggaatgagctcaaagaggcgggtgcagcagtacacccttcccagggtgctttccccctgccttttggttaaaatctgccagtgtcttctgggcccctgctggatcaggaaggagggaagagcttgggggctgggtgacaagacctgcttgggtccttcctctacggccagccccttggttgcgtggtctctggcaagttacctcacttctgagccttcatttgagtatctataaagtggagagaattaaacatgcctcgctgggtttttgtgaaaagtaaacgatattagttgtgaatcaccaagtgcaatgcctggcacatagcaggcacttagtgtgtgctcgagttcctgcttttccccaagaatttcctcctttccttgacttgtgctcatgtcttattttacgtaagtagccatggaagcatatcagcttcacctactagactttaagcttcctgagccagaacccatttttatattccccagcatctggcacaaaattgtgtacatgttaagtgatcgataaaaattaaaacaaattttttggattttatcgcaagcctttgggaagggattgtcttttgagtggataaatcatattcgccactagggtgcacagtaagacttaatataagcagctcatccaagcttctagaatgtggaagaatccttgattcaaggtaacatttactgaaaaatgatttctttctgatcaggagaaaaacaacacagtccaacttattaatctaaagaacatggagtgccagttccttcatatccttaaaacgtagcttcggaattcatacatttcaactggacacattacagtggaaagatacttattttaatatgttctaaatgttctgtgagctgtaaaatatgcttttattagttttgaaaaatttacagctagagaaattaagtaaaataaaacaatgactcataattctgcaccgctgctctttcctgacgatcccttcctccccttgtctgtgaacgtgcttgtttttttcatagctgtgatcccagcacggatacccttttatatactcttttcatctcccagtgaactcttttggcttaacgtgtttgaacacccactgcacgtaaaggtagaaattcagactttgatgcctttttttgaaggaaaacatgtacgtggcctgcgttaaccaaaaacacaaccagccgttattgaatgctcccatgtacagaaccctctgccaggcactgagagggagtcccaaaggaataagacctttgggtgggtgacagaagacccaccagggaccttctgtacctgtatgaaaacctgcagttctgaaacacagaaggtttttaaagaaaatatatgaattagatgttgtttatttgctttacagaataatttgctctagaaattctttcagtaacaagcttccttaaaatactttgaaaaaaaaccttttaatttttgaccatgaatgtaatagatgcttattgtgaaaaactttaatgatgcaggaaatatgaagtatgaaggagaaacagaaatcattgataactcccaaccccaagtcagtgcctcattaacatgaggggcctccctggtcgggggccctacattcctatctgtttacataattgggcttattgcatagtatgtgcagttttgaattcttcctctgctgcccaatcttctgtaacgtgtaaggggaatttttctaccttattaaaaacttttccccaaatatatttttataactgtctcaagtttcatactttgctccatcatttccatgttgtttcctataatttcctgcttttgtttaaaaaataatcagtattacagtgaatatggctatacataaatattgtctttttttgctgccttaatgcagttaagatgggctttgaggccaggcgcggtggctcatgcctgtaatcccagcactttgggaggccgaggcaggcggatcacgaggtcaggagattgagaccatcttggctaacatggtgaaaccccgtctctactaaaaatacaaaaaattagccgggcgcggtggtgggcggctgtagtcccagctgctcgggaggctgaggcaggagaatggcatgaacccaggaggcggagcttgcagtgagcccagatcgcaccactgcactccagcctgggtgaaagagcgagactccatctcagaaaaaaaaagaaaaagatgggctttgatttacacccaggcattagctaaagcccttgtgtgtggtgagagtgggacctgattagattggcaaaccttcagtaccactgttgtactccttggctcccatgccaaatcttctgcttggtagctgtgtgactttgggaaaatcacttagcctctctgatcccctagttcctcactggtaaaatggggataattggtaaatggccaccaattaaggttgttgctgtagagctgaaatgagaagatccagcctagtgcctgacaagggagaggctgaggaagcatgtttctgattcccctgtacctgtcttgattagttataaaacaaagtgtagaaaagacaaatcacccagaatcctccaacttactgtaactcttgttttttgtgaatcttttcattgtctctatgcacacgtttttaaagcgtttcaatctcagtgttcttgagataaatacttttagaatctaaagagtttgaggattgtctgtgccaagccattcatgcactcccttttcatgtactgaacacttggcaggtctgtgttggagagctggttccctgtccccaaagtggtcacatttaaagcatggatgagaggatggagagcgctagccattgctgagtgcttaccatgtactaggcatgttctaaacgctccgtctcctcttcattacaggcctgagaggccacttctgtcctcattcccattttacagatgaggaaattgaggcacagagaggtcaagagacttgtccgtggtcacacagctagtaaatgatagaggcaagcagggaagcttcagactcagagcctgagcagaaagagctaccaccactcacgctgccctcctgcctctgagaataagggatggaaaagcgcatccccttcacccaggtggtgtccaagctctatcccagcttccaaattttgtggttctgttaagggacatacagagaagagatgatttctggggtggtttggatttgcatttttatgtatcacaggatcctgttgatttatcattgttagtgaatctgattacattaagatatcttagatgtgctttgtagaaagtgatctatttcacattcaaagacaagggatttatggctctaagtgccagagtgagggtttatttcagttttgaaagaattattcttgatggattttacaaaatgagattgagaaatgatttgatgtgtggagtgaggagttgtggagcattatgcagatgattggcaatttattctaagcacgaggcaaatctattggcaatgagaggcgcagctgggaaggaggtttgggtggtggtagtgggcctttggtatttggggagtgaatgattaacagtgcatccagggtaattagatgaaggtgaggagagaattggtgatgtgtgtgtgcgcatgtgcgtgcatgcatagcgttcatctggttcatttgatagaggcccatagaggggaagacacgcccgaggacacacaataggtgtttggatgcttcctagtctggacactatatttgcttctcttctttcccaccttccagaggactttcagaatcatctgaattaccccaggattgggagtgtggggctttagactggttggcagcagagctgccgagcctctgggaagagccatgagattctgagctggaatcttctcttcgtgggaagtgaagtttttttgacactcctcctcccccatgtgaaagccgcgacatttctgaggccaacaaatgagacatttcccagttccagttgccttacaatcttgtatcttacagaaaaaaccttgggttgaagaggaataagaaaaggaaagtgtagcagaacccaagctgtgttttctgctttttaataacttcattccatttaacttaaacagttcagtgtaccaagggcggggccttgtgctcgccagaagctgacaggaagaaaacagccgtgtgaaggtgcagcctctgtcctcgagaagcaagcctcattcactctcatcccatgtcattaagggaaggatagagcaatttggaaaaatgcttttaatgtaattgaaaaatgcagattgcaaaattggcgcacttaggagtcgagacagtctagtaaattatttcttgttgcttttaaaactcggagacagtagactcttaaaggtgcttgtctaatgcccagtgatggcctgtgtccaaatgagttgttttagatttaatttgttttatcataaaagtggtaaaattttgggaaaaaatgcaagaaaatggcagaaattaaaagataaaccatagacccttcattcaagcctaatgaccatgaacattttgcaagcagcgtttccttctagtcttttttccctacatatatcaactagttttaatcatatggtaggtactttgtttttgtagcctgcatttaaaatcatagggtggtcatttctcccccagattgttagtattatttcctcttaagagaagggttaggtaagtcattccaaccttttaaggtttccttctagcttctgctgtttcttgtcaggtgttttcttttgtctattctcccagatgaacacagctctcatgcggacccctcatatactggggggagtggagcaagccgggggacagaagccctgaggggcagtcagaaggtacatgtgagtgagaccaactgtgtcagcccaggatagctggaagcctgccttcacctggcctcccctctggcaggcttcctgaagtttcctgaacttggcagaggacagcgtaccttgatcttctacgtggaatactgtgatactggctgaaatgcagggaggaccagaagggctttagaaacctacaaccaaagcggccctagaactctgctttgccagggcttgtggggctgttccaggcctgcctttcctcgccaggattggggcactggggagctcggcccccccatagaacgagggccatacagagatgagcggcaccctctggggctgctgctgctgaaggtcgttgactttgcaactctgattgcttgggcatcctggatgtccctggattgagcgtctcggtttctcctctttatttcttggcctttctgttttatttttctggggaatttcttccactttatctatctttcaatgctttttttgaatttgtatttctgctgtcataaactttcaaattgaagaataatatatattcagggaagtgttctgtcatgtttttacattccaagagctgtttcttattttctgaatgttcctttttttaatatagcatattgttttttattgtatatttacaaggtcttttcttagctctttgagttctttgaaagttttcctgttttctgaaatgtttgtctctttcttatctcctttggtctttttttgttttggtgtctgtgttccatgttagagatttcctgctgctcattccaattagggagggaggacctaaaaagctgacctgaccaaaagctgtgtgtgtgtgtgtgtgtgtgtgtgtgtgtgtgtgcatgcacacgcccttgtgtgggggcaaagggactttgtttgcagcgggccggatgtagggttatgaggcagcaggctggcgctcatcataggaacccacttgtgattatttttatgtatttccttgagcctggtcagcttctcagggaggtgtcttctctgggtgggctcttggcctgctgccagccttccggcatctgagctggggaagagggtcaaggtctctgtgtttagtgtgcagactgcactctccatcctgtcctccagcttggttttctcactgtccggcacatcttttcccaccagtgtgcagatctgtgccgctctttttgggggctgtgtagcgctcagtgtctgacacacaccatcatttatgcgtaaaagtggctgcgtcttctcaccctccacagcggcagaattattaccttttgaaaatgtctgctaatttaatggtgtcttgtttgagaaccaagtgagttcatttacgtacagctcttttagaacgggccggcacttcgttcattctaaacaagcatttgttatcctgattcttgtccattcatctcctgtagtcttagcgtttctcttatctgggcaatttacgtacttacaatattgacctttcatcatattttaccctcttcccccccagggtgttgtgtgatgttgagttttggtatttcatgtatttttttttaacagagaaaacctgacatttttcgctgtcaagtctctggccctttccctttgtaattgtccatggctctagagcatggcatgtcctcccccaccctgagatctgataaatcgtcacctatatttgaccttcatctagtagtgattagcttgagccagtttcaattctcgtcagtgggtccgaggcaggccctgcgccaccatgatgaatgtgtgcgtggtgccagggatcgatgggcatattaaggagcagcgccgcggtccccggcagccagcttcgtgatgctcccccacactgacgctggctattcatgatttaaaatgaccttcttcccatccggcttattccgcagggcatgggtacgccacagcttcctcaacctttcctcaaaaaagaaatgttgtttttgaccataaaagaaatgcaatctggaaagaacagaaaggtataaagaagaaacaaattgcccattttctctccacccagaggcaatgactgcagactttttggtatattttcatccagccttaaaaaaaaaaaaagattcaacatagttgagctccaactatacatctaatttaaacccttctttccctccacatactgcagtagcagtttttaatgctgtaatttattgctttggtttttagtgtggtctccaaatccctggggggcctcaagaccctttcagggggtcaaaactattttcataataatacctaggagttatttgccttttccattctccttctctcctgagtgtacatggagttttccagaggctatgaggcgtgtgcttttgcagtggattaaatacagacgcagctttgagaacccagctgtcttgtattaagccagacattaatgagatctgcaaaaatgtaaacaatgccttcttactaatttttcttggtcttggaaaatagagttatttttataagaatgtgctatttctgttaacatgtggggggtttgttactgttacttttacataaattaataaatattttaaaatgtcctcagttttcacttctaatacgcgaagtacccatagctataatccgaaaaaacaacagctctttggggtcctcagtcattttagacagtgtaattgaggaccacagttttctttacatctgtaattacattttggggaatctcactattgtgttggtaaaaacgtcagcacatcctagttctgggataagtgagtgggttcttttccagccacgtctctgtcttcttctgcttggttagctctccaaactgtgtgatgaaaacgtgatcccaggggtccaagcctctgtcaccctcttgccccttctcctctgcccttcctttggccctttgtggagatgactcagcagcattacaaaaccataagcaaaatccaccaactcgaccatacactgaaattatcattatcctttgaacaccctcccatccatttctggtccatacgggctgtgtttgtcagagtgtgcgtgcagctctgcagcctgtctttccatttaacattctctcccagccctgcccgcgccacactgtgccaccagccgcctctgcgtctttggagggccgtcaattttcactggttccatgacgctctatcgagttgattaactgtaatttacttagccgcccttggacacttaggtggtttctaatttttgctattatatagataatgctgaagtggttatcttcatgcatgaaacccttttctgttggattatttctttcggattgattcccagaagtgggactgctgggtcaaagggttgtacattttcatgggtccagatacgtctcttgtcagattgctttccaaaaggattataccaatttgcactgccaccgcaaagcttgcggtgttggtaataaccaactattttgcttaactatcatgcctagaattttcccttgaagccccaagggggcaaaggcccttatctaagtgaatgtgatctgtaattatttagactaacaccaaaattgctttcagaacattcttaacctgctgagtttagaattctaatttgaatacatgctagcattaaaagtttcacaagtagcaatttctctctccctactcacagtgtatttacacagcctgacaactgtagggaaaatgaaagagattttataaacagaagtgctctctttctgaactagttgaaatgttattttgaaaggtacaaaaacacaaattaaaacagattttcattgtcacctttgcttagaaaagttgtttgttttcgtcctgggcttcttttcatgttcttttctctcattcaagtgtgttctgatatggttctgatacggttccggtacctgggtgtcctgctgtgttgctgttagcccgggggcggaggattggtggctgtcatcaggtgctggcagggctgctgtgggaggggaacgaggtgtattcgggtttgctcccagggcagaagtaggacagatggtggaaggtgtgtctgtggggggaagaggtcagcacatggtgaagaactttccggtgctcagagctgggcaactcgggcagtagactacttggaaagggagcgagggctgttttgcctggaggggtgtagtgcaggttggagcccatgttgctggagggctgggaagtagatgcaggcattgggtcagccactcagaccttgggctccaaggccgttaatggcttgagtgtcctgtggtcagggccaagatggtggctgtgagctgctctgccctgaaatactgcactttactgcacttggggccccgcctgagtggagcacagcgctccacacactgcgtattcaaaagagagtcaggcacattcctcctctaatttctctgagcttcagcattctcatctgtgaaataattatctcacagggctgtgaggatcagaggaggttagatgtgtgaaaccactctgtaaacgataacgctcttacaaatggaaggtattatcaagaactccaagccggggtttattctgtgattgcctcctaagccgtgttcctaagggtgtgaggcttgcaatccactttgcctccagttgccttgattcgttgatcaaataatccggtgcgcacccagtgaccccagcagactcttgaggagctcaggtccctctaggtgtggcttcttgtcttccagtccagcagtgtgacatggctggcagtggttgaggtggtggacttgggggatggctcagctgatgggccttgtgacgtctccatgagccaggcttctggacttgctgctgtgtggcctgtgaattcctcgggccttgctttatgctgtctctgctgtgagcagagaaagcactcagtggcagtgtcagcagggctgttcctcacttctttcttcatttggtcatctgtatggctgtccagccatcagttaaattctggctctttgccaggccctgggatcagaggggaccagacccactcttgctggtaaaaggtgaatgaggcacagacatcaaagcagacttgagagggatgatgagaaaggccctccagggctatctgtgctgggaacaggaatatatgggagagtgtgctaggtctgtcagtgctggaggcagaggacaagaaaagcctcagggaaggggaaggacgagttgggtcttagaagatgaggagccaggatttcggggccagcctggacaaaatagggaggcctatctccacaaaaaattaaaaaattggctgggtgtggtggcacatgcctgtagtcccagctacttgggaggctgaggcgggaggattgcttgagcccaggaggttaaggccacagtgagccatgattgtgccactgcactcaagcctgtatctcaaaaaaaaacaacaacaatgaaatcgatgaggggcagccaggtgggtggggaggacagccctgtactgtgcatgctgtggggcggggacagtgaggacggccaggtgaagtgcttgggctggtcatcagctttagccctggatggtcagtggcccaaggccagatggcgcttcctgtacttgtgctgggtcaggcaccacacaggggtttacatctcatttgccctcagctgggtaatcatcagagctcagggagtcttatttcggtgttcagtcccagcccctgtgctttctgtgtggcttagggtaagttacttaactctctggaccttagtttccccatcgtaagtcaaggacaataacagcatccacctcagtcttctgaggattaaacaagagaacccacggcagactctcaggagagtaccaggcgtatggcaggcactccataatgcaagctggcagcagcatcagcatccgtatgccccctttacagatgacaaaactgaggaccagaggggcgtattgaaggacatgtagctcctaagcacggggctggcatttgaactcacctttgctgcctctgctttctgggattgttctagtcacttccctgcttgggggctccaaaagtgtagtcgtgtaactgtggcaaggcctttaatctttttgtgtcttaatgagctcgtctgtaaaatggcaggagctctgatataagttccatgagggcagggaatttgttttcttcccttgttttatctccagtttgaatgaatagcacctgctcagtcgaccatgctctttgtgggcctacttgaattttgggatgtagagaatcttggaggggtccaactgcactcccccacccacccctcacctccagtctgtgcaggaggcatccctgtggggattcgggattggttaaatgtcgccaggtttgtgaaagggctttggaaactttgctgggagctaaatcaaagtgatgattgttccacatctgtgaaatgttttttttttttttttttttttgagacggagtctcgctctgtcgcccaggttggagtgcagtggtgcaatctcggctcactgcaagctccgccttccgggttcatgacattctcctgcctcagcctcccgaggagctgggactacaggcgcccaccaccacgcccggctaattttttgtatttgtagtagagatggggtttcaccatgttagccaggatggtctcgatctcctgaccttgtgatccacctgcctcagcctcccaaagtgctgggattacaggcgtgaaccactgcgcccggccgaaatgtttgtatttacactgtcaggtaatggtcatgggcttgcagcttgtacatttgtttattatttatttataaatcttaaatccagaaaggacttgaggaagcctacaataaaagatacaaacacagtgaagctattaaagcaagacagaccatgaaaagccaccccaaaaggagaaggaagcctgtcaatcaagcgcagagctgactgctgttcccagctggtgccttgcgtcttgttctgtgtgctgtgttctcgcagacccaaggcaggtggcacaagtttgcccagttcttgctgtccaagagaagccaacacaagtggcctcacaaaggcatgtgggatggcaggacagtagtgctcagaggaaaggcagttagcttcttgtctcagctgcccagggaggagatgaagatcataggagaggccaggggaaatctctgtccgaatcaagctaaggagaggtcacatgttctttctagggtgggctgtggcagggccacaggtccctgggccagactgccagagttgttttgctcttttctgtgccttggtttctctcctgccaagtggctgtaacaatacctatctcacagacctgttgtgaggataaatgttgtggttttggccagggaccttgcaaagtgcttttgttaacctgacctgtatggtctgtgtttctcatggtgaatgttgtatttctcaaatggctcaagtccttcaactcaggtccccgagttcagaggagatgctgctggaggggtggcaaggtggggtctcccctcatgcccttggctctgtccatactgacgttgtcaagtgtgacctgtttgttattgcctaaaaacacttaacgagttcaaagcaaagggaacatactttttaattatttctctgcttgtctccagcaatgctgttgtcaaggaaaccaaaacctttggaaagcttttcagcttctcggtcggaagaggatacttgtacagtgcgtatattgtcggtggaaatggacctgtcgttctgtaacaaaatctgtttcttttaaaagggcttacttccttcacttcttacaaatggactctttttggccttttaacagaagatggaaagttgttactggtattttctcttttaaagaattgcctgcattcttgacatagtatttcattcattcaacatctgttgtgagacttgggtgctagggatgggagtgtgatacagagatgaatatagcctttctggaaaggctcctggctcattgaaagaaacaggtggacagatcattatagcgcagcatcatgactgctctgaagggtgttgggtaaggtgctctggggcataaagaacagcctgggaggggcagtgtcagcaagtcacaggagtcctagaggatgggtagccattgctcagcagcaaagcgatagaaaagcattccaggccaagggaacagagtgtgcaaaggcagggaggtgtacaagagcatgctgccatcagcaaactgcaaggtagctggacgaggctgggcattggatgcataaggcatgaggagcaagacaggctggagaaaactttttttgtttttgagacggagtcttgctctgtcgcctaggctggagtgcagtggtgtggtcttggctcactgcaacctctgcctcgcaggctcaagcaattctcctgcctcagcctcctgagtagctgggattacaggtgtgcaccaccacacctggctaatttttgtatttttggtagagacagagtttcaccatgttggccaggctatctccaactccttacctcaagtgatccacccgccttggcctcccaaagtgctgggattacaggcatgaaccaccacacccggcctggagaagacttctgatcaggagtggggagtgtgaagaggttgcaatacatgctcttcgaagtgcattccatttccgcctgacagagccttgcttcttgacatgcagaggcatgtcactccttttgttcttgcttcagagggaagggacactgctaacacgctggagtttaataatttacttttgctgcaggagtatggccttccttgtaatgtttcagccagcattccagtaaaattttatgatagttaagccctatcggagcattggttttatatgaaaaagataaatcattgttagaaaaacaggagtcttaacttttaaacaccccttgttatttttcttgtaaaactttaaaaaataatttcagatttatggaagagttataaaaataatacagagagttcctatgtacccttcacccaacttcttcgaatggtaacatcttgcataacctggtgcatttatcaaactaagaaattaacattggtacaactctgttaattaaactatggactttatttgcatttcaccaggttttccactaatgtcctttttccgtttcaggatccaatctaggatgccatattgcatttagagagctcttgctatttaataagtaatttgtttttttggggggtggactgggcagtaaggaatggactggagcttgtcctggccactaattttgagttccctgttctgagcaaaccctgcacatcctggctgatgtcccatatcaggagaccagagccttgaagctacagttaagctcgtactggatgtcttttggttttcaagacttgcttcctagttcaatcatgaacaagacaagcagaagatttgcaccttaatgaggcttaaagagcactcacttataaagtgccattagtgacttgtccttaatggtagctgtttagtgataacaggtttctcattccttttttcttttttttttcttccttttttcctccttctggatttaacccagccagccttttgggctaatgttgacattagctagaattcgaatttagactgcttaccacattgatgtttttacacaaccttcctgtggtttatcggataattgagtgtgtcttgaggcagtaactgagttgaaatgtgttgcatttaatgagtgaaactagagcatgctttgcataccgatagatgcacatctgtaggtgatttttccgacaaaagtcccagcctaggacgtttccttccattcctttcccttccttctcttgcatttccccccttttcctttctctctcatcctttctctcatgtctttttcggtacttttttcactatgctctcctttggccttgcacctggtcctgtctccgcctgccttttctcctttgcatttcctcctttccgtccccctgtgcccctctcgctctctcttgccaattcccatcttctatgcctttccctgcaacaggccagtgaagctgttgccacggaaacagaagcccagcagaagctctgttctgctttccggatgcttctaacgatgatgacgcagataatattgatttctagaatcagctaagccctggcctgtggcctctggagtcccttcattttccaaaggccaagctgatgccacagctcatcattctgttcagtagatggtcatttttgatttcaaaattgaaacttcaaaattttgagtaatctacttccctgtggctccagaagactgggtgcaaccatgtgaaaaagacttacttgaatttacttacattaactgagggaaaaataccagatgaggagggtacgggtgctgcaggttccaggaataacttaagttacacatgggagagggttagatgcatttgttgaattactgggctgaatgactgcttttaaaggacttgggggaaagagaagtacagttgaggccttaaaaaagatacttaattcaatgaatgttcagtgaggactggccatttctgagacatggggtcaggtgctgtggggcaccaggagtgtgaaaagcacatttcctcctctggaggagtggctttttaagtgacagagctggggcatgtgtgtcctgtaccgcagtgacattccttgatacttgtcatggtgatccagtgagtgcagctgttgtcagttctgccgtacaacccacatggctgcacattaactgggctttgtggtcccctcggagggctgttggcgcctggtcctcagtggagctggtttatgatggtggcagccttgctgcacctttccgggtttgactcaggcccagcttgttggcattagctaggatttggagttttgccattcagccagcaccagctaatagcccagcaaggaagagttagttcatggattatatttaagttagtacttattcccaaaggtaactttgtttaataaaaaccttaagcccttattactgtgcttctgggtatcctggctccagtgtgtaaaaataagacttataaaattcaaacattatttgtgaaaatgcaaaaacattttcattaatacagggcatgataaaaagcaaaaggcactttccatctgtggctaagtggtctttctgcactggggtctttttgttttcataatcactttgcgcttatttaaatattgccctttcagtcgtgaattttaaagggaggaagctttggtgtgtgaataactttacaactacccacagtatttccatccagttgctatgacttaagttgataatggaccccacacagtagtcactaatggatgataatctaggagtgtttttgttattgtttttattttagaagaaaggtttgaaattagcatagtaaatctctgtgggatctttgcaaataaaagaatgttcacgttaaaaacaattttcaagaaagatgtatggtaatgaataaaacatcagtgagtgaaaataagcgtgtttaattattcaagtagaagtagtaatttaaactaattattgcttgcggatttcataattcagtttttgtctcacaataatatttcctctgggcctccggggcgcgtcggcggctgctcgctgttcctggggcgggagagacctccccctccccgtggctgcagcctctgccccaccgagccagagccagagaggcccagtttctgcttctgccggcctcctcgtggtctcagtccacatctatcccccttgcactgcctcattaggcatttccttgcttatcaccttctctggttgattcgggcatctcagaccagttctgtccattgaggtctgagtgtcgtggaggctggtcccctgcctcctccccggtgtcttagacttccttggcaggggtggccctgagcaccctgcccatgtccccaggaggcaagtccttgccgttcagggctgcctcaggttggatcccctccaggaggctcccctgcctggggattgatcacttcttcctccccagtgctttgtaccagcaggttctggtggtagtaagagaattacagagagaatttgttggttgacatttttcttttttgggcttctttttactttgtttctgatcctaaaggaagaaaaacatattcatacagaggaatggaaaagtaccagagagcctgagaggcagtggggaggacacttcatcccctggaacttgcacctggcttctctgctcctgggtggctctgcacgtgtcttagttctgctcattctgtgtatgcaggcacttgccattttctctgtggaatttgagggcttggatgtgatttttagcatggacactttggaggggctcagttacattctccttggtgcacctcctggggtacaactggcattagcaggtgctgatgaaggagtaggaagtgctgcaaagcacttttgctcaatcgtgcgaggcttttaaaacccagttattactgctactcccatgaatgcccataatggcacaggaggttttctgaacctttctttattgcacaaatgctcctggaacagatcttgacaattcaggtgaattattattctacccctcagaaggtaaagggaaagctttctgtttgtaactttttcttcccaagtgtcctctgtcaaaaggtagtgacatcttctctcctgatatgtgacgtccattattacctcggtataatcataaagctcacacccaaaagctttccatccagcacgtcagagggacaatctttatttaagacacactcccccacttttctttgttattgctttctcctaaaaaaaaaaaacaaaaccaaaaaatcaaaaaattcccttggctttaaaggcatgatctgggctaggagtgactcgttcttttgcaaggttattgtcataggcaggaacaagacaggtgggacatgggggtggacagagtgatgcgctgtcagccaggggccaggggtccaaatggggttctgtcattttccagctgagccctcggcaggccaggcaatttctgggtgttggtttcctctcttggcaaacatagaggctcaactgtgttctctgaggcccttttaagctgagtagttttgtgatctccaaactaactgtagctaaatgaggtaatgagagaattacaggtgtcccccaaactcttcctgcagagtagttgaaatgagcattcatgattctgaatcggttttctctccctgtgagctccagaggaagtcattaagcagagaaattactaacacctcgtgaccaccgtggagcagagccaggggcacgaaataaaatgccatagggatgagacccgtgcagccagccagcacttagggagatctgctaggaggacacccttaggttgtcctcctgagggtccagccctctctgaggggttgacagctgagcttcattacgttcttgaccctgtctcgctgacctcagggcttctgtattagcagtgtccaacaaatggttgttggggtgaattaaattttctcttatggatagtgtcctatcctttctaccaagtaagcttcctctcggggaagagaccattcttctttatttctttgaaaactgattttttaagaatagaaatacaaattggtatttgatgtacagagaaaaatgagtcgtgctcccatgctctggatctggagaggccacatctggctcatctctggatcctagggagcatcagccttgccgtgggaagcaaagcgggcctgggctgccttgaattagaatgacctggctgcctttccaaccaaagcacatatggccaaatgttgggagagtgaattggaggcaaaagcctttggaattattgggatcgttgggactcctgggaaggaactgggcagatttgtgtttgagccatggctctttctaccctaggtctggggaaggtcctctgcttctcccccactgtttcttgtaaagtggtgctggcatgcttagcccgcagggctgttgtgtatggtcaggagatagcagccctgagtagtgcccagagcttagcacagatacagcaactctggttcctttgaagatggaaaatgaatatgtatcatttggcaatgataatgtaaaatcagtgtggaggtgtgattccattaatagattgctgatgaactcaactttttaggagcccgtttgttgcttagagtgaagctggctggaatgaggcagaattagaatgacaggcccactcttctaattgaaatgcacatgaagtgcttggccctcagacttccatcgagatgattgcagtgatcaatattccagtttgcttggctggcagcttccggggaataagaatggatgatggacccagggaaagtactgccaaacagagcattaagttaattcctgtttgcctgggttctggcctgcctgatgaagtgccttgagtagaatgaggcaatgttggtgtggactttatcatgggctgtacccagtatcacaagagctcaaggtggctgctccctgacattcacttttggtagcaattagaactcccatttgctgagatcctaccatgtgtccagcccagtgctgggccccatacgcacatgattggtccccctgaaacctctgaggtgccgatggcatgccccaacctgcgtccaaggacctggggctgagagggcctcagggcacggtgctgcaaggtgcggagctgggaatggagtccagggctgtttgctcccaaagtctatgttcgttccactctcccacgccagcccgtaagtgtaaagcagatgtttggaacctgggttctcattttcctgtagaatcagtgttattcatggcagtgagggcctggtctcaaaagctgggtttaccactgacagtgtcatttctcatgtggttttcaccttgaccttaccaccatgggaggcagagcgcacacccctctggtgttcctggctgggaaacaggggcccctacctgtgggctgcgtgggccaggagggtcagcaggcccttgggggaagtgcaaatgcatccttatctctgtagtgcttcctcccaggcatagggtccgctggaggcctggcgttcccatggggctcactgtgtgtgcaaatgttctgtcccagttcagtctgctgactgggagatgctgacctgactctgtttctctagggccatgatcctgactctgaaatgccaagtatacacccctccctcctcctgcctgcattctccttctgctgttacatgggggcatgcacccctctcccctgcagctctggcctctgctgggcccatccctcctgtgagtgacatggttattccttgtatcattgtctgaacttggcactggtgtgtttgggcccttcctcttaaccctcctaccttgtgtccccatgctagttctgtctttcctgtgctcgcagaatctgtctgtcctcttgcccccacctcagaggcttcttccagtctcaccccctcattctcagaattgaattttttatctgtggaaggtggcagctggcagccaaaccaggagcctaagtcttgggcaaagcttcaacaaggatgctgagctcaggggcctaggaatcctctctctgccccatcttttttttttgagatggagttttgctcttgttacccaggctggagtgcaatggtatgatctcagctcaccgcagcctctgcctcccgggttcaaaggattctcctgcctcagcctcctgagtagctgggattacaggcatgcaccaccacgcctggctaattttgtatttttagtagagacggggtttgtccatgtaggccaggctggtctccaactcccgacctcaggtgatccacccgcctcagcctcccaaagtgctgggattacaggcatgagccaccatgcctggcctctctgccccatcttataggcaccctggggcctaggatggggctggggtgcaggggatggggagggaggctgggccccctggaggatcagtaactctgttatatgtcttcactataatctcattttgggctgcactctgcttttgtttttgtttgggagcctgcttggaggccagcactaacagaaacatgcaagggcagaagcagagctggccatcgggaggtgggtggcctgcagggcctagctctgtggcgcatggattggtgtgtcagtcgcccttcctggcagcagctctcagtgattaggcttggaggagccttggctttaagttctctttggggaagggcggatattagtgcttaagaaacgccactcccgaggaaacccacctggatgtttttctctgtaactggccatttggagacagggccaggctgtgcataggcttttgagtttctcaggtgcctacatggggctcaaaatgatgatgcaatcaatccgtttcttgacttttgggcctgggtccagctcagaatggaggtgtgctccatgggcttgccttcggagaagatggttagcagggctgtgggaagggatgtgtggtggacagaggtacaggctccccaaggcttagaggcttcagaagcccatgtcaggcacgtggggcccaggttcaaagcagaggatggagaagggagggttaaagccttccttctgacgttgatatgtgtgtctcagcactgggacctggagcagtcggcttcggaggcccgttggactgttgaatattgatggtgtgggtttggctgaggagcataggcaggtgtgtttgccattcttatgtactcaggaggggtatgaagggcaagtcagtggcacaattcaagcaaagtgctgctgttactcgagcatttgctgtgtgccaggatcttcacacggacagcctcagttttcataggagtcacttttaggcattttatctccattttgcagttgaagcaattgatacttaagatggtagtatctttgtttagtgtgaagagccaggaattgagtggggaatgcccttatggcagcaagacagtggcaccaagtcctgcctaggtggcttgtccaatgatcagagtccaaggccacattgctaccaagtggcagagctggaatcagcgctactcagcctcacacattttgctccctgtgcctcttcagaacttcggcctgtcacatgtgtgcagctgtgggagcccagattgtgagttgatcaaggtcagggccacaccctgcacttcctgcctgacacagagtaggtgctggacagacatttgtgttgtgaaagagtgagtgagtgaatgaaagacacaccatggggatagaaaaataaggggcaggccccagggcggttggcagatgtgaaatgtggtttaaagacttggcagtaaatctgtggctaggccccccttctcctttcattcccttcttccttccttcttgggattcagaattgctctctgggcagagggctgcggagcaggagcgaggctgcaggtgtgagaaggaccccgccgtgccagggcagcctcaaggagctgttgagcgagttgagcccagaagacaaaggtcgctgaagtccttccaggagaagaagatcaatgcctgggctgagcctgcggttaacatcttaatagtaaccggagagtttctgagagattaggtgatgatatatactcagagctcagacagttaatttgcattgtgtcctatattcctgaaaagttgctttcagattcttattgatgtgctcacattttttggggtaattgtcctcctttgacattaataacccccctgtttactctcaggctcacatacctctcagagtccaggaggcagtgagggaaagcttttaattcaaagccctatccatcttcccaactcaggtgagatggggactagaaagtcggtctggctgaagctaagtgaggccagccttctgggtgttgggtatcaggttctggacggggctggcagttgtgtgtggggctcatggatggttttaggcccttctgccccctttgtcagtgtgcccttgtgggaagccggtgcgtttccaggggagctgctggaggcttcttatggcatgcagatcaaggaagacctgtagactacatgcaccctggcgctctgggtatgttgtttctgcaggtttgggaggcagctgtcctccaaagcatacaattactaagaacagggaccatagtttcacacttcagtgcctaaacaggccctgacacccagtttggctaggttgagtctgggtgccagagattagagctgggattggagatgtagcccgtccccgttcaggagcctctcacgtgtattgcctctcacgtgtattgtctgtgagtgtgctgggctcccagacacatatgtcacagtgagctgtgggaatgacccttgactcctatcctgatgggagtgggagagggtgcaagaactggccctggagacaggggaggggttgtgagagccagagcacagatgcctgcacaccaggcactgggggcgggggttgggatggagagtgtggtgatggtaatggcctatagtcgtgggggcttggggacttctgagggatgtgggtaaatctggagtttttcctataggaacggggagccatggaacgtgcgtgaagcggtgtgtaaaactggagagaaaaaccctaaggagacctcatcggacgttcctgtgataatctaggcctcaggacaggcagactgggatgcttgtgttacccctaactttagattactctcccactgctcccctccttcactgtagattcccacaatttcagtatcaatgtaattacaatttaggggcttagaaactcctgtatttattgagaacccacttaatttacatatattgagtttcaatattgcacaactctgtgtggaggggttagggtggaggagacctgagatgacagaaggccatgttctctagggatggtctgcagccctcagtgctgtctcttttccctccagcgccccctctgtgcccccctccaatccctgctccccccagtctctatagctgaaggctaggacgaactgtggggttgtgaatatttacgcaggcaggcataggactcagtgacgcagctgagagccacgcaagtgtttggtgactcatcagaccttctccaaagacttgtgatatttttctcctctgaagggccgaaagcaatttgcagttaatgatagtatatgacgccagaagagtacgcagaccttccggctcatcttttctgtgccttgggtgttttgtttttgaaaaaacctatgtgaattattttccctttagtaatgtttattttattctgattattaaaataatgtatgctcattgtagaaaatacataaatgcattaaataggaaataaaatgcatgaattatttttccattacagtgttattaggaatgttttgcctgtgcaaaggagatgtggagcgctagacttattttatttgaggtgcttgtcgagataactgagatcagtgggttgcagcctgtgctctggggactccaagggcttcatagaaatttctagaggctgcctccagggtgggggatctggggagcttgagactcactcccaggttcctccctccaaacaactctgccgttttctgtctcatgactgggccttctcacagggctgcctttgagcttatcaaattggagacccagtgatccggctccagcctctcattttacaagtgaggagttgcaggccactggttaagcgtgtctggcgcaaggtgatgtggtagcttagggctggtcttcatgcgttgtaggcctgcattgccttttagtatatgaatcagttaggaatattggcattttaactttaatgccattgtcacaagctatgtcaccatgcagaggacccccccccacccatcccaggaagctgatcgagggtctttaaagggctctcttttgagggaaggggacacctcagagcacctggcacttgaaaagatgaaaagtaagagccccatcattgctgttaggcacacaaaggaggagaaattgctgtgggtgatccctggttgtatgaatattgagaagaaattaagtaaaggctgtgtttcctgacactgatgtattagaacatggagtaactttctacaggaaattggaacagggatccctttaaattgaatttgaagctgtgaatagcaaacctgcacttggccctgtgtgtcctaatgcaagttaagtaagcagtttcctgggtgagagttaagtactttagggatatgggttaatgttgaggccaatgtggctcaagttaataaattgcctctcgcgtgtattgtctgtgaagatgcagaagagtaatttgcttcctgcagagctgctccagaattctcatacttagtttattagatttttggcccaatacattttttccctctcattggttttgttgataataattactcacccccttccatctctctatggatttctcttggttttaattgttttcagtagccacaaaagtttaccatttcagaaaataagtgttttaaaataagaatagtcttggccaaaccccatctgagtttccagagggagacagtcaaagctctattgttaaagtgattctgggggcagtggccactgagattaggaaaaagccagcgctcccttcgtcaaacacgtcagtgctcgtccctggcctagggagctctctgggaactggcttcctgaggtttttacatatgctctggaatctggagtgagggtgtatgcgtcaagggcctcccagggagacggtggaggatacagaggaccggctcccccatgctgctggtgtttagttcttgaccctgtgggctcagggggtggagagaacatcgagaattgtacccaccactaggcaccatgtgaggggccagcaatacctagctcacagtctaataaatcagttaattaacagggtaattataagttgcacagtggtatttcctgggaaatggagaaaaatggctgggtgggtaggggagaagacagcatgcaagctgaggttggaagcctgaggaagacatgggtccgtccttgcacggaggacagcccgtgccgaggctgagaagagcttggtgtgtggcaggaggtggaatgcaaggcaagatttgtcttcagattattccttataaagagagtgttcactttatacttgggtcttttagaattttcttaaactacaggacactcacttttggatgcgaagtttaagcagatttttttttttttttttttgatacagagtctcacgctgtcgcccacactggagtgcagtggtgcaatcatggctcactgcagtctctacctcctgggctcaagcgatcctcctaccttagcctcctgagtagctgggactacaggtgtgcaccaccacgcctggctaatttttgtatttttggtagcaatggagtctcgtcatgttgcccaggctggtgtggaactcctgagctcaagcaatccgcccgcctcagcctcccaaagtactgggattataggtgtgagccaccctgcctggcaaagcagatcttttgatactttgtccagaacataattggtttcaaatatttacccatcacacatttaaatagtctctggtaagccatttaatggtagatccattcctgaaggccatgttgctttgtgctaggctcagaccccagcttcctagctctgtgatgctgggcaagcaaccccaaggtgcctctgtttccccatgtgtaaaacagagaaaatagtacagagggtctcatgctcttgggtcacaattcccttagtgccactgtcacatttttcacagcactcctaggccaaaacaaacaacttaattaacagtcctgtttactaaggagtgaggaccaaacaacttaaatacttatgttgtaacaacacctgttggttctcaaacattggaagtaggttggatgctgccaccctcatggtctgttccacattgattttcacttgctttttgcttttttttttttttctcgagatagagtcttgctctgtcacccaggctggagtgcaatggtgcagtcttggctcactgcaactgctgcctcccaggttcaagccattctcctacctcagcctccctagtagctgggactacaggcacccgccaccacacccagcaaatttttgtatttttagtaagacaaggtttcaccgtgttggccaggctggtctcaaactccggacctcaggtgatccactcaccttggcctcccaaagtgttgggattacaggtgtgagccaccatgccctgcctggtttttgctttttatcacggcaactattgaaaactcagctttgcagagatatgatgtcatctaaagaaatgcaaaaagatctaatgttgaatgtaatgttgaaacctcagctagcagtctgcatgttgtctagcagatattgctgtttcccttaaaatggtaaaatatcccagcctgggcaacatgggtgaaaccccatctctacaaaaaatagaaaaaatttgcctggtgtggttgtgggctcctgtagtctcagttactcaggaggctgaggtgggaggatcactcgagtccaggagttcaaggctgcagtgagccttgattttgccatcgcactccagcctgggtgacagagtgagaccctgtctcaaaaaaaaaaaaaaaaaaaaaggtaaactatcccttggtgcgttattcgggaactgtggtgatagtattgacgtgtttggtttagtgaagatgaaggaaatggtgcacggaaagtgctgagggcagtgctcggtattaggtgctcaggaatcattgttgccctcaatctcaagggttccctttagtagacctagaaacgtgtctttaggagtggtgaaaacacggctcttggagacgtctagggagaggtgcatttagttgcttcatgagatgacagtggaaatatacagtctttctgtgttttgtagtaagtgattgtaagtatgcatgtgcgtctacgttaataagttaaacacaaatacagacatccagttgtttcttcaacgtctctacatgtatatgtgtttaggtatttgtctctaacctttcagttgtgtttttaatcttcttgttgggaaaatgggtaatgtctctgtggtttgccttatatttgggatattagcaaaggggagagtgttttgagatggggttgatgccacaggcaggccagatcacgaaaggccctggtaggacacaataagccttaaggttttattcagaatgaaatggaaagctgctgaatggttttgttgttgtcgtttttgagacagtcttgctctgttgcccaggctggagtacagtggcgcgatcttggctcactgcaacctccacctcctgagttcaagtgaatctcctgcctcagcttcccaagtagctgggattacaggcacccaccaccaggcctggctaatttttgtatttttggtagagacggagtttcaccattttggccaggctggtcccagactcctaacctcaagtgatccacctgccttggcctcccaaagttctgggattacaggcatgagtcaccacaactggcctgaatgtttttaatttttaaaaaggtaaattaactctatggagatataacttaacaataaaatgcagccctgtaagtacactgtcagatgagttttgacaaacctgtatacttatgcaaccatcgctccaatcaaggcacagaacctttcccctgacccacagtgttctgggtatcctttatcagcccatctgttagttccacccccaacctcagccccaggcagccacagatctgcttctctcattgtaggttggtacaaaagtaattgcggtttttgccattacttttttttttttttttgagacggagtctcgctctgtcgcccaggctggagtgcagtgccacgatctcggctcactgcgacctccgcctcccgggttcacgccattctcctgcctcagcctcccgagtagctgggactacaggcgcccaccaccacgcccggctaattttttgtatttttagtagagatggggtttcaccgtgttagccaggatggtctcgatctcctgacctcgtgatccacccacctcggcctcccaaagtgttgggattacaggcgtgagccaccgcgcccggccttgccattactttgaatggcaaaaaccgcaattacttttgcaccaacccaatagtttttcctgttctagaatgaaatatgtaaatggaatcatgcagggcgtagcctttagtgtctgacttctttcacttaacagaatgtttttgagattcatccacgttcagccatttatccctttttattgctgagtagtattccattgcatgaaaataccagaatttgtttatccattcttctgttgatggacacatttgatttgtttctagtgagccgttagaggtagttcatttttttttttttttgagatagagtctcactctgtcactcaggcttgagtgcagtggtgcaatcttggctcactgcaatctctgcctcctgggttcaagtgattcttctgcctccgcctccctagtagctgggactacaggcgtgcaccaccacgcctggctaatatttttgtatttttagtagagacgaggtctcactatgttggccaggctcgtcttgaactcctgacctcgtgatccgcctgccttggcctcccaaagtgctagtgctaggattacaggcatgagccaccgcgcccagcctagaggtagttctttttttttttttttttttgagacagtcttgctctgtcacccaggctggagtgcagtggtgcaatctcggctcactgcagcctccgcctcccaggctcaagcaattctcctgtctcagcctcccgagtagctgggattatagacgtatgccaccatgcccggctaatttttgtatttttagtagagatagggtttccccatgttggccaggctggtctcgaactcctgacctcaggtaatctgcccgccttggcctcccaaagtgctggaattacaggcatgagccaccgcacccggccgcctagaggtagttcttaaatgaatgttggtgtggactggacatgttttcatctctcttaggtacatatttgggagtggaactgcaggctcatatggtaattgtgtattcagctttgtaagaaaccacctgctttgagcaacgaggtgacaccatcttatttacatctttaaaagttccctttattgaggctgaggcaggagaatcgcgtgaacccgggaggcggagcttgcagtgagccgagatcgcgccactgcactccagcctgggtgacagagcaagactccatctcaaaaaaaaaaaaaagaagaaaaaaaggtccctttatttctagatggagaataggtcacgaggggctggggtgagagcagggggagcagcaagggggcagaggcagctgtcaggtgagcaaggccagtgcttgctgaggatgatggggacagtgaaggggctagctctcacggatggttggggacaggatgactgaagcttggtgatgaactggatgatgttgggagtcaaagatgatttcaggttttggcttaagctactaaggatgagatggtgctactcatggaaaagagaagacccaggaagctttgagcatgttaacttaatttctctgaggctcacttctattctgtccagcaagacaggcaaagaaatattagttttatttctaaactaaccagagaaggggaggaaatggctcagatgggcaataggcagtctaaagtcatatgtgtatgggaggtacgtaggcatgctggtcgtatgtgcacagtacctgcacaattctccatgggtctgtcatatttctgcacagtcttctgagcaagccacgaacagctgatttgctctggcctgtcttttcaaggatgtttgaatagcaagcagccttggagagtagagacagcatctctatctggaacagatttatttttattccaggataacaaagacaatgtctcccttaggagcagaggttgggcaggtttaccagcagctgcttatataagattggggcatcctaatgtcaggactcctctctgtaatgcatcccactgtgtgtacaggtaacaccttgccttcatgggatcgctatgggaactggggcttagggaactggtgcagcagtgttaccctggctactactactgctgtgagtaataaactgttttcagtctctgacccagggatctcatgccttctgctagtatgtatgaagctgtggcaggctaacttggtagtttgctagcagagtactgtctcaaagcccacacagttcatgacagtgcctctggttgccaagcacgattggcacagctggtgtcctccctgctctgccgctgtccttcttttcttctgcatctctgtcagtgcactgccacctgaatctttactgagcacctagtaggtgtcaggtccaggggcagcagatagagtgggaagccagatatggttctagccctcacagagcacgtgtcattcagcctctgctgtccaatcagccactgagttgtgacttctctacttagaggtagttctttatcaaattcatctcattcctcgctgccgtttggtttctccctgtgaagggtattcattttcatggttgttttaagagtaagaggcagtacaagggaagtgcctggtatagttcctggtaatcgtagatgcccaaattgtgactactgctgttgtaatttctattattacgtattctcaactctgattgtcattccttgatgtaaaaactttgctgtttgccctcatactacaatacaggttgcagcccaaacagtacgggatgcaaaccaacccatgtcaccggcccattcaccctgccccgatttctgttcctatcacaaactgcctgctgtgtgccttgaattctttccagctctttcccaaacatgacacacccttttaggccttttccctttccttccttcttttcaggcaaagtcttccttatccccctggacttggctcaagggtccccttctctctgtacccattccttgaggttgcctttctcccttgtctccagactgcataaatggcagtgtggcctgtgttgctgtagcaccatgtgcacctgggctgtgccccggcagtgttctgtctttgggctcactggggagggagcactggaccatcgtccccagatgcccagggagaagcttggtgctcgttactgactgtagggtacttttctgtagcaggcacttggggctcacttatgggacccagtaacttcacagtcatgaggtacttgatttgaactgaggagaaaatgtgtcaatacctttcccagggagagtcaccctcacaaaccttggtctggaaggcccatcttagcccaggggtgagatcttgcgtggatgattcagaagtcacagtattcctgaaaactagtgactcaacagaattatatggctttgggagaaagagtccctccaggggcaatccaactaccacaggccaggggccaagctttggtgagccgagcctgggccctgcccctcccttctctatgggcctagggttgctgtgctgtgtgtggcatggccagagtcctccgctcatctcctcaccatctgttacttgtgcgtgtctcctgtgccaggcctggtgctgacactagctcagggagagaggcagccgtacctggaggagctgcttagtaggacacttggcacatgccacatgctttgcagacttctcagtctcccagccactcagggatttgtgggactgagtatctcagatccaaggtggtcaggcgagggtgcagggagatggagccatgtgtggggccaggctctttcccatgacctaggtgccccttccaacccccaccatcctgttaagaccctgagcagccaggctggttgctccagccactcttccctggtggctcccctttccagttctgaggctactgcgagtcaccttcctcctccagggagggagagagctgcctgagcattacctctgcttgcggatgggggtgctagagaccgagccttttccttgttgtctctgccagtgaggctctggagagtgagtcaggaatacagctgcacaaatcgcccttactttgatactgtgtgattggtctgcaagacagacacagggctgacatcgcattttctgcctgacttcttcctggctgcagtgaccctgagctgttcctagccttccatcgtttctgttgtggacaggcgtgtcatgctgcccctgttcctcctgccctggcctggctacttaggctcttgtgcatgtgctcataggttctcatgaaggttgttcttagtttgcttatgtcttttttttttttttgagacggaggctcgctctgtcgcccaggctggagtgcagtggcaccatctcagctcactgtaacctctgcctcctgggttcaagcaattctcttgcttcagcctcctgagtagctgggattacaggcaccaaccaccacgcctggctaatttttgtacttttagtagagatgtggtttcaccatgttgatcagactggtttcgaactcctgacctcgtgatccacaccccccactcagcctcccaaagtgctgggataacaggcatgagccactgtgccctgccttcttacgtcttatatccacactgcctgtgattttgtacatgatacacacaatgtcacctagcactggcctttctgactttcatgcaactattgaaagtgaaaaatttggccgggcaccgtggctcatgcctgtaatcccagcactttgggaggccgaggtgggcggatcacgaggtcaagagatggagaccatcctggccaacacggtgaaaccccttctctactaaaaatacaaaaattagctgggcgtggtggtgcacacctgtacaagtcccagctacttttgggaggctgaggcaggagaattgcttgaacccgggaggtagaggttgcagtgagccaagattgtgccactgcactctagcctggcgactgagcgagactccgtctcaaaaaaaaaaaaaaggtgaaaaatttgcacaacagcacagtagtgcagcctgccagtctcagccacaacggtcagggtctatgctaaggtgagtttatgggacatccctgggagtttggggtggcggtggcgggggggggtcctactcacgccacacctactccgggagggacctggcattggactcaggttgccaggcaggggtgtggagtggtccctacacccacaattcctgtgactcccattgtctcacctgagaccctggccttgaaatgatgggctctaagtaagttctatttctaggccgggcgtggtggctcacgcctgtaatcctagcactttgggagtccaaggtgggcgatcacctgatgtcaggagtttgagaccagtctggcgaacatggggaaaccccatctctactaaaaatacaaaaaaaattagctaggtgtggtggtgcacacctgtaatcacagctacttgggaggctgaggcaggacaattgcttgaactctggaggcggagattgcagtgagccgagatcacgccactgcactccagcctgggcgacagaacaagactccatcacaaaaaaaaaaaaaaaaaaaatttatttcccgtctccacaggggtctctctgcggcttcctggggcctcgctccttccgcctacctctttcttccttctcctgctgtctaccctgtgatgtgatagctttctcggggagtgttcagatgaacagtgtttagaattgttgaatgctctgttggaaaacagaaaaggctatttcatgagcagatgatgaccttattaactataattaggcaattcacagaggcttccaatatagtccagcatcttttcttgttgagatggggggaaaattctatggtaatgtctttggagatgtaatagtctttatcacattactagtttaaattattctagaagttttggcagcctggtgttttcatttagaaagccgaggtatagttttacagttagccacattaatataataattataattttgagcaagtaatttcagacactgacatcaagagttgtttttatagcagagaaagatcacaggtaggaaggtggaacctcgcgtctaatctatctaatctgtcacaaataggatgatgttgtgaacacaggcagttcatgcccctggcccatgctttatattatgggacagagatgcaaatgcttagaaactccccctgtattaaatccccagagaacacgcacatttgaaattaatgggaaattgtcttttctaaagaatttggtatgcaggggcacatgatgtggaatttcccctgggttctttgtatcaggttgccccattgccttgggcttgtgtgagagtggacctgggagtgaacgggtgctcgcagggcccacctggtggtcagtctgtaactgtggctatgagcagcctcccaccctgtaggcccctcacaaggcctagttgcctggatctccaggggcatctggaagcctggaagctactgtctcctgggcaaggaggccttcactgcctccacagcccccatctgcacatgggccgcaggccctggcaaccccttcccccacttccctccactggcttggacctccaggcccacagcaagtaacttttggtttgtgttttacctttcacttgtaagcacattttttttttatcgttctatagggatttttcatatatcattttggatcctgtttttaaagctcagtatccctgtttttacagccttcaggatagtcatcttctatcatgtggttgtaccacaatttgctagttgtatccctgttgctgaacattgagctttttattccagcaggttttttattgttgttttataggcagtgctgcagtgatcatctttatgtacataatatttagcttctgtgcagttagtttcttagactctattgctagggttggaattgctagccaagactaagaataactttttaaaaatatattaaaatcttcttatagtaataatatttgaagaacagaaaaaggtagaaaaaggaaaataaagatgcccagctgtcccatgatgtggtgttcaccactgtattagctaggagtgtatgaggctgcagataacaggaaacccaactcgagtggcttcaacaggtggagagagactcgtttgtctcagggaacaggagacttgagagagagtccagggctggacccaggtgaagccatgctgtgagcgaccctggctgtttgcatctttctgtcccactgtcctggatgttgctggcctttgtctatgctatgctttcctcatctcagtcttcctttcttacctctggctggatgagtctttttatttctgtctgctgaaacagtgtatctcctgcatttgggtcattataagaagaaatatgattatttttcctgcatgtccctcgtctgcaactgcctgtgtttgtgacattccattcggccaaaactggaattttaacagtgtccagacagagaagaggaagagtaggcatcaggactaggaaagagctcctctttcttattaatgggatagtctttcatccctgtgtttcaagttcacagagtcccttgggttagaaaatatcctttgctctctccttgattcctatgaaccagagaaggggacagaatcttcctgggcttattggtcccccagtcagtcttgcaaagggaggtttattgagcacttaccatatgcagcagggggttgtgagccacagtcgtggcctttgggaagctcacagaagaggggaggaagcaggctgacttacccctgccctatcacactgttacccttgtgtcaaccaagcttaaccttggctgagtagaaatgagtgatttgtgacctatgttaatcctacagaaaagaacaaaaaaataaaataaacttccatagatgcaccaccaggttttagttattagcatttttccgtatttatactgggtacctcttttttgttttgtaaggaatgaaatatggcagatagagctaaaaccctacttcattccctttccattagtggccactcccctgacgttggtgggcatgcttttaaatgtttcctgcatatgttatgaatgacataaataatatgtaatacttttgtattttaaaggtttatgtacatgttattacactctgtggttttttgcaatttgcaaaacagtcaacattatgttttctgttatctctctatccatccatccatctatccatctggttcattcaattttcattggtgtgtgggattccactgtataaataagctcaagtttatttactcattctcctactcctggaaggttgtttttactttttgtctcttgcatacaatattgtagtgaacatgtgttccagttttttattgctgtttaataagccacctctaaacttagtagcttaaaacaataatgtttattttgcttctgaatctgcagtttgggcagggcttggtgtgggcagctcatctctgctccacttggtatcatgtggggcagctcaaaggctagaaatggaagcatctgcaggtctgttcgctcagcatccgatgagtgattctggctgtctgctgggaccctggctgtgctgtttgctggagtattacatgtggcctctccatgtggtctgggcttcctcatcccatggcagctgggttctaggggctagtgttctgagaggcccctatactgaaaccagattgctctgtgacccagcctcaaaggcaggcagcatctgttgacttcattctgttctttggaagcaagtcactgaggctgcctcccattcagggcaagggagattggactccaccttcaatgggacgagcctcacagagttggtagacctgttttcatactggcatttatagatgtacatccttgtacacccctgtgaaagcttctggggctgggacccctcatggtgacttgacgggccttcatgatggccctctttgacgcgaccacatgttgccagcttcccctcctgagtatttgttccgtggacgcccaccagcgtactgagcgttcccatttcttcacaccctctccatcatttgctgttagggattttgattttttgcccctctggtgggtgtgaaataggatcttattgttttaatttgcctgcccactggcgaggccaggccctgtgctccatcctgggggtggtgttttatttcctttcccagctgggtgccctaaagaagacagaaacgtcaaagtgctattttttggcttatgatgtcaatttttcaggattgaagtggcgagcgtcccacagagtttattgcaaactattatgaaggtcttggagttactgttggtatgactcatttatgaaaaaaatatgatttcagtaactgcaggctgtatttgtaatgtgatagattttcatttaatctctcacctctctataatttgcccaatttaaaaatgccctgaagcttgctttctctttgtctgggagccctgttcttggtatgtgttattacaataatagtaataagaaattgtgccaatatgtgtctctcttccagctcttgctgtctccttggtcatttaattacttctggtactgatttcccccagcctgatctcccctgttataatagcgtgtgcatgaagcttctgtggagaatgccactgaggatggaagctgtcggtggttggcaggccccagtgtgggcatacctggacccacgggctggctgtgggcttcctccttgggccacatagcacccaattagtcagacacaccttattccgatcgtactgtgaggttgtagaggaaagtcccttcagatcctggcacaaaggctggcattggggagtgtttaggaaacgtgttgaaccaaataattcaaaatgttcggttattataattatcaaggtaacctgctgacgtcactcaaaaacatctggaaaatagccatgtcagatcaagaattttatgatgaatttcctcgaaaacggaacttttgactacttttaatttaatctggttccatctgaacactctgaacactatttgcagcgtgctggagaacattatcttctctgcttccctcctaaggggtgtttggattcttatctgtgttgagaaccagagcctgtgctgcggaaatgagatcttgtctgtgcactgagtcagcccaggtcttttgcaggcactcaggaagcagcatctacatcttgaggggctacttttctggattgtgtgggtgcagcgtgtcctgaaaacatcactgggcactgctgtccataccttatgatggggcacgggccactccaggagtctcaggtggcacagctgcccaggatgggcttggtgctggtcccagggaggcagatgacacgtgttgcccctcagaacagtggggacagccaggtgtgccacaggccatctcgcagggcctccctgtaccaaccagattgggtataaacaaggcattcattacctgttgttttaaggggaggaaggcaccacgggcgaggcctcccaggctggctgggtgagtgttcctgagcccaggcacttcgatgcccacactacttccagggagctgagtttcagagcctgtggcgttttcacaccatgttctaggtgccagcagaagtctaacaaggagcagggcattagcctctgtttccatgacagactgttcacagcctcacagtttgcatcccgtgtaaacaaacatcagcacctgttatcctaattaaacctcagaccttgtttgcatgttaagagttagcaggacaatcctttgctactggggacccgccactgaccccagggctttcttgtatcaagaggaacaaaatggcatgagattgggacctgggagcaggccccacaccaggtgtgacatgcctgtgctcagccaaggggtttaactgcctgtggagtctggggcccagggccctgctgcctgtccagtgtttgcgtgggaatgtcttgggcctggggatgtagagcccaggttctgggaccagcccttcctgccctggtgtcttggtttcctagaatcttggtgcgattcggtggttaggctgatctcagggttcctttcagcagcagtggcagccgtgaccacctactatggaccagcttctgccaggcaccttgtagtctagcagagtaagtttgatcattccattccactgacaaggaaactcaggctcaacaaggtgatgcctttcccaggacatgtgctcctgttgccctgcccctcctggcataatatcccacttcctgcttggtggctcaggcctgtcagtcacacagctcgtggcttccccatgaagcatctcttgggtctgtctgtttctctcttcatccacaccttcctggcccaggctaccatcatatcttgccaagacaagtgcagcagcctcagaaatgttctcccctgcctccccttcatgcccccaggcagccaggatttttctaaaaactgtgcacctgggtgtgtcccttgctggccccatggcctgcagggctcaggatcaagttcctcttccttgatgtgggtcctgggtccttggaggctggttgtgtcagcccttctccatcctacctcccttaatgtgcacatcctgtcaccccatgggcctaagctgtaacggggcagggctgtcacttgcactgactcattccagtgcccagcacaggggtggcacacacccaggagtagctgttgggtggatatacaaatgttgccataggttgcagagctaaaaattagggaggctaggatttggacctacatttgctatattccaaagcccctgctctttctactccttcccctagactgtgaaatatgtttgatggggaaagatacccgggacagaacccgacttttgcacgttacagtagaggtccctggcagcccagctctcctaaacatgaagctcatcaggcagcaccgtcggacgctgatggtgggggctgggccctgtgctgacacaggctcagcaggctgttaatgaggtcctgacaagctttcgttttgaaggagttctcaaaaatgacaggttttatttcaagggtctttgttaatctaatagttttccctggctgaaatttgtggactgtttaccaaagctctggcatgtgatgacctagggacagaattaaagcaatttcagcttggtttcaggcacagatatgcagccagggaaatcacctggggcaagctgaccctcaacatgaggcaaggggtattcagtggggccagggcgagaccctgggccttgcgaggacgccgtcctgacatttccaccccaaatgggatttgcataagcccaaatgagtgcagggttattctccgcacgccgtcatcgtgaatatgcattccacagcttcacatggggtagtttaaaaaattaatagatatgtcctttatttctctctctacaagccaaagcttggaattaattttttctggcccactaactcttgtggttaaaagtacaaattaagttttctgggagaatccatcacaaaattattgaaaagtcagtgtagagaagataatgggctctgtattgggttatgtctgtagggttattgttttctgcaattacacttttctttgtttttctttttttgtgctttgggaaatcaacctgagaatgggcttccaactcggaagagttattggctacttttcccaaatgggattgcccttccaaagaactgtgggcatctgtttgacaacaagttataaatttgtgttccaagttctctgaagaaagcatgaatcttcgacaatggcactgtggcactgtatttcaggcaggcgtgcagagctgtcaaaagtcaataaagtactcagacgcctgcgtgcgcccagcccacatttgtcaagtgttctccgcgtattttgcgcaggattggaaggcggattagagccgagttctccagagctcttcactctgccccttccctgagccccacagctatcctagaatgggatctgttggagcctctggagcaagtttcctggtcccagagtccggctatccatctttcccatggaagaggaagactgctgccccccagccccaccccatttactgagaacctgctaggtgccaggcattgtgcaaggcaaccgggcacagagaaacaaaagatacgcccctgccccagcaatgccgcctggtatgggtgctgccctgccattagctatcccagccctaggaaactgccagctggggtccagtgtctattacttgtgtggtggtttctctagtggcagctagtgaaatctcaggcagaggggtttcatacatgagctgatcactcgggggcttgcttaaaacccttcagcaactcccccttggtctccagataaaagcccggtccatcaatgtgtcttccaaggccttctggaacctgtccctgccaccttggggccctcctcctcctcctctctgctgctctggctatgtggagccgtgctgtccttcaccctgcctggccagccttcacctgtgcctgtcctctgcctgggacattccttcctcctactctcttcttcagcttcatccttcctgactttgtgagacagcccttttcccacgaagccctccatgccccccagctgcattagatgcatccaccagtgtgctcccactgcctctcagtctcctctcttgcagcacttatctgtcccgctccaaatgtatcccgttcaccatggggcaggggcctgtgtgtcttgctcactgcattgtatccccagcttgatcacagtcagcagggtgcagtaggcactttgaaacatttgcaaagtgacacacggtgccttggaggaaggtgccatctctgtgaggcaagagtcctggtgccgagtaggtgcgggccttggaggccaccagtgtgctaatggcaggtgtccaggcaggagccgggggtgacgtgtgggtgaaggatgtgctgtggggtcccgtcatcacttgctttattaagctggttgtatcacttgacatctttcaccactgaaggaaatagagcttgttttaaggtacaaattcaggggtgtctgggctgtgagagaaatagcttctggcaggagtgctgggttgatgggcacctttgccaccaccccacccattgcccaggcagggacaggaggccagagctggggaggggctggagccctggcctcctggctctcagtggctctcagtgtcaggagatgactccctctgcacccctgctgtttctcctggtgatgtggtgctggagtgggtttctctggccaggacagccagtggaggccttgcagcgactgccgtgccctcaggctgaggctccttctacgaggctggaagccttttcctcctgagaccctaacacgctccctttcctttcctttttgagggaagccaggttccctgcagcagggcctcatcacagttccccctggagcattcacgcaaggtcacttttcccatctgaggaaacgtttgtcgtgtgctccgaccgaagcgttggcactgacccgtctagaattctgtgtgcggagtggaggtgagatgctgaggctgtgcctcagcctatcttgggtccccctctgcctacaggcagtgagtgtggcctgggaggcaggtggccctgtggggtgactgagctgggcgttgtcctttcctcttcctggtgtgtgtagcgagcctggtcagagcatggcgtctggagtcaggcggcctggctacgggtcttgggtctgccactcaccagcctggtgtgggcagccattttagcctttctgggcctcagcgtcctcctctgtggatgggggacagtgcctgagcgccgggggctgcacatggtgcctgtctctctgcgttcttagtggaggtggcccctgtggtggtccctgttgatgccgacctgctagcctgctccatgctgtccaggagagtactggggccttgccagcggagccccctcttccctggtcttatccctcggaggtgctctgctgagagctgcccctgtgaggagccatttcacttctttcttcaagtggatgtatttttgaacatttgataccttctttcaaaagtgctgtaccttcgcttttattctactttgaatgtaatttagttgcacattcatatttaaaatctcatatgaattaatttcatgaaattggtttgtttttcttcttccatttcatgaagcaatatcactcaagctcctcttgcgtctttggcaccagaggcgtcatcccccgagccactctgagtcatctaatatggtttcccgagcgtgtcagcttcacttcacataagtcatttcagatcctgcacttattgaatcagtgcatactgctgtcactgggaagtttccactgtgccgtagatactcgtttgtaacattttagaacattttcttccatttggcactttgtgttttgtcccccgggttttgatctaggctgcagaacaggacctgtcctgactccgtgctcaaagtgctgagtgaccctgtgctccactgaagttgctccatccaccttctagaactctgacgccagcttgtcatcagcttctcgtttccttgggagatggggtggtgcagcagaggccagcctgccgtggggaggtgggctgtgtgtgctcccatccctatgaggctaacaggagacttacctataagcaggcatgcaggacctggagtgaaagaaagaggagaagaagttgcctccttgggccaaggggctaaggtggctcaggatatgtctgttcatcttatatcggagcccactgttcatctgccctgaggcctttaatcaccaagaccccagtggctgggggaaggcctaggcagtcctatacatacagcttctgagaacgtcagaaaatcaaggattcaaccccataatataggtgacactgcttgtcttagtctgcttggactgccataacaaaataccctagactgagtggcccacacaatagatagtttatattctcccagttctgtagactggaagtccaaggtccaggatcagccagcagcattggtgtcaggtgtgggctttccccttgggttgcacacagccaccttctccactatgtgcacacatggcctttccttggtgtgtgcgtgctgctggggtggggcggtgggggcagggaattggggcagggagagagagggctcttatgtctcttcctgtaaagatagtaatcctgttgaatcagggcctaacttatatgacctcatttagccttccttccttccttagaagtcccatctccaagtgcagccacctggggagttagggcttcaacatatgaattttggggaagacacatccatgacacccctagtatgctgcctgacacatggcaagtgctcaatgaatgtttgttatatttgaatctgaaaggttccagaaagatgagatggacttggccccagaggctctaggcaaatcttgcagaccaagggggcctggtgtgtgtgtgtgtgtgtgtgtgtgtgtgtgtgttcccgggaaggcacatcctaagcttggcctgctggctctggctggtatgttgggtatagactggagatgagctccacctctgcccagccagtcagagtcacctccggacctcctgcttcctgatctcctcagccctttggggaaatggaggaattgtgacatttgccctaggtgatggggtgctgctactggggccatataccatgaagccgaaattcctagtctgtttattcataataataccttatagctgagtaatgaaagctgcatgagagcaaggagagtgttttatcatcagcacgtcagatggcgcctggcacaaagtaggtgctcactcattgggtgttggatttaattaaaataacggctagtcttgatgtgcaaaatggcttcatgtactgataacctcgtaccttatgccaggcaggactgtggtccctgtttgcagatgaggacactgaggcacagtgggaaccagcggctgttataggtgacccagtgagggaggctgcatctcgataggctgtggggaagggatggtggagatgcaggaagcccatgctgacgtgcggagtgggcctgcacagatgaggcttgcttcgtgctccccagcctggcaacgtggacatttctggctgtcgagaaggggcctaagaggtgcccactcccctccttgtgggtcatttcatccaccaactcctgcggtgccagaggtgtcctctggcctcagcctgcaggaataaatcgctggtgaagggcttccttctggcctcatcgttggcttctatgtggccggccttcagtaggtgtttcctgagtgagtcgatggaaggacacattaaccacacttacagattgaaatcaatgccctttctgctcagctagctaatctatcactctctttggcccctgacatttattatgaagtgtgttcttattttattagtatggctaattaatggatgacattaaaatattgacatgaattgatttgagtatctgtatccttggagcttcagttaataaaataacttttgataagactagtggttttagaacattgagacttaattatattttctaaaggatttctctagaatcatataactgcttggcaaggtactttaattccctagttaaccgaaagaaattggtttttcgtttgattttgctaaatacaaattaaaagtaatatacatttgataaaagcagttaaaggattatttataaaagcctccttctttatatattcggaaataatccataagaactgaattaatattgaggatgatatgcagagaatatgacagttggagagcctgtttggcctagagaaatatgcatgcatttctgttggtaatttctttttttttttttttgagacagagtcttgctctgttgcccaggctggagtgcaatgggacgatctctgctcactgcaacctccgactctggggttcaagtgattctcctgccttagcctcccaagtagctgggattacaggtgcctgccaccatgcccaactaattttttttttttttgagatggagtcttgctctgttgcccaggctggagtgcagtggcatgatctcggctcactgcaacctctgcctcccaagttcaagtgattctcttgcctcagcctcccaagtagctaggattacaggtgcccgccaccaagcccagctaatttttgtatttttagtagagatggggtttcaccagattgatcaggctggtcccgaactactgacctcaggtgatccacccgcctcagcctcccaaagtgctgggattacaggcgtgagccaccgcacccagccttgttggtaatttcttttgccattcttcctcaaagatgagtgcctttcttccttgggtttcttctgtgcagttgatgtgttacacttgtacatcccagtttcagcatcagcaagttgtgaattatgacaatggttgaaataggagcactaaggagaattcaggtgtttcattctcatcttacttaggttaggaagtctgccaaagctagcaatttgaaaagaaagaaaataaacaaaatgaaaggaaaggaagatatcttgcagaaacactcactataaaaatataataagtcaatgggtattatcccacttgtaagagagtcaactcctttcattcgttatttttagaaagcttactgtcacgatgcctgaatcttccaaaaatgtagcatgctgaaagagaccttgcaaataactccatcaagttcactagcctacaaaaaatccatcttctcacctttcttccccttttaaaaaatgttgatgtaatttcaggcttacggaagagttgcaagaacagtatcaagaatccccagacacccttcacccagtttctccaaatgttaacatcattttataacccattccacatatataagcatgcatatatacatattttttggtaccatgtaagagtaagactgatagtcctttactcccaaatatttcagtgtgtgtttcctaaaacaagaaattctcttatatagtcacagtgtaatcatcaacatcaggaaaataacattgaagcactagtcatgtgttgcttaacaatggagatatgttctgagaaatgcgttgttagacagtgttgtggtgggaacaccatatagtgtacctacatgaacctagatggtacagcctactacacacccaggctatatggtataacccattgctcctaggctacacagctgtacagcatgtggctgtgctgaatactgtaggcaattggaacacaatggggcatttgtgtatctacacatatctgaacttagaagaggtacagtaaaaatacagtctaatcttatgggaccactgccgtgcatgtggatcgtcattgactgaaatgttgttatgcagcacatgactgtattatctactgtacataccttattgatattttgtcaactgtcccaaaaatatcctttatagcaaaagagaattcatggtcatgtgttcccttcatcattctatctctttagtctccgttagtttgaaacagttcctcagtttcacaacactcacatttagagtacaagccagttattttatagaccttcaatgtaggtctgtctagtctttccttgtgattaggttcaggtgatgccctttggcaggagtgttccgggtgatgctgtgtttctcagtgcttcctaccaggaggcacatgttggttagtcctgttgctggcagtgttaactttgatcacttggctaagatgccaggtttcttcagtgtagttaatattttgccttttgcaattaaaaaatataatatggagaggcactttgagacaacataagtatcctgttattcctcaacctctcatcaactcgttttagcatccatccatgattcttacctgagtcagtccctatgatcacgcttgtcacgtggggatttctcatcctaactagaaagaagagttttcattccccccccattagtctgtttattttgtatccatgtggactcatggactcctagtttcttagtttaacagtaagttataataatacatttttatcatttgataagagaaatctcttcacgctagctgctgtctccatattctttgaacatgacttgactttttggcacagcaagatattctgggctcacttattcttttcctgccccagtcctagaatcagccatctccaaggagctctggttccttttagtggagaaaggcatttagaaaccaagattttggccaggcatagtggctcatgcctgtaatcccagtgttttgggaggctgaggcaggggggtcacgtgaggccgggagtttgagaccagcctgggcaacatagtgaaaagccgtttctacaaaaaaaaaagaaaagaaaaaaaaaccagagagagaaaccaagatttgggatttgggtattagatgtgctcattgcttcattgctactgggggtcactgcttctcagaagacagatcttggcgatagatgtctgcctatacatgcacacatgcctctattcagttatttccaggagaacctgtgagtttacactgatgtctctaatcctgatctagtgctgtggggttcattctgcccttttccatttccatatttgtcactcccccctccaacagtgaaacctggcttcctggttttcacaatgtatttatgtatttgctcaattctagaatgtcagaaagtagtttcaaaattgctaacttctgcaaaaagaggtctagtgatcagaattcagtattagagctcttttcgacttcagactgagagcatatagtccacatttcaggtgtttcttgggtttgttccctgctgccccctttcagtgtggttatgttattcatttgaaatacaatttggttcctttgtttctctttgtattctatttgagagatttccccaatcttagggattttctcttccctcccttttgtgtgaaccacggacatttccaaaaggcaggtctgtacaaaaagttctattcagagaggtgctccccctcctttccactccaatccctttttcctctctacccagctcccaccctgccctgtagggaaccagtctcattagtctgtgttttttccttctatgtttctttttgctttaatgagtagtttcttattccgctctttttcttcataaaaagtagaatattctgaatcctctttcacagtttgccgtttctcatttaactgtgcgcctgagcaggctacattagtcctgaggggtccctgatccttccttctgctcctgaggggtctgttgtggtctccattttggctgttatgtaggtgcatgagaactgtgcagtgtgcgtctaggtgctaatgacagcacagcccccaccaggcgttgtgtcttttccacctgactctggaagagtggtaatgtgggcagaggaggaaactgaggctcaaagtagtcccatgaccacacgtcacacagatgtgagctggtcctagaggttgaggccagactgtctggtgccagaactgaaacttgtgaatgacgggtgtacttgctcctcctgctggggttcattgcatgcctgagatgccaagagcagggctcgcatcaccctgggtgctaaggaaaaaggccccagggagggaaggataacccaggagaaaggaggagctattccccttataattgctttccttatcattcttttaaaatttgttgtgtgtacatgttttgtaatgagtataacacatcaatagaatagggtttatgtactcaaagttgtgtgctcagaaaaatttttaaaaatgatagtgatatgtgatcaaaaaagtttggagatcacggaaagagaagctcactcagctgtcttgaagtggagagagccctggcctggccttaacatccagagatgagggcttgtgatcccacctgctcctgctatgggggcaacaagacattcattcactcaatcattcgttcattcattcattcattcattcagtatggctgagcggtgaggttaacacagtgagcaggaaggtgctgtcctgacttcagagagcatctgcaagtccagatggggatcttcatggctggaaggacagtgaggcctgtcagggaaggacacagtgctgtggatcacctaggaggggcttgtaagtgaggtttgggggttagatgtgacttccagggagaagagtgacgcctaagtgtgtatgagagtcctctggtgtgaggcttggagaggagggagtgtagctgctggccagcaccgtggaagagttgactctgagcaaatcattaatctttttgggccttaattgtcttctctgtaatggggaaggatagtaccactggcctctccagcaagttctttgcatctgctgaggccagattcaggtgtcaaattctcagctctgctgttgactagccatgtgtctttgggatgtgttatgtctggagctttgctaacaaagctttctcaccttatctcattgagtcctcccatccagcattttccatatgagtgctttgagtttcagagaagtgaagcgcttatggagggtcccacaagcagtgggagccgggacgcagggctgactactacacctgggcccgccttttcaccacagactgtgtgtgcttgtcatacttagactttgcttgtacttgggaaaggagttcagtttgctttaatgtcactttaatgctttttagaattcatttcctttgtttattttgcagcggtataatttgcaatgaaatagtttcacattgagcttacatgttttgatggcatcttaatgttggctccatggatttgcagccagatacttttgtcattctaactttcctatatgatggcactatgtggcagtgtggccatgaactatggcctgggtttccctttaggccggccaggtagcctctgagtcaggtgttcggtgtctcttgggtcgtggaggactctgcacactggggacaagtgtcctgtgtgtcagtctcctgtgtagcttggttttactttgccatgtcattgggtccttcctggggttgggtttcacctaggaacatctggctgggcatcatatgtgcagaagagagcgtctcttcgctctcgccccctgagctgtggagggtacatgcgcaccccagaagcaaaagctctggctcccagagggccttggtttgctaggttggccctgctttcagttgctgtccttgtgccacagcatatgctgagccatctgttctgcctttttgttttggaaaatgtggcacaacagttagagtcttgcctagaagagcactgaaggccttttagcactggggctgtgccttagccatttgggtcccttcagtgcttggtgaggggctggagctggagtaagggcctggtacttgtgtgttgaatgcttgtatgcatgtttgattattgtggctgagggctcaggagagtggcaggaaaggaggaggtggagcccagagcagggacttctttccagggcccaacccacacgttggtcttgctcctggaagagcacctgcctgtagaaagcaggtcccttctgcccagccccccacggcccagccttagccccatcctctcctcaagagaccccacagcttggctttagcaagacccagacccatatctgagattccagtctgagcccgctgagtgttgagtctcactgtttcagctcttgggtttcagtgcccaagaagtggtactatagtggcataaaaaagccacccgaagctgggctcataccttagctttggcacttactagctgtgtggccttgggcaaggtgggttgcttaacttctggcagccttgatttccttactgtgaagcagagacatacctctaagcagagagtggttgtagggatttgggatgacatgtgtccagcacccagacacttgggcattggttgccattattattattagtattattactagtattattagtattagtagtattactgttactgctactgatgttactgtcaccaccactgttaacccccattctctccctctacctctccaaccctacgttcacccacagcactggtgttatacgcccccttagtgaagaagagaagacaggagctggctcagagcatttatctgcccagctgctgtgagccctgagctgaccaccaaggatgctaaggggttcaaggaggactgcacctccctctgtccttgccttctcatccttttttctcctgacacaccattgttttcgcaaaagaaagaagtagttggagtctgggaaagaaatccccagggccctgtttcagatgattgtcccatttctaaacttgagttaataagagtaaacaaagtagtaggtagatttgcacaggagaatattattattctcatgattatgtaaatatttatctgttctggctttcttattttgttgctggtgtctaatttccaagtcttgtaatgaagtgtaatttggagaagatttgcaaagacaggcacgtagtgaaataatttgatttgttcagtaaacttggtttcagttattcctttccatgagttgttttagaaccccttcaatttctttgtgatttgacaacagctttcagcccaatgaagatatgactcttaggcattgccaggaattcagaattggtttataatattgtcgcttaataagaaaatgcgttcattggcaggatataaaatttatgggcttcaaatggatttctgtttgtagttttagccctctgtgctcctgccattctcgaggctatgagtaaggttttttaattaagtcaaattgaattgaatgagcttttattgaacgcccactctgtgccagacaccagctccttaacccttgcactgccctgtaggtggctatggggagctgagccagaggaggttttgccccatgctcacgatcattcagctggcaaacctgggaggtgggatttgaagttaggtttgattctctggctttttcatccaaagctgattataggcagacttgattaaggagaagagagaggttgagtggctttcatgttatttcattgaatcttgtttagtcttctcagccaccctgtgaggttcattacattttccctattgtatatctgaggaaagtaaggctcagagaggtacagtgatatgctcagggtcacacagctggtaagaggcagagctgggatttgaactcagaactgcctggctgcaaggccagagttccttctagaacccctctaggggtctgcacttcctttagcacatggccaattgaccacctgcccacaaaaaatggcctggccctggtggctagggcaccctcctgcagatggaggcaaggagcagtagggagtggggctgggcatcagttgcccaggtacttcctagctctatgccctgggcaagtgaagtcctcctttctgaccctccctgcacccactggtgactggtggcagaataccctcctgggttattgttaggatcacagacaacatgtgtgaggcacctggcacttggtgggcactcaggaagtgaaggaccctgccctttggcatctgttgcttgtcagaatgcgtggtggatggctctggcctcggtgacgaagctgctgttgcttcagcccccggactcctgtgcatcacagagctgattcagtgcagacaggtgactcatctgatggcattttgtgtggcgttgtgcagttcagcctggtacagcacggcccgcccacagcaggtattcaagagccgttagtgtttatgaaggtgataaaattgcctagatggagggaagccgtcaaaataagagcctttgcctgtcttgtgaaagttaacttgcaaacctaatgcctgtggggctgctgaaaaagcgtcacctggatttctccttggagacagaactctctggaaggacagctgggcagcccctgcttgccatgtgggggtggacgctttttatgtgacagtgagttggagaaactaacagtggtcttcaaggcattgtgctcagcttaactctttgaattgccatagctttaaaatgaatactagaaacagttatatatttttcacactctccatattttctccattcaatataataaatgttatcttgaatgtttgagggttttatagcaaaaattcctcccatttgtaaagcatgctgcagtggatgggagtgaactagctggcagcgctctcgtgtgacgtggcagaggctgagggagttgcccaaaccccacttccagttggaggaagcctgggccctgacttccagtgcatgttcaggtccacttgtcaaggaaaggatccattgttaagaaacaaacatgggaaactgtcatgtgagcgtccctaaaagcagcatagtcattttcgagtcactctctgataaagatagaacacttcatttaggcacatttcaggatttcagaacatttggagtagtcctggggtggaaagcagcgttttcctttttcaatttcaacctgactccattcctctctttatgtgtgtcagtcatagcaggggagtgttttcctcttggatgcgtttgcacctggcaaatgaatgtgcaggaattctttgattgcaaaatagctactctcaaaatgcagacaggcagccacagtcagggagcccttcggccacggcagcggggtggcgccagacacctggctttgagtcccgtggaggcatgccacttagtctgttctgagcggctgtttacaggcggatagaaagggctgtaggatgggaccctcaaggttttggggcatgggaggggctggccgtcatgattcagcatgctagctctctggaggctgtgctgagcactgagggacactgggagaaaaacacaggctcctgctttgtccatgtggaaggagcccaggctgccctggctgctatacgcatccttccaggcaaccttcaccttctggtctatttagtctcattccctgtttttattcccttcttttatttagggagagccagagcagcaattctcaggtcaggattatttgggagatccatattacttctgattatttacgaagggacaggccgggggaggtaaccacctcgataaattcgtcagcgaggcagctggagggatgtgtgacaaacataccaggctgtcatttggccagagattgtctgcactgggattgttcccccaggatagtcctgatgacaaatgtaattgacattttttattaaccctgaaatgattaaagatgctgctgctgaatttgtgtcaaagtacccggtccctggcattttgagaaagggattctctgtggagccaataaacagcctgtgttttcttcctgttcatcactttaatcaactaagacatacagagccctgtctggtttggtcttgaaactgggccagggagataagactctgcttcctggcttaggtttccagaacactctggtatggacatcatgagggacacataggaggcactctgttcatttaccacacagtcatcaaacgtttgctgagctccttctgtgtgccaggtcctgtgtgtgatattgggcgctgtctccttgaagggtggtcgctgtagaatgggggctagaaagatgtttatggggatgattgtgagaactgagcattgtaggggaagactgggccaccctcactgcctagggggtggggtggggcagggaaggcagtgcagggggtggtttgcgtcttacaggaagggagtctcctctccagacaggtcttacctctggagctctccaggcagatgctggaagtggcagtgcccagagtgtgtgggtcttggagtgccagagtgtgggaacacagaggggcagcaggggagggtggaagacacacaggagagcttggctggggcctgcagatgggctgggggccacatggagcgcaggtggactttgctgcttcctagcctgcctgctgagttactgaagctcttggtcttggtttccttatctgtgaaatgggacaatcctactttcgcttctgtcatagggctgctgcaggatgaaatgacagtaggaggaaagcccctgattggtgcttggcatacagagcctagtcaacaagcatcggttccttcctagatgcagtctcagtagcagtggccaggtattgagcacctactgcatgccaagcgctgggctgaaggccttgcactgactctctgttaggtatttttattcccattttatagctgagaaacttgttagagggtaaagcagttgctcagggtcacacatagagagaggcagagagaagatctgacaccaggctgttgctcccaagggcttcctttcagcagtgcaggggctgggaggtgccaggaggagcaggaacatggagagggccagctttgactgtggccagagccatgcttgagctcttcttttggagggatgggcttgggttgcagagggtcttacagggagagtgtgcttatcacactgctcctggatggactgatgaattgaacacttcctgagcacctgttttgtggctagccctctgctgagggtgcacacattccctcagccacaaagccagtatttagtgagcacctactgcatgccatgtggtccaccaggccttgggtagatggtggtgtaccagaggcaggggtcttcaccctgggggagctcccaggctggcagggaaagaaggaaagaaaaagatcacacatctagcattgtggataagcaacatttcagcactgaaatagtgggtctatgttattaacattttatatgctaggctctcccacacaaaaccagatcagaaccctctctcttgcccctgaactgcataggtttcaaaggtgatctgtccccttgtatctcgacctgttgctcaggaaccattcccatcagtttaatttctttttccttttaatcctgtggctggcaggatgttgcaggggcagtaatttaataaaagtatgcagtttgtaaagcagctgctattctgtgtactaagcacatttgccaaccttttcagggaaacctccaagctgttcttggaacttagcgatattgcaggaaaaaaaacattctatttaataacatttcatcctttgggttctgcagctaatagaagcataaatggaggccatgtctgaaagccatttctttatgtgattcagagaatcaggacatagcaattacacagtgtatgggatttatggaaacattcatgcctaacaagaagaaaacagctcagtaagttatttaatttgaagtcacaggcccgctgactggttccccacccagacctaccgcactgctcggcaggccccaggcgctcgcacacaggtgcccactgctccctgtctctctgagtcctgcccggctgcaggtggaaacctgggcctgctctgtggggtgtgttcacaccttaggccagggcaaggtggagctgggtttgaatattgctcttctgactccaagcctgtctttcctcaccactgcatataacagcctcattaggtttgtaatacgtggcagctgcatgatctgctgggtaagagacacacatttagaaaaatttatgtgccacatgcttttcctttctttatttctctttcccctgaactgagataaaaaggagagtcacacacaagcagatgtcagaatgactgccttgcttcgccccatctactggaaaagccaccgactgaattcttcctaacaccgtttctgtttatggcagatatagggtgggggtggggggcagggccctccattctctgctttccgtgctagccgaagccttaattcaaaaacaaattgagtccttcagctgtcactcgattgttccctctgattttgggggataaatatcattgctgcagcctcatgtctcctctctctccttttccccaaagcttttccccttttattttctctctctgcccagaactcaacatatctctgacaaaagcatgcattatttagagcctgtcgcctcttgaagttctttaattacagaattaaaccaaagtaatgacagtttaatttgttctttcattaattgggagcgctccgggctgatgtgaaatgagcgcatttggaaggcatgaggaatatgtactgagtgattggagcatgagtaataataattgctgtcgtttagtgccgggcgctggctaggtgctcctcatgcatattctctgttaatgctccctgcaaccttgaggaggagataccaccttctctgttttgcggcttaggatcttgaggctcagagaggtgaaccaacagccacctgtcagccagaggaagagccaggcctagacaccaggagcccagccccagagccttatcctgtccatagccccacttggccttgagaccagcagctgtggcctcaggattctgcaaggggtggcccacaggaagatgggcacacctggcggggcatgcctgagaaggactaagttgtgtctggctgaatttgaggctgagaggaaacatttgaacccgtgaaaatggaaggaaattggcggtcagagggagctgaagcctcactggtgctgatggaaattttgctacttcgaaggtagcagtttgtcctcccgggagccctgcagccactgaggggcatgcctgcgagtgcatccgtgccacttagttgtgggtcagggaggctgctgcagggaaccgcaggatggacatctctaaagcatatagtgaagggtagaatccaggtgtatggggccccgtcaggcctgctggtcccccttaccctagctaaggcccatgccagagctgctacctttccatggacacgtctgggtccaggtgacttccttcttgcactggccccaggccccaggccccaggccccaccgtacctggcagatgaagtgcctctgatgcccctccgtggcctgcagaagttctgggttgggcctttggtttcaggcccctgggactatacagagggtggatggttggtgcattcacagtactagtggctcatctggagggctgtgtctagaaggaggcagcggcgaaacagctcatcgtcctcctcacgtccttagggacttgagcctggtgtgtaccgacactgcgctctcttggcagcaggcagtgagggacaggagaagaaccaaagttgatagtgccttctgtggcaccttctacttcgtcactttaattccctttaagcttccccaccactctggaaagtgggaagattagccccgttttctagctgttgaaatgaaagctcagagacaatggtcatttacccaggccacatggattgaaggggcagaacagagttaggattcaggggtgtctgaccctgaagtcccccatggaactgggcctctgtgttcttgctgtcaccccatatccccaccaggcaccctctcactcactctgttcacatctcccagcaacctcagagttttaccctatgagttctcagacaaaactttagaatttattatcaatgcatttctctgcagcaaagtctggatgaatttaagattaggggattcggttacactttattactgtttgtcattaaaaatcatgcaaataagccatggaataaagtaacttgtgttgttttggacaccagatttacatgtttactggaagaaaaatgatgctgaactccttcaaggtggtaataaaattttgcctcagagccttagctttgttggtctttttctataatttactccacaacttccaaaaaatattttaaactagtttatcataaaactcacaccaagggtttcaaaacatccttttgtaaaggtgaaaagaagactgagaagctgcataggctgcaggctgggagtggagaaggaaagacctgctgcagccatgtgactcaggggcctgagaggtgaatcaaagcctccttgttgccagggctgagacggggacaggatggcttctaggcttcctgtctttggattttagtaggaagtttccaggcttttgttctgaaacccccaggttgcttcatttagcttccgacctccctgtaggaggaggtgggcacagaacgtgtttggaagcgtctgggagaataaggaccaggctagaaagaacctttgttctaccctgactcaggcatcggccatcctttcagagcccatttccaccacagttggaagaagtagttggggtttagaaccctgtgattccaacccatgctgcccctccaagaagacacggggcgaggcccggccataccagtgttgaggtaaaggatctgaggctggccatcctggtagatgaaaagagggttcaacccaggatgaccccaagcctttgggttaactgctgagtttggtgtttgccccagatattataccccctgactgtttcagtgctgtgctccaccttcctcctggcgtggtggggaagggtagccatgaagctcagttggagtatagaggaggagccttctggctttgtgagctcctgcccctggggtcctgcggtggtggtcacaagtgacacagagccatgacaagtagcattgttgatgttgatgatcagaattagtaaaaatgggctggtcgtggtggctcatgcctgtaatcctagcactttgggaggccaaggcaggtggatcacttgaggtcaggagtttgagaccagcctggcccacatggttaggccatctactaaaaatacaaaaattagccaggcatggtggtgggtgcctgtaatcccagctacttgggaggctgtggcaggagaatcacttgaacctgggaggcagaggttgcagtgagctgagatcatgccactgcactctagcctgggtgacagaggaagactccatctcaaaaaaaaaaaaaaaaaaaaagtaaaaatgtataaatcacaacacatggtaagtaacacaataccaatcataattcacttcaaaaacagcagcttgaaattaatcagcagttgtgttgtttcttagaaatatcagaagccacacgctgtgtctgaaagcttgtgagtaagaatgaggaggagtgacaggcagatcagccaacgatagaggggcttctgtgatctgggcaggtgtcgctggtcactcctggctctgtgggcgtggttatgtcctaaccctgtgagttcttgctgctgtcagcaccgcatggatgcagggattcctggctgttagttacatggccaagcagcttctgaaaattatcgtctgtggccacagaaatccttgactaagtgctacggagtcatcattattatcccatcacatgattcttcttaatcctttagaatcacttgttaaactttaataggtaagataatttcatgctcattgaagtaatgtaattatacagactaattcaacgctattagaaaatttctgggctccatttataataacagctaatgcattctaagtacagtttgttagggaaccttgcatattcaacccaaaagaaccccaggtttgcgcgtgagcttggatgctgagcagtgttgagtgaactggagcctactggaagctgttccatttgtccttaggtgacttttttagaagtgattagacttggggattgtttctcagaaatggactggagacccataaatctacaacgattttaattttggacaccaacctggagcccacaaagacaacttcccacgagttagcagcagtgctgggcagtaggggggcacgtgtgctgaggcgtgggcgtgccagccttgcagtggaggaggggctgctctttgccacgtgtctgcagctctcttccggtctctggcttgaacagactggggagcctgaggtcacattttacttgtcttttgggagggaggttggggtaatctggggcaaggggctcagccagctgccacccagacttgagtgctctgtttggtggcaccagacatggtgaggtgggtggtattgagcagggtgggggaggcagcaaaagccaggcctacagaattacacttctgtggcctaatgattttcaaaaaccatttgcgagattgaggtaatgtatttcccagacttaagcaatttactccttcccaccgtgctgaatcaggctgttaaatcctcttgctgtgtgcgtagagctattggcaccagggaaaaatggtcaagttcaaggcccctgccaaatctgtgctcttttctttggaaagtgatgagtaactgcactttaaaaaaaaatgggctgggcgtggtggctcacgcctgtaatcccagcactttgggaggccgaggtgggtgaatcacctgaggtcgggagttcgagaccagcctgaccaacatggagaaaccttgtctctgctgaaaatacaaaaaattagccaggcgtggtggcatttgcctgtaatcccagctactctggaggctgaggcaggagaatcacttgaaccagggaggtggaggttgtggtgagccgagatcgtgccattgcactccagcctggaaaacgagcaaaactccgtctcaaaaaaaaaaaaaaaaaaagaagattttaggaacattggaaaatgttaagtgaagaaagcaggatgccagattgtacattcagtaggatctcaggagaaacaatgtctgcatagaaaaatactgtggaaactgccagcaggttgcagggcttacctgtgcttgagtgcaaggattagatccagtgtcccctctgttccttttcagcatcttacccgttgcccagggtggtgacacctgggccccaggtgagaagcgccccagaaagagaagcacatgcatgctggccgtgagtcatgggcctgctaacttgcttgtcctgtaaccttgggcaacttccttcctactgggagccctagtctcttcatctgtatagtggcccagttacactatctcagaggagtgagggtcactgccaggactccgtcacctgcgtaaacacctggcaatgtgggcatgtggcagtctagataaaccatagccttgtggtggtgatggggtcattataaaaatgcattgtttctttcacaaccaggaaaacattacacataaaagaacagggcaatgactggaggtggaaaaacaacgcagcctacctagctgcatggagacctatgggaacatccactggaccttaacttggcttatgggagtcaggagggcttcctggcggaaggagtgtctcatgggagacaggagagaagagtaggagccaaccaggtggagacagaggaatgtacttcaaacagagagaaggcatatgtaaggctggaggttcaaggaacagagtgagtttgggaaacgcacctagaaagtggcgtgcaaggacgatcgtgatgggagatgaggctgggcaggtgagtggggcctccggagtcagccactgactttcccactgtagctgtttacaaccccctaagcccttgggatgtgcttggcaagataaggccttatggctagaaggctcggagagcatcctttactgggcttctggatggaatttttggagcaaagggttagtactcatttttatgcaaattgagaaatcttgatgaaaacgatcacttccatcccagccccatcagggagggccagggagaaccgtggcttcgataatggtatgggcctgttggagcctggctacagggctgccccgggaggcctcctttgggagcagagacagcctggcactggcctgtggcggttgccatggcagcaggacatgagcaacctgactttctgagagtggtcacctctattccggggccctgccctggctggctgttgcattggggtgggagaggctgtctcagctgggtctctggaaaagctgaggtcaggaggcctgtgccctgggacatggctatgtatgacagccaggacactctgcctccacccagactgggccttcagaaggaattaagttggaggccattaaaactaaatcaggtgatgcttccaggagcccccactcagtaactgctgagagcatccctgagtccctgcacgtgcatgaagcagacagagtgattttaacgcagctccttgtcctggcttaggtgacgcctcccctcacttgtagaggtggcaccatcatgcggtcataggatgagacgtcccaggttctggctctccctgcctctgctatggtgtgatcagaagggggctgtctcctgctgttacgccatgtgccacgacaccctgccttctcccctgctccccttctgcctcactcccctctaatccacctgtaagtcccagtgattcttctctaaactgggcattcagtgcgtccacagtccggcggcccaggcctgctctctcccctctgcgcaccctcttcacttgtctccttgtgttattctggcctttcctatagcagctggtatgctctttaaaaacaaaaatctgcttatcactttgctccaatgcttaaaaaaccatccattttacatggagggaaaaattccaaacttttgcaagtgtctgctgagccctgggtgacctgcgttttgcccactcttgttgctctcctccttcacatagggctccagccacactggccgccagtcccccaggctgtgtgactatgccttgctcaggccctccccacctcaccccttcctctggagaagcctgctgacctccccagtggaaatcaaggtgaatctgttccacctgctattgtcatctcctagagccagttctgttcttcacagcactgatctgagtgagaagagctgtttgttgcttaatatctttctcttccactagactctcatgagctattttgttctctagcagttccagcagtgagcaaatttcttggcagatagcagactggcataaatatctgttgaacaaacccagcgagtgaatgagagtcactcagtcactctaagcctctctttgcccatctgtaaaatggagatgacagtttccctgacaaccttgtgggcttgtgtgaggggcacatgaatgtggaaagtgatgcacaaaaataaaggtataacattattactactcattctaaccaggtcacaacctcttcttccccgcagttattgagagagggagtatgtcttaggataagagagtaggagcagtccagagcccctcttactgtgtgcagattaagcacactgaggagggaagaggcctgtggcttgaggaaagatgtgacatgcaaccccaaaagcacttcacagtccctacaggtggggcaggtgtgaaagagcacctaacaacgtcaaagcagctcaggctttagacctcgggttccagctgtgcgggtccacaagagagtgctgagaaattacagagaatgggagggagctgggagactagaggtgcccaagtggaaaacccattttccaagagtgaaaaaaggtagttttggaagccccatgtaccatagtgactgagtcggggagggacgcttatactagagaaagagaaaatagacgccaggcaggcagtagaattcatggccttgcaggattaaaagacagacatgcttgccaggagccagcgttcattcgccaaagcattcttttttttttttttttgagacgaggtctcactttgtcacccaggctggagtgcagtggtgcaatcatggcttactgcagccttgacttcctgggctcaggtgatcctcccacctcagacacccaagtagctgggtctagagttgtgtgccaccgtagtagagacagggtttctccatgttgccccaggctggtctcgaactcctgggctcaaacgatctgcccgcctcagccacccaaagtgttgggattacaggcatcagccaccttgcctggctcattcattcttacgtgagctgttagacttataggatctgtgtgtattgaggccagaggctgagtgtgtcttgatttggaaaggtgctgacattcagagcctcaggcctttagagccttggtgattccatcccatccttgttttacagaagagcaggaaccagcctaaggttcttgtggtgccagagaggttcagactgttcttgagaaggtaagagagataaagaggtcatacagtccaactggatgacctatggcttgttgaacaagagcactcaactctgagaattaattatttactctcagaatagaggaggtctctcatgactaaaggatactatacttagcattcttttccacagcctaataataaataaattgggtaatgttacagaagggaggtccgctttccaatctgctgatgacccaaagctaggatagccattcttttgtccacatgtttgtccatctgtccttctatctgtccatcatccatccaactatccatcctccattaatcacccatcccttcatctcattcatttatccatctatttcattccattcattcatccatccatccgtccatcatccattcataacccatccctccatgccattcattcattcatccattccgttctgttccattccattccttcatgtatccatgcattccatccatccatccatccatttattctatctatgccgtcactcactcaagagacattgggcttctagtatatgctagactctgttcaagacactgggggatatagaagcgaacaaaacagataatgaagagatagtgtccttacccccatggaacttacattttagtgggagaaataaacaacaaataagcaaataaataaatatgttaggaagtaacataaagctttgaagaaaagtagagctggctaagatgaaggggagtgatgagagcagtgtttagatcgtgtggttcagggaacatctctctgagtagagacttgagggaacccagcagctgggtagagaagagcacctggacagaggagtagcaggtgcccaggccttgagggggaagatgctggagtgtgagaggccaggaggccagtgctgctacagtggagtcagggcaggtgacacaagatttattccaggtgtgatgggaagccactggatagtttgtggggtggggggctataactcgactctgatgcagaggtccagtctggctgctgtgtggcagtagattgtagggcaagagtggaagctgagataccagttttttgtttttttctaaaatgtttttactgtggtaaaatatacataaaatgtaccatcttagacattttcagcatacagttgagtggtattagatacattcatagtgttgtgtggccatcaccaccatcctctccataatgctttcatcctgtgaaacttgagacatcggttttgaggctgttgcagtggtgctggggagagaggatggtgctcagaggatggagccacagaggcaaggagaagtggttgggttgacagagctgacgagtgagggggaagggcataaaggaggacctcagcactttggaccatcaaattaggagacagggattcagtggggaactcaccacgagacaacctaaaggctggcagtaggaagaggggttagtctggctttgcattgtatttctctggagtgcaggactagggcagtgggttggaccttgaggggtattgcaggtgggaggtagaagagcattagtggtgctgaaacctgcacactttcgagccagagtgccttggtccaggtgcctgccccacctctcacagtatggcctgggacaggcaacctctctatgcttcagtttcctcatctgtaaaacagacctaattttctacttcatagggctgtggagaggattgagttaattcggttaactcagttcactcaactaactcaattgtaaagtgctgaaaagcatgtgtggcatgtagtaacatgctcaatacatgattattgctacctggaggcggtcccagaataatgccctggattatgatgctttcaaatgtcccggatatgaagttccagattatgatgctttcaaaaggtgcactggctcctcctgagaccattgtactcccaccattggacaggctctgcacctgctgggggactgggcaggctgtggagggatcttcccactctgcgaagtgggtgtagctgatggcccccagaagccccagcctccagctctccacactctcttcagccccttctgtgatatgtctcgctcttaatcctttttgctttaagaaaactcttctttgcccttttacatcttctgttgacatttaaaattccttccctttgttctgaccttattgaatagagagaataatttcttggaattctctgtataatgaatgttcaggtacttacagatgctgatcgagtttctcctcaacctttccttcgagagaccttgcatcatttggtgtagaaacactttaggaagcacttaggaagatggtgtaaaatgaaaatgctgctgctgttcttgctgttgctgcaaatgtgagccctttgtaacccagatatcagcttgggtaccctgcccttagagatgcaaatgaaattggctcaaactcccataccatgtatcctacaaaccctgaagtgttcccaggttctctgcaaatttttgtgaagctggtggtggtggtgttcagtggctcacccacagaataaatactctgatcccctcactctcctaaacattcctaccagaaggctgggtgtggagaagattttgactgaggtaatggggtaatggagtatgtgtatggcaggtgtgagggtggaggtgaggaggtggggtgaagtgttactttttaattactgcaaaacagatgcttaaaattgaaaattatgtttggcttccagtaatgaagcagtagttctggcagactaaccctcccacagctaacaactataaactgtacaacagcaacaacaacaaaactacctgaaggtattggagagcaaaaaaaagcaggcagagactggacagacgtctaccctccaaagaaggaaatggtactggatgagtttctgacttttatgattttgtctgtttgttttgcctaagcataggctccagtctgtgccagacaggctgctaaaaatttgtatagaaaatctgtagtgttactggcttgaagaaccagaggacagagtttggggtaaccacagcagctggaaagtggctataaactctacccaaatctttgaatgcagactctaagcagctcaactaaggcaaagagaactgaatagaaatttctgctgctgcacaccgcaagggaaacagagtttgaaatttgagtagagccaggttagctgcgtgtttttttttttaaatcaatattcttcagaggagcataaaagaatttagagataacatacattttgtaatgttcagtattccacccaaaattcctagataaagcaagaaacaggaagagggggcctatattcaagagaaaggccatcaaaggagcttattgccaagatgatcccaatgttgaaattagcagacaagtattttaaaacagttattatagatgtgctgaaggacacaaaggaaaatatcctcgcaacaagtaaaacaacggggaatctcagtagagaaatagaagctacaagaaaaacaagtgttaaattctggaactgaaaaatacagtatctgaaatgaataattcaccatttcgattccataacagagggaaatgacagagccagtggacttggagatagatcaacagaaagtattcagccttaaaacagagaaaaatgatggaggagaagaaggacagatactcagagaactgtggacaatatcagaaaatctattatacaagtaattgagctccagaagagaggagggagagaatggggaagaaaaaaatattttcaataaataatatcaggaaatgccccatatttggtgagtttcttttttaaaagaaaaaaaaaaatcccaaacatgtaaattgcaaacaggacaaatacaaagaaaaccacacctaggcatatggtagtcaaaccaaagatgaagagaaaatcttgaaagcagtcggagaaaaatgagtgtcatgtggaggagaataatcatgtgaaaaactactcactcttcaccagaaatagtggagtctagagacaatggaatggtatctttaaagatagaaaactaaaaatggtatctttaaagttcatacttatagtgaatgagatcagtttgtagatcactgctggccttcttgttatctatgacacagtggctcacccacaaaacaaatatttgggtctcctcactctcctaaatattcctatcaggaggctgggtgtggggaagatttgactgaaatggagtaatggagtatgtgtatggcaggtatgaggtggaggtgaggaggtggggtatctttgatggcatctttaaagataggaaactaggaacatgtcaactcatgattctgtatccttcaagaatgaatgtgaagccaggcatggtggtgcatgcctgtaatcccagctacttgcgaggatgaggtgggaggatcacttgaagccaggagttcaagaccagtctgggcaatgtagtgagaccttgtctcaaaaaattaggtaggcatggtgacatgcacctgtagtcccagccactcaggctgagacgggaggattgcttgagcccaggagttcaaggctgcagtgagctgtgattgtgccacccaggctggagtactcagcctcctgaatttactgtgtctagtatccaaataaagattacaaaacatgcaaagaagtaaaaaaaatatgaaccatgatgagaagaaaaatcagtcaatagatacagatccagaaatggcacagatgatacaatgagtagacaagaactgttcaaccaactattataaacatattacatatgtgcaaaaaggtagagactagcatgagcttattaagaagagacatgggcgatacaaaaaagatccaaactggacttctagagatgaaacaaagtcttcagtgaaaaacacagtacatggaattaacagcagatcagaaactataaaagaggttagcgaacttgaagtcatagaagctatccaaagtgaaatacagggaacaaaaagcttgggggaaaaatgaacagatcatcagtgagctgtgggacaacttcaggttcacccaatatatgtgaaagtggagtcctcaaagaagggtagaacagaaaaaatatttaaagaaataatggctgaaacttttctaaatttgatgaaaatcataaacccatagattcaagaatctcagtgaacccctggcacaggaaacatgaagaaaaaagttcaccaaggtatattataatgaagtttcttttcttttcttttctttttttttgagacggagtcgcactctgtctcccaggctgaaatgcagtggtgtgatctcgggtcactgcaacctccgcctcccagattcaagcgaatcttctgcctaagcccccaggtagctgggattacagttgcctgtcaccacgcctagctaatttgtatttttaatagagacagggtttcaccatataggccaggctggtctcgaacctctgacctcaagtgatacacccaccttggcctcccaaagtgctgggattacaggcgtgagccaccgcacttggcctgaaatttcttataactactgttaaggggaaaaaaacttaaaagtaaccagaagggggaacaaggcacattacatacagaggagcaaagacgagagtgacctgaacttctcattggaaatactgccagaagacagtggaacaccgtttgaaagcactgaaaggaaaagccaaaaccaaaaccactgtcaaccccaaatttaatatccagtgaaatatcttttaaaaaagaaaggcagattactttttcaggcattttaaaaccgaagtgatttcgccgtcagcaaacttgcgctataagacatgttaataaagggagtccttgacacagaaggaaaatgatgctagagagaaatctacatttgcagagaggaataatgagcactagaaatggtaaatatgtgggaaaatgtaagatgttttttgttcttatttaaaaatcactttcaatgatgattgactgtttagagtaaaaacataataatgtgccgtttgtaacatatgtagatgtaaaatacacaataacaatagcacaaaggctaggatggaggagattgtgtatattattgttacagttctcataggggaagtgataatattacttgcaagtagtctgtgataagctaaagatgtatgctgtaaaccttaaagcaactagtaataaaacagatttatggttataagtctaacaatgggagataaaataacaaaagatattcaatgcaaaagaaggcaaaaaaattaggaaagagggaacaaggaacagatgggataaaaacaaataacaagatttaaacccaaaccatatcaattatggatgaaatggtctacccatcccatttgaaagacaaagattgttaggttggataaaaagtcaagactcagtgcctataagaaacccactttataaagacacaaaaagttaaatataaagggatagaaaaagatatatcatactaatagtaataaaagaaagctggagttaacatagacaagagcagatttcagagcaaagaatagtaccaggataaagagactcataacaacaagggggtcagttcatcaaaggacataacattaggtgtgtaatgtcagctgcttaaacattaggtgcataaatatttatataaataataagcgagctctaaaatacatgaagcaatactgacagaagctgaatggagaaatagtaaaatccacaattatagttggagatttcaacaccccgctctcaataatcaatagatcaagtagacagaaaatcagttaagatttataagactggaacaacactgtcacccaatttggcttaattgacatttatggaacactccatgtaacaacagcagaatatacattcttttcaattgcccatggaatgtccaccaagagagaccatataaaacaagtctcagtgtatctaaaaagattggaatcattcaaagtatattctctgactactatgggattaaattaaaaatcagtaacaaaagtatctggacaatttctaaatatttggaaactaacacacttctaaatagcccgtgggtcaatgaagaaacagatagagacattagaaagtatttggaatggaatgcaaatgaaaacacaatataaaaaatttgtgcagtgttactagaagagttctcagatagtaatttatagcactaaatatctatattagttgggaagaaattttcaaatctgtgatctcagcttctaccttaagacaccagaaaaagaaaagcaaattcaacccaaataagccaataaaaataagagcagaaataactgaaatagcaaatagaaaaatagtagaggaaaatcagtgaaacaaaaagttggttctttgagaccaatgaaaggtatatttagcctgactcatgggagataacagagaaaaattgcaaattactaatattaggaatgagagaagtgacctaattatagatactgcagacatttgaaagacactaaggtaatgttatgaccacctttatgccaatgaattctacaacttagatgatatggaagagttccttgaaagacgcaaacaataaaagctcattcaagaagaaatagataacccccaaagcctcatgtttatttaaaaaattgaattcatgattaaaaaccttcccacaaagaaaactccagttgaatactcgctagtgaattgtaccacttaagaaattataccaatttatcatgggatgaattgtacctaccccaactccaaatttatattttgaaatcttaacccccagtgcctcaaaaggtagctttatttggagatggggtcatgactgaggtaatcaagtcaaaatgaggtcattaggggtgcatcctatccaattctccctctatgcatatctatctccgaatctcccctttctataagggagaagctatgtgaatacaaagacagccatctacaagtcaaggagagaggtctggaacagattcttccttcagagccctcagaaggaaccaaccctgccaacagcttgatttcagacttctagcttctggaactgtgagacaacaaaattctgttgtttaaggcactcagtttatggtactctagtcatggcagccctgggaaatggatatatatatatatccgtatatgtgtgtgtgtgtatatatatatatatatatatatatatatatatatatatatatatacacatacacatacacacacatatacacacaaactcttctagaatagcaaagaagggggacacttcccaactcattctatgaggccatgattaccctggtatcaaaccaagaaaaggacatcataagagaagaaagcaagagaccaatatctctcatgaacatagatacaaaattttttttttttttttttgagacggagtctcgctctgtcgcccaggctggagtgcagtggcgcgatctcggcttactgcaagctccacctcctgggttcatgccattctcctgcctcagcctcctgagtaactgggactacaggcgcccgccaccacgccctgctaattttttgtatttttagtagagacggggtttcactgcgttagccaggatggtcttgatctcctgaccacatgatccgcctgcctcggcctcccaaagtgctgggattacaggtgtgagccaccgcacccggctgatacaaaatttttaaataaaattttagcaaatcaatccaactacatatatgtgcatatcatgaccaaggaggatttgtcccaggaatgtaagcttgccttaacatttgaaaatcaatgtaactcagcattaatgactgaactataatgttaatgactaattatgaaagaaaaaccatatgaacatttcaatagatgctgaaagagcttttgacaatatccaacattcattagtgattaaaaaaaaacaaacttccagcaaactagaaatagaagagaactcctttaaactgataagaggcaccaaaaaaaaacattagctctaatgtcgttcttaactgtgtaagactgaccaccttcccagtgagatcaggaataggcaagggtgtcacggagagttatttagcattctactggagattgccagtgtgataagacaagacaagaaaaggatccagattggaaaggaggaagtaaaactgcctttatgtgcagataacatgatcatctatatgcaattccaggctgcgcacagtggctcatgctgtaatccagcctttgggaagctgtagctggaggatcatttgaggccaggagtttgagaccagcttgggcaacatagtgagaccccagctctacaaaaataaaaataaaaacatttagaagggtgatgtgtgcctgcagtcccagctcctcggaaggctgaggtgggaggattgcttgagcccaggagttcaaagttttacagtgaactgtgatcgcaccacttcactccagcctgggtaacagagcgagaccctgacttggaaagaaaagaaaagaaaagaaaattccactctgtctattttaaaaagcttctagtactaaaaagtgagtttagtaaggttgcagaatccaaggtcaatatccaaaattaattgtatttctacatacgagaaatcaacaatctgaaaataaaagttaaaaataccatttatattatcaaactatgaaataattagagataaatttgacaaaagacattcaagatcttttcatttaaaaaaccacaaactgttccttagggaaattaaagaagacctaaataaatggagagagacatcctgttcatggattgggagactcaatattattaaggtgtttccccagatattttagaatcagtgcaactccagctgtagaacacaaacatcatgaagggcttctcaaagatttggcaaatgggctgatcccatccgtttggtaaagggttaggcactggttgcacaggcttgtgctgaactgtgtgagtttgagaatggtctctaaaattattttctggggcaacagggactgtcaagaggtgggatgaggccaggagccaggcctgactaggagggtctccgagataagagtgagtaggatagggccacgagggaggcgaaggcttacccagaagtttgacagccaggtgatggggttatggatgactcttattttcgttgtatttttctgtttttttttgtttgttttgtttgtttttttttttgggcagagcacacatatttccaatgaaatcagagaaacaacaatcctatagctgtttcctttgggattttgtttttgcacttctgtatagtttgaataatttacaagaagactgtattttttgtaaccaaaaacgaaaggcaggcaggcagaaagaacatgacctgtggctagatcaatacttgttcaatctttggagactgtgaggaactcctggtggggccatgtcttggtaacgaggacacagaaactgtggtaaatatggcaccgacaagtgactgcaccatattttacttgtcatattcttttcaaatctgttacttttgtcggacacaaagaatgtctctagttaatacatgaaatcatcttggaacatttgacagaagatttaactccttaattctatgaaggcagtttgggatctctaattacttaattgaaaaaagcacgcacttcagtctgctgcaatgttggggaattaatctttaaaacctgacagtgaacattaaattcaattaaggagaccaattggcaaagattcttccctccttcaccctggatagctttgagaggtagctgactggtctgcattgattcagatgctgtcgttgtctgtgcatctactaggagagccaagtgtgcgtttttcacttcagggggagcttgtcagacgatttacagattgatggatctccttacatgtttccgtggctgatttgggagttcccctggacaagaattcaaacattccagtttgctgcttttggccttggacttcatagagttcaagttttttgtaatttcttctttcttgcatgagaccactatgttgcccaagctggttcttcctcctccctccgtcctctcctcctctccatcctctcttcccctcccttctcttctcttcttcccccttcctctctgcaccccccttcctttttcccttctctttccctctccccgcttcctctcccccgctccttcctttttcccttctccccttctcttctctcccccttcctctcccccttgctccttcctttttcccttctccccttctcttctctcccccttcctctcccccttgctccttcctttttcccttctcttcttctttcaccccttcctctccccctgctccttccttcctttttcccttctcttttcctccctttccgtttcccatcctgtgtttcttttttctctcctctccccaattcctccatcactccttctctcccttccttttttcttctgctcctcctcctctccgtcttggttaatttaactttttattttaaatatgaaatgttttaaacatactcaaaattatagaaggtaacagatacctatacacctgtcactgagattgtcaaatccccaggtgtgtctgttctcattctcagcggacccacccatcagcatttgacatggtgaccagcctctttgtcaaaacactctcttctctacgcttccaggactttcctcttctgtttttttcccacacttcactggcctcttcttagactcctttctggtttctctctctcctcccctggttcccagcctgtgaaacttggaggcctggggctgagatgtgggactcctctctgtcctgtctgcacttgctccctaggagagctcatccagctcaaggctgcggcacaatttccacaatggcatccacagctcagcctctaccctgggcctctcttttgaacatcacactggtacgggaatgagtctttatactgtctgctgtctgtcattcaaaactgagctccaggtcctccttccctcaaacttaccccttctgcaggctgacccatccctgcaactccacccctttcagtgcttgggccaggaactgcgaatgtgtcctgggcttttcccttgccctcatatcctacctccagtccagggaagtcctgttggttctaccctccaaggcaggccacttctctactgcctcccactgttccaagccatttcctctctccctggattcttgcagaagcctcctgattgtcttccttcatctctcttgcccttcattctcctccctgcatggcagctggagtggtcctactgcagtggaaccagccctcattcccctccgttccacctgcagaaccctgggatgccccaacggcttgtggttttccgacttcatccctttcttaccacctccctgccaacccccagccttgctcacttctctagctgcagtggcccttcttgctgttgcttgaccatgccaggcatactcctgtcactgcctggaagcttcttccctcaatttctacatagctggctttctcaccccttcaggacttcctccaaagtcacctcctcagagaggtcctccctggccaccatttcagccccttcccttgaccttatagagccctttcctggttactttttaatacttcagtcttcaccactgccttaaggactgtggatttttatttgttcagtgtctgtctccctcactagaatataaactctttgaaggcagagatttttgtcttatttgtttcctgttacacaatgcctggctaatagcaggtcctcaggaaatctttgttgaatgaatgaataaatgaatgagtttcagaggaaacatttgggcatgttttcttcggagagcattttccatctctccctctcctcatctcccacaccccatcgcatcaacccagtgcatttcatctcccccaccccatctcatctcccctacctcatctcccctccccatctcatcctcccctaccccatctcatctcccctactccatctcatctcatctcatctcatctcatctcatctcatctcatctcatctcatctcatctcatctcatcttcttttaccccatctgctctcccctatgccatctactctttcctaccccatctactctcccctaccccatctcatctcctttacctcatttcatctcctctacccgatctgctctcctctaccccatctcaagtcccctactccatctcctctcccctaccccatctcatctcccctgccttatctactctcccctacatgttccaccctctctttggaagagctgctgcttagtgttcatagcttttccctctagccctgcccctttccctcccttcctaggagtgatggccctcctcatgcatgtttttatagcctggctacaaattcacgtataaatgagatctgcttttttttttctttgtgtgtgtgtgtgtatttttaaaaactgtggcagaataatacacagcataaaattgaccatcttcaccgctattaagcatacaggtcagtggcattaagcacattcacagtgttgtgcagtctgcaccccatctgtctgcagaactctttatcttggaaaactgaaactctgtccccattaaacaactccccattccccctcccccagccctggccaccaccattctactttctatctatctctatgattttgactactctgggtacctcatataagtgcagttatatagtatttgtccttatgtgtctggcttattttacttagcataatatcttcaagtttcatccatgttgtagcaagtgccaagatttctttccattctaaggctgaatactattccactgtatggatagaacacatttttacaattcattcatccatccatagacacttggattactcccctcttttggctattattaataatgctgctatgaacatggatgtacagtatctttttgagaccctggtttcagctttttgggcatttacccagaagtggaatggctggatcatgtcataattctacatttaattttttgaggaaccatcatgctgtttttcacagtggctgcaccatttgacatgcccaccagcagtggacaagggttccagtttttccacatccttgtcaatgcttgttattttctgttttttgatagcagccatcctaatgggtacaaggtggtgtttcatgtaaaaacttaaatggcattgtacttcgtatatgcagcttgacttatgtacttaatattaacttttttaccatttaaccatgtaagccctgtagatctcgtttattttactatttaaataaaattaaactcatattcatacatatttttggaaaacagcagttccctgtgccccatctccctcccgtgaattcttattccactttgaagtcttctggctgtgtcttctggctgtgtcgtgtttctaaatgtaaatactgctgtttcttgattttttcagtttgagaccccagctattgacccttagtgaggaagaaaggaactgagctctcttcacattttttgaaggctactcttgaccttttgttttcttaagtgtagacatttacataatcccaggaaacaaggtttcagagctctgatcctttgcattctgagaacattcgggacttggcaggttgaattttcttgtctttaatgagaaggttatccctgggatcaggttggtagaagtgcatgggtgtactttgtttgggtttttctcttattaaagaaaatgaagcttggttttcctaatggaacaggtctggaatccacatccagttgtgtgccagccattatgccatgtgctgtgcagccattacctcctcagccttcaccactgccctcggggtggcgctcttcttattcccacttcagggaggagaggactgaggcccagagaggcaaagccactcagccaaggcccgaggcctgccagcagccgtatcaggtgggaggcactccgttctgactcccacacgctggctgcaagtgctcctctgcttctcgggttcagcctctgagccacctgggtggtaggtgagagcactgccctcatcctgcagtgacaagaaggtaggggactagcactgctgagtacctctgtgtgtcaggccctgggcctaccctgacatattccaaactctccggcagttcccctgggctgcacggtgtgtttggcggcatttgctgggagagctggtggaaagctaagctcaggggctctcacgtggtgtggccctggctctgggaatgtgcagttttatacttgatatcttagatcatttttcagaagtcattgagtgtaacagggttttctctcatgagcctcataccctcatgaaaggccagcatgggaaggagggaaagcaccttctctcctccaacaaaaggacagctgcccctacggcagatatttgtactttgactggttgtaaatacgagtgtagcacattcctttttggatctctgtcttacagcagaacccatgaaaatagcctggacttgggcagtgtccatggcaggacagatgccagggatgcaggcgagcctgggataagatgccagggatgcaggcgagcctgggataagatgccagggatgcaggcgagcctgggataagatgccagggacgcaggtgagcctgggatagggttgtgaatgctgagggtgcaggactcccacccggctgcagggatgaaacaggtgtgaagggctgggtaggtgaccggcagacacaggaatgcgttttcttttttcttttattttgagacagtctcgctgtgtcacccaggttggagggcagtggtgcaatcgtgattcactgcaacctctgcctcctgggctcaaacaattctcctgcctcagcctcctgagtagttgggactagaggcatgtgtcactatgcccaactaattttatgtagagaaaaggtttcaccatgttgcctgggctggtcttgaactcctgagctcaaatagtctgcccaccttggcctcccaaagtgctgggactacagatgtgagctgccatacccgtccagaatgcagttttcttaaccccagaaaaaatttggggaaatgatcctcccaacttaccaatcccaagcctttacatttctgcaatgaaaagtttaacatctagatatagatttgatggtaaaataatgagaatctaattccaccgagacctttttctttctacagtggggtcgagctgagccctggagatcaggcccttgttgtgacacctggtgctgtctgtgtttgcctgcaggtatggaacgccgtggactccgggcactgcctgcagacctactccctgcacacagaggcagtgcgggccgcccggtgggctccctgtggccggcgcatcctcagtggtggctttgacttcgcgctgcacctaacagaccttgaaacaggtgcgtttcttgtgtcacctccctgaggtgagctggcagctctctccctggggaaggttctctggtgggcacgcagccacaagctgtatacgcttgcgtggcagagggagaggggcctcagggtgggctcgtgctcggtgagagggcttccagactgcttgcccattggaactgcgactccccacagaggatgggcctctgccagccaacacagaggacagagccccaaggttgtctcagcctcaagccatggggctggataaagaggtggctttttaatctacttctgacatgcaatttgtgctgaaatagatttaactttatcattgtgtcctttggttggaatcaggttagaattcctgtcaattcattatcgttgaaagtctgtgagaaatgattccagctcataaggaaagtcttcaaacgagttctgctttaatgcccacactgaaaaggcacttgggtaggatggattcgtgccgggtaaatcctgagagggctcttgacaagcagggcgagaaggagagagaagtcagtggaaggaactttccttactcagcgctcctgtgcaacaggcactgtcaatacccaccgcagccacagcccccaggtgggctctctccggggtttacagtgaggactgccagggagtgacagagctgggattcgcacctctgccatctgcctcccagtccgagctccttcctctctttctcctttcccctcccctccccttttctttcctttcctttccctctatgttctctttcttttctttctttcctttttaaaaatgttttatccccctccatgagcaggatccagcttctttcagcaccacactacctcctccccagagctcctcggtctcatttctgctgggctccactgccaggagcccagggagaggccagacttcacaccagtccctggggctccccttgaaccctcaggccagcatcttgcctgcctagccccgcagtggtggtggctctgggccctgcctctcctagggtctggcaagaaggagatgataacttgctggtccaacccctgccactcatgcccagcagcccccaggagacgcagagggaaaatggagaaggtggtttgtttccaccttgagtgtgggcggccttgcagctccttgcatgctcagtaggggaggggacagtactaatggtcacagggcccctgccacgtgctataggctttgcacacagcatgtctaatcctcactgcagctgccagcagtgattatttccattttaaaggagaggaaactgaggctcagaggggcaaagcagcttgctcagtgcctcccagtggtgcatagccagcagggatttgaagccatgtctgtacaactacagattctgtgcccttcccaccgtgccgtgtgtggcagtttcttctcacaaagcacttccctggtcttactgattctcttaaccccttgcagagtggccagactcagggagtttgatgccacttgatgatggtgatgactgggctgatgatggcagcacttactactgagcactgtgtgctgggcattcttccacagcctctatacagcatcttatttaggccccactcaccctttgagacaggcgccatcagaatcagctgtacacacactggccaggggcacaaaccagcaagtgacagagccaggatgcacgcaggtctgctaggccccaaagcctgctgcctgactgttacactctgttgtctgcatgtcccataagatatgcttgataggcgagacagagctgaacaagacccagtgcctaccctggagaagctcctgtctgctggagaagacagaagtgcagagtcaatcccaaattgcagtgatggagaaagacacaggaattgcaagaacatctagattggaaaatcaaggaagacttcctggaggaagtgaaacctgagctgagccacagattaggtggacagagaattaggatggaggaggtatggttgatgaggaggaaagtaggttcttgcagatggaacaaggacagagctgacacaggaacagggttccatgtagtatgcatggaaaccaaagcaggatgtaatatggggtgcaggggctggggcagatgagtctgaggagtgcaggaggggaaaccccagcctgtgggtcaggtgagcacatgtgggtagcacaccgctcacagagtgacaagctcactcacacacaccgtcggattactcaaatcaaattcatttgatggcattgatgggttcatagtggcccttaagcattattctctcaatcaacagaagttaaacaaatgcatgcaattgtatgtgtgggtgggtgtgagtggggtgtcttgacagggggttctgaaatttttagacattcaaagagggtcctcctgtctgatgagtcagggactgccatagcagctggcgggcagaggccattgctgagtttgaagcaggcaagagtcagggcttggtctgtgctttgagtagtcctccttggtagctcccactggtcctgtgtgacctgcagcccctggtggagagttggaggagtgggaggtagaatgccttgcctggttggtgataggactgcgtttggagaacagcttgtctggccccaggcccaatgtgcccctctagctgtggtgtgttgggtgtgtaaagaaaagcatggccctgcccccagggcattaccatccagtgggggaggtgattgaggacttcttcactccatccctctgctaggaatggcgctcaccactgggttcattcaactgttgaatgaactgttgaattcaactcttgaaggccccgtttcgttcactccgcagttgcttattgtgcacccactgcgtgtaggacttggtgctgaggccacagtggagagtgtggtgggcccctgggagagaatggttgagggatttggacctcacccttggggaagcgctgcacacacagacagggtctctgctgctgagggtggttggtttccatgtccctctccctggctggcttgggagctccatgaggatgggagcctgtcctggtggtctttgtgtctctatcctctggccagggctggcttggagcagctgctcagtacctgtgtgggtaagatgtgctgagtttgtccttgccaggtcctcctatctgggcagtgaagcccatcagggactgccagggctggtcggggggcctccacctatgtctccccctatgtctcctaccttatctctgcacatcccacctccagcttttggtaagtgctctctttagccattggggtgggctctgcaggccctgtggctttcgtcccgctttgacttgtcttgtcctttctcttcgctgagtctgatctccctttctactggatctgcctttttccgcccttggtgatttggctttttcatttcaatctaattagggctccctgccaggagaaggcagtgcagggcgttctcaccgcagcgctttgggaattagtcacttggtgcccattgtcattaatttggcgccaaggccatttatcctggtgtcctcaatcaatacagttaaaaatctgtggattctgtaatgtcaatacctggcctgaaatacggagggccagcaccattttatctcattaatttatagttctgacaggttgttggcttatagaacaaccatgaatcaacacttaaataaaacttgctcacaattatttttggtgctcttgtttcagtctgtaatcttcctaacaaaacgtctgtggcacgttaggctgaggtggcctcagggaacgctggccgactccaccagggccctgagtgtcacctgtcttatgagtcagctgtgccacacgccagctcagccagtctcctcagaatcccccggagagctccctcagttctaagcggtcctgtcatgtttcttgcagactccaggccctgaggcaggtgtcccagcctgaccctcgaggctgcagctgtagaggcatgcagggcctctgtcctttacctttgatggctgcaaaggagattcctcttcctggagccctggagccccggctgggcagggaaccctgtcctccttcctgtgcatgggccggctctcctgatgtgcgctggctcctctgagccatctgtgcagtgccacctgggtctacctcccagatcctggaggcagcacgcgtgagagggcacatagacagggtacaggtgttggctcttctgcctccccgaaccaggcctcttcacctgtttctaccacaccacctggtgctggggctgttgaagggagcagctgtgataacacatatagggtgctttgcagaatgcctggcgtgtggtaggtcctcagcaaggaactcctctcctcctccgtcatggcccatgaggcccttgttcctgctaagctgtccagatggcccttgttggcaggccatttccccacatggggccacttttcgatcatcatccagaggcccctgctggtcccctcagtgagcttacagatgtgctgttggtcccctgcgtgggtcttgggggcagactgggaggaggccttgggccatcatgggttctcccagcatctcctccacattccccttcctcctggtaatgggacaacacgcactctttattagggctctcgagtgggtatacagacccccagcctgcccggcctgaccctctccagagccccaggcactcatggctgcaggaggcctatggccctcttccttcagatgcccacagcctgcagctctgctgtccccagcttttggctggctcctcctgccctgggtgtcccagtgtcttttggtgggagtcatgttgtgtggaagtgagcagccaactgggactgggctcataaatgaccatttctccttgctttccaagaggtgtcttcttgtctctcccttgttttcaatctatgactggggcttccattcacagaaatgctacaaggaaaaagagaatgacaggttatcgagcccttgctgtgggctgggccctgggctatgtgccctgggttccagcacgctgcctggcctgtgtggaggtgaaatgagtgagtggatggtagactctttgcttatgtgactcctcctgtgagaggagtgtttttaatcccatttcatggacccagaaactgaggcttagcatggtcagtgactttcttgaggtgacagaggtgggatccagtgctggcatgtgactagtagagctcctgctgttgaggtatggtgtggcatgccctccccacgtctgtttccctgctgtgaacaaacagggaaacaatggggaacccaacttaacctgactcctggggagcctgctgggcagcagctggccacctgcagaggataacatggggcctctgggaagaaggagtgctccagactcatggggactgatccctctgattaagtgggccactgagggaaagatgcctcttcagtgatggatggccacgctccaatgacgactttagaccacttggcatgggaagggtgagaagtgtccaaatgaaaaccatggcaaagagccccaagagctcctgggctttggagaaggggccacagaaggaggctccttgttgtgctaagcctttgaggtggtgctggctcctgccggtccttggaagaagtgccgtggaggggcctgggcttctccgttctttggctttctggcactgtggctggagtttcgctagcgtagcttaggaggacttgattaggtatccctcaggtgcccacagacccaaaggaagtagaagaaagcttgtgggcacatttacaaagcatctgatacttacatgtacatgctccttgagtcctagggactgttgccactgatccagaagtgaaggctcagaggggctccacagcctagcgaggtctgagctgatgagggttccctggctgccgccctttatgtgcctccttgtccagttagcagccgcctactttcttgcccacttgtgagtgggtctattttccaaggccagtctctgttgccacgaatatccttcgtttctcactctgaaagtgcttctcctctggctcaatcttgttttctctttccttacttctttggagtgagaagctgaccctagttacggatattaaatcaaatgttattaaacttcattacaacaccatgccagcccttaactgccacttggaaaagtgcctagagatccttcacatctccacaaacacagctcacgccagccctctaggcaaagaaaagatggtttctaattcaaattcttgttttgttcatgaccgtgactgcacagtagtgatgtctggcgtgtgtgtgtttggttgcagctgcatcacagtttggtgcccttgttaggtaaggctgccattattgactgactctggagcccaaacgtgtttacggcatgtctgctattggaatggcgagttccgagtttcagaaaaccaacttactagtaaagcactgggatacaccttgtttgaaagttgagaactcttattattattttttaaattttggaacattcggtcttgtccagagaattaaaagcagtggctgacaatggtctgggcaatgattttttggataggacttaaagcactggcagcaaaagcaaatataggcaaaagaattgcatcaaactaaaaagcttctgcacagcaaaggaaacagttaacagagtgaagagacagcccgtggattggaagagaaagtttgcaaatcatacatcttgtgaggggctaatatggaaaatgcatgaggaacttaactcaacagcaagaagccaaataacctgatttttaaaatgagcaaaggatctgaacagacttttctcaaaagaagagatatgaatggccaacagatattagaaaaaatgctcaacatctgtaatcatggggaaatgcaaattaaaaccacaatgagatatcacctcaaacctgttggaatgcctattttcaaaaagacaaatgatagcaagtattggtgaggatgtggagaaaagggaatccttgtacaatgtaaatgagtacagctattttggaaaatagtgtggaggttcttcaaaagactaaaaatagaattaccgtatgatcctgcaatcccacttctgggtgtatctccaaaggaattgaaatcggtgtgtggaagggatctctgcacccccgtattcattgcagcactgttcacagtagccaagatatggaagccacctcggtgtccatcagcagatgagtggataaagaaaatgcggtgaatattcacaatggaatactctacagccttaaaaaagaagaatattctgtcatttttgacaacatgggtgaacctggaggacattacaataagtgggataagcgaaggcacagaaagacaaatactgcatgatctcacttatatgtggaagctaaaaaagttgatctcgtagaagcgttgagtagaaaggtgttaccaggggtttgggggtaggggtggatatggaaagtggagatgttgatgaaagggtataaagtttcagttagaatgaaggaataagttttggtgatctattgcactgcatgatgaccacagttaataatgtgtatttcataactgctaaaagaatgcacttttaacattctgtccacaaaaaataaattagtgaggtgatagatatgttaattatcttgattaaatctttctacaatgtatatacagatcaaaacatcacattgtacccccaaatatatatatatataaaattatttatcaattaaaattaatttaaaatgaaacaaaaaagaatgggaaggaaagagctggtgtaagtatgttattagaagacaaattttaaaaaatgactgcaactactactatttcttctgttactactattattacaatgctacagctactgtttattgggccctatcagttgtctggggcttagctctcctacatacattattgctaattctcacaaccaccttttgtggtcctgagtctacagatgaggataccagggctggagaggattgctggccgatgcagggccacagctgatggggaatgttcagatgcaggcccagctggctctcaggccagacccttcccaggcctttgcccggattgctaagatggcccctgtttctgatgcataaagtttgatttgaaagttagtaagtttcttttctcgttaactttgagtcaggatggctaaatttatagctggctgaatacttcccagaggatgagtgtaacgatattgattttagcgaagtgagtcatatgcctactgcctggaaacacaagctcaattaccacaagccaacagcataagctttcccttgtcaacatttttcctacatgttcatgagtctgtggatgtgaacaaagcactaggagaagcaaaggtcacgaataactggcggcgatgcaaggtagggtgccgagagctggccttgagattagacagggccagtctccgtctcagtgtggctgactcatgtggctctgagcgagtctctcacctcgctgagcttccatttccctggctgtgagagatgggttaattacacctaccacccagggtgccgtgtgatgcgtgcaagctccagacaggcctggaggtaacaggctcctgataaatgttgttccccttccttgactgtgaactgctttgccagggctgcctctgagctccctggagaggggggcatgagcttctcttttctctcctggagacccatacttgggtttcatgtggcctggacgaaatacctattatgtgccaggaactaggctgggagtcagtcatgctgaatggaagaggaaggccctcacaggcctggagccctgcatgatgataggattcctagtatagacgtttgcaacttctatgttaactaagaacttcttagttagcaagatggacaggtggtgctgccccggccacatggttggtcactttgggaagctggatatctccacctgagaaaggaagaggggcagcttggaggagccactattccagagttcccagatgccttatcacagtcatacgggggtggaagcactggtcatagagtcagtagaacaaatggaatttctgcattgtgttttaaacttgtttttgctttaacaatttttttatttgtatcattattgattcaaggagaaaataagtgatttttcctagctccaagaagatccaaacagtttttacactggtttagctcattataatgagatcaataaagtcagtgctagtggattaaatattttaaaactcagtttcctataataagcatacagtgaataaacagaattttctataacaaacaggtaaacaagcaagatggtcttaaggttaaaggttatataacagctaaccattgcgctgaaagtaacattgcccaggagaacaagctccttgatttatgaaaaggtagagaggaagagcccgtctgacaagttaagaccttctcctctggcacagctagtgttcatgttcaagatatttcactgatgaatattttccagactttacccatatctctttaacaaatgtaaagggcagcccagggcgttgtattttcaaagcctcatgagaaaagctgaaaaagcattaatctgtggaggttattgctatttaaaaacctgtatcccagccgggcgccgtggctcacgcctgaaatcccagcaatttgggaggccgaggtgggtggatcacaaggtcaggagattgagaccatcctggctaacacggtgaaaccccatctctactaaaaatacaaaaaaattagctgggtgtggtagcaggcacctgtagtcccagctactagggaggctgaggcaggagaatggcgtgaatctgggagacagagcttgcagtgagccggatagcaccactgcactccagcctgggcgacagagcgagactctgtctcaaaaaaacaaaacaaaacaaaacaaaaacaaacaaaaaaacctgtatcccttggttttagtttgtaaatgaaccaattgtgaattcaataatttggggtttaattttgtaaactataatagctcccttttgttgattgctgtttgccatgctctttggaaggcttcatgcaccgcgttacatttagctctcatgacgaccttacatttgtaagagtgtgagacagagcagtgcaaggtcctgcccaaggcccctccactggaagtgacagagctgggatgggatctgggtctgcgtggctctgaactcctcagctataccatctcctgcttccaacattgtgccagataatgatggctatggccctaatttctgaaacaaagtcttatttgagaacttcttagttagcgagatttctaccttagtcttttcactaggtatccagaaacttactaaaaaatttaaaaatcttgtagttttgaacccttttaacaaagaaaagcagtaagggcctagttattataagtacaaataggaaaaatgtataaactacagcttatcttctaaatggaaatacttaaaagacagattttcaatctctttagggggttgaggaaaaaataacattcagattttttgtttgtttgttttagcagaaaaagttcgatcatcgtcttttagcaattcagctttcacattttctctcatctttcttccccattgttggcaagactgtatcactgcacttttgaaaaaaacatatggataattcactgccatttctgaaattaagcatatggttatatgctatggtctaaaaaataaggaacattttttctccaggcagagagagtttgtgtttccttttggatttaaggattggcaatgaattccaagtgagcaagaagccggccactgaatgttctcagcaataagcgcagttgtccttgtggggagaaagagtttggcagtcctgggccttctcggtggtgtggggactgcagtggtatccgtgtcctccttttctgtctaggggttgtgatggtggtccctgcctgcagtctccagatgacccccagccgcttggctgaagcgagtgtcctggggcctctgtgctgccacattgctgctctgagtccctggcataggcacatggagaccaaggggacagccctctgcctgtgctccctgagcagggggacttgctagttggtcatatcacggttggtttctgatcaccaattgtagcttaaaaggtggggtttgtcatgctctgtagaaggctttatgtaccaccttgagttccaggaaaggaaaagaagagtacattttttttttttaggaataccagatttccaattagatcaattcaccaagaagcagttttttggtttacttgagagagtcgtttgtctgctgatctaatgagagggacatagcacaaagaccatcatcttacaagtctgctcatctccttgatgacttaaaaaatctttatttattagaaaaacagtattacaacaaatctgttagtataatttaaaaagttatcttactacccctagaacaattcatttcatttcagtgaatctcttcccagtctttgtccatatcaacagggatccccaacccctgggccacggactggtacctgtccatagcctgttaggaaccagaccacacagcaggaggtgagcagtgggtgagtgaacattcccgcctgagctccttctcctgtcagatcagcagcagcatcagattctcatacgaacggagccctattgtgaactgcgcatacgagggatctaggttgtgctcttcttatgagaatctaactaatgcctggtgatctgaggtgggacagtttcatcccgaaagcacccccatcgcaacccctggttcatggaagaattgtcttccacaaaacctgtccctggtgccaaaaaggtcggggactgcttcgtatcaattcccattttatactcttgtagttgaagaataggaatcaagcattgtccatcttgccaaagactgctgtttgtgattccagttttcagtggcttttcagcatcccatcaggcagaaaaccacatttgtcttcactactcccctcaggctggaccgttagggtgttgtttacagtcccttctccatacgggttggatggcctaaagcagccagttcttgacaacattgtgctgacacaagagtgaccatgaaaatctcttgtgctatctgcactgcatcttgtagcaaaatagtcaaggggcttgtggagctcaaagaggtatagattcttcatttacagaaaagcaagtatttctaaaattttctctgttgataagtgactaccagttttaggcccctagaagatactagaaaaaaaagatcaacacactttattatccatcatggcaaatgtgatgcttgaacaaagggtgaaagagtaactactttctaaaaaatttctactatggagagaacattttgaaaacagatgtttttgtttccattgttatgtgatttttgttgccaaaaatgatctgtcacctattaaaatcttgaatatcttcacccttaacctgggaacagtgtttttctaatctgttttaaaatcctttaagtgaaaatttcagtggattttgagctgggtggttacaaatatgataatgcaattattaacctgattagttgcaggagccattatttgacattagggaaatggggctttactagcaaaatgttcacaaaatcctttgcttcgatggtggataaaagtggaaaatgtccgggcagcccagctttgcaaaggctctcgtggctctgcaggcacctggcatgcaccctccccattgccaggatacccaagaggaaggtcagctctgctgaaggggccaccaaggaagagcccaagaggagactggtgcagttgtcagctaaacctgctcctgcaaaagtggaattgaagctgaaaaaggcagcagcgaaggataaatcttcagacaaaaaagtgcaaaaaaaaaaaaaaaaaaaaaaaaaaaaagggaaaaggggagcaaagggaaaacaggccaaagtggttaaccaagaaactaaagtagagttacctgcagaaaatggggaaatgaaaactgaggagagtccagcctctgatgaagcaggagagaaagaaaccaagtctgatagaataccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgctttttttttttttttaagaggtgaaatcatttgctggttgtttattttttggtacaaccagaaaatagtgtgggatattgaattatgggaggctttgactgtctcgggtgtcagcttaacattccatacatggggggttagtttttatatcctataatacaaagcatgttaaatggccatatggagtcagtcctgcatttaacgtcttgaatgttttaaattacttctattcccttgttttttagtagaattgtttcctaaagaaaaccactccttggtcattgctctccctgtcagaattgtgtggactctgtaaatctttggttgtggtagtcctgttttcctaataactttgttactgtgctgtgaaagattacagattggaatatgtagtgtaggtgctcttcagttgtgagctggtgggacgtctgtaacagctgatcagcatgtgaagatactggtacttgatagcctcttaaggacaatttgcttccaaattttgacctggaaagtcactggaataactttcaaaaataattacaatacatggctttttagatttttgttacatgtgttaagaattgtgtacaaattgaaatgtctgcacgatcctcaaccaataaaatctcaattatgaaagagaaaaaaaaaaaaagaagtggaaaatgtctcccatgtggccagtggtgaatatcttccatctaggtccgggcatctctgcgtgcaagaaactttgtcggctttgatagagttcagtggataaactgaacctacttgcaaccagactacattcaaataactgaatcacaaaaagttccctacattaagaaaaatggaagcatattcaattctgttgctctcactaaaaatagtattacataactcagatgatttcagagaggttcattgattctcttaataagggtatattaaaatatattttaaaatattgacttttatccttgcatcatcctttaaagagttctatttttggtttttaaaaaatgtttataatatgttggtacagaggcacattattcaacttaacacagatatctatatattggtggtatgtgccttaggtttttcatggatggggcgtactgtcaaactataatagcttggagaccatggatctaggcagattgggtctgtgaaagccttctgctgggactgtcatgagtactcatgtgactgtcatgagtactttcatttccacacctggtgagctggtagagcccttcactaatgtgtgggggtcacagaacacaaagcagggcaaccttttgtgctttctgaattgaatgagcaagtgctgcttcctgggttcccgtgagtggaaatgatgcttgagacctcggtgtcttcatggtcttcttcgccaccagcttcccgtgtccctaagtagcccactgctcagtcccatgggggagtttctacgggtacaaggcagtcaaggttcttcctcctgcgctgtgggagcccttgtggcacctctgagcgaagcctcctccatgtttctggctgggtggcgtggggcagctgctgtgcctggtgtgtgagccctgcctgtgggggacatatacgggggtggcactcagagactcccacagtgagaacacctccccaaggccagtctgccttcttgatgcagtttcagatggatgaggtgtggacagacaagaatgacagccagtgctctgggacatgggggctgcactgggcagtggaaggaggaccagctttgacctgctccaaatgattgatgtttttgaagtttatatagcttacctctaaaagatcatagtgataaaaaagacgttttccacaccatacgtatatatatgtacatacacagacacttacctaatgcacataaatgcttgacaacagtttatgatgtatttataaaggacaaggactgcgttgtgtcctgtagagccagtgagacccccaatggcccacaccaccctgtccaatctgtgcttgggccaccatgatggccactctcatttatcgcccagcatctcaggccaccccacctgccatgctccatagcaaaccattcatccattattataaagtggctgattctgaaaagtatcaccttagaacaatcctgtttttggtttttagactcccagataaataatctactgtattaactgtagagccttggaaatgttccatgacctccctgggcttggtttttggctgttaggtgggcatagggtcgttgcatggtttatatgagctaatgcatgtcatgcttacagcaaatgtgaaaggtgcactcatcaatccacccatctaagctcagcccagggggaggggatgttcagctagtcaagggtgggctggccagagaaacagagaataagggcaaatcttgctgccaccgctgtcatatttccaaaaagtgtccattgggctacatcgggcccaggggagctgtgtttgctatgagccccataccagatggcatcttagttttaagatatttgttttgtgacctaagtactttctaaccctctcttctctttttgtgttgtaggaacccagctatttagtggtcgaagtgactttagaatcactaccttgaaattccatccaaaagaccacaacatctttttatgtggaggcttcagctctgaaatgaaagcttgggatataaggactggcaaggtaatagccatattcctaacttggcctttccacaggagagcttgtttcgacaatttgaataattgggggcaggtcagcatctatatataggacccttgaggtggaataattaccacttaatatttaatcagtgctaagcataatttttagatgttttgaaagaacattcttgagttgtcagacttaaaatatcaaaggtgcaattttatgcagcatattactaaaaatatttgttgaacacctactgtgcacaaatgcttccagatgatataaaatgaatctgctgggttactcaagggaataatgtgcgggtacagatgactttggtacagagaattggtgtgtgtgtgtgtgtgtgtgcgtgtgtgtgtgtgcgcacttgtttgcatgcttgcgagaggaagggagggggtaagtgcttttagcttgctgtgggaagacttcttagaggaatcacttttcctcagtcttaaaggctggttgtgatttccatccccatcctttattacaacctgctgtgccttttaccatcaccacttactagatggcagctccaccctagttgttcaggccaaaaacatcagaattagccctgtctctgctctttgcatcacattcccatacccaaaccattagcaaattctccaaaacttggacatttttccccacatcagctgttgtagctctgctattgtctctcgctgggatggttgcaggagtttcccatctgatctctcactttcccccttgccccttggaggctgttctcaacacagccgctagactggtctgttacagtgtgactcagacatgtcactcctctcatcagaatcctccaggctctgatcttacagtaaaagccaatgtctctgatgatccacaaggcctaaatgatcctccttggcctgggggtaggtcagcatttctcatcagtgccagccccactaggctccttgccttccctgaacataccagcacattcctgtctcagggcctttgcacctgctgctccctctgcctggaaggctcttctgcctgtttcctaagtagaggcttgctgccccctgtcatggggctctgctcacatattacctctcggtgaggtgccccctgcccaaaacccactagcatccgctagtcccctctgctatctcatttctctccatagcatttaccatcacctgacatattatggattttatgtgttcattcatctgcctgtttccctcctctagaatgtaagctctttgaaggcagagagttttgtttgctgctgacatctagcttctaaaacagtgcctggcacatagttggcactgtgtgaatcatgattgactgagtaaatgccagaggaaggcagtcatgcagacagggcagatacaggaggtgggaacacaggatgtctatggggacttggctaggcgtgggcttcacacagcgaggtggcctgggcagagagtctttcaacgctgtgtgtcttggtctcaacagtggggagccacgggaggtttgtgaacatctgccttggtcctagacaggtgcagcgtccaagcagatatgtcctgagtagaggctgtccatgtgttccagagggaggagggtgagacagagcccccaaggcctagattccaaatttgccttcttgcttcagactggctggcaccggaagaccctttcctgacaggcagttggaaggggctgctggtttgttgaggagagcctaaatgcagagacttttcttgacagagaatgggaagttttgtctgtacatgagatcttgcttaaagtactcacaagtgggagcatagatagatgtagtctttaaaaaaaaatcacacatttttcttttacaaaggaactttcttataaaaatatttggaaaagggaggaaattacccataaagaagtggacacagtggcattaaaaaaaaaaaaccgccaaaacacgttatatttaggatctaaatacatgacaagtgaaagaaaacatttgaacgtgccttgtgaactggaaactcttagtcataccgtttgaagtgggacctcctgagcacccagccactcctgacaaccacgtcccttatgggtgcgcttactgtttttagcctcaaagaccaaacacgtaagaaattactcaccaaggacgccatctgatttaagcatttgttaaaaataccggattttttcccagggcagatgccagctgacgagctctgaaaatgctgggggagaagcaattagaagcagatgttgctgtgactggtgttggcatgtttgcgagtctctcccaagatagtaatgtggctaagggatctgtgcagtatttgtttttacttcctttctaccaacaatcctcccccactgggtcacggggctcgttccgtttgcatcagttgggctcaggggacaacactctttcctgcttagacaggtgttgcccatgtgtctcaaatggactcggcaggaggaccagggaggaggcacagccccctgccctccagggactcccgcctggggctgctcacttcttatccctgtgggctcctgtggcgctgtcccaggtgctgaaccttctggctcagcctgggcgtgtatgtgaacatccagaagtgagcagcttggctttttccagctgctttcagggaccgcggtgggaatcgcaggtgtaagtaggagggacacagaccttagcttaaaccaagacaggccttcccttttaaatacagtagggaaggaatgttttgttgtaaaagtaatacagaatcatatgataacattgggaaattcaggtaaagagaggagggggagtccaagcagccaaaggtaaacattagcaacattttgatattcttctttctgtttttttttcctcttgtggtttttaaaaaaattataaaagcactatttggttttatttgtatacgcaattttgtgttttgcttttcatgtagcattagaaggatattctttgttagtgcagaccctcgtaaggtcgtcagtcatattcctttgactcagggtgttcctgactcactgccttgcttctccccaggactcagaacaatgtctggcataggcaggaactcagtaagtatctatggatcaaatgaatcagatgaatgctttaacatattaaaccatttccctgcattagacatgtaggagatttaaaaaacttttgccatttaaaattaatagatgtgaggacagagaccagcagtcagcaaactatagcctaaggctagtccagcttgctgccagtttttgtaaataaaggtttattggaacacagctatactcatttatgtatcatctgtggctgcttttatactacagtagcagagtggactcattgcaacagagaccacatagcccacaaaaccaaagatatttaagatctggctgaccttggtaaagagagatgtgattctgacatctgtcaccctattgattgtcaggactaatcctcctgagctggctgacaagttgggtgtcttaccccattctgtgttccttgcagaaaccaggtgctcagagaatgtgttttccaagtgggaactgttccttcagtcaggggtgtataagttgtttctctctcttgttacaatctccaaacaaactatcaaggttgactttattacacattccactgtaagaaacatctttttgcatatagctttttccacatttgggatttatttccttaagcttgaatctcagaatgaaaatttctgggtcaaagcaagcctacattgtgaaggtaaggagtaggtttctgccaacagaactgaggggagtgaggccagacaacctctccctgggatcttagggcacagtgagtagttggaacatacaactttttagttactttccagtcatgagattttatgattccttaaacgtagccaagtgctaagtgtcaagattctggacttctctagtctagcccaattcattacagcaaatgggctgtttggctccctgtctcctcttcttggtgatcttgggtgatctctccgcctcgggtttgatgtttgtagcacatctcattagtgcaaagtgcctgacttcatctccagaggtcggcaggatgtgttctgcacaagccagctgtgcgtacttacttgaaactggcttcctgccgctgctgcagcatcctctgacccctcttcctcccagcagtctgcttgaacatgggtgtggtctggaacccaggatgcctgtggtctgacctttatagtattgtgagggtcaatttctgcagaagcccctgagcctctagtgccgttggcctgagctgcaggagacctgggctcacgtcctccctctgctacttgcttggctgggtgatttcggccacattccttaagcaaaagcctctctgattcacaatttttaaattggtatcgtaaagtggcaggccaagccacgcctccaaagtagcgtttctcaaactcacctgtgtaggagagcacctgggctcttgttaggatgcagattctgtttcagcaggtccaggttgggataagatcctgcatttctaacaagctcccaggaaatgaaggggaggatagtatatggaccacattttgagaagctagggaccaaagggcctctgaagttaaaagtcccttgcttctctcatttgaaccttatcctcaattagcctgcaccatctgtgacctatctcagggacaacgatcactcttgatctgtgggcacttttatccacaggtgtttatttacagccgcttggtgtgggagcctgagtcacctctgtgcctggcatccccgacagggcctggaccagagcaggtgttcaggataacctggagtgagctgatggggtcagccgccactgtcattgtgatagaggcctgcaggagcacccacctgcccacaacctcaggggcagtggccaccctgggatcgacatagagggcatggcccctctgacaaatgggatatgaaggctagctggaattcagctgtagtgagtcattccagaagtgtggacagaggcaggaggacttgggagaccctgtgtcagatgagatatggtgtggccatcaaagcactgtagttctccactgaggctgagctcctctgctccccggtgtttggtggataacagagttatgagtctcttgcatttccagctttgcggtgctgtggctctgtgcccagcacagaatggaagctgtagaattgcaggagaagcctgtgacacggactcagctgtactgggccctctagcagtgtggggaatgttccaaggtagagccactttcaagttcactttaagatgactatgtattttgaaccaaaagttaggataagtaataaaaataaattctccttttgtaatatgaatcagatttgttaagaaagcttatatagcaaatttggtgaatcaccttttttgcaggactacattatggaaccccaacctcagcaaattacctctcagttaaggcaagattgaacactggaaattggagcagccctggaaaatctaggacatgtggctcctgcagctggcagcctggactctgccccagttcctcctctctttctatgtgcagggtgacattgggcaggctaggggtcgagtggttcttttgttgtctagctcctactctgcgcctgagaaaaagagttgcagatgcattcagatctgccaactttactcctccagagaaggctgcacctctaaaaccccgattctctgctcgctctgggactctcatgataaaaccagctctgacaggccagctcactttctccagcataccctggtgtcacattgacactaatcgtcaatatttcatgcttgttctacatcttttcttcctacttttattattatttttaaatttgtaaagggacattttgacttccagatcttgacttggtttcttgacctccttctctagctttgtcccacaccctctgcaggcacgtgtcctaacatgcaggtgacaggggagtgggtggctcacccttgggcctgtgtgggccctcagctcagcttcctatgatcctagcccatcactagtatgctgtagcattctggtagcatgtggactccctgagggaaagagttgtgcctcatttaccatggtattcccagcatccagcatagtgctaagcacatagtagggagggaggggaggcaggaagggcgcaaactgtcgcatgaatgactgatagctctaatcaagaccagttcttaaaatcacaagcaattatcctggccagttgaacggaggctgagccactgtcattaatttgcttatctccttcccctcctgtgggcatccttccttggatgggagtgatctcaggatgatagtaataggaactggtaaagcagcaggtggtggctgggctggcctgacctgactgatctagggcacgggccagagctacccagggagcattagaaactattgctgcccagggtggcctaggcctccaggtttttgaaaactctgcaggtgattctaatgtatagccagatttgggggccatggtatgggtgcctagtgaaaattcagagtggtttctgtggggcttctgccccagtgggtgagactgtctttgagatttgcactcctgtgatggtggccatctgagagatggcttcgtctacttggctcaaagtgccatcagttttgtggcattgtaggcaagttgcttatttgccttaatgagattttgattactctccatttgtctctttcatctgttttatattaaaaaggctttttatttggactttttgtgctttccacagtcctgactaagctttgctgcaagctaaactttgaatgcagatgagagtaggagcctaatggaggcaaagatgtaggacccgaggctgttccttgtctttcttggctcccatttcctcatctgtcaactggggacgtggtggagcccctgatgatctcgagagcccctttcagcagccagtgctgaccacagtgtgcctcctgcaggcatcacgctgtgcacgctgtgtgcgccatggctcatttcctcgtggcctcttgggaggtggactgggtgctgccaccatccccttcctctgtcagggccctgaggctcggaagggctcagttacacaccacaagcacacggccagttggtagtggggcaagactgtgaactgggggtggtttgatgcccaaaccctcacagatcctcttgttcacagtgtgaattcagctttagtcttgaatgaacatacagtcatgcaccacataatgacgtttcggtcaatgtcagaccatatataggacaatggtcctgtaagattatagtgaagctgaaaaattcctgtcacctagtgatcacctgcagtgttcagtacaatcacatgctgtccaaatgtatagcctaggagccataggctagacctctagcttagatgtgtcgcaggctataccgtcgaggttcgtgtaagcgcatgatgttcacgcaatgacaaaatcgcctgatgacgcatttcccagactgtatccctgtcgttaagcaacacatgactaaatatttatcagtgagggctgtgcgttttgttcttggagaagcctgcatggacagccctggcattcacatgctcactgagcactgccatgtgcagctccgtgcctggtgtcaggacctggccatggatgggacagtggtgggttttgttctgagggaccacagccctgtaacctcaggcctgaaaacagaacccaacgtatctgtgagagcagccttcctgcccccaaaatattggcaaggaaactggttctgaaaggttcagctgtctgtgcagggtaggcagccattgacgggattggatctgaacccaggtcttcctctaatttctgcttctccctattgcaggaagaggacgcatttcatttatccatgtcacaaacattttctgagcccccaccagaaaccaggcattgtcccagggcatggggcaacaaaatccagttagatggcgcatgccctaaagctgtagaagggactgctgaaaacatctgtttctctcaatattcagtggatccatcagcttcactggctgccttcacaattggctggggagtccctgtgtgttccctgggttgtctaaagtcttaggcagaagtgggcaattggttcccagaatctggaacctcagagacctgccctgcaacccagtcctcctcttcagcctccctctgcaccactttcactgggactgtgtaagaagacccctgtttaaaacccatgagctgccaacaagctcagtggatgacagtgggaggcccatggcactcaagagggcgatgttccaagactttcattaacacccaccccacttgataatttttgcccttaaaaatgcagcaggcagtttcagaaaatataaagcaggttctttggacctgtgctgattctataaatatgatgtttctgtaattctaatttataaatcttctataatacatattgccactaaaataagctctgtgctgcactgaacatgcttcttcttaaggtttttaaaaatttatttatttttttttactattgatttacaattcttgtacttgaaaacttattttagccttgccataactaatagtgtccaaaaaagtcatgggcttgatgccttagttatttttttgtcttaatatactttaactaaaaaaatttctttagagacatggtctcattctgtcacccaggctggagtgcagtggcattatcatatctcactgcatcctcgaactcctgggctcaaggtatcctccagcctcagcttctctagtagctgggactacaggcgcctgccaccatgcctggctaatttttaaattttctgtagagaagggtctcactatgttgcgcaggctggtcttgaactcctggcctcaagcgattctcctgcgtcagcccaaagtgctgggattacaagtgtgagccaccacattgggcctaaagtaaatactcattaaatgttttttggtaacagatttattctgtattgtacaactcactcattcactcattcactcagttcttagtgtgtttgcagggttatgcagccacagcagtcggttgagaacattttcctcaccccaaaaagaaaccacgttttttagcagccatgcctatccccccagtgccccagcccctggcaaccataaatctactctgtctgtatagatttgtctgttatgaacattttatataaatggtcttttgtaactggcttctttcgcttaacataatgttttcaagattcattcacattgtagcctatatcaggacttcactcctttatgttttttttaaaattagactttattttttagaggagttttatgttcacagaaaaaatttagcagaagggctagagatttcccacttgccctctgcccattcttatgcacaacctccccataatcattctgcatcagagtggcccatctgttacagatggtgaacccacagtgacacatcgttgtcactcagagtttatagtttacgttagggttcacttttgatgttgtacattctatgggtttggacaaatgtttaatgacatgtacaatagactgactgtttgtgtcctccccaaaattcatatgttgaggccctaatccctaatgtgatgatattaggaggcggagtcattgggtggtaattaggacatgagggtggagcccatagaactggggatagtacccctgtaagaagagacacgagagagatgaatctctctccaccacgtgaggatatggtgagaagacagatgactgtttgcaaacctgcaagagtgccttcaccagacaccagatctgtctctgttgagatatcctcaagctcaaagattctttcctcagctgtatccatgctactaaactcataaaaagcattcttcaatttttatttcttgtttttggagacagggtctcacactctctcccaggctggaatgcaatgctgtgatcacagcttactgcagcctcaatgtcctgggctcaagggatcctcccaccttggcctcctaaaagtgttaggattataggcgtgagccactacacctagcagtgcagtgttctttatttttgttacagtgcttttgatctcaagcagttatttttggtcttttcttagaatttctatctgtttgcttacagtgcccttctgtttttgcgtattgtctactttttccattagagcccttagcatgttgattatagttgttttaaatttgcagcctgataattccgtcatcactgccatatttgagtctagttctgatacttgctcttcaagctatgttttttgccttttattatgccttacaattctttcttgctagccagacaagatgagctaggtaaaaggaactgctataaaaaggactttagtaatgtggtgtagtgtcagggtggtggggaagtgtcttgtggctaggttagtcttttagagagtctgcttctggactgtgagctcacatgtacttcttagtcccctctcccctttaaataggacaggacagctagaatgggctggacctgggtgttttcttcctccacatagaaggctagaggggaaggaattgggcgtttcccttctcccatgtggaaggcgggagccagtggcggttgggtattccccttccccaaggtcagctaggctgtgataaacccagcaggttagactctggctaactagtttctctgcagtacagacctcattaagagcagaatgcactttaggaggctgaggcaggaggattgcttgaggccaggagttagagagcagcctgggcaacatagcgagatcatgactctacaaaaacaaacaaacaaacaacatagcaagatcctgactctacaaagataaatacataaaagaagaacagaatgctctgttatattttaaagtagttctggctgggcgtggtggctcacgcctgtaatcccagcactttgggaggccgaggagggcggatcacaaggtcaggagtttgagaccagcctggtcaacatggtgaaactctgtctctctactaaaaatatgaaaattagctgggagtggtggcaggcacctataatcccagctacttgggaggctgaggcaggataatggtttgaaccctggaagcggaggttgcagtgagctgagaccgtgtcattgtatccagtctgggtgacagggtgagactccgtctcaaaaacaaacaaacaaacaaaaaaaccaaaaaacccaaagtagttctttttctccttctgctggaaacataaggggattttctccagtcttcactgtgagaacctggtagctcctggaggtaaaatgcacaaaattttgggggccactgatgatcaggtcttccagagtttttaatctctctgacttgtccacaatgagcctctagcaatttgtcaattataattcagttttctggccctggttcctgtggaaatttctgctccaatgcattgtgattgtttattcacctatctatgtctccagttttgggggcagtggtttgccttacgatctcacttcttttgtggatctgagaagagttttccagtttgttcagctttttacttgctaggacagagttttgatttataagctccttacctgccagaccattaacaggaagtcttctgcttctttttatgaccaaataatattccattgtatggatatacacattttgtttctccattctctaggtgatggacgtttgcattgtttccatttttggacatttgtttgtaagtctttgtgtggatatatgttttcatttctcatggttcttcctagaagtagaattgcaaagtcatatggttggtagctgtttttatgtgtaatcttttgagaaactgctagactgttttccaaagtggttgcaccattttatattcccaccaacaatgtgtgagggttctgatttttccatatcctcaccagcacttgttcttacttgtcttttatattatacgtatcctagtgggtacaaagtggtctcgtttgatctctttgaggtttgatatagaactattcagattgtatatgtcttcatgagtgagacttggtagttgcatgcctcaaagaattggttcattttatctaagttgtgaaacttaatgtacatacactgatttgtaatattctctttttcttttgatatttttagagcctgtagtgatgtctcctctttcattcctgataatggtatttgtgtctttttactcagtcattgtgactagagttttatcaatcttactgatcatttcaaagaaatactgattttctctattgtttttctacttccttaatttctgctccaatttttattttcttctgtctgcttgctttggatttaatttgcccttctttttctgatttcttaaggaggcaagttaggccattgatttgagatcttttttaatataaacattttaatgctacacattttcctctcagcactacttcatctatatcccacaaattttagttataatatactggctgtattttaattttaatccaattacaaatactttctaattttctttagactttctctttgacatgtgggctatttagaagtgtattgttcagtttccaagcatgtggaaacatctggagatttgccagatttttctttttctttttttctttaattcttttttttttttttttttttttttggagacagagtcttgctctgtcccttaggctggagtgtagtggtatgattttggcttactgcaaagtctgcctcctggattcaagcaattctcatgcctcagtctccagaatagctgggactacaggcatgtgccaccacgcctggctaatttttgtatttaatagagatggggtttcaccgtattggtcaggctggaagatagctttctatcattaatttctagtttaatcctgttgtagtcagaaaacatactttgtatttcagttcttctaaatttgccaaggttagctttatggcccagaatatagcctgcagtgttgaatgttccatatgctccgtgcattttgctgttgttgggtggagtgttgtataaatggcaatttggtcaattggttgatgacggtgtctgttcttttacatccttgctgttttttaatctacttgttctttcagtgactgagagaggagtgttgacatctccagctatagttgtgaatttgtgtatttttctcttcagttctgtgactttttttgcttcatatactttgaagctgccagcacagctctactacagtcctcctctcaggtcaaagctgttagaaaaaataagaaaaaagaaacaaaacaaaaacaaaaacaaacaaacaaaaaaagaaatcaagttcccacctctgtactagtcacttctctgagtttctgtctctctctcacaagccacctgctcttgtttacttttcgagtcctcagggagttgctttttgtattttgtccagaatttcagttgtcatcagtggagaggtgggctgcaggaggtgtgctccaatttagcctcaggtcgattttgaacatatttttctttttcccttgaatttcccttctttttggctaaatgtcacctgtcctccaactctctagtgatgtctcctctccaggaaattttcccaagcccgactggattgtgtgtccccctccccccgccaggtgatgctgcttccacagctcgatagcctgggttgtagcccctggttgtcccccggtgggatgcgagccctgtgagggctgggagacatgatggtcttttccaacctggtatccccagactgtgtgtgtgctggcatctggtcagcagttcattcactgtttcttgaataagtgattgtgccaacctccatggacctgcagtataactctgcaaagattgtatgactttaggaaagtttgtgcaattcaatttgtgccccaacaaatagattcccagtttcaggagtgtgttgatggctgtgtgattttaagcacacggatgttccatgtaccctgtcagtgggcaggctttcctggcagccacagccttttctcacacccctgagggaagactgcttggtgcttctctgcaaatctggcgcggaggctgcggagggagatggatgtgctgagaggagactgagggccacgttccgtaacaagcgggccattgccacgcccagttcagaagggagatgaggagtggatagctctctttcccctctgcatgccccttttccaccaaacagatttcttggtttttaattacagtctttgtcttgaattttttcttttttttcaaaaaggtcggttttctggctcacctcactcatttgctcattgaacactgcggagcacctgctgtttatagggtgtcttcctagtttagaggattcagagaagctgcaggaaatgtctcttgccctgctgctggcaccacctccacccagttggtggcccagccagaaacctctgcagcagctttagggtctcccttctccaccacctcagtccctgcgtcctcctcttccagggccaacatgtgaggttgtgcagtctgtacagtgcagagaggcaccttgctgagggataggtggggtctgtattccattccaagccctgctggccaggccacgcccctgatttggaatggtttctactcgaaggggtatctttctctaataggaaccaaggtgccatgcgggccagtggcagccctgtccctccccttctgtctcttacttggcctgagtggggctgtgagccgatgagagggcttgtcgtggggtccccctgtgacttgggtgcaagcagggtgtaggggtagaggcaaaaaagggccttggagacctggagacccaagtgctgcccatgacttcagaatggagggtgaggtggttgttctctagatgttcgttttgattagaaaaggaatacatggtctttgttggctacttgggaaatggaaaaatataaagaagataacccattaaacttcaacccagccataaccaccactgacagttggtatccttcattcaattgttttatgcatatgtatttacatttttatataattgtctttcagcttattataatatcattagaatttcccatattgttaaaaggtttttggatgctataatttttaataattactcaatatattataccaagatgtatttaaccagccctctattgttgggtgtttataagatttccagtggttcccttattacaacactaaggcaaacttctctgcacaataattcttaaacgcagaattagtcgaaaggtaagcatggtttttaggttccggaaaccactgcctgcttccttccagaagtggaagtgccagctaaccctgaagaatgggttcatttgttagtttgcttgttttcagtgtaggtgagacttatgcatgttcacctgcatcctggaggaaggcactggtgcagagagatgggctggaggtggggtggtggctgagggagcagggtgggtatagggaagaaagccacctccttcttgagacaggaaggaagtggggctgggagatagagcagacgggccacaagaggcctccttccttccagagctcctgtcctgggctgtggaatgggtcccagggggtgaagttcgctgtgttctgctttgctcccagtccttgctaatcagcccagccaagcacctcagaactcaaaggggtggccaggattcactgcacacctggtgaatgtagaattcagtgtttggagtcaggtgggatacaaggactggaaattgacaccagatagctctgtctggtggggagacagagctgtccctgagatgggggatggtacaagcattgggaaatggtcttgcagcctgcctggccccgctccacccagaggttccctgggacctggttgctgtcttcctagaggtgccacaaccctcctcccctacttctctcttacctgctgcatcctctctgtgcaccaaggaggagggccagcctgactggatggggcggctccctcctagtgcattgtgtgtgcccctggtgtggacactggaggggcccgagagtggggtggcttgctcactcttacttctctcctgctgcggttctgggtggttcaggacctgcgggggctgcggggaaggccctgccctaattcagtggcctagaggcaggccagctcgtctcttctgctccttcttccagggacccgaggagggtgaagtggctctggctgtggagggtggagaaggaggggtggggatggtcagatggaggcatgccgggcacggggcattctctgtggcccagcccaaggccagtgcaccacaaagtggccttttttggtccctgttgaccctgtgcctcattagagagatagacccctcccctcagtgccctagttagtttctctggggctaggcagggcctggggttttggggccccccacagttttgacgctggctcagccaagcgagcctcaccatctccatctctgttcagagtaggcctgagcctctgtccattgtcctacgtggcttctttggggttgagggtgcgtggaggaggcagctgcaggtggtactgcgaggcaggggcctgggcttttcagagttgggctgctcttgggggtggctgcattgttagagcctagttttaatttgtgcctccgctataaagtaagggaaaccaatttttcacttgagaggatcaacacacaaatacatgtgtaattgtctatttctgcttttcttcctttcccatgtgttttgtatctgtaatttaaaatttcacagtcttcaacatgacagtttctctgtgggtatgtttagattcaattagattcaattcaaattcagcaaacactaattgagcagctactgtgtgcaccgggcgacctggtgtagtgcatggtacagaggggtccggcttgaatgtcaggccatggagtaggtgtgacagtggctctgcctgcacctcgcttcatgattgtgggcagggcacttcacctgtctgacctcagtgtcctcaactgtacagtgcagctggcgagcccaactttcccaaagtggtcacgaggattaaggaggtcacatgtaaggcacctagcaagacagatggcacttagagtgttcaataaatgctcctggccatcttgatgtcttcagatgatgatcacaacagggttgtgccctccacgagctcatgataattggccatcatgagctgtcttcagttttgctaaaagtggagcagagattgtaccttccccccagccagacagcatacctggccaaaacatcaagtgcctgtgctttcggctgaagatgttctaacccagtgcgataacaccggtcatctcaggctgatcagaagctcagatacacattctcccatgtctttgattaattttttaaagggagaagtgaattaattattgctgaataagtgtggacactcaggatgtgggggaaagaacctaaaatgggaacttaggagctgtcactgtgggaacccctgtgtaagccaccccaggagctgtcagaggccctgtgattcccacatggcaacaagccagtaaataccctccaagacagaggaaggtacagctcagcccttcctgatggatggagaacttgaggaccagagaatgggggcactgaatgtgggggctcacaaaggccatttgggccttttccttggaggaggatgctgggaaatggtccctcaggcaatgcagagaggaggatggtgcagtctgcctggagctgtgcagcagacaagggccagcttcatctcactctccaggagccccagggagccctccttccctgtccgctcctaccaccctttggtggatcctattccccatccctccccgggtcccgtgacctgtccccagacagctctttgggctgtttgatggggctcacacctaggaaggctgtccttggaggatatgttctgcttctgttggaagtgcctcaggcatggccccttgatagttgtgggaggtgcaggcagagccccccactgtggtggcccttgccctcccactcagctctgagcctgatgtcatccacctctgtacattgtccgagggacagtttcataacttccctgcttaaggggaaaggccttaaggctctcatgagccccccacattcagtgccctcattccctggtcctcagtttccccatctgccaggaataggctgaactccatgacctagcctgtgtagagcacaacccccagttgttagctgggaatggctctgacgaggccttcctgctgcgagtagtcagctccctctcctggagctgggggagctgggggacccaagacactcacaggctgctccccacctgccagctccagttccaccagtgtcctggagctgctcactttagagttcttcattaggggtcctatagacacttgctgaattaaccactgcatggccaagtggccacggcgtgggggaacatgaggtccctccctgcatggcgaggggaggagtcagtctccacagagtacatcgtgatgggaactgcttgggggctaatgaaagactcacagaagaaggagctaatgattttgcttgccacattgggaggcttggctggcagagggtttcaaaggatacataggagttttctaggcagcaagtcaaggtagggtattttaggcataaggaatgtataaaggcacgtaggcactaaagggcacaacatatgagggaatggtgagggttttttgttgctggagaacacgcagtgtgtgtctgtgagtgtgtgtgtctgtatgtgtgtcggtgcatgtgtgtgtgtccatccatgcatgtgtgtgtccatccatgcatgtgtgtgtgtctgtgtccgtgtgtgtgtgtgcgtgtgtgtgtgtgtgtgtgcatgcgcattcagaggagagttaggaaacaaggtcagcttggctgcccatggtggccagtgcagggcctccaccctggccatttttaggttgtgacccagagctgaacaccccaagggaggctttagagataagggagacctccccagtcacgcccagcatgctgtcaccattgcctttaaagcgtgtcccctgggagcctgagccagctcatcagttacacctgaatataaaagggaaaggtgtcctccccctgccccccgcatgtggttattaaagcgcgccatctttaagcctcattaaggagtgttaaatgctaatgaatttagagagaggggtgtcttggggcctctgtttccttggaaacatttgaaagcaggtgctttataatgagctgtacctatttaaaagtgagccgtgagggccactttgataagctggatctcagctgcagatgggcaagtgtgaacaaagccagtggaggccagtggagacgctttgtgctctgtgaaatatcatttctctggtggtttctatagaaaccactggcacctaggtaggagaattgccgggctccccggcttcacttacacatcacaaccttgtccccagccctggccacctcagcccccgtccccgaagactgctggattcccgttggcagagcggggttgggttctggacagatgggacagatgcatgctaccgcaggtgtaattcgctttaattatgtctgttctgtacgcactgcttgatttcagttggtcccacctctgcttatgatttcaggcccagctgataagaagaactaacatttgtggagctaattcctcccctcagagcactttaaagaaactttttattattgaaaaatgtaaatatataccaaagtagaaagactaattaatgaacctttatgcaaccagcatcctgttttaacaattataaaattatggccatgcttattttatccataatcctacccatttcccaatagtctccaccctcctcaccctcaccactgattattttgaagcaaatcccagacatcctgtcattttatttgtaaatacttttgtttctttaaaaggtgtgggcttaaaaaactgttatcccatctagtaatttggcaataattccttaatatcatccactctctaatccatgttcagatttccctggttgtctcataatttgctttaaacagtgccttgttcaaatcaggaccctaacatttgatttctaagtctcttaagtctatagatttctttcctactttctttttcttataacttatttattgggtaataaatcagttatttttcctgtatctttcttactgtatccctctgatgtaatttaacacattcctctgttccttctgtatgtcttatgaactggtggtttcatcttaaagcaggtcactgggggagcttgtgagtctgctgctgcttccaaggctcatccctattgtatgtatcagcattccttgttgctgagtcatagtccattgtatggacataccgcagtttgtttatccagtcacctgtggatggacgttttgagttgtctccagtttttggctgttatgagtaaagctgctgagaacgttcatgaacaggtctgtatgtgaatatacattttcctttctttgggtaaataactgagagtggaattgctaagtggtgtagtatatatatatttaaatttttaataagtcaccaaactgtttccaaagtggttgtaccattttgcatttccatcagcagtgtgggaaagtgtcagttgcctcacattctcaccaacacttggtgttgtcagtctttttcattttagttattttagtgggtgtgtagtagtatctgattgtggctttaatttcttctccctgatgactaatgatggtgaacatctttttgtgggcctattgaccatttgaatgtcttgttttgtgaaggatctgttcaaagtatttgcctatataaatttattattattgagttctaagagtctttctatattctggaattattttctcctattacataggtttttgtgttctaagaaatctttacctatcctaatgttgcaaagattttctcctatgtcttcttctagaagtttcatagtttttgccatacatttattcagggctatggtatattttcagttaatttttgtttatggtgtgaggtaaggtcaacagttatttatttcttttgctatgtgggatacccagttgttttggcagcatttgttgaaacgacattattttcctcattagattgtttttggagccttggtggaaaatcaatttgccacatgaggttctctttctggcttgtcagttctgttctattgattgatgtgtctatcattttaccaatatcatactcttttggttactgtagctttataataatttttgagattgagaagtttaagcctcaaactttgcttttctttttcaagatttttctggctattctaggttctttacattcgtatttcaattttacaatcaacttatctttttctacaaagatatctattgggtccaatctgtagatcagtttggggataattgacatcttaataatgttgcatcttcttatccatgaacatagcacatctcttcatttatttagctcttctttagtttctgtcagctgtgttttgtagttttcagtgtttgatgttacacatgttgtattaatttattcctcagtttctcatgtttttggatactaatgtgagtggaattttatattttatttcattttccagttgtttggtattagtatatagaaatactattaactttctttttaaaaaaataatttcaacttttattttagatccaggggatacacgtgcaggtttgttacctgggtataatgcgtgatgttgaggtttcgggtatgattgatcccttcacccagttactgagcatagtactcaacagttagtttttcaacccttgcccgctccctccctccaccctctagaccacagtgtctattgtgccatctttatttccacaagtacccaaagtttagcttccacttataagtgaaaacatggagtatttttgttttctgttcctgcattaatttgcttaggaaaatggtctccaacttcatccgtgttgctgcaaaggacatgatttcatccttttttatggctgcatagtattccatggtgtatatttgccacattttctgtattcaatctactgttgatgggcacctagattgattccatgtctttgctattgtgaatagtgctgtgatgaacacgtgagtgcatgtgtctctttggtagaataacattttcttttggatatatacccagtaatgggattgctgggataaatggtagtactgttttatgttctttgagaaacctccaaactgctttccacaatggctgaaataacttacattcccaccaacagagtataagtgttcttttttctctgcagccttgctagcacctgttatttttttgactttttagtaatagccatgctgtctggtgtgagaagttatctcattgtgattttgatttgcatttctctgctgactagtgatgttgaacattttttcatatttgctggctgcctgtatgtcttcttttgagaagtgtctattcatgtctttggcccattttttaatagggttatttgtttttttgcttgttcaattgtttaagtttcttatagattctggatattacagctttgtcagatgcgtagtttgcaaatatttctcctattctgtaggttgtctgtttactctctggatagtttattttgctgtgcagaagctctttggtttaattaggtcctgcttgttaatttttgtttttattgcagttgcttttgaggacttagcaataaattctttcctaaggctgatgtccaaaatgatgtttcctaggttttatttttataggattcttaaagtttgaggtcttacatttaaatgttgagttaatttttgtatatggtgaaaggcaggggccagtttcatttttttgtatatggctagccatctatcccagcaccatttattgcaaagggaatcttttccccattgcttattttggttgactttgttgaagatcagatggctgcaggtgtgcagctttattctgggttctctattctgtttgattgggctatgtgtctgtgtttgtacagtactatgttgttttggttactgtagccttatagtatagtttgaggtcaagtaataggatgtctccagctttgttctttttgcttaagattgctttggctatttgggctctttttgggtttcatatgaattttagagcagttttttctagttctgtgaaaaatgatattggtagtttgataggaatagcattggatctatagagtgctttgggcagtatggtcattttaatgatattgattcttcgaatccatgagcacggaatggttttctatttgtttgtgtcgtttatgatttctttcagcagtattttgtagttctccttgtagagatctttcaccttcttggttagatgtattcctaggtatttgtgtttttttttttttttatggctgttgcaaatggtattgcaaatgggattgtattcttgatttgttctcagcttgaatgttattggtgtatagaaatgctacagatttttacacattgaatttttatcttgaaactttactgaagtcatttattagttccaggagccctttggcatagtctttagggttttctaaatattgaataatatcatctgtgaagagagatagtttgacttattttttcctatctcaatgccctttatttctcttgcctgactcattctacaaagccaacatttcataccaaaacttggcaagaaaaaaagaaaactacaagccaatatccctgatgaacatagatgcagaaatcctcaacaaaatactagtgaaccaaatccagcagcacatcaaaaagttaattcaccatgatcaagtaggcttcattcctcggatgcaaagttggttcattatatgtgaatcaacaaatgtgattcaccacataaacagaattgaaaacaaaaataatatgattatctcaataaacacagaaaaagctttcaataaaatccaacatcctttcgtgataaaaaccctcaagaaactaggccttgaaggaacataccttaaaataaaaagagctgtctatgacaaacccacagccaacttcatactgaatgggcaaaaactggaagcattccccttgagaactggaataagacaagggtgcctactctcaccattcctaattcaatgtagtactggaagtcctagccagaacaatcaggcaagatacaggactcttttatatggactgtgtatcatgtgaccttactaaaattcacttcttagttcttgtagctttttcctagattacttagaaattttaatttacatgatcatgtagtctgtattattttacagctttctttctaatgcatgtgcaattatttatttttcttgctgtattacaatgactagaactttcggtacaatactgaatagaaattgtgaaaatggacatttttgtcttgtttctcattttgtagggaaaacaatcagtcttttaccattaagtatgatgttagatgttggtttttcatagataccttaagtcagtttaagaaagctaccttctattcttagttgtatgaattttttaaaaatcatatattggtgttgaattttgtcaaaaatgattttactacatctatatgttttcctatgttctgctaatatgttgaattacattgattttttttaaagttaaaccatatctttcctatttggttttatgatatattgtccttatatagagtttaattcaagttgctaataatttgttaaggatttttaaaatctatgttaatgaggattattgatcgatacattttttcctatattctttgtctcattttgatgtgagattaatattgacctcagaaaagtgaactgagaaatgttctctacttatgtttttgaatgtttgtataagattggtattatttcttccttaaatgtttgatagaattcagcagtgaagacatctggacacaagactttctttgtaggtagatattgaatcacaaaaaaaattaactatgtgtaacgtgggccattcaggtgtcctatttctcctttagttgtttttgttatcttttatcttctaaggaatttttccattttatctaaattgtcaaatttattgctctaaaattgtttttaactttattttttaatggctggggtgtcttcatttcttcttgttgatctgagtgccaatctggtatcactaccccccaggctgcagaacttcctttagcatttcttataatacaggtttgtggtggggaattctctgtttttgtttatcaaaaatgtctttatttttccttcatttttgtcgtgtcctgccctttttatacttttatggaaatataactgacatacaataagctgcacatattcaaaatgtacagtttaagttttcatatatgtatacatccatgaaatagttaccacaatcaagataaataatgcatccattaccttcaaaagtttttgtgcccctgtgtttacttctagaagttgtatagttttgggcttcatattaaagtctgtgatctatttagtattaattttttgtgtatggtacaggtatggatgtagtttcatgtttttgcctgtggataatcaaatttctgcagcatttgttgaaaacaatatctgtgcctttacctctctgtggaaatcaattggctaaatagatttaggtctattgttgtactctctcttctgttccattgatttctttttttttttaattaaaaaaattttttgtaggctggttatggtggctcacacctgtaaccccagcactttgggaggctgaggtgggtggatcacttgaggtcaggaggtcgagaccagcctggccaacatggcaaaacctgtctctactagaagtacacaaaatagctgggcgtggtggcgtgtgtctgtagtcctagctactcaggaggctgaggcaagagaattgcttgaacccgggaggcggaggttgcagtgagctgagattgcaccactgcactccagcctgggtgacagaacgagactccatgtcaaaaaaaaaaaaaattaatttttagagacaagggtttcactgtgtcatccaggcagtggcacgatcatggctcctgcagcctggaacttctgggctcaagcgatccttctgcctcaatctcctgagtagctggcactatagatgtgcaccaccacactcggctaatttaaaaaaaatttcttttggccgggcacagtggttcacgcctgtaatcccagcactttgggaggtcaaggtgggcggatcacctgaggtcaggagttcaagaccagcctggccaacatggtgaaaccccgtctctactaaaaatacaaaaattagctgggcatgatggtgggtgcctgtaatcccagctactcgggaggctgaggcaggagaatcacttgaacccgggagccggaggttgcagtgagccgagatcgcgtcattgcactccagcctgggtgacagagcgagacaccatctcaaaataataataataataataataataatgtaaattttttttttttttgtagagacagggtctcgccatgttgcccaggctgatctcaaactcctggcttcaagtgatcctctttctttggcctcccaaagagttgggattactggtgtgagccactgcactggccccattgatttatttgtctatctttataccattgttttcatcattgtaatattataatgaatcttgaaatcagctcgtataagtcttccacctttgttctgactactgtaggttctttgcatttacatttcagttttacaattgctttgccaatttatgcaaaaaaaaactggcttgaactttaaatggtattgcatctcatctgtagagcaatttgggaaagaattgtactgccaacaattttgtttctttcaacccataagcatagtatacttctctatttactgaagtctttaatttttctcaccaatgttttgtagttttcatagtgtaggtctttcacatttttttgtcagaatttatccccaagtatttatattttgatgctattgtaagtgatattttaaaatttcagcttctggttgctcatggttagtatatagaaaaattgtggctatgtgaattttcaccttgaattctgtaactcttctaaactcatttattagttctggttgtttctttgtagattctattggattttctatatagataatcatgttgtctgttaataaagtcaggtttagttattcttttccaatctggacactatctgtctatctctatcctctctctctctcatctattttctctcttcctccctccctcccttcctccttttctccttcccttccttccttcctttcttgtttccttattgcactggctcaaacctctagaacagtgttgtctagaagtggtgagagtgtgcatccttgccttatttctgatcatagagggaaagtattctctttcagttacatatgatgtcaactagttgttttgtacatgtccctatcagtttgaatgtactcccttttattcatagtttgctgagagttttttaaaaatcatgaatgaatgttagattttgttaaatgccttttcccatttattgaaatgatcatgtgtggtttttttattctgttaatatggtggattttgtcagttgattttcaaatattagaacagccttgcattcctgggataaacttcacttgatcataatatattattccctttgtataatttggaattatatcagctaaagttgtgttaggaatttttgcatctatgtttatgagggttattgatctgaactttttttattataatatctttgtatgggtttggtatcagggtaattctggcttcatagaacaaattgggaaatgttcatttctcatcaattttctggaagacttcgtgtaaaaattgacattattccttaaatgtttgctagaattgactagtgaagctgtcttggcctgaaattttctttgtgggaagatttgaaattttaaataaaatctacttagtaaatatagggctattctgattttctattaatctttgagtgacttttgatagcttgtgcctttcaagaaatttgtccatttcatcaaagttgtccaattttttggcataaagttttttgtaatgttatttttaaaaatctgtataatctgtggtgataccacctcatttctctcagtgctgatattggtgatttttgtcttctctgttttttactctgatcagtctagctagaggcttataaattttattgatcaagtatcagattttcattttattgtcttttactctttcttttctttttacagaactcattgatttcttttcctatcttatttcctttctttcacaaaaaccttgaatttaattttctttttctagtttcttaaagtgtaagctgaggtcatagttttgagacttttattcttttccgattatagatgttcaatactattgatttttctctaggtatttcagctgcactacccaagctgttgatatattgcattttcattttcattcagttcaaaatactttctgatttccttttggtttcttcctgatccatgatttatttagaagtgtgctcgttaggttccaaacacttgggaacttttcagatgcctctttgttattttttctaattcaattccattgtggtcacagtacatacattgtatatttgaattcttttaaatttatttagatttttttgatgttttaaaatatggtctatcttggtaaatgttctgtgtgcactgaaaagaacgtgtgttctgtggttgttgggtgcagtgttctataaatgtcaattacgtcaagttggttgatagtgttatttaaattttctatatcctttctgttttttctgtctattctataagagctgtgctatactttgaacgtatgtatccctccaaaatttatatgttggaacttaaaccccaaagggatggtattagggggtgggggcacataaggggtagattacgtcatgagggctccacctttgttagtgtagttaatgcctttataaaagggctggagggaacaaggtgggcccttttttactcttccatctcttctgccatgtgaggacaagcaagaaggtgcaagccctcaccagacactgaatctgctggcacctcaatcttggacttcccaccatccagaaatgggagaagtaaatatctattatttataaattgcccagtctaaggtattttgtcctagcagcaggaatgcactaagacaaggcttgcaatttgtgtctctaagagtggatttgtctacttcctttttcagttctgttagttttcctgcatttattttgaagttgttaccaggtgcatacacagttaggattatcatgttctcctaatgaattgattcttttatcattgtgaaaggaccctcttttttttttttcttttttttgaaacagagtctcactgggttgcccaggctggtctcaaattcctgagctcaagtgatcctcctgcctcggcctcctaaagtgctaggattacaggcatgagccactgtgcccagccatgaaaagaccctctttatccctttattctttactctgaaatctactttggtattaatatagacattcctggcttattttaattattgttagcatggcatatcttttttactttttttttttttttgagacagagtctcgctctgtggcccaggcaggagtgcagtggcgcaatctcggctcactgcaagctccgcctcccgggttcacgccattctcctgcctcagcctcccaagtagctgggactacaggcgcccgccaccacgcccggctaatttttttgtatttttagtagagatggggtttcaccgtgttagccaggatggtctcgatctcctgacctcgtgatccgcccgcctcggcctcccaaagtgctgggattacaagcgtgagccaccgcgcccggcccttttttacttttaacctatttgtatctttatatttaaagtttgtttattttaggcagcatatagctggatcttgcttctttattttaaacctgtctaacaatctcttctttcgaactaggttatttgtcctgttttaatttattatgattattgatatggttgggtttaaatctgctaccttgctatttttttttatttgttccatctcttctcccccatccatttttttcacttggattaatttagtatttttatgatttcatcttaatcttttttgttgctttatcatctgtggcattgtgctgtggggtttgtttttttaaaatgattgtctgcatttaagtcacattatatctctttttctgtaagaaccttagagcagtattcagattttcagtttctcccctcagggtctttgtgctattactgtcatacatttttcactcttacttatgttacaatctccaacattgttattatttttgctggaagtagccaataattttaaaaatattttaataataaaaagatattatctattttcctacatatgtattatttctattgcttttcatttttgggtgtaaatttagatctggtatcattttctttgtgccttaaggacttcctttaacatttcctgtatttttggtctgctagtgataaattatttcagcttttatttgcccaaaaaaatctttagtttgtcttttgtctaaaagatatttatgctaggtaaagaatttggggttgatgatttttttctcttccagtactttaaacatgtcactcaattgtcactagtttgctctgtttccaatgagaagtctgctgtatttctcatctttgcttttctgtatataatgcatcttttctctgtctgctttttaagatttttctctttaccattggcttcaagcaatttaaacaatgggccttggtgtaatttttctctatgtttcttaggctttgtttagtttcttttatctgtgagtttatagttttaatcaatgtattatagtcttttatctgtgggtttacagtttaatcaaatttggaaaatttttgctcgtagttttttcaattttgtttgtccccgaaaccccacccctcatctccctgtctcacttacattcatattcagggtttttggatttattccatagctcactgatcctctgttcttccatatcttcaaatttagtaatcatatcttatgcaatttttaatctattaatagcggggcattgttttatatcacttctacatgtttgatttgggtctttaaaagatatctttcatgtgtattatccttaacattctcatactgtccgctaccttcttgagcatacagtatatagtcataactgatttattgttcttttctatttattattagtattatttttgagactgagtctcactctgtcacccaggctggagtgcagtggcctaatcttggctcactgcaacctctgcctcctgggttcaagcaattttgcctcagcatccttagtagctggaattacaggcgcatgccaccacaccttgcttttttttttttttttttttgtatttttagtagaaatggggcttcatcatgtttgccaggctgttcttgagcttctgacctcaggtgatccacctgcctcagcctcccaaagttccggtattacagatgtgagccaccacgcccaacctcttttctatttattctatcatttgtgtcactcatgggtctgtttctattgacagattttttttttttcattatgggaagcattttcttacctctttccaggtctggtaacttttgattggatgccagacattgtgaattttactttttgggtattcagtattttgttgtgctttacatattttgagagattttttggatgcggttgtattgcttgataacggtttgatttttcagaggcttgctgttaggctttgtttggtggaacaaaaacagcctttagactagggccaattttgcctcatttctgaggttatactcttgtgagtactctatccaatgccatgtgtatttcaaggttttccccctctgactggtgggaaaatgaatgattcctagctctgtgtgaaacttggcaattgttttgcttattctcttttggtggttcctttcccggtttgtgtagtttcctcacatgaatgcactgattaatatttgtgttacttattataaagaaaggagtgttaatatctccaggtaaaatcgtggacttgtatggtttctcctttcaattccatcagtttttgcttcatgtattttgaaagtctgttattaggtatatacatatttaaggttgttatgtctgctagatgaattgacacttgtacgttttcattgtattcctcttattcctggcggttttccttgttctgaagtctactttgcctgctattaatatggtcacttcagccctcatttggttatttttaatatggtatatttttttatccttttacttataagctatgtattttattatatttaaggtggctgtcttgtagactagatacagttggatctttttaaatgttaatctgaaagccaattggacaatctgtcttttagttggagattttagacaatttatatttaatgtaattactgctatggttgactttggcctgtcatgttattattttattatttgtctctgttttttttttttttaaaggagatgggatctcactctgtcacccaggctgaagtgcagttgtatgatcatagatcactgcagccttgaccttctgggctcaagcagtcctcccacttcagcttcccaagtagccaggaccacaggcatgagccactgcacctgacatatctcctctgtttttttttttttttttttttttttttgagacggagtctcgctctgtcgcccaggctggagtgcagtggcacaatctcggctcactgcaagtcccgcctccagggttcacgccattctcctgcctcacgcctggctaattttttgtatttttagtagagatggggtttcaccgtgttagccaggatggtctggatctcttgacctcatgatccacccgcctcggcctcccaaagctcctctgtttttattccacttgctcttttcctgccttctttggattattttaacatttttattatatcatattattttatctattagctttttggttatgtctctttgtattatacctttaaattgttgctgtaaggactacaatatacatgcctaatttttcacaattctacttattgttaatattttaccacttcaagtaaaacatatgattcttctaggccaggtgtggtggctcacgcctgtaatcctagcactttgggaggccaaggcaggaggatcacctgaggtcagaagttcgagagcagcctgaccaacatggagaaaccccatctctactaaaaatacaaaaattagccgggcgtggtggcacgcgcctgtagtcccagctgctcctggggctgaggcaggagaatcacttggacccaggaaggggaggttgcagtgagctgaggttgcaccactgcactgcagcctgggcaacagagcaagacgccgtctcaaacaaacaaacaaaacaaacaaaacaaacatgattcttctaaccagataagcctttttaccccctaccctgtaagttaaaattgtgttatggattacatctacatacattgaagatccccttcccagacaatgctatatatttttttcaagagtcatacgtatttcatataacttaagtgaaaaaatgattttttatatctacctaatcatttaccgttttttgctgctgttccttcatccctgaagctccaagttttcctctggcattatttcctgtcagcctgaggaacttcctttagcatttgttttagatagatcaggtctgttcatgacaaattcacttagttcttcttcatttgtaaaggccttcatttcctctttattcctgaaagatatttttgctgtctgtaaaattttggattgatgctaatttaccactttcagtatgttccgctgttttctggtctccatagtttctgatgatacatttatggtatttcaaattgttctcctctgtgtaattcttcatttttttttttcctgggcactgtcaaggttttttctttgaggtttttagcagtttgattgggatatgcagaacatggtttgtattgtgttttttctttttaatttatcctctttgtggttgcagagtctcttgactttttaaccaaatttgggaacagtttactcaatatttccttaaatattctttcttttgggtactgctgtcttcaccttctcctttaagaactctgttgatggccagctgcggtggctcacacctgtaatcctagcactttgggaggccaaggcgggcagattgtctgagctcaggagttcaagaccagcctgggcaacatggtgacaccccgtctctactaaaatacaaaaaattagccaggcattgcaacgtgtgcctgtagtcccagctagaggacgggaggctgaggcagaagaatcgcttgaacctgggaggcggaagttgcagtgagccaagatcgtgccactgcatgccagcctgggggacagagcgagacttcatctctaaaaaaaaaaaaaaggactctgttgacaaaaatatttaagcttttgatattatctcatagatccccaaagctctgtttatttttttcttcagcttgatcatttgggcagaatgagggatttatttcagaatgtttggtgtccatgcccactatgtactgccttaatccagtcagtctttgggtcaacagcaggagttaaaacacaaaagtgaataccaactgggaacctcatctgccatactggtctttattcaaattttgacttcctttcccaacccacctgctattattgacttttcagagtcttcaggtagttgcttttaaaattttgtccagagtttttttgtgtgtgtgtgtgtaatttataggggggagagagagagagagagagagagatgcatagtgggtttactccatttcaggtttacattagatttgttcattttaaaatttagaatttttttctatctggtacatgttgcataattttaattgctatgtcttctagtttactaacggtttcttttgcagtgtctcatctgctgttaatcccatctaatgtatttttcatctcaaacattgcatacttcatctcttgaagtgtgatttggatcatatatgtatatatgattcattaaaagttattataactccataacatatgtttaagaaggtagaggagagactgaccatggtaagtagagatatggaagactatctctatatctatatatagtctttgtatcatatatgtagtctatatatatacacatatagtctatatataacatataatcatctatatatagtatatatagtgtatatatactatatatagtgtatatatagtatatatatagtgtgtatatatagtatatatatagtatatatactatactatatgtatatatgtatatatgtatactatatgtatatatagtatatatactatatatgctatatatatactatatatacactatatgtatatatgtatatatgtatactagatgtatatatagtatatatactatatatacactatagtataaatacagtgtgtatatagtatatatatggtatatatagtatatatagtgtgtatatatatgtacactatatatatacacattgatcatttgggcgtgtacatatatatgtacatatgtgtgtgtgtgtgtgtgcatatatatatatagtgtatatatatatatagtcttggtctattatctatgtcacttctggccagtttagctgggtttaagaactataatccaggtgttgagtttgctgattgtttccacactccttctgtggacagagctgggaaatatttttcttgtggagacaaaatatattattgtttatactgatttttccaattcaaatttaggattacagaattttctttacttttttgtttttatattttaaaaatctcttttatgctaacatttttaaacttccatctgccttaccttaacacatttcttttatatatattgacactaacaatgaaacgactgaaaacactttaagatttcttgcagttctctttgttcacagtgtatatctaattaggatttaccaccatattgccagttttctattaataatgtatattcaactaaggattgaccatgtaaatgtcagctgcttttgatagccaccatcctatgtgattggcgacttctgcttttgcgactttaaaccaaagcagtgggccctgtgctacctttccactttgccttgcatcttggcactggaagaagacaatgcatttattactgagagttgcccaagaactcacagctccatcctagggactctagctctggctggctggggaggagaaggtttacaagcatcgggctcgtatgtgtcaggcatttagctgggcacagcacccttagttcctcaggtggaggtcctgttgttacccctactttacaggtatggagactgaagaacagacggaagttacttgcccaaagtaactgtgcttcaggtcttttaaaagaaaccttatttgtgcagttaagctacgaaatcaatacatggttaattttgtttgcctaattttgctttcacattttagagattgctttttaagttaattttgttgcataatttaataaaatgtgtatatgagtccagagaaaggattggcaaactacagttgatgggtcttatcttgcctgtgacctgtttttatatggtctttgaggtgagaatggtttttacatttttaaccagctccaacaaacacacagacacacacatagacacacacacacacacacacacacagagagagagagagacagagagagaattatatataacagtgactacatatggcctacaaaacctaaaatatttactgactggctctttacagaaaaactttgtaacccttgttctagagtcaaatctgcaaaacaaggtacatttcgagaaatcatccatgttccacctctaaccctgtctcccccattctgctcccctcccttcctcttaaggcagtcttatttatttgcttattttagtttctagtttgtcttcttattgcttcttagtggaaacacacacatgttcacgtcccctcttctttacacagttttttctcccactttgaattttttttcactgaacaatgtgtcctggagatcgcttcatagcaggataggttcctcattcttttttacaactgcgtagtggtccagagtattaatgtactagagtttattcagccagtcctttctcgatgaacattgggttgttccctgttttttatttttacaaatagtgctgttttcagtggcattgtgcttatatctctttgggattttgccagtgtaagtttaggattagttcttagaagtggggttgctgggtcatgcatattgccgagtaacgatgcatatgttattttgctcaaagttgtctaaatcctttctgcacagggcttgtaccatttgcatttctggcagccatatgtagatacctaacacccccagagccacctaacaagggtgttgcaaaactttgggattttgttaatttgataggcaagtaatggtatctctgtgtgatttaaatttgcattgcttttgttaggagcaaagtggaaggaccatttcatttttttctgagctctgtttccttgcccgtttttctgtagagctattggtctttttcatctatttttagggaccatctgtgtattacagatagtgacctttgcctgtaatagaagttgtaaatatttctcctacttgtcttttttactttatttatttatttacttgcttgctttctgccatcccaaagtatttttttttaattattattgtttttatatagtccagtttattcaacttttcacttattgcttctgggtttggagtcatagctgggaaagttttccctagtcccaggttgtagagaaattcaatcatgttttttctcatagttatgttatactttgtttaatgtaaatgtcagttgcttttgatagccaccatcctatgtgattggcgacttctgcttttgcgactttaaaccaaagcagtgggtcctgtgctacctttccactttgccttgcatcttggcactggaagaagacaatgcatttattattgagagttgcccaagaactcacagctccatcctagggactctagctctagctggctggggaggagaaggtttacaagcatcgggcttgtatgtgtcaggcatttagctgggcacagcacccttagttcctcagctggaggtcctgttgttacccctactttacagatatggagactgaagaacagacggaagttacttgcccaaaattatgcagccagtaataggctgccacgctcaggtccccagggtgtctgcctaagtgcttgggccctcccacttggcatctcacccctgctcatccaagggccaggagaggccccacccacctctgggctcttgtgaggctgcagcgtggagcacagtcctgctgtgctcccacctcccaccaaggtcttggagcagctttcctttgtctccacgtctgaggcacagggcaggggctggctcaatcagggccaggggaaggacctgtgagtgaatgtcatctcacccgggggtcctgggagagccagtggcaaaggcttttgtgtgttgcctcagccctgcatgccaggatgttgctgggagccggaggaccctggattgctacttttaaagtagtcgaccttttgttcattcactcattcatttatgcatttactcacttatccagcatcaatttgacacaccttactgatgcctgcaggggcagacccagtgctagccaagggtgacccagaaatgtgggcagcagggcgtctgtgccaggagctcacagtcctgtggcgtaggcaggtggctgatgtgggcagctaagggagcacagggttgcgtgtgagcccagagcagtgcctccccaccccctgtccttcaggtctgggtgcagaggactggcagcatggggtgagggatagctgggtgcatccgccagtccttcttctttctgaggaccaggagtacttagaggctcagaggtgtggttggggccctcgtgttgatgactcaaaaactagacctaggaagggaacgaaccttccccaggcacatagtaaatctgtagtgggccaagattggagcccagtgaccacccccaaccccgtgcactctggaagtggcaggaacccaaggctgctctggacgagtcagcagcggcccagcatcccccaggtttgctggtgggccgagtggtgggcagattgtagggacataacccctgcatgtgtcatgatcgatcttctgctttccccaagaccatgtccctgcatctctaccaggggcccgcagttgccagaagagtctgagtgagactcccttttggatccagctcgttaggctcgggtagcagcgtcccatgccagctgttggtgtaattaaggttgccataaaacccaccagctagacacacaaatggctcctttgctctttcctggggcatgagcagttgtgaaggcgagtaaatcatgttcggtggcgatcacttcaaaggccagccttccacttgcagccacattattggcagggatcgcccataacacggcttgtttcccagccattcacttttatgacaccctaatgaattgggccatttccatccattctcagaaaatgtacggaacaactgttttggttctcctcaaaaagtttgtcttgggaggcaggtggtgtgttggcaggggcatgtaggtagttcttggctcctgggcaagttgcctgtctctgagacttcatgcccaccgagagaagctacctatggggctcttgtcatgagataacttatgtgaaccccccagccaaggcccagcacctaacgggcactcagcgagtggcagggagggccgtcatcttcctcatcctttccctgggtcagcctcttagggatcaaagtgttgaggctggtgggggctgtgatatcaaggccatgtgggaggatagagcaggcacaggcatgcagaatccagtgcgtggaggaaggcaggcagccgtgccgtgaggggcagcttgtctccctgttctgcattcagaaggctttttttttccacccctggatcattctttaggcttcagggggcccactctgaaatctccctggttgagggttgctttggaagaggctcagagaagagcggtcatctgttgcctaccctcccccaggaattacagaggcaggaattgaccagcaggagaatgaaccgtgggtcccagggaagccgtggaggtcggaagaggctccaccatgccctggccctgtgaccttgagcaaatccgtacctcttcctgggcctcagtgaacctcatccagagaatgggcctcaacctcctcctcctctaacctaaactgaaattatggagtgacacatttaatgtgaatttgatgtatacattttaaggaggatgacagaaaatatgtctgcaaaatttgaaaggtatgaactccaattaaaaagtcaaggtggctcattttgagctggcggggcccagggactgaactgtttatgctgcagccacatggtggcggcccaggaactggtaaagggaccggccggcccctgcgaccaacttgagaccttgctgcgcttccatggctgcgcgtgggtgcccagcatgttatttccatattgtcattaaagtcctgtcctctgtgagtttgttaagtggagctacttgctggtcctggtactgggacccttctccatcccctcaccagagctggatacttgagagcagaagctgaatgtgataaaatcctctaagaaagcaaaacaactgctcaatacttaataaagtcagtttatgagacagcagactgtgaagtatcggtgatgatgctaaaacaatacaaagtgtcgttaaagctaaaatatgtcctgtgattctggctttatggtctgtccccaagcacacttgctcctgcattactgtggctcctctgggacaacaatctgggactttgcaagctgtgaattatgtgacgtcttcagaagcaggacccactcaaagcatgaccccagtgttgatggatgtcaatatgctctcgaggtgcccttggcgagtcaaggcccttccctttgcgctttccctgggatcctgctgctctcaaggggtgatagggatgcctctctggacccatgtggcaatagagcaggggggctgagaagctgacagacactggactgggcatggggcaggagggtccatgattccatatatggcttgtgggtgctgctcagcctgggtgtgtgtggcccagcataaacttcactaaacctgcctgccccctgggtccttggccttccctgcataggcgcctgtccgtgctgccaggcctgccagcatgaccggtgtccgctcttgcaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgtaagaaatcccatttggcattgctgtcagtttcagccacagagcgtatccatgtagttctggtctgtctgaggtcccaggtcccttctgtgggaggaggctcactggactgaaatctccaggatgagggtagtcaggtctcagcctgccgcacacatggagagcttgctgtgggcttccagatgcaacctccttctgctcttcttgtgccagcacagcaaccccacagggtaagggtctggtggggggcggttcagtccagatcaatggggaacgtggcagtgcaacctgagaaaccccaccctcccactgccaccacaaccagctactcagaaggggtttctgaccctcagtggcattggcagttgatgtagcccaggagttcagagcaggggccccacagttagaacacctgcattaaggttttggattcactaggaccttataaggcggagagccttgggcctgctatttagcctctttgattctcactttcttcattagaaaatagttttgagaattaagagagagagagaatgtttgtaaagggtatagcacagtgtcaggcacggggaatgcttctgtgctttaactgtcattaccaccaccaccatcaacatcactaccaccaccagtgtcatcactgccaccatcatcgtcaccatcagtaccaccatcagcatcactgtgtctatagccaccacaaccactgttgtcattgtcactaccaccactactatcatcaccaccatcatcaccagcaccagcaccatcagcatcactaccaccaccagtgtcatcaccgccaccatcaccagtaccaccatcagcatcactatctttatacccaccacctccactgtcatcattgtcactactaccactcctgtcatcaccaccacaccatctctatcaccaccaccatcaccatcatcaccactgccatctctgtcaccttcactgtcaccagcatctttattgctgcaccaccaccatcaccactctatcaccaccaccatctccgtcactaccaccaactgtatcaccaccacgatcactgccgtcattacaccaccccatctctgtcaccactaccatctcttatcagtaccaccccaccatcagcaccacactatctctatcaccaccactgtcaccagcatgtctagcaccaccaccaccattaccaccatcatcaccaccgtcatctctgtcacaccaccatcaccaccgtgattgtcaccaccaccatctctattatattgttatcatcaccaccaccaccaccactgctaccgtcatcattgtcaccactaccaccgccatcatcagcatcatcttttgagatttcaactaacccaagactaatctctgaatttaaaactgtatgtcatgtgtatatgatatatgtgggtgtacatgaaatatctatcctgtgtacaccttcttttcctccctgccttttccttgttctcagtgggttctaagtggctctgagcaaacccacttctagacctccactgcagggtgtcccagggcaacccattgggcaggacaggcccttgtggggagctggaggggcacgtctggcctctgagggtgtcctgcctccaggagcccaggggaagtgaggcagatgaaggtgccttgcgcctgaactatagttacactccacactgtctgtgtggagggagcaggtgctcagcctggcaccatcacactgggagcttgttatctggccatggcagcctctgtgcctctgatggccacatcagcctgaagctgtgcttcctgctgctccccactttgccctctgagtttgggctcacttagagagtgtggcctagggacaatagttagaacaatgtaaagccagcttgagggggtagtttttaggggtgcttcctgtcaatgaagcagtgagatctcgcgccccctgtgttttgaggtttgtgcctgcatttcttttctcatttggccacttacctcctcacttactgtgcattttggctgtgtgggtccctgggctgggctgggctgtccctgagggctcattgtggaggtggggagatgggcatgtagattccttttctatccttgtgtgataaattacacaaacttggtggctggaagaacacaaacttattccctcacagttctggaggcccgaagttcataatcaatattaagtatgattgggctgaaatcaagatgttggcagggtgtgctccctctggagtgtcaaggggagaatccttcctgccctcttctggcttttggtgacagccagcattcctgacttgtggctgcatctctccagccctccaagccagcatcttcacaccaccttcactgtttgtcacatctctgcgccttccctttgtttctttctttcttttttttttttttttgtagagatggggttttgccatgttgcccaggctggtctcgaactcctgggctcaagagatccgcccgcctcagcatcccagagtgctgggatacaggcgtgagccaccacacccagccttggctttctttctatgaggctgcacgtgactgcatttagtgtaatataggatcatctccttatctcagaatccttagttatgtctgcagagacccttggttttgaccctgtaaggtaacattcacaggtttcaggaattagaacatgggtatattttggggggcattttcctgcctgccacagggacacaggcaggttgtagaagctgggaaacatggaggaaactggattcccctccagcctccagaaagaagtgcggctccgccaacatcttgacttcagcccagcgaggcctttttcagacttccgactcgcaggactgtgtgatgtgaaatgtgtgtgtcttgagccaccaagcttgtggtgatttgtcacagcagtgataggaaaccaatggagacacccagctagggtctgggagcaggccccaggccccagagcagagtgccaggttgggggtgtcttctctgacccatttgtggctctgctgttctcaggagaggttcacctgccccagcctcgccttgcacccgagagagcccgtgttcctggcacagaccaatggcaactacctggcccttttctccactgtgtggccctaccggatgagcagacggcggcgctatgaagggcacaaggtacttctgtccttgtcccccaggcgaatgctgagccccagccccaagcctcctggcagtcctggacatgggccctggggtgcatggagcctctgtctgggtggatcctgctttctgtttcctgggtgagcgcatgccatgtggctcactgtctcttcaagtccctgaaccacatctggtcctcaccccaggccccacgtactgggcaggaagcagtagttggctcacacagacaggtctcagaagtggggggcaggaacaggacaaaatggtcatgggtgtcatttctgcatccttccctttcctcactgaggccaagccttgctggggtggaaggggctgggtgcttagtgactgtcactgaggccagacccctcagctgggctggagctggtcccgctggatctgctgaactggccttgggatgtgggcccgcatcagggctctacagcctcatgggcgggacctgggctttggcctcagggacacgaggtgcgaagcccagctctgctccgtcagctcggggcttcagcctgctcctctgtagaatgggcatactcaccccggcttgacaggtgcggcttgctcacccactgtgtccctctctgcaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaagtgatttcagcaa

SEQ ID NO: 2676 - DNA, 73118 bp, Homo sapiens
tttaaagaaaaggttttatatgaaaggttccattttgtttctgtataaaggcttttatcctgtaaggaaaaaaaaaaaacacaaaaccctagacataataaatgcctgttttctacaaaaacaatgtctaactctgggtggactgatctcttctcaacagcccagggcagggctggtccctcattcacctgtgtccacagggccgaagacactgcacacactaggacaggatttgattgaatttaaatcctgccacccaccaaggagacctcgggatatttaatgtttgagggccacactaaacgatcactgcagagaaccacctcttttctttactgtagtttaagtatgataagtgggctttgctattacttattggaaaaaccagtaagaaaagctaattttcaggcttcaatgtgatttgacatgcaaacgggaagttttgccaggggttaataaaggttgtgaattccaaattcctagccgaatatggctttgctggtaagccccctggaagggaggttgggagggctgaccagatggtcatcggggcactgggatggaggcacgctggggcctgactgcctgctctgctggagactgcagaatggatggcagatccacagtgcatcccccttccaaacccaggaggcatctgtcgccttctctttggtagacagtctggagacagcagaaaccctctgctctatttttttgccactctaaatatagcagaaaacaaaataaaataaataagataatctttgctgcctccaggtgccctctgagggacagacagctgctccagagttgttcatgaggacaaaaagcccaggcagcctggagacccagctgctctgggtgagccttagctcacttcctgtggttcctgggacttaccaggcccacccccatgcgcatttctccaggcaggttctgaggactctttggacaatttctctttcttctcaacccttcaatctcctaatccacccccctacccccaatattttcatagaaactaagggaattttggaggtgaaagaagtcatctagtttccagtgtccaccctccccattctacagatggggaaaccaaggcacagagagggcagtgccttgcccaaggtcattcggtgagtcagtggtggagcaggcctgaggcccaggtcccccagttcccaccccgttctgcagcccacccctcagtcggccttgggcagggacttcctgtgcgaggggggcacgaggtgggggggcaggctgctgggcagctcgtagccgtcgagcttgatcttgatgaggtgcttggccagcgcgaactcctcctcatcaagcatgccgtcgcagtcgcagtcggccagcttccagatcttgcccaggacgctgttgggcagcttggaggtcaccatctccttcttggcgttgacacctgatatcttgccattgatgggcgacagagtgtagaagagctcgtcgtagacgggcttgtctttggccacgacccactcctcctcgtcggcgccctccttggcaccctccccgtagccctggttgaaggggccctcggtggtgccatcgaaggcgccgccctgcaccagctgcgtgggcgtgctcgtctcctcctggctgatgaggttcatgaggggcgagatcttgttgctcagcatgttgtccactgcctcgatcagcttgggcttcagcgagtggaatttggtgaagtcatagttctcaagctgttcctgcagaaggacaaaccacaggatgggttacatgtggtctcttcagggggaaacagttgggggccactggagggagactaattctgccccaggcagacgtcccacccactactcaggagtgcactctttgggagcttcccacatccagatgtaccacatataggagtggttgttttggaacaagaaacaagtgtttttcctatggcagccaatctctgctggtggccgcatgagcgacagcaacctccgaggactctgagaaaccttctttcacctgcctttttaaaaatgctctagagttagtattctatttctcaagggatttcactacacacttcagccgatcttcatagcaatcctgggaggaaggaggggcaggcatttagaaccacattttacagagagctgtgaggggctgtctggcagagtcaaagcagagcccctgtctcctggctcttgactaatgctctctgtgctggaacacagagctgtgacagaaggactatgtttacataaaacaactaattaaataccttgttttcggaacacgtaaaaaaatgtagtgtaggacagcttcttagtggctctaacctcttatgaatgagctgagggcgctactcaacaggaaccccgtaggaccagccccaccaagtacggcctgaccaggggcacctgtgctaccccaggaaggtatcgaggcagggccacggagaccttgcatatacaacataatcatcatgaatccactgtcatttctaaaatatggacaaataagcaaaagctggaacttgtaagagcagggagtagggctggggagcacgagggaataaacgtagctggtaagcctgagtatcactggccaggtcaggacatatcttagctctacctgttgagtgaggcagcctgtcagcagacagagcagcagaagcacaggctctagagggggcctgggaaacactgtgactgcccaaccaggctggggcagactacaggatgccacagaggctctgtggatggcaccgtagaaactgaccttcctaccttggttctccttggttactccatccatccatccatccatccatccatccatccatccatccatccatccaacaacccacctgtccaactaatcctccaactaaccatccatccattcaaccaaccctccatccatccattcagccaacaattcatccatccatccacctacccgaccaacttttatttgtcatttactctgcaccagcccctgttctggggcttggggatacagaataaatatgaaaagccataattcctgctttaaatgagcttatgttgtaatggaggaaggatactccaattgtttaaaaaaggacttgacataacacagtgaaaaggataacatgaaatctataaagtcattagaaagaaaaaagccaagtcattaaaagggagagaggggccaggctcagtggctcacacctgtaatcccagcactttgggaggtcaaggtgggaagactgcttgagcccaggagttcaagaccagcctggtcattagacccatatatatatatatacatatgtatgtgtatacatatatgtatgtgtgtatatatatgtatgtgtatatatatgtatgtgtatatatatgtatgtatatatatacatatgtatatatatatgttagggagaggaagggaataatcacatcagatggctaaggttaaggaaaactaccgcctgtataaggagaagagctcagttgcccagggggacccctggggaccctcactgtctaaggagagaaaacacttgtttattgcaagagacaaactttctgtggctctgaactgcgagagttacctagagctttacatgacaggcttcaaagatctgatgaaaagtgtcttcaacagtagttttattaaataaatgcagaaatgttccaggtatggcaggttttatatgtgaagtatttctgtatgtacagttctagagggggccaaagagaggccatgcaggtgtgcaattttctggagatgaggcagggagatttgcaaggaaaagtcagacctcgctgttttggacagaagcaatgtgacaggctgctaggaaaaaaaaaaaaaaacttggtgttatcataaatatcatgctttcttgtaaaaaaaaaaaacagaaaaaactggtaagcaaaactaaaaatttaaaataatttataatctcatcatctggcaaaaacctctgctagcatatctgggcatgcatttctagccattaacatacatacacacacacacacacacacacacacacacacacacactgaaacaataccacactcttaacaaataatatgtcatatatttctgtggtattaatttttacataacctttctcttaacagttacagaatattgaacttagactgtagagctgggccattcttaattaaccctgtcccctatagctggacacacaggttgtttccaatagagaatcaaaatcatggtctctagggtggcagggcaggaattctgggctgacatttggaaggggattcctgggtggtagttggtggggggacagagctgagaaatatcagctaaacgggctgacatttctctagggaagggactctgacatattctcaggaagtaaagtcagcagccatcaaaccatgcaaacccagcgtgtggcccctgctcagctcagagcagcgggtactgcaggccgggtctctcaaacgcagtcactagcatgtcactcctgacatcagcaccaaacaatgcggcctgcacttcgggctcctgccaccaacatctcaatgggccaaggagatggaaaagagaacgctaagcaggtggaggagcaggcgtcccccacaaaaatcccagtgctgctgggtcaacgagtttggattccccgggtgcgtgaacacctaccccatttccttaagaatgagcctgcgctcagagcgcacacagagcccctgtgtctggcccagcagacaaaggagggtgatgcctgcccaaacttcccaccagcctgcaggggccgtggattccgactgcagagctctggaaaactggcagggggagtggccgcatatttgcaggggtggacaggaggcagcagttattcctgtcctgggaggcaggcaagaaataaaccctccattctcatccctgtggtcccccccaggcttgaccggggactgcgggggcaccagttaaaccatcatcatgtcactcctgacatcagcaccaaaccatcatcatccctgccctctgccacggtgagtccaaaacagttcttattgggatgaatacacactggggaacttaaaggtatttgcccatcaacagttgtatccactaagccaggaccctggaattgctccctctcaagaggcaaaggtcagttcccagccccgtctctggtggggctgtcccttgcccattaattgccaacattaaccagaagagttttcaaatccaccagagggtctgagcagatggggctgactctgctgccctctgctgttgaaatgctgccaactcatgagctgaggggtccaaattctccttccagtcagaggagcagagtcagcagtaacggtggcccttcgggtgctcatcttgtcctgcagtattaacactgtgctgtcagtcacggtccctccccagagcgtgccaggcacgcacaggcagccacacaggtgggttgcagggcctgtcccagctcagggaagggccttcagaatacactctcctctcactgctacagctaagagtcactctgaccagctggctccatgagagaacagggagaataacaacctaaagctggcatcagcgagctctctgcgtgaccctgatatgtgcaaagatcacagtgtggtcacttctaagcgtatgtcccccctctgtcaaggcctatgttacagaggatgttagactttaacagcctcagggatgggacaggccctaacccacacacgcgcccctcaaagcttccggtgacagcaagctagcttgcagtatcaggtgacactaagcattcctgacaggctccaggctgccttgttccttggggattctccgaaggaatggggtgatgtgactgggcctcagcctacttcccaaggaggcctcttcctgcagcttctaggggttggcacggggaacccctggtctataagccctgtgggaatcgaggctgcgtcagggcctgagagcctgctgtgatatggccttacactaacttactaattcacttggcttgtgtgaattgagcactcaccacgtcctagatgctggggatatggcagtgaacagggcatgggtcactgacctcatggagccacagacttacgtgggagagagatactaaatatcagacatcagataattcaattacatggaagcacaacagtgctcatattgtaacaagaaacatgtgtccttacagtggggttgctgtcaattatttttacccccatttgttcattttttctgttttttgacagggtctcctctgtcgcccaggctggagtgcagtggcgtgatcatggctcatagcagcctcgacctccgggcttaagccatcctcccacctcaccctctcaactggctgggaacacaggcatgagccaaccacacctggctaattttaaaatattttaatggatatcgggtcccactatgttgcccaggttgttctccaacccctggactcaagcagtcctcccatttcagactcccaaagtgctgggattacaggcgtaagccactatgtccagcctcatttgttcatttttttgtgttgatttattccaggggcctagaacagtgatagcagcaggaggcagaaaaatgctgaggcagataggggtgggtctccagtgaaaccctatcttcaagccaaaggcagtttaaagcctgcaggccaagctacaagtcaaatccatggactggattgagaacctgtctttccatttggctgcttttctttgattgatcctcacccttcacctattttacatatacctacccttccctaattgtttttacactgttatgtccacctttgactggtgcctttgttttaaccttttttgcatactcacaaatcaatcagcatgcactcctctatcctgtgcctataaaaaccccagactcagccacactggggagatgacctgacttcaggagagacaacccaatcttcccatcccctcttcactgagagttgttttgttgctcagtaaaatcctccaccctcatcactcttcaattgtcagcatgaccttattcttcttggatgcaggacaaaagcttgggacccaccaaacgcaggtacccagaaaggctgtaacactggccctctgccctcaccattgcagggtagccgtgccactcaacagaagcagtggtggggtcgagctggaccggagccatgggccagagtggggcaagagggtgactgagctgctaacatgatgcacaactaaaagagctaattagcacactgtagcaccccctctggggctttggggttgcgggcatccctgcctgggcactgccacgttccccttggggtgacacacctggtctggctgcagaccatgcacagagcctgctcctatgtcagcacttggagtggctggctggatcctgcacttgcttgctcacccaccttccgtggtgctaaggtactgggcatagacctgagtccaggtgattctcagcaaaggcttggccctccttgtaccctccatctcagtgggccatggctgctcctgagatcatgctttccttgttgccttcccccagctcagaggaccctgggtgtcttctgacctggccagcccaggctagctttgtcatgagtagctctggtcccagagcctgctccctacattatcgggctcacaggggaccagcaggagaggcctggcaagggaggcctctgtggagccccagggctcaagagcagcgtctccctgtggcaaggcactgtagcaacttcaggaagccagcgaggcacagaggccccaactgggccacagctcaggctctgtatttctttataactttcatttaggtcaagaaaccaagttcccttctgaaatatctgaagggtacaaggaaacagctgtcttactccttggtcatgggatacagggcataaccaggggtgtgaatggggaagttgcccagggagactgctcctggaggccacaacagccctccaataccacctggtgaccagaaaaacccaattcagcttgtgagcacaggaatacccatttcactgctggaagaaaagagacatttctctgttgtgtgtgcgtgtatatatttttttgagacggggtcttacactgttgtcctggctggagtgcagtggtgcgatcttggctcactgcaaccttcacctccagggctcaagtaatcctcctacctcagcctcccgggtagctggaactacagacatgcaccaccacacctggccaatttttttggattttctgcagagacggggtttcactacgttgcacaggctggtctcttgactcctaagctcaagtgatctgtccgccttggcctcccaaagtgtagggattacaggtgtgagccactgcgcccaggctctgtgtgtgtgtgtgtgtgtgtgtgtgtgtgtgtgtgtgtgtgtgtgtatatatttatttattttttgagatggggtctgcctgtgtcacccaggctggagtacagcagtgcgatctcagttcactgcaacctctgcctcccaggttcaacaaattctcctgcctcagcctccaaagtagctgtgattatagccaccacacccggctaatttttgtatttttagtagagacagggttttaccatgttggccaggctggtcttgaactcctgacctcaggtgatctgcctgcatccgcctcccaaagtgctgagattacaggcatgagccatcacacccggccctctgaatatattttaaaataaatacagctaaagcatattgggtcagatcaaatatattagactgattcactctgaatccaggtgtaaagagctgtcatcaaaacagcaagaaaaacccacctctgagttagtgtataatttatataaagcttgcattaaaaaaccccttaggatcaaagttcccctctcatcacctgctggcccttgcctcttctgcccgaccttcccttctccctgtatcctctctgctttcacctttccctcctcctgcctcgggctgtacctgcttgcagtttttaatctatgctggcttcaatgctgtcactctgtggctcaaggcaaaagatggtaactggtggtctctgtgtgcagcccatatgcaggtgggctttgtttgtcctacatagtatttttttgagcctaaatgtgaaaatcaggtgatctgacatacaaatccagatttccagcttctcttgagccttccaggtctgtagtcccacaaggcagtgaccactgggctagacggggcttctgcattgtccaatctgccctgccatgagacccctgacatgttcttagcacacctcgggatggttttcttccttgctgacacatgtttcttggaaccttcttctctatcaaacgtgggaaaaccaaaggcagccagagagggtgacagagtttctctttcgcctggcctgctccactgtttgcgttactgggtggtggctgcaggcatctgagtttgtggctcctgctttacagagaggactgtggcccccagggcagaggggtccttgcagcagataagaagacggccagcctggctctgtgaggactgtcagcccagaagccagatgggtggcctcgcttgtgaggacacgctcgtctaacagcagtgcagagaggtagatatgccggtcagggcaggacggctgaatgcagcacccattgttgcctggctggagctgcccagccacaactcaagagaggccttgacagcaggccaatggctgcccagcaccagcctttaagcacagtcctccctgtgcccacgcagtccagcagcgtccgcagagccccacagcccctgctggagcccttgagcctgcagcagcaaggctgcctgagcacataatcccacggcgtgaggcaggtcagggcagggctggaggaggccgcccaaggtgaccctgaaggccactcccagctgtgattccctcacagttctgggattccaatgtcaccgcaacatcaaccagcctccttggacacagtctaagagggctgctcacctgactttctcatgggagcttcatttacctttggccatgtgtttcctttgtttacgcattttggaagacaggcaatttctgctttattcatagcctattatcatggatcaccattaggaagatgcgttgtccttgatcctaaaccatgggactctcatttgtctccagcaaacagccagacaatgtggcactgcacctctgccctctgcccgtgacattgtagtgggctcccagtacctgcatagccttgacctcagggaagtcccctgcagaaatctggtattctcgctgtagctgaatgtagatttccggtagcctgctgataagctctctcttcttgttttcctttccaaatacacttggcatctccttcttcaggtagctgatgatgtaggcatgcacctggaggggtatagatcaggcagggaagtgtcatttagaattgcatcagagaaggaacaaacaagattgcatcttaactccatcataacacataacaggtacccacacaaaccaggtcccaaggacaggaggaggggagggtccagggggagtggagctgtccaagggtggccggaatgtggccagacttggggaaattctacggctactgttctgttgtgcctctgagtggcaattctggtgtctgtagggagtgagtggtatgggtggggcctgggtgggagagctcttagttctggcaattaaccagaatacccaggagaaagtttcaccaggctggtgcctgggagcaacaggaaatgaaactggaggctggcatcaatggctgatcaacatggaaatctgtacccagtgaacgatgagatgagaatccccataacccccctgttatgggaggtttagactctgagatctctacaggtggaattaaagtcattctgcacaagaccagctgcctgggatcaggctggatggcagaagatccccctgggagaggagcccagaagccccagaaaccttgatcactggggcttggggtagccagcaggctgtcattggaggggcgagaatctggcctcaacatttccactcttctactgatttccaacttcaggatattaagaaatgttcactacaaaagttctctttgtatatatatatttttgagatggaatctcgctctgttgcccaggctggagtggaacagcgtgatcttggctcactgcaacctccacctcctggttcaagcgattttcctgcttcagcctcccgagtagctgggattacaggtgtgcaccaccacgcctggctaatttttgtatttttagtagagacggggtttcaccatgttggccaggctggtctcgaactcctgacctcaggtgatccacccaccttggcctcccaaagtgctgggattacaggcatgaaccaccatgcccggctactttgtatatcttgaacttcagagtaattgtgaagtcaagtaagtaactaaaataagaaaggatgaaaaacagagtggtgattacaaaaagaaaatgactatgtagcaacggaaaatcctattaaagaaaacagacttctactgtaatcttgtagaagttgaaattaaataaagggggtaagcagatacattccatagctcagctgagggcccgtgtgtggacacatgctggacacagccaaaaacattttgtgaggatttggatgctaacctaagtacctaatgcaaggtctgacatgctgaggtcagacaatgtcaacttcccatctgcacaagggtcgtttaacagaagcatgcactgtgcagcctggctaccgctgagaggatggtcttggagagatgacgctaaacctttctgtcaccagcaaacttgtttatgtacttatttttcaaatgaagacaattgaaatgatttacaagattcttagagataacttgagaaacccgaagtttgggatccgttatttagaatcctgggctttaaccgctgtgatgagcaagtggtaagataccaactcctttgcctccgacagtgaatgcctggcttggtgtgggtgggctggggagggccagggctgagggagcacccttggactggaggagctgccacgttccatcagggagaaccagctgctcaccagctgtccttgcatcatttccttggcctccaccttcctggaaattctggattgggcctatgagtatgttctctatgtatacctatgtatacctctctcttctgtgctcaggctcaccccaccctggagccaccccaagggaagcaggaggcccccacagctgctcagtctcccaaacacaagggcttcttattgagaccacccccttccctgctctggggcctagccctggagcagctgcctaggcctctgtagggcttcccaagagccctcaccacgtactagtaaggtacctctgagccgccaggccccagctcagggagggcttagttcccgctcatctggctgactcctcacccactccctgccgcccaccccccgaggttgggcacactgttcctgaacactccctggtgcccagggcctgctttacctgcactgaactcagctgatgtgcacctgccacacccttcacccactgagtgtcacctgatccctcgtctcaggcctcatggtgtttgctggctgatgaccgaggtggccccgacactaggccttcacagccctgataaacctggggctgatcttgtgccaggtctcaactccctcctccttccgccagcttggtgccacctgagtcatgacccttaggtgacctgctcacactgcagctgctctcggtcccagcctccacttctaggaagttctgttagcgaggtttgtggaagtctcctgttacgctgcctctgcatgtccacccgcgtcctgcccttcctggtgcgccctaaacaataacccagggccaacttctgtgcacagacctgctttcagaagttcatcaagttggccaggcacgatggctcatgcctgtaatcccagcactttgggaggctgaggcaggtgggtcacttaaggtcaggagtttgagactagcctggccaatgtggtgaaaccctgtctctactaaaaatacaaaaattagctgggtgtggtggtgtgctcctatagtctcagctactcgggaggctgaagcaggagaatagcttgaacccgggaggcagaggtcacagtgagctgagattgccccactgcactccagcctgggtgacacagcaagaatccatctcaaaaaaagaaaaaaaaattcatcaagtcacaaggtaaattataatccttagcatcatgaaatactgaatctggaagtgaccccccaatatctactttaattcctggttccaggacatccatgtgactcactcaaggtcatacagctagttggtagatacagagctggcactagcatccaagtgcctcgttcctgtccctaaagaactaatgactccctgtgggtatgccctgtgggtatgcattaataatcttactgaagttgttcaaaatctggaattcaaaatgaactgtgtcccatagaatgagtctggaaaactttgatctgaggtttgacttctgctcgtgcctaattcactgagaggctttggaagggtcctttattctccctttccccacacatcaaacacggacacaatgatggcacacaaacgtcgggacaccacgtgggaatgcgggtgaagactgcgagctgctggcaggatggcatcctgtcattttctaaagtcttctggtaaacagacgggacagcttgaatgactaaaatccacagtcagcctccagagatcactcctgcaattatgtgtcaaaggtgtctccaaatacatgccagacccagggccagacctggtggttgtccctggggaaggaggtggaaacacttgggtcttctgacctttataatgagagaaaactaattgggaagaggaggagtacgaaagagaagagggggactagacctggagcttgaagatgaggctcaggccccgtgaccactgcctacccactgagcaacttggggccaggcatggcatctccacctcagcgtgctcatccacaaattagaaatgacaacaacattcatctcacagagttattatgagaataaaagaggtcatgtatttgaatgcactctgctcactagaaagaggagcaaatgttaacttgttatcaactaatggccaaagaccaacagctggaggtacagtaatgagagagagggctcccggctggttactccttaccaaataattaataaactctctctatttaaatagtaatataatgaatttgggttccaagtgtttaatttacattgacccctgggggcttttgaacattcgtatcttgttcaagtcatcctttgccttgtgtaaacttgcagaagccctaaggcatctaatggggatgactgggggaaatcaaatggatcaaaatgacaaaatgacaatttttctctaggctaataactcaatgagcagaaaggaaagtccttccttttaaatgtatatgaatgtatatgtagttcacacgtacactctgacacagatctcattgtgtccaatgatgtgtgtgtgtgtgtgtgcctccaagactgagacacatgtactaaagagtgatactggccacatctactctgggcttggagggtaacttcagcgagtgctggatgctggaagcgaccagtgctggaatgaaaagcttcatggaatgtgaggatcaggcagtagtttggggaaggcgggctgggaaggcatggtgacacactgtgccacgctcatctgcaaacttaacgcaacctgctggagacctgcggctggaagcccagctctggaaacctgcatagagtatttaaagccagggtatcagcacgtttataaagtgggtttatgataatataaaaaattcagttaataagcctgagacccaaaagatgaacccatggggtaacaagagtgtgagactgtgagaggcagagaagggcagctgacttgagcaagggtttgttattctgctcagatcaaaactggcaccaatggcacgtgtaattccgtgcagccttaaaggggaccggagggggctgcacacttgtctgaggtcaaccttcaaagagacaggcttccatttatgggctcaagcactgacacacacacatccacagtagctcagggctgctgactgagttatttttagagccctgccgaggactaggcaataccaggatcttcatgatccattatatcatgattctcacacgctttagcctgaatccatttggtgcacaaaaaatgcctcatttctttacaggagaattttttttttttttttttgaaatggagtcttgctttgtcgcccaggctggagtgcagtggcacgatcctggttgactgcaacctccaactcttgggttcaagtgattctcctgcctcagcctcctgagtagccaggattacaggcgcccacctccacgcccagctaatttttgtattttttgtaatttttttgtaattttttttgtaatttttgtatccagcacttgctgaagttaccctccaagcccagagtagatgtggccagtatcactctttagtacatgtgtctcagtcttggagacacacacacacacacacacacacacatcattggacacaatgagatctgtgtcagagtgtaagtgtgaactacatatacattcatatacatttaaaagggaggactttcctttctgctcattgagttattagcctagagaaaaactgtcattttgtcattttgatgacatttagtagagacggggtttcaccatgttagccaggctggtctcgaactcctgacctcaagtgatctgcccgccttggtttcctgaagtgttgggattacaggtgtgagccaccgtgcccagcctatagacaagaaagccaggctgtgcacatcacatgtgactgagaagagtctacatttgaaagaataagctaaattccacagaactacagtgaaccttgaaaatcactgacctctcctcttctttctcagttttacttgtttcttcctcaaatgttgcctcatttttgttgagcaaagatctccaaatgggtgacagcctttcctattcttgggcaatacgcttctaaagggtggggtctgatagtgaacttgcattgtttgggatttgtatgagtctaatttctttaatttggctattttaattatagctgaataaaagtaaatgacatgttccaaacccttttttgggctttcccaaaacagcttcctttaaagaatcatgaaatgaaccctgattggcatctcagagtgtgagccgtcttccaagaaggatgtctactgagattgtaagaagtgatctttgaggctaaccaaaaacccactctaaagtttccctgttccttaaatacagagatgtgaaaaaaatatacaaacagaaaaagaagggaaataaacttcaagagctctttgggaagagtatctatctacttttcatattattaaaatgtcacctttatgacacttcgagtttgattaaaacggcgcacttgctttatctggatgggccatgaatcctggttaattatggtgttctataaataaacatactccacaacccaactcagacttgacatctcttagctgacatctgaaaacttaccctttgcatgttttcaaagtgtcagcttgataaacctaaactttgtagggtttctgtggatggagacttttatggaataaatagattaacagatcagtgcagaaaacaaggacacagggaggaggtactgtagctgctgttcactcccgatttcaggtgactgctttctggactgaggtgtcacactgaccgaggtttgaacgtatactttgcagcttacaggctgtgaagcctcggggacataacttcacctttctgagcttccgttccctcaggtgggaaatgaggacaaaaatgcccaactgtgtagttgtcaacaggatcaaacaaaaaaacacacataatgcagactacagagctttggaacagttggtgtgaaaaaggaaaactggatcaagagaaaggttaataaaccaaaataaaagcacttttggaaaatataaacactccaaaaagaaaaactcaggtaagcatctgtccatttaagcagaaacaagttcagcggtggaacatgaaactgcaggtggcgtgaggtcaatgtcatgagttagtggccaaggccgccgtgctgagtccggcttctcctccgggtgagcccgcttcctgtccccgttcctcagcatggcactgcccacgagcaactggcactgagaagctccggctgcaaatacccatacttcaaacattttcctttgtgaaaaggaacaagccagatactattcttaggaagaaaaaaaccacaagcctttttcctgcaagtaagctcagcaagtttgaccgtcccccactccctgcatccacacaagggttttcattattcacagtgtcagaatacagagcagcgttctgtgcctccaaacccaggccgcgctggcccgttcagagggcccgaggctcaaggatggcagggaagctctacgggttaaggcgcttggcatttccagcgagctttctgctccttatttatttatttatttatttatttatttatttatttatttgagacagagtctcactctgtcgcctaggctggagtgcagtggcacgatcttggctcactgcaacctccacctcctgggttcaagcgattctcctgcctcagcctcctgagtagctgggattacaggtgcctgccaccatgcctggctaatttttgtatttttagtagagacggggtttcaatatgttggccagactggccttgaactcctgactttgtgatccacccgcctccgactcccaaagtgctgggattacaggcgtaagccaccgtgcccggcctccttatttatttatatgactgaatacagcagcatctccagtcactgggtcttcatttaccaataactggtaaatgaagaatgtccatgagcatttaaaaatagttttaaaaaatctcaaaatctgcaaaggctatgacatgagtcaccaactttggttataaactaatgtggggtgtcacacaccttgaaggttgttcagttgtacctgctggagaaaggaaacaccacaaaccaagggatcaccgagtggaaaaacagccttcctgctaccaagcattaggcccaggacaagggcgagggcaaaatcatttcaggagagctgcacgtaagtggatttacaaactagttagcacatctgccttgcagaactggagcaaaaatggcttgtagctctggaaaggaagccacttggaccaggaagaacagataaagaaggatgactcacacaagcaccacaccactgcaggttagctgagccatatgggaggaatgcatgcacacgcactgggacacacgtgacagagagggacacaggacatcgaggtcctgtgtgaggggcagcagcagccaggacggtgtttgttttcacccaggcaagaggctgcccagtgagcacactggcacgaggacaggctgctaatgagcagcaagaaggaggaagaattgtccccaccttggctgtccccatcagggaagccctccctgcctcctggccaggcacgtagtcacccttcccagagcactcatggcagcatccataccatgactggcacatagccaatcacccagggagctttacacacacacacacacacacacacacgcgcatgtttacacacatgcatattcacacaaggccatgtgtgcacgcacacccctatatccgaggctctggggcagggcctgggaatgtatgttgcttctgatgatcagccaggtttgaacttcactaggactagataaaactctaaaggcacttccagcattagaggacaatgattttatgaaacatgcacatattttttaaagagccatttttttctctgtattttctcttggaggagggatatgcttttctctctttggagacatgaattgactctgtcacttgagggatgtcagcaggtcacctctcactgccccattgggcacacactcctggggctgctgaaaggctcagctatgaggcaggcgagccaggagcccaggcatgcaggctaacagcccgcagcccagaatgaggatgcgggggtgacccaaaaccagcacactccaagagtaagactgagccatacttcttcccagggctcccctggatccaggtggtaacactggcctttggtgcacggggactagcagtggcctctcagcatcctgttggtctcaccaatgccacctctttcaggtttggttggttatattcctatcgtcctgacatcctaacagctaccatgtagtgggtgcactgattgatccccctccctgtgcaccaggcactatgccaagtgctctgtcacactgaccaactgtcaccccaagttcttgtgaagtgctcttattagctccatggtacagattggagaacagggttagtcatctgcccaggagtgcagagccaggagctagggtgtcagcagggccacctgacctcgaggctgtattcttaacctagcgcatgttcattccttaagccttctggaacgaagcctcctcccacccatcttgcctctggagaggagacagcagagtcccagcccctggcctctgtgcaaggcatctcctggcttaccttggccagcctcgctcgcttgatgaggtcgttgagcttgcgcaccgctgccttctgggggaggctctggatgtctctaaagaggtcctgggcctcagcctcgaagagccggcggttgtccgtgttctgcaggggctgcgcccagaaggagccaatgtagacgcgcagtacctcgggcgtgttgatgaccttgcctagggaccacatgagggccccgtagacccgcatcagctgctgcgtgtccacttggtcggccttgttcagcacgacacggatcttgtcgtcctggccccggaaggccttgatggcctctgagaattcatctgagatgtccagcttgtgagcgtcaaagagcaggatgatcctgtccaccctctcggcaaaccactgcaggacctggcagaagtcatagcctgggtggagagaaggacacgtcagtgtagccactgctgcaggagacacgtttaatgggcggctcaggaacagtctcgctctccagcagctgccagggagagagccctgtctccaacctggaggcagtggaggcctggtgacatgaaaatcacgggctggatgaatccgggtgggaaggacctggggagcccttccacaggaggagggaggaaagagaatggggctcatggtcactttgggaattgctgactttcatatctgcgatttcatttagtcctcatgagtgttttatttcacctaatacagaccttttgcttgatggcagaattgatcaatggttttataaaaacacaggccatgggtcaaaagatcttacttctgaaaagtctcacttttctgaaagccccaaatacagaagaaagagaaccagaggccacctggcatcccatgggggtatccagtaagcataacagaagaggcatcgccttcaattaacccaagtttgtagagtgctgaggaggtcaaaggttggcccagccagtgttgtgatcaatatttatctttggactatttataactcaggtatattgtgaatatttttttaacattacgtatcacagccattgtgtaaaatggtctcttgccaatttctttttttaaaatggcctggcccacagcaaattctgtccagcctattctgaccacctccacaaatcatgcagctgcataaacactcttcagcccaaggtcaaggctctcaggcctttccccagggaggcagattcccacgaaaagcaaacaagaggaggccaagcccacaaagttgacttttaatctcagtctgactagttgcagaagcagagtctcaatccagcccagctagtgctgagatgtcacctgcctgacccccatgctaggggtcgtctcccctcttcttttagattttgaaaactttcaaacatacataaacatctgtaagtcatataatgaatgctgatgtacctaccacataattttaacaaatgttgacactttgctttgtttgctatttcagatatgttttaaaaccaagtatcgtttctttagataacaaaataccatacggtggtgagaaggaactagatcttcacttgtcaacacaggtaaatctccagaaaagaacaagagtaaaagcttagtttcaaaaggacatatacagcatgataacattcatgtaaaatgttaaaatacaaaatactcaaccatctgtggatacagactatagcacaaatacaaaaatgtcaacatcgattgtgagaccctggttggctgtgggggtggagaaggtgtgaatccaaggcagaggaaaaagtatctgaggtgaataatctattaggtgaaaataaagagggtctgcggactaaggtttccatgcatttgaagaacaggtgttagaggaatagctgaacaagcaaactggattcaggtccatttttcataaagaaaacaagacagttggtaacgctgaagccccctgtgcacccctccctgagcccttccccccactagcaggccgctgtcctgagtgtggtgtttatgccgccacacgcgtggatacttccagttcatgcttttcatttctctgttctgtctcactgcggcactccctgactccttggggataaggaagacaaaggcagttctcggaatgtgggccagagtttattttcattgctgtcagcagccagtttaggtcagaggaatatcaaagacctactgacagggtcacacatagtcaaggtttcactctgagttctgtccctgaaaggccagaacaaactgcctcctagggtaacactaagtgctactgccatttgagacagacgtgtgcacagacagccctagctcacaggattgtaggtccccagcggatgaatgaactggctgtttgctgggtgccgggaagatgctttggagccacccatagatggacctgcatggggacttgcttttccaggagagatgattgattcaccatgctgacctgaccactctcccacgtggtcttcctagtgatcagatggggtatctgaaggttcagaaacagatcaaagaaaacgctgtgcacatggagtgaatgtgagttgcttttgctgaatacccttcctgttgggtcaggaggtatcctttatgggttgtggaggctgaaggtgtggcagagagtccctcgccccattccttagcaagctggggcataagcatgtgatctagagttagacattcacttccttccaccagagaggagtgctgaaccttggggaaatgacacgaagacacagtgaaaataagaatttactcatggtggtggcggcttcctaactcttttctaagcctagttctccaactttcccattaatcctgtgacaaattctccaaaacattttcttttctgcttaaattagttagaatcagcttctttggtttgctattgaaagtgatgataaggctgggcacggtggctaatgcctgtaattccagcactctgggaggcagaggcgggaggattgtttgaggctaggagtttgaaaccacctggcaatatggtgagaccctgtctctacaaaaaataaaaacaaattaactgggtgtggtggcgtatgcatgtgggctcagctacttgggaggctgaggcaggaagatcacttgaggccaggagtttgaggcagtgagccatggacccaccactatactccagcctgggtgagagagtgagaccctgtcacaaaaacaaaacaaaacaaaacaaacaaaaccacaattggtaaacaatcctcccctcacccccatttaagatttcggaatacctcttactgtcggttccgaaagaaacctgccacccaaactgaaacacagctgctgctgctagctgcgctcgcgccaaccctgccgtgcttgtgccaacccagccgtgcagatgcagtctctcttcctcccagggccgcctgggttgaatggttacctttgattgcaacacttgtgtttaaactttaacttaaatttgagttcctaacagttaatttaagcatctttaaaaaagatgccatttcaatgctatagtgaaatcaaaagttattaggaacagagctgccagatttaagtttactataagtgacgccaatactcatgtctggaggaacaggtacatatccatattttcttgtgttaaagcaacaatgagagcttaatatagttcgagaagtacaggtaggcagagctgtgtttgttctgtccctgagcaggtgtaagaggacggtctgtcacacatcaggcaacacaatcaaaggagtagaaatcacagtgtccaaaagagagcaaggaatgatcaaagctgggagaggttggtctgcttaccacctccccctacaaagttaggattattttgctactttaagcattttaagtgtactgcacagtggcattaaataagtcacattgtcgtacaaccaccaccaccatccaactgaaactctgaacccattaagcactaattctcccctcctctctctagcccctggcgaccaccattctactttttgtctctatgaatttgactactctaggtacttcagagaagtgtccttttgtgcccggcttctttcactcagcacaacgtcctcaaggtccatctgtggtgtagcatgtgtcagagtctctccctcctcctaaggctgaataggtcggcttgattcttgtgtcatgaaggactcaggcggcaaatacctagctacccaaaaatcccagcggatctaactcccaacatgtcatttagtctgcctgctaaaggaaaacggtgattcagaaggacctagagaccactgatcctcaaagcctgttcctgtgttggaatgaaataaggggcttgctaaagtttagactcctaggcccctccccagagccactgaatcagaatccctggggctgagcctggggatctgcacttggaagcttcccaggtgattgcaatgcatggtgcagtttgaggatcactgtctagactgaataccagggtggggaaattgtacagataggtttatgttcctgttggttagcaagcaacaaagcaaatcaaacacatttaaagtagtattagttccttttattccaaaaagttaccaatagatgtttaggtggtgcatcacaggtcgaggaaacagaactgaaacatgcttatctgaagacagattttaaaactcacccaagctccctgcttttgcccatgctgggctatggccctggtgaacccttcctctatggtctagactgagcctagaaagccagcccaaaccctagtcattcttcaaaatatctgggccaactttgattaagttagacattacttaacgttaagctccagtttttttcacctgtaagatcgggttgttgagtgattacctgagaaaatgcttttatccataaggcattgagactttgttaactttcagcaaatttgagctgtggttactctggtttcctcaactgctccccatcctgagttcccttgcctgtgctgcctatggcaccacttcacacagggtattaaaatcagagggatgggctggtctctttcattagattatatattctctaaccacaggaactgtgtcttcatcatggtcacacaagatagtggcggacaatgtgggccttggacccagactgcctgggaccttcctggctccatcacttactaattctgcgaccttgggcaaattacttcacctctctgtgcctcgtttcctcatctgtaataacagtgtcttggggctaccctagggctgataatagtatccacaggcctcaggagctgcagagttaatatacgtgaagcatttagaatcaccttggcacctagaaagctgtccaaaatgctatctactggttatttaaaaaatctttgtatccagtgcctggcatacaggggggatgcaagaaatatttgtgggagaagtgacagaaagcaggcagtggctgcctatgacgggagcccggctggtgagtggaacagacaaacagggagcgtctcagggtgatggaaagtttctatatcttgatgatggccatagtcacacgagtatgcaaatatgtcaaattcaccaaactgtacaattagatagaatagatgcatttttcacgcctgtaatcccagcattttgggaggtcaaggcaggtggatcgcctgaggtcaggagttcgagaccagcctggccaacttcgcgaaaccctgtctctactaaaaatacaaaaattagccaggctaatttttggcagatacctgtaatcccagctacttgggaggctgaggcaggagaatcgcttcaacccaagaggcggaggctgcagtgagccgagactgtgccgctgtactccagcctgggtgacagcgagggactgtatctcaaaaaaaaaaaaaaaggtgcatttaatcatatgttatacttcaacaaaattgacttaaaaagcaaaagtaaataggaagaaaagaaagaaaaatcccaaggctgctaaacttgtttaaagatacacatctccacaaactgctgaatggaccaggaagttgaaatctgttcatcaaggggctacatacctaagctggctgtatatggaggtgaacgaagctatagtagaagccttaagctttagaagaaatcggccttaagaaccactcgaagcggctaacctgcatcctgctttctggccaaggtgatgaaaacctctcatggtgacagaacaggagtgagaatgctccaagtttgtgagaactggtttcagctaggcacaatgcaacgtggcctggggcatggaacgatctggacctatgtgtgtttgcatgtactagtgtgtgttgtgggtgcaggactcaacataatcatagaatcatcccacggtgctcagtatattttcaacacttattcatgcaattaatagaaatttcaatcctttaagaccttccagtgaaacttgtattagtctggaacaaaaaagagatgtaatcagtccagttgtttcaaaatatagtttctttctttgccaaaggacccaaaagctacacagcttggggaactaggagaaagaatttgtcctgcggaagatcccagattggcattcctggctccatgttctgggaacaaaaggagggggcaggaaggaaggagccccttctacccaatcaagggcttcccgtcacagcccctgtggaaactgtggtcctccatcctggccagagaaagagccaccagggaatggcataaggggttagaacagttgctccctggctcaggtaaatatagcacgggggtccctgaggaagcaaatttggcagtctatttttaatagaacaagagaaaaataatgcttacatttcttttcagagccaagtttctaattatgagttttaaacaagatgtgtgtctatggccaggtgcggtggctcagacctgtaatcccagcactttgggaggccaaggcaagaggattacttgagctcaggagtttgagaccagcctgggtgagtgaggccctgtctctacttaaataaaaaaaacaaagaaagatgtgtgttaatgaaaggatgcaaggcaatggaaggcaggcagaaatgcagccgagctccccctgccatgtccctcctcccactcctggggtgggcagggccacttgcccgtggtggtgacggaacactgcctaaaactgctcaaacctctcctcttttcgaggccctgcccgcccctcccatagttagtagctccagttccatgtgggcattcctaccactgcccccagcactttctgtgtggctctgtctgtgcaaccccaggctctcctggctgcatgttcacctttgtgtccctccagcacccgtgcagtgagcatccagcacgaggcaggcaccaagagttccttcttgtccccaggttccaacctcactaatctagccctcagacgatccccatcccttcttagaactcaaagattatctccaaaactgtgagtgtccctgattatgtctagaataaatgtttccagaacaaattctccatgactagcctctgctgcaattctcaacctttgctcagtctcttactaagccccaccctctccactgcacaaaccacactgggctctgctgttccgcagcagcatcctgtacttccctgtctccacacccttgctcaggcttttctttctgtctggaatgccctttcctcttctccaactacagccactcatccctctggggaactttcctccaggtggccttcccccacccagtggaacagaaccgcctttcctgtttcctcctgatggggtctgtagcagcctgagagcagggccaagtcttcactgtgtctgtaacccaaaggcccactgcagatgccttacactatcaaatcaggttcccggggatagagtcttatagctttaatgaatttccttcatagcacttatactctgaaatggtatatacatttgctgactataagacagaaattctgagggcagagactccactccttattctattcaccactatacacccaggaattactactgagcacagtaggtgttcaatacatttggtttattcctccaaaaactaaaaatggaactatcatatcatccagcaatcccactttgggtatttgtccaaaagaactgaaatcaggactttgaagagatatctgcacacccatgttcactgcagcattattggcatcatttctttatccattcattcattgatggacgctttatggcaacagccaagatgtagaaataagaaaagcatccatcagtgaatgaacggatagagaaaatgtggtgtacacatccaatggaatactattcagccttaaaaaaaattctgcaatatgcaacaacatggatggcccttgaggaaaaaaacatgctaagtgaaataagcccatcacagaaggacaaacatacataattctacttgtataagatatgtaaaatagtcaaacacacaaaatcagagaggggaaccatgactgccagaggctgtggggagaaggaaatggggctttgctaatcaaccagcataaaatttcagttaggcaagatgaataagttctagagatttgcggaaccacactgtgcctatagccacattgtgcttgtaatggatacttaaaaatgcgtaaagagggtagatttcgttaagtgttcttatcacagtaaaatacagtaaaattggtttaatcaagtgaattcacttgaacaagaaatgtaactgatttttagcaatctggcaagtttagttgcttaaatagtggtatgcgtttctaaaaaagggttgttactaactaggggaagtgtaaatcatctcaaagtaaacatcaactatctgggatcgctcaggtattataaatacacttcgaaaagagtccctttagttaataataacagccacttcagggcaaggagtctctgcattgtttcctggctgagtttacttcgcaactagaaaagtctgcttctgaaaatgtcttctgaaaatgtcattgtggcagagagcaaaatgatagctataaatcaacaactgcagcaaatatttacttagctcttactacattcctgcactgccctgtgagctccatatcactacaatcttgtaatccttgcaacaatcccatgaagtaggtacttttattacccccattttacaggggaggaaaaaagactcagagaggttaagtatccgacccaaggcacacagctgtttctcaggggagcccggattcaaacccagggactcggatcctagagcctgtgctttcacccgctgcgctgcaccatatgtgtaccaggatggtagaatcagaggtgagtgtactttattttctcctttttgatttgtggtttcctaagtgttctacaatgaatatatattatttttatatcaagaaaacaaatatgcatattgtaaaaattattggcccacttgcattattattgaggaggttgttctttttcttctacaatggtgcttctggtgaaggtctggattccagcatttccctgccagaggctatggtgggtgtgccgagcaccaccctgagggggaagcagtatctcagcaactacacccccgaggaagaggcagtccccaatcagcgggagcaatgggacctgctgatgacaaaataagccacagaatgaatggctctgctccactggccttctctcctccctgcccccttttccccagctgaccagatgcagggcagtggcagggaggggctgataccaaacccggtctgggagactgcccggagggaacacaggttcccaagctccttttggagaggctggatgtgagttcacctcgaacctttcagctggtaatggccacctcttggagaatgtaactggttaccagaaaaccccagaggttgtctcccagtacctagcctaaagtgggtgtggccacagaacctaccaaaatttaaataaaagcaagaactaggcgtgtccagggatggcgttgtgctgtttatccgctctctgctcttcccactcctccttcctttgggattttgtccaagactctgtaaattaatttttctgtgcctgtttcctcataaaataaacaagctaacctcacagcctgtccctccttcctctgggggatatgtgacaataacagatgggtgagccacatgtccctgaaggcccctccagggcaagggcgggagagccccacatcacaggttcgtgccacgccacagacatgggaacagaggaaggttccacgccagtactcggcccactgaacgctgctgcttctgggcatgtgaccaagtgaaagggaaaattgggtttcgcatctcactttccatctcagattaaataccagatgaagaagcaggcccatttaaagaaggctgagccctggagaaagacagcaacatggtattatcagtcattttaggctctttgctggagagggaagttggtaaaaaaacctaccaagaaaatcctgtaagtcctggagcctggcttaacaatttcattctgctgggcctcagtttctatacctgtgagtcagatgatcaaaaaggattctttctagatcttaaattttagctatatagggtggttccaaacagtaagcttctttgaaataaaaagccagattcccaggaaaatcgatttagctcagcgtctgtatagtacagacacgaactagttacagtgccagcctaagatgacccttcagatggctacagtagacccttcagatggctacaggaatactgaatgaacaactctaaatgacacaattatcaaacagtaagtttcattttattacatcccttctactggattcatgtgctatatagcatttgggccaatttgaaggtccttgaatgtttctataggtgtaattagttgccccaaagtttaacttattgtcatccaattccaaacaactctatactgaaagaaactatctgaggaagggttgtggaatgtatgacttccaaggatgcttaagaagtcaccccatctaaccttctgatattattatatattaggatgaacagatccaggaatcccgtgtcacgcacatggaaattgtccattcctcatttttcaagtgggctttgtgtataagtcaggctagaaagtctcatacaatatgtctataaatcagacggagttggcgtggcaaacattacttgcactgaattttcttgaggcaaaatgccaacagactccacccaaatgtgatgaggtcaaacatttataagcaaggctttgaccgtgacaatgcatcttgtcattctgtggttcagaagggcaaaggtaatgtttcttcaggctacagttttctaaagagaaatgttaaaccaacgggatgacaactggggtcataaagggctagaaagcaacttctgacctgaagaccccacccctcgccctgccctgttcctcttttcaaacatcttggcattgcacaagtgtcctgcatgcctgtggacaacagctggcactgcagaccagctctagcaattaagttatcagctaaccagctcctcaagccaaactattactcagagacagttatttctgggcttatgtcacagatggaaagaaagacccagtcagtgggaaccatgggaatccacacggggctccttataaaaaaatgactcactgattttgctaaaagtagcccatgtagttaccaacagtatttcaaaacagtcaaatacctccagaaaaggaaatactttaaaaaggtatacatgaaaagatgctcaaccacactaaccatgaggaatgaaaattagaatcataatgagatggtgggcatgtaaacaggcatgccttctacagtggcatttttggcaccagctaacataataaaaagaccgccgctccttttgattccaaaattccacctctaggaatgcatcttagagttacatctgcacattttttggattagtctctatttcatttatttttttacattgataaagaaaaattgtatatatttatcatgtccaacatgttgttttgaaatatgtatacactgaggctgggtgcagtggctcatgcctgcaatcccaccactttgggaggctgaggcaggtgaatcacttgagcctaggagtttgagaccagcctgggcaacaaggtgaaaccccatctctacaaaaaatgcaaaacattagctgggcatggtggtgcatgcctacagtcccagctactcaggaggctgaggtggcaggatcacttgaacccaggaggtcaaggctgcagtgagctgtgatcgtgccactgcacttcagcctgggtgacggagcttcgagatcctgtctcaaaataaaataaaacataaaataaagtaaaattaaattaaaataaaacaaaattaaatatgcattcaatgtgaaatggctaaattgacagtgcaattagcatatgcattacttcacatacttgttttgttgtggtaagaacacttaaaatctactcagcaatttcttttttttttttttgagacggagtctagctctgtcacccaggctggaatgcagtggcgcaatctcagctcactgcaacctccacctcccaggttcaagtgattctcctgcctcagcctcctgagtagctgggattacaggcgcacgccaccacgcctggctaatttttgtatttttagtagagacagggtttcaccatgttggtcaggctggtctccaactcctgacctcgtgatccgcccacctcagcctcccaaagtgctgggattacaggtgtgagccgccgcgcccagccagcaatttctttttttttttaagctcctcccttttcagcaattttcaagatatatttgcacgttatcgtgccaactgtatacacttgcaccgtacatgctaaactgtgtaaatccactgtggcactgtttgtaacggcaaaagattaggaacagcctgaatgtcacccaccaaaaggatggcacctattaattctggtctatctatatgatggactgcgggaggcagctccgaagtacagacatggacaagctccaagatttactataagtgggaaaatcaagacacagggcagtggagcgaatcccgccagggctccacgtgagtgggcgggtgagctgggagaagccccagggtctgcaggcagggtctgctctgggagaggaactgggggatatgggtggtacagacattcttcactatctttttgtagccttttgtcccaagcacatacacacctacccaccgcagggtgcttcagaaaggtgaaacgctgcatacatggtctgatttgtgctttgcatctcgatttggattccaacaggaggcaattttgagaaagagactaagattacaggtgaatggaggtttcttgaggaaactgcatcagggcatgtgtgagaaatatccctagatacaagaaagaggattatggcaaaaagaattggaggagtgccagaagccgggcccctcagccacacccgggaacactgctcccgggtcattctcttcagcaggtttcccacctccagcccttgtctgcactctcgtggctttccatagctctacggtcaggcccaaatacttcacgcaccctcaccgcccctgctttggatctctggaagagcaaggcccttgtctgagtcccaggactcggccatcctctgccctcccctgggaaatgctgagcgcttggccgagagggccctctgagctgggtccgtctattctgggaccaccccagttctataaaatgaatcatgaccgcccctatcaccagttattaatcatgatccatgttaaatggtttacacatgttatcttcaaaacaaccctgggaaggaaaattccctcactttataaaagcggaaagaggctcacagggccccatgctgggattcaagctcaggtcagcctcctccagggcccacaggagtgtgcctgcatctccccacctccctctgtctttctaaggaaaatacagatgctccctgaaagccttgttattttcagcgtttccccaaccacaggcttgtttggatggtcgagatgcctgcctgcctgccgggcacaggtacatgaaacctgaattcaagccacacgtgtatcctggggaggaccttttgctgtttccctctcactctgagcttcatagataacaggaacggctgatatctatggagcacttaggtatgaacacagatcattcagattctcgtaagatcccactgtacgagagaaagtaccttcccctgttttagagcaggggaaaatgaagctcaaagaggtgaagtaactcgcccaggttgcccagctggcaagggaaagagccagggacagggagaaacgtgcccggccagtgtttctcggcatggattgccactgcctctcttccacctagaatcctgcatttataatctttccctcccaccttctaggctgggggttccccactggtgcacagtgattaggagggagagaagctttaccacctctagcaacagggattgaggctgtgtaacaggaatgtccccataaaaccagggaaggttattaaacgtttcaaagtgtacctgaaaacttaaaaaaattccttctttattttcattaggggttcctaaaaatcctagcttccgaagtaggctaggcgggggtgctcctgcaagcagtgagacacagacagaggacccagcatcaggcctcacgccctccctgtcagacgcccatgaggccgacagggtcacttggtgactcctgcgggacagtcacctctgcttccttccaaagccctgccctggaaggaggctggttagtcacagagcctgccccaccccatcgtctctctcactcaagttctcccctccgttctctgagagggcagccttcaccctcgggcatacagagatgcaggacaaagcccaggttggtttcggtaggttctccaagtttgccagccccttctttcacttgttttggggatggcagggtatgtaggagggacaggctcaggctcaggagtggtggctcagccctaacccagattcctcaaaatggggccccctgtatcagaaccctctggaccctgcccagatgcccctgaaccatgtgccaggaagtttttttttttttttttcaaataaataaatggagttttgctctgttacccaggctggagtacagtggcacaattatagctcactgcagcctcaaactactgggctcaaggttctcttgcctcggcctcccaaggagataggactacgagaacacaccaccacacccaactaatttattttattttttgtggagactgggtctctctatgctgcccaggctggtctggaactcctgccctcaagtgatcctctcgactcagcctcaagttctaggactacaagtgtgagcccctctgcctggctgaagcagcattttaacagctccccaggtgataactgtctgtggaccctggggctcaccgtgctagtcttccgagcatcatttgcagccgtgtggactccagagcaggagggggcagcagggaaaggctggcctagaacatatatgccacatgtatgacagagaaggaaaggacagcaattgcacggccgaaggaaagagaaaaaccagcaaccaaacacgcccagagaactgagtggcaggcccagggctgttcttgcccagtacaggaagacccggacattcctaataattctaggtaatcaacagaagattgaaaaagacaatccttcagtggcttcctggtactctcagagaaaaatctatgcacttccccagggcctacagctcacagcaggtggcgggggggcctcctgatctcatcacccaccacttcctggctgctccctagcctctgccttccccgaatctgccaggtctcacctactctctgcctttgccaatgcagctcctcctgctgaagagctcttcccccaactctctgccaggcaaaccctccattctttacgtccagcctaaatgccacctcctcagagagccctccctgactgcccaccccttgctgtgggacatgtctttgtttcaattgcatttgttttgtgttttggctcctctatctcccctagtatatgcttcatgaaggcagccatgaggtctcactgttgctgtgaaacctaaggcacctggcacctgacacatagtaggtgcttaagaaattgaccagggggcacagcagagtggggtgcacagcagacattcaacataagaaaacctctttcccctttccactatcctaggagtgagaatgcagggtagtgtgtactcttttccaagcaaaattatcatcaaaaattgctaaaggaaaaaaataggagatttgatgttgctgggggaaagcatcaattacattttctcatggggtttgctgccttctccgtgtgtgtgactggcagctgtattttgccctggtttgcatccacgcctcttgtggttaacagcacgcactctggaaccagactgcctggtttcaatcccactcaaccacttattggctattttggtcatcagccaccttaaaatgtagtggcttaaacaataacttctattttctctggaggttctgtgggttgactgggctcagttgggttctcgcttggggtctgtcagaaggtgatagtcagacagtggttggggctggagttacctgacagctcaactgagctggttctgtgatggcccctttactcacatctcagctggaccagccaaggaggctgcctgggcctcttggcctctccttgtgactagcttgggcttccctcacagaatggccgtctcagtcacagtatgacaactactaagagtagttggactttttagatggcattcggctttccacagaatgaacacttgtagagatttaggtggaacctgcagggcttcttatgacctagccttaggaaatcatgaagtatcacttttgcagaattctactgatcaaaagtgagtcagaaggtcaatccagactcatgaagagaagactcccaaggcacgaatgctgggaggcacaggtcttggcgtggtggtgggaggaggcagtatctttgaagacaagctaccatacttgctacatgattgtcagcaaatttcttaagctctctgtgcctcagtcttctcttctataaaatgggataattgctcctacctcacagagcttttgtgaggagcaaatgagttaataatatgtggaaagcacttaacaatgcactatgagagtattagctattattattattactcaaaagagtaaggagcaaatgtttttctctgattaatctctgtatcccaatgtctgagatatcccgtgaaatgttttatatcataaacataaatatgaaatgctctatatgcaaagtaagtgaagtgtccttctccccatcaaataaaattttttgtttttcatctaaaagtcaaggtttcaagtttagataaaaacagtcatttctcacaatcaataatgcatttgatgtattaacaaaaactcaaactagctgccggggctggcgaacgctgttgtgagtcacagtggcgatatgctcacatcagggccggaagcagtaacacttgtggtgtggaatttcccgtggcaccagcggaaaaggagtctggatgcgtttgtcaaaacttccccgaaacaaaaagaaatcaggatttcctgctagaggcccaagtggctagtgatgtccaggacctcacaacccaacctcagactggccttagccctggctggaaaacaggatctgccaacaaatcatcagggctgggccccagcctccagggatggacacttttctgtcactgccaaatccagacaaagctcagagtcaggtcactgaatgcaaactctaaataaaaaaatggcttcatgatccacgcctgtggctgcatgttctattctacagaattctccaccacgtcctcccatacctcctacccctcagtattccatgtggccttcaggacaaattcgagtctcctgccacatgcgcccacctgccatggacccatgttccagccacatgcacagcttccgttcctccaagggccctgagctcacatatctctctctgttctttcatacactctttctgttgtctagaagagatatcaacaggaagggcagccacagttctctctccctcgactcggtgctaggcagaggctgtggtaagagtgtcatgtcttcgtctcagtttgtctgcacgctggcctacagcgccctgccttggctggctagagagctcacccatctctccagccaggctctgatcaacagcctttcagaaggatagacacatagagcaatggaagggaactgagggttcttggtcttttaggaaaaaagactcatttcttttttgcatatgtgtgtgttttcctctcaaatccttcttgttaccaaagcctgagaggggaagtcattcttatctggacatctctaagtgttctctctcctttcccgagcaagcttcaaaatccggtcttttgtcttcaaagttcaaaagtggatgcatttgtacttccctgattgtggtctgctggtgcctttttcatttttttctgcacccctcttagtcacagcttggatgtccaggccccatttcctagctctgtcgattcttttgagatatgggttgagtaaaccttatccgaaaaggttgggactggaagtgttttggatttcagattttctgattggggaatatctgcacatacatatataatgagagatcttgggaaagggacccaagcctaaacactaaattcatttatgtttcatagacaccatacacagatggcctaaaggtaattttacagaacatttaaaataattttgtgcatgaaacaaagtttggatcgtgccccgtcacatgaggtcaggtgtagaattttccacttgtggcatcacgtcaaaaagttttggattttggaggattttggattttgaattttcagtttcaagatgttcaacctgtattgtgtttgagcaccttagctgtgttggcaggcccttgaaacagcctgttcctgtttatatcactacccaggcgcctttttgattcttgagggctttccttaacatctccttaacattgcctaggaggacttaaagatgtttgtatatagacgttaaaatggtaatcagtgattctgaagtttctgttattgcccgtcatgttacctgaagtgcagttagatcctcccggcttcatgtactattactgtccactgcttttaccagcagggcattttctgtccttttatttttcattgtcttcccagttctattcattggtttataatgaataggctgggattaagaggcgagagcttaaacatcaggaaaagacactctcgaattttcatttgacagctgttgttcctgagagaataagtcgatctgttagaaaatttagatagagctttttccttctagagttatttaaatttttaaaagggagaagctgtactatttttattaccaaaatcaagtctattgaaggctacgcaaaacctcatattctcaagaaaccataggaataatctgtggttaaaacagcaccttgaaaatgccaaatgctaaatagattgataagaataccagttgctacattataatttttcaaaggatgttatgattggagtcagaatccggaggtttgtactaagtagctgggaacacacttgtgttcatgctaactctagaaatatatcctagattatgtttaggttcagcatggactcaatagtattctaggaaacagtatttcagcggccagcatgataagaggtcgagtgggaaggaaaatgctatgcgtgtggataaaggtgctctttcttctcatcgcagagtcaaacacctggctgctatcaccaaggacaaaggatgttctgaagagtgaaccaactcagatttacccacacacttcaagaaagcaatttagaaaaccgcaggaatccaaacattctttcattggctactaaaatacaagaaaagaaatcaagaaaagtttgtaggacttttaggaagctattacttgatcagaatattattattataaatatatcagaacacttttatccttgcttgatgggaattcaacacttcacgtcagccaggaaagctacaggttagtaactaaactaacctagtctgttgtccctaaagattttctgccaatggccaggcatggtggctcacacctgtaatcccagcactttgggaggccgaggcgggtggatcacacctgaggtcaggagtttgagaccagtttggccaatatggttaccatactgattatcattttaacatttatatacaaacatctttaagtcttcctagacaatgttaaggaaatgttaaggaaagccctcaagaatcaatatggtgaaaccccgtcacttctaaaaatacaaaaattagccaggcatggtggcaggcacctgtagtcccagctactcaggaggctgaggcaggagaatcacttgatcctgcgaggcagaggctgcagtgagcactccattgcactccagctttggtgacacagcaagactccgtctcaaaaaaaaaaaaaaaaaaaaagattttctgctaaccataattgaactaaggaaaacttgaggggtaaggagtttccatacggagtagtatactaaaaattgctccaaaatcaattgccctcatgggtttcatttatacggctcctaaacaggagatttagatgacgtttactcccctggaatgctatgtatttttttttttaaataaatagggatgaggtctcactatgttggccaagctggtctctaactcctgaactcaagggatcctcgtgcctcggcctcccaaagggctgggattataggcgtgagccaccgcgcccagccactcagcttttgagggttaatcatcaaccgcacaaaggggaaaggaggagcagtggagggcagtacacaagcggccacctttcctccttcccaggcacaatgcccataagggaggcaaagacccgccaataaagtcagtgggggatgctttaaacatcttgtggggtcacagtttgtacccagtctattatcccatgttgacattaattcttggcaaaggtggggctgtggtcttatgaagctggtcttacgaagctgggtgtaggtgtgagtatacgtgagaacgtggcactgtttgcaatcgtttgagctgaagctgctttacaacagtatgcattctttggggttagtgtgttgaaaatgtcagctgagtgacttccaccaccagctgcgcccctaacaccgtgtggcaccgggcttgggaaccacagctgtggcccgtcgtgctgtcatcgcttgtggctctgggtccttccccacctgttgctgtgtccgtcggtgtggcagggaccgccgactggctggaacatatatgctatttctgtgcataggatgtgagtaagtacatgccatagtaagtcagaccaggatatgagtcagatcatattataaagtgatacaaagaactgatcttcaaagcattctggaagcattaatccacgtgtcaacactattgtaagggagctacagtttgaaagacacgattactaagcaaaggagagacgctgcaagactcaggtgaacagaactggctaaaggcctaccaatgaaaacaaatgcatatggtgggagccaaaatccggaggccttaaaatttagaggtaaaaagaaagagttagcaggaccacatatttctccagcatattcagtcagaaatggagaagcagtgaaacacgggcagctcagaatagctgtggaacatgggcctgctttattatccatactatctgcagagcaacctttctggggctaaattaatggtcctcaactgactcttaaaaaaaaaaattgattggcactgaggtgtaaagacacacataaaaagacgaccatccacagcactatttgtaagcataaaaactgattaaccatcatgatgtccacaaatcagcaaaatgaactatattatgtcactttcatggaacccaagtagctattaaaaggaatgaaataatctgaatatactggcatggaatgatgtccaaggtagactgttatgaagaaaaatcaaggtgtagaaaatgtgcatggtaatcccatttctattagaaatgtgtttgcatatgcgcaggaaaaagtctctaagaagtgagagaaaaccattaataattgttaaatgtgacagtgagttttttttaaattcttattcattgactgaatcctttgccataaacatctatacttttataatagaaaataaagccaacaagatatttatgaatagcattaacctgttttttggtgtttttttttttgtttttttttcataattgcaaggttcttggaggcccgggaaaggtgaccttaatggcattccatagctggcaagtccctgactgaaacagtgaaggcacagcaggcaccctgggaggcctcggctcagcatagccccgagctctctgcgggaccacggagcagcagagatggcattcccaaaatgccaagagaaaggagggcttattggcctcggaatccctttcttgacccctgtcacgggaccctcactggcctatgtaactgcacttctgctttgtgagctgtggggtgttcactgccttgtcataacctgcgaccgtgaccccacacaggcttctgctcaaccctggcatgcccagacttctcagcacggtgctaccgacttgctgttcaaggggttgtgaagagttctcagccagaagtgatggcagcgatgcatctgctccatctcctccctcccagcaacccgcctttgtttcaagggccagggcaaggaaaagacttgagctgcctctggacctgtgatggcaggaacccatcctgaccctcccgatcaggcatttcctctccgtaagtcaactctgtcctctggtctgcccctgatgcccccttcctccaggacggagggagatagcaggcccaccggttttttgtttttttttttttttttgagacggagtttcgctcttttgcccacaggctagagtgccatggcatgatctcagctctccgcaacctccgcctcccaggttcagctctcgtgcctcagccttccgagtagctgggactataggtgcccaccaccatgcccagctaatttttgtatttttagtagagatggggtttcaccatgttggccaggctcttctcgaactcctgacctcagctgatccacctgcctcggcctcctaaagtgctgggattacaggcgtgagccactctacccagcagacccatctgttttgactacaaagcacaggcctagaagcagctattgcctcagccttgtcttgtgaaggctggagaaacttatgcttcggcacaagcattttctatccttcacagatcccctctgaatgcttcataatctctccctaccccacagcttcccttaggtaattcctactccttcagatcctagttccaatgctgcttcctccaggagcctctcccaacacccccgaggccaagccaggtcccctcacacctcgatacctcccattgtttaccccactcctcatcttcatttactcatgtgtaacttgacaaatgtctttctcacagaatataagcctctggagggggcagagtctttgatgctatgaactcctggttgacacttggggccccttcagctgcccaacagctgtcctggaggacggatagaataatatagggacagaaatcctctgctcacagcagagagggcctcagccagcacttggtggggaggggcagggacaggcactgacctcggctgatgcgctgcttctccccagaaaggatgccggggctgtcgatgacgctgatgctcttcaggacctgattggggagctgtgagcacatgaatctggaagagacggatcaaaggaggggtcagaaactgggcatcacagagtgctccaaccatggggcttcttggcctctctgggcttactgacatctgtaaagtgggggcctgaaggagactgacagaaactgaggatgcctaatgaagttgtttgtgaagtaggagcttggaggagattgatagcacctccatccagccacagagaacagatgctggcccatgggacaggtatgagaggtgcacaagcacctgctgccatctgccacctgatgcctttctgttcattttgattttagctaacatttattgaacatgcaggtatcttacaaatatcctctcatttgatcctcatattgacctcatgaggtgaaggaattatgcttaacataagagaggttaagtaatgctcagggtcactcagagcggtgccttaaaccaaggtcagcctgcctccaaagccatgggcctcacctctcctggctccatgctggcccctgcccaagcatcctgggcctctccccctgggaatcccatgccttcttcaggatgcactggcccactgggctggagagccccaagctccctgcctatttcctagcatgaaagctgaagggactggggcctgtttccccatctgatgccccaggaacttagcatccagcccagtgtcccctatggctttagggccagggaggggcaggcacctgtgacacccaacatcctccaggtgcttaggagtctaggggagctggagagtaggtgaggggaccaggttggggaaggccctggctgagcatctttaggcccctcttgttcctcatttgcctgataccatctcctcctcctgatcctggtccctttccctgtagtcactgcccttgtatccactccacggaagcagagtgcggaggaaaaatctagcctgtgggtcagcagacctgggttcaagttctgcccagcgtttcctgataatctgctatgggactctgggtaagggcctccctgctctgggtcttgggttcctcacatgaaaatggtggcttcccgacagggtctggcgatgtccttttagctttcagactgagtaactccaaaagtgatggcaggaagtgctttgttacttccaccctgggcaccagggtctgggatggacctttgtgaggcactgtgcatgtttaaggcagaaagtgtagaatgcctctccttttcctttactatggatggctgacatctgtgtctgtgtgggcagaaagctaaaagctcaattcttccgtacgatggaagtggtggggattactcacaaagtaaaaatgctgggaatgcaggacagggaggcctggccagcctccacagtgcacatgtggacaccacagccctgggtatgagcggccgttactgacatttcaaaatcactttctctgaaggggcttgggatacgatttttcacacagtctttcctacattttcaaatcggcccaggaagatatagaaaaagacattaggatccttttgcaggtggaaaagttgaagcacaaagcagttatgacattctgaggccatgctgctaatgcacggctggttgcagactgcaacctactgtttctgatgtcagtggggtggaatttaacccacaaagttaaaaacctcataacattaaaagtaaagggtcaagttagtggaagagaagcccccaatttccacctgtctgcagacacttgtgcacagtcccctcctgtaccccaacctttaaataaaccctactacccaacacggggagaggtttgtgggaataaagcacatgaggctcaccaagcattctttgtaagttcacagaaaaaaccccaccatgccattattcaattctctagaattggggtgggaacagggctctgggcacatccgtggtgaacctcgtttcttgtcaggaatgattgtctctcagtgccgtcccattctttccatcagatggcccgagacatctggcggagctgaacatatcacacctacgtgaaacaattttctgcaaaccattcccgtggacaggctgatcttttccccaaaccacaagctcacactcaatatccatttttccaaaacagccaccccctagattctcaggtgaggctaacagagggattcaaaatttgcacactgttcactccctgtgtataaagtgacagcctttccacagctcccaggcctcctgacatgacagcagaggccaggcacgggagccacagagcaagccaccgtgagatgtgctgacgtcaccacatggcatacaagcgggcaaagcgaggagcccaggatggctgaaaaagagaggatgaggagcagcaggtggaggcggagggagagctttggctggggcacctcaagagtgggcagctggggttttgggtgcacagctggactctgctccctgaaagacagtgtccaggggtgaggggcaggcaagagaacagaaaggagcattgagaccctgtggtgccacgctcatgctgcgaggtgacaactgcatatgaatgcattcgtacgaagttatgctgggatcagaaaaaatcctaatggtgttctagcaatcatgcctcatgcttcttctctgagaaagggaggcgcacggcaaacgtacttgctgtgtgtataacagcagtgcagtggtagtcgtagcccagtagtgaagaacctgggctctgcagtcagcactgccaagttcatgtcccgaccccatcaactcacagccgtgggactgggcaaggtatgtcgtgtgactcctctgcgcccagtctcctcctttataagcagaggttcacagccctacctgtaaggttgtggtgagcctggagttaatgtgcacggaaagtgctttgaacggtgcctgacacccagtaagggggccctggccggcccagcttattgaaatgcttccaagcacagatttgctgtcccaagatggatttcctactccttcctggggagattaacacaaggaggatctgtgccttgccctctacatttcacgtaaaatatgcagacacatgctggttcaacccaggagcctcacatggccctcacccgaggatgacctgataaatgttgtcttctgaagtaagagaagaagacggagcaactgaagatcctaggctgccccctcaactccatatcctctccacgtctaaggaagggccaggggtagcagagatgggggataaagtaatggtccaggctatgaggtctcaggcaagctgctaggagtcctgccacacagtaaaaggagagagcaaagccaggcaccatgactctccctgtaatcccagcactttggaggctgagtggggacgatctcttgaacccaggagttcaagaccagcctgggcaccataatgagacttcgtctctacaaaaaataaaattagccgggcatggtggcatgcgcttgtagtcccagctactcaggagcctgaggtgggaggatggcttgagcccaggaggtcggagctgcagtgagctttgatggtgccagtgcactacagcctgtgcaacagagtgagaccctgtctcagataaatacatacatacatacatatctacagaaggagggggcaaggagattacttaaaatttcccccaaacactaaaattccaattaaatgatcagcattttaaaaactagacttttagaagaaccagacagtaccttaatactgattttgatttctcaacaaaacagtaatatctgtagcagttataataataataaaatagcacaaacatttcctcacctcttactgggtgtcaggcacagtttgaagtactttccatgcacattaactccagccttactgcagccttacaggtagggctgtgagcctctgcatttagaggaggagactgggcacagagcagacacatgccataacatgctgagaagtgatggagctgggacatgaacttggcagtgctgactgcagagcccaggttcttcactcctgggctactatcaccatggcacacactggaaccactgctgtgtggcatatcatgtgcagggcaacatcctaaaacaaaggggtgacgtgccacagccctggaacttgcccctaagaggcttccttgtgtggtttgctctctacctagtggtgtggagtgtctgtcagggtggggaacaggaggtaggagatttaggctccagacgtctcccttactcattctgagaccttgaccttgcacaggtctctaaacctctctgagcaattctaccaggcctgcggacttccaggtttgccattaggttcaaataaacctaagcttacagcggagagagtatagaattgtttcaaagtacttcttttcaccccagcccactttattgatgagggtaaaaccagagagataatacaacttcctaaatttgcacagtaaatagaacacaacccacaaaaaagactttgacaactgaactgtaataattcttattatatggtcctaccacaaatggctaatcttatcttccagtgcctaggaagaactaggaactgaatttcacatccagattacagcaaagcccctggttgccctattagattgaaactaattaccacttttaaaggttaaagattatttaagactgccaatttcatatggttcaacctaaatatgtacttttataaatcccctcctgactgccacaggggaaagcccagtgcaatggcccagccaggaaggtctgcctgaccccagggagaaaggcatttctggaatgtcaggaccagaaatgtacaggcagctgctagtcaagaacaatggtttaggccaggcgcggtggctcacgcctgtaatcccagcactttgggaggccaaggcaggtggatcacgaggtcaggagttcaaatcagcctggccaacacagtgaaaccctgtctgtactaaaaatacaaaaattagccgggtgtggtggtgagcacctgtaatcacagctactcgggaggctgaggcagagaattgcttgaacccgggaggcagagtttgcagtgagccaagattgcgccactgcactccagcataggtgatggagcaagactccgcctccaaaaaaaaaaccacgatggtttagtgaccagggaactaccacccagggaaccaccacaaatcttttttattattgttatttttttagggacaaggtctctcgctatgttgcccaggttggtctcaaactcctgagctcaagtgatcggcctgcctcggcctcccaaagtgctgggattataggtgtgagccaccgtggctggccaacaaatcttgaggttaaagaataatggggaaagcttcagcaagtttattatagataaatgaaccacaatacacatgcacaagacaacccagttattccctcagattaaaaaaaaattattttgctggtgaatcaagagtcattcttggcaaaagcctgttttccttaatttctgcagctaaattggctgggggaagccgcacgtgcttggactgatgctgtgaactttagtaagtcagtttttaaaaattcccagtggtacacagtgactatcaaatattcaaaacttggctaggcacagtgtctcatgcctgtaatcccagcactctgggaggccaaggcgggtagactgcttgggcccaggagttcaagaccagcctggccaatatggcaaaaccctgtctttacaaaaaatacaaaaattagctgggcatggtgacacacgcctgtcgtcccagcaatcgggaagctgaggtgggaggattgctggagcagaagttgaggctgcagtgagctgtgatcgtgcctccgcgctccagcctgggcaacagagtgagactatatatatatatatatatatatatatatatatatacacacatacacacacacatacatatacataaatttggccaggcatggtggctcatgcctgtaatcccagcactttgggaggccgaggcaggtggatcacctgaggtcaggaattcaagaccagcctcgccaacatggtgaaacctcatctctactaaaaatacaaaaagtagctgggcatggaggtgggcacctgtaatcccagctactcgggaggctgagagaggagaatcacttcaacccgggaggcagaggttgcagtgagccgagattgcgcagctgcactccagcctgggtgacagagcaagactccatctcaaaaaaataataataataaaataaaatcaaaactcaaaagctaaactgagtgaagcctcgcttaattacaaatacagaagtaacaaatggagtagaaggtcaataatacacctgcgtattttatgatgggggaatcaccattcaagcataacacagtggttgtttatcatcaccatcatcaggcccagctaaaatgactgagccctggaagggctgttcacattccttcagctcaaagggaagtttcaaaatttcaattcccagggccagtgattcaagttattttttagaaagaaacagaggcaatgaggaagtacatgagattaagaatttcttctgtggaagataacaatttaaaataatactagatcctagacaaaaaatgtctacagctatctgaatttgaaaatatacacattaccattttttagaaaaggagactgaggaataacataacatcttattcaaaagcagactgcaaggggaaatgtcagaccccaatgcctggcacttccctggcgtctcagaggatccaatgctctgggtgcccttggctgtctcctcctctgtgaggggcaactgcctcctgatagcaacctctggaatgtcaacaagcacctccccagagctgctcccagatgggccactgaggaattcgtcgtgagcacagcagtctgctagagtttcagaatgtctcactaaagccatttccatagacctctgtgtgttctaaactccttttattgttcaagtatggaatttctctaatataaacctttttaggaatttatcttcatttctcagaaatgcaccatagaccccttgtcgctccttagaagccagcctgggaggctgtgactcgggctttgctggtttgcttaatggtggagggtgttgtccccctccaggtatcacctggtacttaactcttttaaagatgcccctgggggcagatgcccaagccagcactccttaaggagaaggccaggtaataacgatctgtcacagggagattctggtgtggctgcttgggagagaaagttctccgcagaaaacaagcaattttctttactaggtgttacattttgacctagttcccagagaagtatgctatgtgaaaagaggtttgcctctagtactaaccctgtgctgttcccagacggaagctataattatgtacacatatttgaacgccctaactaattgactctttcttaaataactgctgtgtgatgcagtggcactgtcctgtggatactacttaatgaggctgtttactcttaagtagctatgagtttacatgaggcatgtcccttacacgtgagcctgacacacacttggctagaaggacagaaactcctcttggccgatgctgagcagaggcatagggtgtgggacaggggagaaggggaacactggattccaatcccctctctgcctcttcctgatggcctctccctgagcaagtcatgtctttgctttcggccttctcatttgtagattggcaacagtattgtctgtgttatcaacgccaaaagaataatgtacatgaaattacgtaagtgatgacttgggacataatcaccgtcatcttcatcatcattactggagggctacattaggaacagccttactaaccctaaccctaaccctaaccctaaccctaagagttaaatagggggcactgggcagtgattcccagtccaaacatcatactattggtcagctggcctgggttccagtcccagcactgatctcactggtggagtgacccccagaaattaaagtaacctctttatgccttgattcctccccctccattgaggataacagtagcatcatgtcacaggggttctgtgaggatttaaagctaatacacaagtctagaacagaatctgacacataaatgccatataattatttgctattatttttctatatgttattctgaattcaactgacacttgcttttattataaggcatggattattttcagcaagttttaaattctgagacaagagctttgccattcaaaatcgttcctaaaaatttcttttctgtactcatctgtcatgtgcttgggatttgagaagaaaaaaacattttttttttttgttaggaaagtaaatcatttgccaaaataaagcaagccaataaccactcttcctggtttctcccttgtgaattcagacttcacaaagtgggaatttgaaaaaactggcagcttatttcgttaagcctttgttgggcaaaaagagccccagacaaagggcagtggcaatgaaaccagaggaccccagggaagccttccacagagacagatcctgtgccttgaactttctggggcctcctgttctggtctacttcccctccaccctgggccactctgtcctgagagatctggagagttgaccctctggggttctcccgcccagggcttaaccccctctcccacaatgagacactctggtgccaaccaagtcagctctggagttgaagagtaaactcctcctagaaaagtcagccctgcaggttggaaaaaaatcacctggacagtgttcctatcaccatcagtaataagatggaactcctctgggactccttccacatcacctgcaggtttctgttcatcccactgccaagttccctggttgctttctttgatttgcaataggatcatcaaaaagcccctaatggagaattcagctccccggagagttccatcttccacagaaggcacctgcggaggggcctgggtggccctcagccgagccagtgcacagcatccagcacatcattcattccccaggccacatgaatggtgcccctggagctgcgcgatgaggcgcttcggcctttgggaggacagcagccggctgggaggatccgttcctatttttaaaaacttctagaaaggagatgtggactgtcagctctaatgctacttcctctccctaaagaggctcggatgaccctccctagctctgtgcctcctacaacccactcctccaaatcagccacacgaaagctagacccaggaaagagggaaatagaggggtgggagagggatgataggaaacaagaaaaaagcattacacaaacgcaaggggtagcaaataggaggtgcaggagggaggaaggaaggcagatccagtgggaaagggcagagttgtagccaggggtaccagctggcctgtcttccccaggccagcagccctcagttccactgggaactctaatgaaaggttatgggaggagtacaaataaaacacatctccaagtgaggcagaacctcagtgaccccacaactttacatctataaaatagtgaccacgtaggctgggtgtggtggctcacatctgtaatcccagcactctgggaaggcgaggcgggtggatcacctgaggtcaggagtttgagaccagcttggccaacatggtgaaaccctgtctgtactaaaaatacgaaaattagctgggtgtggtggtgggtgcctgtaatcccagctacttgggaggctgaggcaggagaattgcttgaacctgggaggcggaggttgcagtgagcggagatcatgccactgcactccagcctgggagacagaatgagactctatcttcccccccgcaaaaaaaaaaaaaaaaaaaaaaacgaccacgtaagaaaatcagcttttcatgtttttcactctgtttccctggccctgctctgatgaataaggaaacagctcaaagctgggagtgagaagcaaaagggacagccagggaggtgaggggtcctgttctggagtcagtgggtaaaatccgagtgtccggtgaaggttaggggtcctctgggctaagctctctgactgcagaagcccagcgcaccatgcctgagaggtgtctgtctaaccagtgcttaacattgccagtgacgaggagctcactgcctcatgaggcagcctaatccatttctgtgcagctcaaattattagaaatttgttccttatactgtaagcatttttattttttaacttttaaaattttttgcagagacagggtcttacttcgttgtccaagctggtctcaaactcctggcttcgaacaatccttttgcctcagcctcccaaagtgctggattacaagcacgagccacacacctggccctgtgcagccttataatgtccagttctgggccttagctctgccctctcaagttacccagaataggcataaatgattatttcctatgatagtctttcaaatatcttaatatgataaacatattttgtatgacttctagagcagagattctttgttcttctgtttttgaacctttatatgtaactggcagtaattcaaagaaaaggtttaaacagcctgaccgaagatggcagcttgctggtccttaccgattcaggaaagcgtttccaaagcgactgagctttctaaacggctttttggggtccacgactaaagcattccctggggtgctgccctcagtctctccatacatcacggcgatgaaggagtctgtggtgggctccggaccaatcctcatgcctgggaaatcctgctccagtaggtatctgggagagggaagaagaagagaaagcttagcatcttatcacaaagtaagaggccagaaagctgcctgggattaccaatttttttacataatcatttaaaaacgtagaaacataacccccaagaaaagcacgcaatcctcctctgcatttctgttgatgcaacagacgctaccccaagggaagtgtaccgtgctggctcctgggcatcctggaagctctgctcaggctcagctcccttaggggagcctccctgacctgcatgtggggacacctcttttgtggtccctgggcaccctgtgcctgctgccagcgtggtgctcagcatgtgtactacaattacttgtttatgggccctgcaaggtgtctgagctgatgagggcagactcatgtcccaaccatgccaggaggatgatcttcgtcttataagccttgaaggggctcaagggaaaaaacctgcacagccttctgcagctccccattcctgcaactaacaatctatttggtcctaaactacttctttgtttctaaaaagttttgactgattctaatgtaagcccacaatctgtgactatttccagggaaagagagaaagtgctgaattctatcaaatgccaaatacaatttttccatctttaaaagaatgagaaattaagccaccatttagacctatgttttctatgtaaataaaactgaaaaaaaatttttttttttgagactgggtcttgctctgttgcccaggctggctggagtgcagtggtgcaatctcggctcactgctgcctcgacctcctgggctccaacaatcctcctgcctcagcctcccaagtagctgggactacagacacatgccaccatgcctagctaattttttgtagaaacagggtttcaccatgttgcccaggctggtcttgaatgcctgggctcaagctatcccctcaccttggcctcccaaagtactgggattacaggcatgagccaccgcaactggcctaaaactgaaattgtttagcaaccttaacgggctatattctaaacctttaattgatgtcattgctagttttcacttcatccaaagtttctacgtttctgtgaagttgtggcaccccagaatagatacaccattaaaatatgtctcctaaatttacagtaaatctgatgatatcttttatctctaaatttagagaaaaaaatctgctaatagcacacggcatttactgagtgcttgctatattcctgatatggcgctgagccttctatattgtttcacctcatgctctgaggtggatgatgacattaccctcgttttatttacaggtgggaaaactggggcatcagagaggccaagcggcttgcccaaggtcacacagcggatgttcgagtggaaatggaatgcaagcattcagactccagaacttgcactgtcttcagaaatggcctcaagttagtggtttgctcaggggtgaagagcaaagcaaagttcagggcctcatcccagggtgtgtcacttggcatgagggacgaggacccccatttcctctcagctgaggggaagagctctccacaatgtccccctgcacggtcctctggctaccctgacaacaagggccagctctccctactctccctggagtaaagctgggctcaggaggtgctaccgtttcaaaatgtgttcagctttaatttttaaaatatcttcaagagtttctccatcaaaacctctgtatccctaatagcctagaaatgttcgtgttgatcaattcttacacattccacacaaatctgagaaatgctggtaaaagttactgtgagggatgcccactctgtgaaactccagcctctatggagtggatgcagagcgtgtggactccatatacccatgggaatgtggaatttaggttttacagcccctctgggatctcaagggtgaagacattcagcagcgaggctggaattcaaagccagatcacactcttgcctccactcacgtccagtttgatttttacgccctgtggcctggatggggctatgtctggaggctggtatgactgagggaggagagactgctggggagggaggggcttgggagaacagcagccagtgtcgcccagctccccgcagcacacacagttcgcaattcacgaaaatgtgaggtgcgggagtgggtttgaagcttgacaggcactttgctccagaatcagtgctaatagcaacggtgggctggccaagacggcctacaaaaggtcacacacactgattaaagggatgaaccagacgagaactgcagcgtgtgctttttggggaagagctcggtgtggagctccaccttgggtggctcgcggcaacacggccccttctcggcaccttcaccaagcctggccaggaggaggcccttcagattccgggccagggaggtgagcatacggatatcgtagttaagcagtgagtcccccagctggacaatcactcacacagcacaggtgttgaagtcagacatcactgtcgaggagtgcctgaattactttctgatgtttcattcctgtacaagtacagcaaatcccactacttttgaaataacaggggtttcaaggaaaaatataaatgaaaaaattgtttaaagaagagcagatgtttcctacattcaagtttatattgcaatcgaagccagagttttctaagtagcgaccctactggacagacctttaacaataaatcatttttaaagtgtgcttcaagtgtgaaataatttgaagtcaaaggtgtccccctttgactgtgaccttggtaaatcaatctctggatctcagacacagaggaagaactagaattaggaagaattactgtattataaagcttgcttgcattatcaatttgtttggtgatactttcacagataatacaaagttaacattcagtgttcaatttcaccatcaaagaaataccagtaaagacagagcacattaacaaatttttgaaaactcggaatcatcaatgctggcaagggtcctgtgagataaacacccttatatatgttggtgggggaataagttggtctaacttcactaaaaagcaatttgacaccatgtgttagaagcctttaaaatgggggtcttgctgggagcggtggctcgtgcctgtaattccagcattttgggaggccgcagtgggaggatcgcttggcctaggagttcgagactagcctgggcaacatggagaaaccccgtctctacaaaacatacaaaaattagccaggtgtggtggcgtgcatctgtagtcccagctacttaagaggctggggtgggatggtcgcttgagcccagggaggttgaagctgcagtgagctgtgaccatgtcactgcactccagcctaggtgacagagtgagaccctgtctctaaataaataaagaaaaaataaactcaaatggggattttgcggagttgacctctaacagctcgtgctggtgttatttgagggcctgtttcctctcctctcttgggctgtcatttcctgcagggcatggtctatatactcagtactttagaaacctggagtctggtaggaatgatttgagtcagcctcttatctttacaagcgacaagactgagggttagtgcaggaacatggcttgttgctggtcaaactcacagggtggccatgcaggatccagaacctgcagcccctttctcctggccccagacttctgctcttacaccaggcacagcaccatcaccctggggtcctacactgcccccagctccctggtgctctaagcaggacctggcagatccctgactttacatatgacactctaagctgattgccctgaagaagatttttcactgggggactgcagaaactcagattcatctgttacactgctgggtaaacaggtacatgtcagtgcagtgagggaactcggaacaaccaagacaccaagtatctgacatggaaaaagggagaatgaagtgatggatccacacacagcaagctggaagggaagagtctgagctgatgctgaggtgcaatgtgcataaatgggtcaatcacacagccacacgggatagacagcctgatcaactgtgttagacatttctcacggtgggagtgcctcagaggctttcccaaagctacgagtttcagggactctagtattatctgcaataacaacaattcaaaggaacaagaggacacaggaagaccaccgtgattcagagctgattagcccctccacaggcatcctgtgctttggagacttgatttttgtccttggctccactttgctccccctttcctgtgttctcggagaggcctgccaattccagcaatgattgctccaaggttctcgagccaagccagccacataaaaaggtatggacatttggattccaagcagctgggcggaagggatggtgggatggatgggagacctgacatccccttgtcctggtccgatgaggtccccagttcagactcatccaagtggctctggggtaccccggttgccagcattcagcccaagctcacagagctactttgatgcaagagtatatatggatggtgtcttctttttttcattgcttaggctagaattttttttttcacttcatagaagtgaatgtcatttatgacaaggggaagaaaaaaaactctcaagatattgaaaacagagatactctcaatatgtccaagcaccatcttctcaacgatgagcttaagaatgaataaaaaccaaacaaatctaagtggcacattattcaaacaaatgctggagtagtgggcaaagcattacactttaaataaatatacctaacgcttgaggactcgttatgtgctaaagtctttacatgaatagtctcatttcatcctaactaccttatgggcaggtactatttctatccctattttacagatgaggaaactaaggctcaaatgggttaagcggtttattaagatgaaggatttcttactagtcttatgaggacaccacccaccctaaatcagagcctgagaggccgacgggttccactgggaatgtttacaggaacgtgtcctgtgaatcataacaaatacacaaatgtaagattttaaaaataatacggcacatatattttgagtgttgtatgagcattatttttaaattatcaagccaaatctaaagaaatggtttgtgtgggctgggcgtggtggctcacgcctgtaatcccagcactttgggaggccgaggtgggcggatcacgaggtcaggagatcgagaccatcctggctaacacggtgaaaccccgtctctactaaaaatacaaaaataaaattagccaggcatggtggcgggcgcctgtagtcccagctactcgggaggctgaggcaggagaatggcgtgaacccgggaggctgagcttgcagtgagccgagatcgtgccactgcactccagcctgggtgacagagcaagactttgtctcaaaaaaaaaaaaaaaaaaaaaaaaaaaagaaatggtttgtgtgatgataaacgagatcttaaaatatgttcgtgcataccttggcatctgtgcatggagtttgggggttcaattcattgctattgcctgaaacatttttaaaataagttttggaaagtttcatgtaatatatttttcttcagaatacttacttgatccactatttcactaggagagggatgaaaaggaagagttactacttctactctgatttgatttgagcctggaaagatgttttaagagcagtttctggccgggcacggtggctcacacctgtaatcccagcactttgagaggctgaggtggatggatcatgtgaggtcaggagttcaaggccaccctgtggcaaacacggtgaaaccccgtctctactaaaagcacaaaaattagccgggcgtggtggtgcgcacctgtaatcccagctactcgggaggatgaggcaggagaattgcttgaacctgggaggcggaggttgcagtgagccaaaattgcaccactgcattccagactgggtgagactccacctcaaaaaaaaaaaaaaaaaagcagtttctattgtttaatctatccttgtgtttcacaccaggaaaagtaagtgggagaatcaagcatttattacttccaaagtcttacaagataggccaagatatataaatatttcctagcaaaacagtatgacctgcactatcactgcttctagatactaacaaatgacaggttactctgaagccgtactgtacagtttataatgcatttcacacattcagcttatttcatcctcactgccatgggagcaggtatttttattcctagtttatagaggagaaaactgcttatgccaagttaaatagcttacaggagaccacattaatactgggtaatgactacttttaacattttgatgtatttccatcccatcatttttcagtaaatgtaattttcctttataaaattgagataaaagttaaacaattttgcatcttgatttttcaccattagtctttcctcataccattaaaaattctttgaaaacatgatttttaatggctgcatactattctaagttgaatatgtatcaatttattttgtcatttcctgttaggcatttaaatagctttctattttttgctgttataaataatgctgagataaacatccctgaacaaacatctcatctacttaaaaaagtctcctttgaattactgaaaaactaagttaggctgatcttcacttacatttttttttttttttttttttgagatggagtcttgctttgtcacccaggctggagtgcagtggcatgatctcagctcactgcaacctctgcctcctgggttcaagtgattctcctgcctcagcctcccaagtagctgggattacaggcgtccgccacacactgggctaatttttgtatttttagtagagacggggttttaccatgttgtccaggctggtctcaaactcctgacctcaggtgatctgcccgcctcagccttccaaaatgctgggattagaggtgtgagccaccgcgccagcctcacttacattttaaatgtgaaaactaagttttattttcatttttcctttagttaaatcattgacatgttatcaccaggactgtttgttcagatgatgtcacctttgaaactgctgtgcctactaagggaatggacattaggtcattgaaccaataaactggaatttgctgggtaaaacttttcgtatctcaggctatttttccagctatggatgggatttatactcctcagggctgagatgtgcttgaaagcacactgctgtctacccactgccattacctgtaagttgctccactccaccttccatgctgttttgggaggagggtgaaagaaagggaggggaatttcactagaatcaaatcagtttcttacagttctatttgttcttccagtctttcagtcatgcaatgactatttattgagtgtttttgatgttgtaacttgtaatttaggagtatgacaacagactttaggttgtaaactctttgatctgggagtactgtaaatcgtcatgaggaggttatggaacacagcatatcccaaagttacttgactatggaacccttttattttctttgaacacttacgaatgatctcccacaactgcattccacagaacataggttaaaggaaaaggctaaaaggcatctaacaaactccatatccattttgtttttttctccaaatagaatcatttaaatgaaatccttttaaaactagtaatagataatttcttaatgcaattaatttatagataagaagccaccagctgacataatctcttaaggtgaaataacataggcaataccattaagattagaagcttgatatgaatgcctacttcctggtattatgaaatatggaacagaaggggagacaaagtaatcatgaaggtaactgatacagttatctatctagaaaacctaagagaatctactgacaagctgtcagaataacttcttgagtcaaatgaccagatataaaacaaaaatgtacaactcagtagcttccttacatatcagcaataccctgccaaaaaaaataagagaaataaaaagcccattcataagagcaacagggcataaaatacctaatacattaataagagctccataggacctgtatgagtaaatcaatcacttttccaagaaggtctgcgttaaagcaatggtgagctgctgcttgggaagagcaaatacaaaaatgtaacttagagacagaatgcagttccaggacaaatggatcccagtgggatttttttttgtttgttttgaagaacctaactaagaaagttcttctcaaagaatgacagaaaatgagaattgatagcatttgaaaaataaagagtaatgcacgcagaagagtcttgagctaaaattattaaaaagtatttcaaagtgacaatatttaagatggtatggtgttggcataagaatttacaaacagaataacacgagacaaaggtcctaacagactcaatatagtatttaataacttagcgtatgaggaagcctcatgtgacagcagaaaaaggtagatttaataatagtgttagaaaatgacaaaagacaaaaaaaaaaaaacccacaacaatataattgagacagattttacttccaggtgggttaaaaagttaaatatttaaaaagtaatcctattttaaaaagagcgcccggccagccgccccgtccgggagggaggcggggggcagcccccacccggccgccgccccgtctgggaggtggggggcgcctctgcccagccaccctgtctgggaagtgaggagcccctctgcccggccgccaccctgtctgggaggtgtacccaacagctcattgagaacgggccatgatgaggatggcggttttgtcgaatagaaaagggggaaatgtggggaaaagaaagagagatcagattgttactgtgtctgtgtagaaagaagtagacataggagactgcattttgttctgtactaagaaaaattcttctgccttgggatgctgttaatctatgactttacccccaaccccgtgctctctgaaacatgtgctgtgtccactcagggttaaatggattaagggcagtgcaagatgtgctttgttaaacagatgcctgaaggcagcatactccttaagagtcatcaccactccctaatctcaagtacccagggacacaaacactgcggaaggccgcagggtcctctgcctaggaaaaccagagacccttgttcacatgtttatctgctgaccttccctccactattgtcctatgaccctgccaaatccccccctcggagaaacacccaagaatgatcaataaatactaaaaaaaaaaaaaaaaaagaggcagggcacggtggctcacgcctgtaatcccagccctttgggaggccgagacaggcagatcacttgaggtcaggtgttcgagaccagcctggttaacatggcaaaaccttgtctctactaaaaaatacaaaaattagccaggcatggtggcccatgcctgtaatcccagctacttgggaggttgaggcacaagaaccgcttgaactggaaggtggaggttgcagtgagccgagaacgtgctactgcactccagtgtgggtggacagagtgagagtctgtttcaaaaaaaaaaaaaaaaagaatatgagtgaacatttcctgagtcttaagataaacaaggattttctaaccaaaaaataaaagatattataaaaaaggaaaaattgttagatttgatcacaaatattaaatatatctgcatggaaaaactattacaaaaattacaaggcaaatttcaaactggaaaaacacttttacaactgtgacaaaggattgatatctgttactgagaaaaacatttacatttatttataagaacaagaccagggccaggctcggtggctcatgcctataatcccagcattttgggaggccgaggcaggtggatcatgaagtcaggagatcgagaccatcctggctaatacagtgaaaccccgtctcttctaaaaatgcaaaaaattagccgggagtggtggtgggcgcctgtagtcccagctactccagaggctgaggcaggagaatggcgtgaacctgggaggcagagcttgcagtgagctgagatcgcgccactgcactccagcctgggtgacagagtgagactccatctcaaaaaaaaaaaaaaaaaaaaaaaaaggacaagaccaacacttcaaatgaaaattggacaaagttcacagacaattcagacaattcacaaagtaatatggaagacaactatattttataagttcaacgtcactagtaagaaataaacaaattaaaataagtctgttctggctgagtgccccatggctcacgcctataatcccagcactttggactttgggaggccaaggcgtgaggatcgcttgagctcaggagtttgagaccagcctagacagcacagcgagatcccaactctacaaaaaatgaataaattggctgggtgtggtggtgcaatgtacctgtagtcccagctactccagaggctgaggtgggaggattgcttgagcccaggagtttgaggctgcagtgagctatgatggcatcactgtactccagcctgggcaacagagcaagaccctatctaaaacacttttttttcctatcaaattaattttaattagttttactggcagtttggtgaattactgatcctcatatttctggtgggagtctaatttggaataactgtcctaaaaaagaaagatagatacatagatttaggaatatatataagcctgaaaaaaaaaaaaaatatatatatatattttgagacaaggcctcactcagttgcccagactggagttcagtggtgcaatctcagcttactgcagcctcgaccacctgggctcaagtgatcctcccacctcagcctcccaggtaactgggactacaggcatgcaccaccatgtccggctaatttttgtatttttttttagagatggggctcaccatgttgcccaggctgatcttgaactcctggagtcaagtgatttgtccaccttggcctcccaaagtgctgggattacaggtgtgagctgctgcgcccagcctattatctatattttttgaggcactaatttatgcttaggctattctaagaaaaaaactagaaatacaaagatttatggccaaaaatgttcagttcattgcaacattatgtataacagcataaaaacagaaacaacctaaatgtccaacctgtactatagattatgatgtagtcattgaagttatttttgaagactatataatgacataagaaaatgctcatcgtatcatattaagcaaaaaagaaccccatttattaaattatatttacacaatcctcagttttgtaagcatgaattctatgtcttcatctaagtcactgagagaaatgtgaacagatggggtttggaacggatggaaggttcagcaaagtcagcctcccttttctgggttgaggctagccctcttccattcctccattaactgaaccttcatctggcaatggttcccaaatgtttcctaggggagggcacataagaattactgtgagagatggtttagaaaaacaaaaacagattttggagcctgacccacagagatttcgactcaggaggtctgaggtggggccctggaatccgtgtcaaaaggcctccaagtgattctgatgcacagccacgtgcagaaggaaccacggccttctggttcgaggttttgaaaaggacattgaacaccttttgtaagtcagcttctgaatgtgagttagggaagataatgtcaggatggaaaaagccttccccctcctacatttctccaaatactctgttgctgcttgtcaggtggatgatgtgacaactggcccagctgctggcctgcagcgcttccctgctcggactgcagctgccagcgctcccctgcccaccccccgccccacctactcacctcctgcctacccccaccaccccacccagccccgcctaccctgcagctccttgccctgctcttcaggacttttgctccaagtcttgcctcctctttgtcttctgagatgccagctgctccctctccatggcttcccttctgtccacttttcattctgctgaggttgtgcttgtctttacccaaacccctgtgatgcttgtggccaggcctccttcccccaggcctagctgctgagaatttgacgcctcacatcccactcattcctcaacccgcgccatctggcttccttcaccaccactcacaggcacacctcttggcaaggtcacctggctcccaaaggctaatctactggttctgtttcagtccttttcctggaagcatctgacactactgaccaccacctctctccctggcttttgtgggggtcatcgttgctttacttgcctcgtatccccttttcttggtagcagcatcctcaggagctgccttccccagctctcaggccacgtggttggtggggctgacctccccactccccacatttcatgcccctgcccctaaggattggttcagggatgggcatatggtcagggtcaaaccaatgagactcaagcctgagacttttactggggctgctgagccagcagaattcgaggctggaaatggaggtggccgcctgcccacccctgagaaggaacacaacatgaggagggccacagagccaacagagtcctggtgtgtctcctgcagtcctgggccaagcctgaagcttgcacatcctggtctgatgggtttcaggaaaacgttcttatctttttatctaagctagctttggttggatttctgtcacttgcaacctaaagagatctgagacagcactgagccactaccctcccaggcaattacccacctctttggtactttccccggagggtctccacaagctctgcttcctctcacttaagagtcctgtgcaaggacttctacttcccagatgctggctactaaatgctgacactcccaagtcaacagaccagcccagatatctccctgagctccagacccatgtcttacccctcatggacatcgccaccttggtgtccactcaaacatgacaggtctaaatctaaacttatcattatgccccatccttcctcttcttggatccccatctcagtgaacagctgtactccccagttaccccagaaaccgaggcctcatgggtgacacctccccaccctcactccctggccctctttgggcagctaattctctgctcattcctcagggctcagcttttaggctgcattctcagggaggcagccttttccaacccgcaagcctgaatgagggggtccctcctatgcccccagccaccctgtgtttctagtgttacagcccttgtcactcagagctgtggcctgttgactctcttctgtgatggctggccccaaccctgaaatcaagatcatttgaataaatgaacactagcatctgtaggtgtgatcttatattgtatattgaaaatatagtctaattttctgtaaaaattaaatatctcaatattttagagagatctgtaaagggtataatatttggaacagaagattgattttcaggagccccagtatctggatgagtgtgagaaccactaaataggacccatagtttttctgtgtgagattttatttttttaaaaatagatgaaccaggctgcctattagtgaatgccttcacttcccttttccttaattactgagtctagaaacttatcaagggaatgaagcaggcctttgttcctattcagaatccatttccctgcttttttgaaaatgagaacatctgcctgcttccagtgttccaatacttttcatattcttcacaatttcttaaaagccaccaaatacagttctttgagcagaaatgcaagttctttcatccatgtgtccggccagagatttcctgaacctcgcctgtggcaggccctgggagagctcctcagcctgtggttttaatcccctcttgaacacagctgggctcccttctgccatctctggggcattttctttgaggaaaaggaggaagctgagtagttctgctttctgttaatattgcagcaagagcccatgagtgggccgatcacttcctgattcttgttcttgttctaatcataccttaaaaggcttttttaatgtccaaggcacttttaccttctcagcccactccagcttcttgatccttcataccgcccataaaccttgtctgcacccttgcacatgcacccctgccccttttttcccctattaaatactatagttaaatgttaatatctaaagtttttaaacacaattacggtatcaagcattttattaaaaatttttatcatactttgattttaccaacttgagtgttatgaacaatgaacatgtttatacattgacaagaatactcatacagggattgtgggatggctactttcactcccttttccctcatctttactcctttttttttttttttttgtagagatggggtctcactatgttgcccagggtggtcttgaactcctgagctcaaacgatccacctacctcagtctcccaaagtgttaggattacaggtgtgagccactgcacctggcccctcatctttactctttagttcctttgcccttgggttcttctagcttatttctactttgttttctttctggcatccatttctattttaaattattacacatagatgcagaaattacttggctggcgctagttgcagaatcatgaaaattaaatcacatgatgcttagtgttgaaagactgaattgttttggttttttattgagatataattcatataccagaaaatttattcttttacagggtgcactcctttagtatattcacaaagttgtgcaaccaatatcattatccaatttcagaacattttcatcacatcaaagagaaactccacgcccactaacagtcattctctatttcgtttgcatgcggctatccagttgtcctagcaccatttgttgaactatagtttcccccattgttctaatagtttttaagtggtttcttaggattctctacatagaagatcatgtcatctgcaaagagttttacttttttctctccagtctgggagtttatttcttttcttgccttatttccctgctctctacccttttaaagcctatatagtttcttgagtgacttccctcttttttcctcattagaataagttttctggggagagggaacagagcatatgaagggagaaagtggagctcttaaaaatgtgtagtttgggatggggcgcggtggctcacgcctgtaatcccagcactttgggaggccaaggcgggcaaatcacctgaggtcgggagtttgagaccagcctgaccaacatggaaaaaccccatctctactaaaaatacaaaattagccaggcgtggtggcacatgcctgtaatcccagctactcgggaggctgagacagaagaattgcttgaacccgggagggggaggttgcggtgagccgagatcatgccatggcactccagcctgggcaacaacagcgaaactgtctcaaaaaaaaaaaattgtgtagtttgcattcatttcaaatggacttcatactttttcagtggaaatgtcttccttcacagcacctggggccagggattttctggaggaatctttgaaatctgttttcctcaagttttggacacaagcctgggtgagctccatatccatccttcctcggctagtacagagtctaagatgacatggtcactttcccccatgcccatctcccctccttctctggccaattctttattgccagtcaaaggcagaagagccaacagcaataagagaagattcccaccatgtcagcacaggttctgtgtcatcagtgacctcttggaatgtgcaggaagccagggagataagaatctatggctatgtagattaggtacaccccacagccaagtatgagcttctagggcccaatcgctagaagcaaacaacccagaccactaaccaggctctaactaaggcaggatccaggatgctcagcaccctgggccaacccttccgctcaagatgaatccatggttcatttacagtgtctggggtgatatttaattccaagttcacaagtctccagggtagctgcccttttgtttggggatttcctcccgggtgctaaatcacttcctcctagctccaatctgaaaagcaattcaggtctcctgtggcctcaccaagcttcctgcccacactgattttcttctaacctcactggtctaccttgtgtacatcacctaacaacaaagccacttagctcaaggaaagcctcaagaacaaatggcttcctaataaggtgattcctccctcaccctagggtggcccacagctccagcacctgctgagaggtggccaatttggatgaggtagctgccaggaatcaaatctcagaacccttcataaaactgcgcttagctattccacaaatttctccaaataatgaaacagagagaagagtgagaatataatgagagagaaatctggaaaaatacaaaagataaattcatgttcctgtgagttgtattcatcttcctgggagttgataatcaggctggctagctatccagtctatgggagcagagagagggctgcattatctccaggttggcacagcatctagcaggggctccctgatgacacctgggcacaacaaggacctcacagcaaagacaaacaggaggaaatgcctagggtgtggggacatgccaccactaaattacaaaaatatatgcctttcttctttgtatgtttcaacagtaccgcttcccactcttgtaccacttggccataacactttattatccctagtacctaaaaactagacagtattactgagaccttaaatgtgacatttgtcatctttcaaggtgccagttactgtaatacagctatggttcattttgagtgtctgggtgacggtgacatatttaattctatttttgtcttgtccataagcaccaaataaagcaattttgaaattactttcttcacactcaatttattatctagaacgacatttcaatacacagtatatttgttttgtggaattcattcgcagtgtatctggaggcctggatttaacatatttcctgtagtgatagctactctatttgtaggaactatttaggtcactggagtggagaaaaagaggtcgctacttaacagaaatggcatgtatccaaatatagatgcagttttctcaacacctgttgcacatcaaatgatgaagagattgttacaatttccaaaaccctggaccaaaaccttaaatgatcagcactttgtttcaactgatacacggcttaagtcagaaaaataagttcttcttaccaaaaacagtgagcctaaatatgctggctgctttagaaataaaacaggtgatcaacaaagcaatctgtttctgtctaaataatttcccagcaaaagtcacttcttttgaaactatatgatttgaaccacagggtatgcacagtgattgtgtgctttcagaaacacggtaagcatgacaaatattttcagttgtcaagggtaagcgaggagggaatgacccacctaagaaatggaaactaacaaatagtaatatgacactcccccttagttccacaggctggtgcggctgctacacgcagctcacttcctacgggcggctaaaggcggtgcatgaactgaacgtaggcggcctctttatcccctccccacaacactgtggggtggcacgtaaagacctcaagggaagggggcctgggcgatacgctctcctgctgccattcatttgttcaagaaatagttgaacaaatgaatagttaaacaaactctccaactaggactctgtcccattcggataccctacgcctctccccccatttccatccctaggcatcactccctcgtcaagaatatgctgattatggctcgcgccccctctctcccttggaccctcccgccagggcgaccggacgaggccagcgggagcaacgccttccgaaccgcaaggaaggagggctcggagtgcgcagggcgcgggttcgcgggaccctccagcgcgcggggctggccagccggggcggggccgagggcaccgggcgccgagctccgggaggggtccccgaggtcgcgccggccgggaggggcagcggcgggaggcggccgactgcggcgcacacgtggggagggcggagcggggcgggagccgggcgaggggcggtgacggtacctgatgaaggtggtcttgccggtgctgtactggcccaccagcaggatcatgggcttgttctcgaagtcggcgtcctccagcgcaggcgagtggaactcgtggaagcggtacgcctcctccagcggcagcaccttgcgcaggtagagcgagcgcagcccgcccgtcaccgtctgcaccgcgtccgcgccgccagcgcgttcgcgcccgcccgcctgccgccccatccagctgaacatcctgccgccagtccacgctcggatgggaccctgctccgggttcgactctccccggctcgcact

SEQ ID NO: 2677 - DNA, 26889 bp, Homo sapiens
agggatgcaaaagtgttttactaccaggagttcacaaatctgtggacagcacaccagtgaggattccacggtgttggggaggcaggcagggtggtactcatgacccagaggcagagacaggagcaagagcccttgggcccactgcacccacagcttcacattgtgaaggaggccgggagaaggggaacaggcaggggtgggaagcagcccaaccttgggttttggaaaaagattgcatagctcgttaaaaccctgacctcttttttttttttccgctctgtcctgggtgaccagggtgtctgccagcacttggacacgtcagaccccaccacctcctgttgggttatctgcttttccctctttgggggggtggggagcatttctggagtaggaaaggactggggcatggggcggggtgcggagggcctggagagaggccatgggtcccggggctggaccacagcggggctgtgggaagggtcctaaccttcacaggcccccttcctggttaaggttttttttttgctgaaagggccacaggatatatttgtggtgtaaaccccagaggctgccactgctttcctggggagcttggaggccacacccatgtgactgcagggcaggatggtggacttctaggcccctacagcctcggcagtgtcctcagatccggatgtggaaagtgctagaaagagagaaagggcaagagagggtgagaggccctgggtcgggcaggtaaaggctcctcagggaaaagcacagcaggccccagccccatgctggacagtgcctcattagggaaccctgcatagtggatgcaggtaatcaacactgggggaagacggaggaacagcggtgcccagggagttctgcccccacttatcactgaaggggcccccaggtcttcaaccttccccctgcaggggacaaaggccagtcacacgtctagggcaagggtggcttgaacgtgacctcctgcttcctggccgcacaccactgctcacaaatagcgagtgataggggcctcagccccaacatcccggcctgccctgctctgccctgcccaagcccggcccctgtagtggcagcacctgaggaagtcaggggccttggcaatcatgtcctcgaagtcagcaaagcccagcttgccgtcaccgtccaagtcagcctcctcaatgaccttgtcgcacacaagcaccacctcctcctcatccagctctgacttagtgagccgggccagcgtcagctccaggtcctccttgcagatgaagttgtcagtgttgaagtctgtagggcaggggttggacatgttcaagtccaggctgcgtgcacccagggacccctacactatagctcttcctcctagctggccccactacctccaccagcttctgatgtccccagagcatctccatgcacactcttgggatactggatccctgcccccaagagggcttacccaccaggcatcgcttaaacacccacatccaccaccaacaacaaccccacaatgactaaaccacatcctgaagcaggtcaaaagtccaaatctgaggtttcctgagaacttcaggcttaggccagatagcccttcctggccttagcccacagtggacccagtgttccctttagacttctagagctaaggaaactaaggcccaaaaaggccatgcgattgaatcaaggtgggagagccactcggagatggagcagggattctgactagggcctatgggactctaagacccatgttttctaaactgcaccccgttgcctcagtggtgtgtgaccagaagacacggtgggtcaggagactcaaaatcaaaagacccttagagaggggcctgtgcctggcctttgtgcacacagagcagggaacatggtttgattctacccagcaaaaggcactaccactgccccaaagcacagcaaaatggttcagaggaccgagccatgcctggccacatcaaagtgaactctctcttcttacattttgagcccaactaccagatctgcgcatgtgctgtttcttctgcctggggtcccttcccagcaaactcctggtcatccttcaaattttggctcacacatcacctcccagtggcggggctttctagcgataagggtcctcttccccgcaaatgagcttctgttgcccattggcaaactctgacattaatggtagtgacaaagacccatcatgtgagcattatatgctctttctcatttaattttcaaaacaaaactatgaggcaggcacaattgaatctccactatacacatgaagaaacagagaggtggccaggcgcggtggttcacgcctgtaatcccagcactttgcgagtccgaggtgggtggatcacgaggccaggagattgagaccatcctggctaacacggtgaaaccccgtctctactaaaaatacaaaaaaaaaaaaattagccgggcgtggtggtggacgcctgtagtcccagctactcaggaggctgaagcaggagaatggcgtgaacccaggaggcggagcttgcagtgagctgagatcgcaccactgcactccagcctcgttgacagagcgagactctatctcaaaaataaaaaaagaaacagggaggtgaaaaggagaggtacctgcctgaggtcacatcccggtcattgttggaccctagagcccaagctcttggggtgactctgccctgtctatctctgcagaggcctgggcacaactctagggtatgcgtcagggagtattcatctctgcccatggcatgggacatagcaaatctctggaaagatttgctggctggctggctgaattcctgtggccatttaacctgagtaaactgaggctcagaagtgagatgatcattgttgcaaatgaggccccaggcctccccagcgccagactaggagggccctggctgcctctccccactccacccccagcctagagcagcaaggaagccacagttcttccatgtattcctgtgcccacccggtccatgcgatctgcacgcccctgtcttgggcagacagcagcccgtcccaggagcaatgctatggggtccaagaccgggcggatgttgggtggaatctgagaagctttttacatgagccatgtgggcatagtttgtggagggcagactggcaggtattttctttctaatatgcaagcaaaacgtgggtgcacagacagaaaccaaagtcctctgaaataaacatgataactagaaagtgaaacgtcagtctgggcgtggtggctcacacctgtaatcacagcactttgggaggccaaggcaggcagatcacctgaggtcgggagttcgagaccagcctgaccaacatggtgaaaccccatctctactaaaattacaaaaattagccaggtgtagtggcgggcacctgtaatctcagctactcaggaggctgaggcaggagaatcgtttgaacttgggaggctgaggcaagagaatcgcttgaacccgggaggcagaggttgcagtgagccgagatcacacgattgcactccagcctgggcgacagtgggactctgtctcaaaaaaaaaaaaaaaaaagaaaagaaaagaaaaaagaaagcaaaatgtcagcccctgataggccctgctgcctttgggatccagtgtctgatcaaacgtgctgaggacaggagctttgaccttgactcttcaggtccaagttgggtcccagccccttcctaggccttaggcatctcaactgaggtctatctgaggatttgacaccagtccccatgggtctgtcaggccagcagagggggtgagctcgtgggtatgaagttttctccctgtggctgtgggagaagcatgagtccttggctcatgagtgcccgccgccctctggtggctggtgagacagccagcctgagggcagagctgggcggggtgaatccaggtggccctacctcaggcagtattcgggggggctccagaggcccccctgcaggcctggccttaccaccatggcctaggcagcctctctggctcctccattttacacctcaaagctgctgagtgatccttctagaaaacagagctgcccttcctcactggaaaccttgcagtggccctggtgtctggatcactaggtccaaactctgtggctggctcccacagcctggccccagattctctccagactcataccgccccctgtcccaccaccttccaagttcctcccatctccttatcaagctctgcgcttccctgtgtctgcatgggctgcgccctctgtcaggtctgccagccccctcttctccagtccaagcctctgctagtccctgcttaaaggtcatgcctgggacccctctcacactaaccacccgacctgggatgggtgagtccctccctccttcgttctcaggaccctcacagatgtctctcagggactgatcgtctcccttggccaccccactggacaggcactcttcagaggacagatcagcttcactgttcttggtgtccctagggcaggagccagtagtaaccagacagcctaagggccccacatgttcccccaccgcatattcaggccccctcctctagccctggttaccatagatcttgaaggcatagtttgccttgagctctcggggagccgactcgcagagcacggaaaacatgtccacaaagtcgttgaaagtgaggttcccctcaccatcctcggaaaacgccgccacgatcctttctttgaagggattctcctgaagaaaacacacacagcaatcactgtgggtgcaggataagcaggagggccccggagccagactgtggacagcctgtgtgaccctggaggagtgaccaaatccctctgagcctcggtttccccatctgtaaaaagggaataataataacaccttcttaattgggttgtgatgggattaaatgagctaaagtatgtaaggtgttggtaccaggcccggcacatgtaagagctcaggaagcattctactgggtcatgtcacatcattaagatgggcacagccagggacagtggtgcacgcctgtagtcccgctatttgggagactgaggtggaggaatcacttgagcccaggagtttgaggcttcagtgagccatgatcgtcccactgcactccagcctgggcgacagagcaagaccatgtctccaaaaaaaaaaaaaaaaaaaaatgctgagcacagccagtgtgttatcactggaggcactgcctcatctgaagcagaagcagaagcacagattcgtcctgttacccagaagagcacacagaggctctgcctggatgtgtagggctctgtccccagcagaagaagatgacagcccagggcactggtggccctcagctcaggccgtgtcaggccaggatcgtgggaggtggatgtggggtcagataactggaccagtcaagcagcaagagccatacagccagttcaggcccaggtctgctgtcactctgctcctgtgaattctcccctagaccaccttggatgctgcctctcccagggagctgtacacggatgccttcctagatccccaaatcactcatcctgcagcccttccatcccaactgagctagcgcttggctagcgccattccgtgcccagcccaggccagtgcgggaggctcagagacagaccacttgggtcctacccatgagtgtctcacctgctccagcaaccctctgagcttgctcttgagccccttgctgggccagacggggtgctggtccagggctgagcctggggcccattgtctctcaggactgaggtcacaaccagagtgcaggccccaagtggatgccatatagcactctgactccaccttcaagccacacatcccaggcctggcaaggggctactgacgaagtcccactgcaatggggagttgtgccccaaatgccttcttaatgctgaatgcactttacatattatggataaggaactcatgaaacgaaacattcagatatatatggtctgaggatcagcagcatcagtctcacctgggaacttgctcgaaaagcagaatcctgactctactccacatgtactgagcctgaattggcatttggacaagatccctggggagtttaaaattaaattttaacaggtacgttaaagtctgagaaatgatgctatggatgaccaccatgctgacctcagtgagaagccacagccagacaacggggagacagaaaagttatctaacaaagcagacacaggtctgccaactacagcaggcttggggccacttaacaaagggacaagcaaatgagcacaagcccatggcctgcagttgggtggccactgatgtacagcacccttacagagcccacatagcttatttattcagagtacagatgaggaaactgaggcacagagaggttctgtgatctgctcagagccacgcagacacaaagggtggagctgggttcagcctagacctgggggcctctgctgctggtccagaggcacagatcccctgctcgccagcaagaggtcctgcacatacccggagctctggcatctggatgatgaggctcatgggcacgtggacgatggggctcttcctgtagtccattgggacgaggttgggggccagctcatagaatcgcgaatgcagccttggaggaaagcagagaaaaagcgctggagggggtgccatccctaagccccagcagcccggtgctgtcctgcctaggcctctgcctctgcagaacatcctcagccaggaccaggtaaggggccaatgggaggctctctgctctgcccacagggtgtgaagttgggagggaggtgagttctgcccagacctctgtgctgataaccaggttgtgtccaggcctccctatttccaccacacccaccccatcagcaccaccaccatcactccttgggcctgggtccaaatcttttaattttttctcctttgggctctcataagggttttctatgctcaggatactgtgctaagcacttaacacatcacctaatttaatcctcctccacatcactgtgcagacagatgcatcctgaccccagcttactgctcagcaaacagggctgaagaggttaagagtgatttgtctaaggccacataactagggagcatcaagggccatgggttgagcccaagatgggaaatccaagcagaaactcttagccactcttcccccttacactcctgagggtccatcaaagcctgggcccacttcgtggccccaccaccccaacttaagccctgagggttgggtctctctgggagagctctcagcagtcctcacaccctcaggaagcccctatgaatgggtcacccataaactctctaactgggggccatcgggacccaggctgctaccctggtgggcctggccctccctcctcactgatgggtcaggtccctagctcctgtcccagcctccaggaaatcaagcccacctcaacaagctgcatggaccctcaaaggtgtaaggcatcctggcactgtctcacttggaagctcccttcctccccgccccctgcccattattcagtctttctttgccctatgtccacttgtccaggtccctgtcatcccagagaatagccccccatcccaagacaggtacaaattgtatttagatgacattgtgagctgcatgtggtggcctatgcctgtaaacccagtgttttgggaggctgaggtgggaggaccacttgaggcccagagtttgagaccagcctaggcaacacagcaagaccctgtctctacaaaaatgaaaaaaaaattagctggatatcgtggctcagtcatagctacttgggaggctgaggctggaggatcacttgagcttgagcccaggagttggaggctgcagtgagctatgattgccccactgcattccagcctgggcaacagagcgagaccctgcctctaaaaacaaaaattgtgtccattaagtgctgccatgggtgggacaagtgtaaggggcattgactgtgggctgaggtaggtaacctgcctaaagtgatgtcctaggctgctggtgaatggattaggtatgaccctgtatctcccaggcttgggccggccctgccacccccaaagccagatcagcccaggtctccttttaagtggcttgaccctgtgacacaccccaggcccacctttatcaagccattcagcacagccacccaaccttccttgggttctaccagttcttgtggtcctgctgcctactgtccttagcaaggcacctgactacttacccagctcaaacagataataacaccagctatcgtttagcaagtgcttactctgtgccaggccctgaactaatcttctctgtggattgctttacttattttaatccccaaatcaccctgagaggtagatattagtctcccattttcaggtagggaaaactgaggctcaagaatcaagtgtcttccccatcctacacagccaatgagcagtgggaacaggacttgaacccaggacctctggacaccaaccacttggctcctccctgcaagtcaagccctggtaagcacatcatctgctggttcagagcctgtccagggcaaatgaacagtaaaatgccacatgcccactttgccagtcgcacattcctataaaagggtctgaaattacaaggatgtgccatgacttggagacagagcaggaggggaaaacccctaaacttgtactttgggtgggaggaggctcagcaaatgccagggcggtgggatcaagctgagactctccacaagagggcactcaaggactttctttgctcctatttcttgcatagaggaaaactacttttttttttttacactgtccccaaataaggaacaaccacttgtttcaaaattcatgcatcttctttctttctttctttcttttttttttttgagacggagtctcgctctgtcgcccaggctagagtacagtggcgcgatctcggctcactgcaagctccgcctcccgggttcaggccattctcctgcctcagcctcctgagtagctgggactacaggcgcctgccacaatgcccggcacattttttgtacttttagtagagatggggtttcaccgtgttagccaggatggtctcaatctcctgacctcatgatccgcccacctcggcctcccaaagtgctgggattacaaggcatcttctttcataattcatgcatctggtactttgacatatccattgtgcttccaactgctacatttcccacttgaccttgaccccacctcatatgtggcagtgtgatgttggagtgtttctaggggttggcctacacctctgaagttttgtgggatggctgcagcaggagcatgaagtcaggctgaggttggagccctgcctacacctctcattagcagtgtgggtaagtgggttaatccactgaaggataagtttctctatcagtaaagcaggggctattctactgttctcacccctggatgttcataaaaccactggccttcaactggcagcttttagcatgctgcctgccacgtcagaggctccctggaaggggtggactagggagagaggctatgggtgcttggcagggttgaggaggtatcctctggggtgggaaggccagcttctaccctgggacacagatctgttctaaaacagtaactaaaatcacattggaatttttctttaaagaaaaatccaaggagaatttgaaaacccaaatcactgtgaaagaaactctaagcattgtcaaagaaccacatctctgtcacctctcccccaataaagggcactgaattcaagaagagttatatattagtcctactgtaacatccaggaccagaaaccatacttacgctacttgaactgcccccgagtatgaggcaagaaatgtgaaaactctcactttattttacaaagttaacaagaaccctgatacaagaacctaatatgtagcatccagaatggaccaatggcacttgcatagatagatgaaaaagtcttataaaataacatactgggggccaggcacagtggctcatgactgtaatctaaatgtgctttgggaggccaaagtgagagaattgcatgaggccaggagcttgagaccagcctgagcaatgtagtgagaccatgtctctacaaaaaaaaaaaaaaaattaaaaattaggtggatgtggtgatatgcatcagtagtcctagctactcaggaggctaaagtaggaggatctctagcctgggcaacagagtgagaccctgtctctaaaaaaaaaaaagataagtaaagaaagaaaaaaatagcatactggtaaatcaaatctaagactttaaaagaataatatgttaggatcatgtaggatttattccagaatgcaaagatagttcaatatttggaaatctgtggctacaaatcatattaagcaaaaaacattttgaccaatttgatagatgcatttatgactgtatatgtgaatacagaaaaatatctgagaagttatatactacatgtttacactgatagtccctgggaggtgggagtagagaaatgtgaaaagaaggaggctaacttttacttgttatttcacctacttctcaattatttgaaattttagaagtaattatttatttatttatttattttttgagacagagtctcgctctttcgcccaggctggagtgcagtggcgcaatcttggctcactgcaacctctgcctccagggttcaagtgattttctcatgcctcggcctcccaagtagctggaattacaggggcatgcgaccacactcggctgatttttttatatttttagtagagatggggtttcgtcatgctggccaggctggtctcgaactcctgacctcaagtgatccaccacatcatcctctcaaagtgctgagattacaagcatgagccaccgcacctggtcaaaagtattttaaagtatatgttgttttgtcaattaaaaaaacttaaaattcttagtaaaacagaaacaaaaggagtttctgcttaggagcagaaacaaaagggtatctccttctctttttttttttttttttttttttttgagtcttgcactgtcacccaggctggagtgcagtggctcaatctcagctcactgcagcctccgcctcctgggttcaagcaattttcctgcctcaacctcctgagtagctgggactacaggcgcccgccaccacacccggctaatttttgtatatactggggatatacccatcaatgtgggatgcctataatcaccattattatataacatttctccccaggagcactaatcaatgtactattcgccatccaggtccatgagttctgcatatgtgagtcaactgaagacagaaaatatttggaaaaaaaaaattgcatctacgctaaacatgtatagattttttttcttgtcattattccttaaacaatacagtatagcaactctttacacagcatttacattgtattaggtgttataagtaatgtagtaatgatttaaagtatacaggaggtgccgatttaaagtatataggaggggctgggcacggtggcttacacctgcaatctcagcactttgggaggccgaggcgagccaatcacttgagcctaggagttttgagaccagcgtgggcaaaacagtgtcacccttgtctctacaaaaaatatatatatataaattagtcaggcatggtggtatgtgcctatagtcccagctacttgggaggcagaggtgggaggaccacttgagcccaggagtttgaggctgcagtgagccatgatcgcaccactgcactccagactgggcgacagagatcctgcctgacaaaaaaaaaaaaaaattatacagaaggatgtgcaaagtggataaggttatatgcaaataatatgccattttatatagggacttaagcatttgcagtttttggtatccttgggaggtcctagaacctatcccccacagatactgagagaggaatgtaattagttaagacagtaaaatagtacacttaaatactggagaggaggcaagttaccatttactggaaaaccaaaaataattagcttaaagactatttgaaatagaaagagttcagaagcctttctacacaatagtttttctattatgtattaacattagccttttcaaaagtaggatttggctgagtgcagtggctcatgcctgtaatcccagtgctttgggaggccaaggggaaaggattgcttgaggccaggagtttgagaccagcctgggcaacacagtgagactgtttctataattttttttaattaaaaaaaatgaattcacaatttaaaagaaccaaaaaaaaaaacacaactaagtataaaattggtataaaatgtactaattttgaagtatcaaaaaaaccatgaaagtttaacaaaagatataaaaatattttaggtacttagataactattgtgcattcctgatcggaaagacttaatgctgtaatgatgacgatgatctgttcatttttctataaaatgaatatgaccctaatcaaaacctgcaaatgatctatttgggatctagccagcccaattcaaaagtgtgtttggttaagtgtttcttcaagctactggcaaaaaaaaaaaaaaaaaaaaaaaaaaaaagtttgtttaaaagaataaatgtaggagtgttgcaggggaaccctgaaaaaaaagagaaactggggaaacatttttccctatcaggtattaaaacagtttaaagctataataaggacaatgtatgaaacagacattggcatttacaaggcagactagtagaagtggtagatcccaatgtaaatgagaatgagcccatgacacagcatttgaaatcaatggggaaaagattaattcctctgaaagtcacaaaccagcaatccaccattcatgcctagtttccatatagcattttaaaataattaaattacgtcgaaataataaatttagaattttgctgccaccatatacagattgaaagatcttacactataaacctgggtttcttaatcaagatggtctgaattcccccaaggcaacaactagctggggctaaggagcagctatttctgcaggtgtccgttctaaagagttcccacccgactagacagcttcatttatttacagtgcatgctggcccccctgacaggcagctgagcttcagactcttgggttattcactgaatgatctggggtcagaagacaaaaagcatataacagcagtgggaggaaaaagcaaaagtcttaaaaatatccattatctttgatcaggaaatttgttggaaatacccatatatgtgcagttatgtgaatggtaccacaagaatattcactgaagtacaaattaaaatcgtgaaaagctggaaatctaaatgttcaactatacaaattaagaaatatccattaaatgcagccatttaaaatattgtatcagaatatctaatgatattgaaagttgttcgcaagatgttaaatgaaaaaagcagaaggtacagtataatcccattttttttaaaaaagcttgtatatatttatatactcacaaaaagaaagactaagaggaaggctggtcactaaaatgttagtgattatcttgggtagtagggggacagtaagatcttttttcttatctttttttaactttaaaaattgtgataaatggctgggcagtggctcacgcctgtaatcccagcactttggaagcccaaggcgggcagatcatgaggtcaggagtttgagaccagcctgaccaacatggtgaaacccgtctctactaaaatacaaaaaacagcctggcctggtggcgcgtgcctataaccccagctactcaggaggctgaggcaggagaattgcttgaacccaggaggcagaggttgcagtgagccgagatcgcgccattgcactccagcctgggtgacagagccagactccgtctcaaaaaaaaaaaaaaaaaaattgtgataaaataacagaaaatttaccatcttaattattagtttttctaaattgtggtaaaatgcacatgccataaagtgtaccatcttaaccattttgatgggtacagttcagtggcatattaaatatgttcacattattatgcaaccatcaccaccactgatccacctccagaactctctccatcttccaaaactgaaactctgtactaatcaataagttcccattccccctcctcccagcccctggcaaccactattctactttctgtttctaagaatttgactacttggctaggcctggtggctcatgcctgtaatcctagcactttgggaggcagaagcgggtggatcatttgaggtcaggagttcgagatcagcttggccaacaaggtgaaccccatctctactaaaaatacaaaaattagccgagcgtgttggtacacgcctgtaatcccagctaattgggtggctgaggcaggagaattgcttgaacctgggaggcagagattgcagcgagacacagactttaaaaaaaaaaaaaaaagaatttgactactctaggtacctcatgtaagtggaatcgtatatgtcattttgtgactgcttatttcactgtgcataatgtccttaaggtccatccatgttgtagcatgggtcagactctccttccttttgcaggttgaatagtgttttattgtctgtctataccgtgtttggttcatctattcatttgctgatggattgcttccaccttttgtgaataatgctgctatgattgtgggtgtacaaacatctcaagactctgctttcaattcttttgggtatatacccagaagtagaattgctggatcatgtggtgattttatttgtaagtgtttgaggatccatcatactgttttctttagctttcttatctacttttacaatttgcctaaggaaaagcaattttaagcatatatatacttttttttttttgagatggagtctcgctttgtagcccaggctggagtgaagtggcatgatctcggctcactgcaacctccgcctcctgggtcccggttcaagcaattctcctgcctcagcctcctgagtagctgggactacaggaacacaccaccatgcccagctaatttttgtattttcagtagagttggggtttcaccatgttggccaggctggtcttgaactcctgacctcatgatccacccgcctcagcctcccaaagtgctgagattaaaggagtgagccactgcgcctggccaattttaagcatattacaaaacaataccatctgcctttttttttttttgagtcagagtcttgctctgttgcccaggctggtgtgcagtggtgcaatctcaactcactgcggtctcaacctcctgggctccagcacttctcccacctcagcctcccaaggagctgggactacaggcacacaccaccagacctggctaatttctgtattttttttttagagacaggggtctcaccatgttggccagactggtcacaaacccctgagttcatgtaatccaccggcctcggcctctcaaagtgctaggattacaggtgtgagccaacgtacccgaccacaatctgactttttgataaacacatacaaaagaaaaacactggcataatatataccaaaagattaacagccttatttctgggtcataggcttacaggtaattttttttgtcttctcttgactggcttcattttctaatttttctacaatcattatgtatatgtgtagtaagtaattaaaataggttacacaaagtttttaaaaggttgagaaaataaacaataaaataacaagtaggcaaataccttggagtgctggctgggtgggcctctctgtgtaccaaggggacaaggactactgtcccgctgattaaagagcacagcctaattagggcacaagggaagttgaagtgctaagctcttacctataaaaagcaaggtgactgaatagggtgggctgcccactcggcctcaatgtgggaatgcaggagctgtgtcctggggagcaatcggatctacctgggtgggggcagggcagagggaaggagaattggaggcgggctatctgtgactcggtatcactgccccaaagttgccacagagctgggccccaacctgcaaagaaaaacctcctgctcaagtttcctcctagccatctggtcagtacgcagggagcagcttaccaagaaaaccatcctggtgggggtggggagtagcatccctgaaaggcccttgggagcagggaagatgagcatggcctggggctggatagcctggctctgcagctgactttgccctctctgggctccaggcctcagttttgtcacccggacctgagatgtgaacagtggagagggctctcctggaggggcagtcagtcatgctggcctctccacagagaaggctggagaaaagcgaaggggggtgaaactggaattgagccatcatggccatgcctgttccctctagggacaggcaatcccgaatctgtcttgtcttaactacccttccctgagggtggacaggtgggcagcaaactccaggtagctcttttcatgtttaataacaccatcacccagccctcccagacacaggggcctgtgagaaaacagctcctgcaagcaatgtcatccccatgctgcagacggggcctcaggcttgggttttgctctggtgttgaattacagagcctagggtcctgatgcgtgcagaggggtgcaggccagggctgtggggagccaggacgcctctcctcaagccctctcacctgcctggagcccctcattttccaaggggccagggatacccctgatatggtttggctgtgtccctacccaaatctcatcttgaattgtagttcccataatccctacgtgtcatgggagggacctggtgggaggtaattgaatcatgggggcagttaccccgaggctgttctcatgatagtgagttctcacgagatctgatggttttataaggggcttctccccctttgcccagcacttctctttcctgccgccatgtgaggaaggatgtgtttgcctccccttctgccatgattgtaagtttcctgaggcctccccagccatgtggagccatgaatcaattaaacctctttcctttataaattacccagtctcaggcagttctttatagcagcatgagaatggactaaaacaaccaccaaaggcccatcatattggatcggattcccggactggccttcaagctcctctctcctcttccccacacaggcaatcttgctgctgtcaatgagaccacgggaggatgggggtgggagtgggagcaggagaagctggcctgtgtctcacctctgctgctccccagcctggaatgttctccctcagccaatcctacctgtctttcacccacacactcttcatatggtcactggtggctaacaggtgccatgctccctgttagtcctgcctgatcacaagtctggtggggagctgggcccctgggtccaggaacccaaggagcccctaacaggctgttagagcagctgggatagcactagggtggcagggtgttgggggtgcttataaaggagatgattctggagttgggtctggaaggatgcatagcaatgctgtgggcagaggagaggcgaaggacactccagggagtggagatagccagtgcaaaggccgaggcaaggggcttttgttgccagaatgaaaatggccgtgggcctcagaagacaggcagcttgggcttggcatctacaaaggtagggaacccgaagctccctgtgaggctcaaatgaggctccatgccaagaactctgaaaggtaaaaggtgccacaagaatgccaggggtgacagctttgttattccaataccgagagccatcctgtcgaaatggggacctcacccctgacatctctcaagctacagggcaaatcccacttatcaaacactataccccagtgttgctgcctctcggcaatgctatgagggtaggtttcactatccctattatacagaagaaaactgaggctcagggaaggtcaaatggttgcccaaggccacagatgccaggtctactgatgccaggcctggaggctttgccccttgctcagactctctaaggtggtggaagtggggtatcccctgcccatgcaggtgacaggttggaatagcagcctgggtagagaggaaagccgagaggcactgcctgaatgagcagaatggttagggcagtgacaagctgcagcacagctctcttgggaagctgcaatgggctctggtcccagcctgaccatcgatctccagggcaagtgatcctgggactttgctggcttttagtgccacccaggcagaggggcctagtgaggcccgtggggcagttttcttggtattcagtgattcctgctcacccactggtcctggggttctgaggctgccgatcccctttatctttcccatccaggtccacccccacccccatcaacaccaaggagaagggctgtcctgggaagaagcagagccctgatgaatagctcaggggtggtggccatgccctcaacttttagacgtcctaggagtggaagaacatcaaagctagagccaaagggcccttagggacccctggtctaacagacagggactccctgctataccaggacccaggatgcagtgaaatagcaagggacctggagtcagaggctgggtcttgagtccctggctctgtgactttagccaagttgctaagctccatctgtcaaatggggataaatggattctcttgttacaaggtcacaatgaggattaaataagaatgtgccggaaactacccacctgaaagctcatagtaagtagatgttcattccccagcaggaggatctgggccctgggaggagtgggaagctctaactccatcctagcccagtggccgagtggggacctgaatgtggctcctgatacatgctgatgctctgcctcagccccaggagcacagccagcccatgtggggtgccccagcctcaccccggccccagtcccagtcccaacagggtgaacgagaagccacacttacttgaggatgtccttcttattgaagaaggtgcagtcctgttgagggaaaacacacaacacacagtcagtgtgcggctcccagactttcttcctcagaggcctcgatgccacagggctcacaggggatagctccggactggggacagaagagtcactactatccctttccaccttgccctcacccactggggacagctggctctagtaggtatagaaaatgcctcccaaaacctttatccatcctgggctaggcctaaggagcttagtgcatggtggggggctgtagcatgctttagggtacacatgtaggaggaagatgaatgctcacaggtatgcgtggctgatttgagtgccagtgggatacactgggggatgacagggaggtggctgggagacaactccgaatgaggacccacagggccacctcgtgtagctgcatggggtgccatcctcactgtagccctgagcatggtgctaggggggttgtgcagtcccaggctcagagactgagagttccaggcacatagactggggaagcatcagtatatacttggtgtctgaagccagaaagggatgaggtcacccagagaagggagtgaagaggccagggagatatgggagggagaaacgtgggcagggggaaccaggtagcatctggggtagaggtgagggtaggggctgctggggatccccaggtaagcattactccaggtggggggcagcacttggctcctagggccatccagatgacaaactcatctcggaggggtcctgtctttgtttagatgaactgcctctatccacagcttggcctgcccaaggtgagtatcaaccactgggagtcagtgacaatggccactatgccagcccttggtgaaaagtatagaggtgaagaggacccagcactttgtaaaatgcccaaccgtaaagggcttttgtgcacctcccctgctgtttagctcctccgcctttgtccactgttacagcatgaagcaagaaggcctcctaggtctgcagagcccagagcccatagggcctcctggggccataagctgaccagagccagctctgatgaggagtgaatggctgaaactcaggcctgcaaacagccaggcttgccctgaatgagacctgaagccgctggacatcagggcaattggattgcgtgttaagaggcccaaagagaggacgcctgcaggatgcacacaacatctggggtttccactgggtgccttcgggagagctgaaaaggggagagctggtgggaatttccaggccccatttggcccaacaagtctgtccttctaagctgctgctccctgggagttagactaaggatccatgctggcttcttggaaacacgaggggttctcctgggggtctcagctttgcttttgacagtggttcctctgtaggagcccagaaaggctcaggctggggaagcagtgccccctgctcctcacccaacacagacagaaaactccctacttagcaggcctcaggcacagacaggctggagacacagtgggctgatttatcagcaaactccagaaacatggtgcagaatgtggacttccctccaccccagggccgtttccatggtctaaggtgcccagtgagaagggccagggctctcccacctagcctggaggaggcagtcagcagaactggaaatggggagaggtcccaactcctgctctcttccccccgatctgtcctccttcccctcccctcttctctctcctatcccatgtgttggaaaggaactatccaggtcctgattcaagggttctcctgacaaaagatgcaaacacttcccctataaccctgctccctgtcacaattacttacacctccctacatcaatggtcctcacgctgtggctcctggaccagcagcatcagcctcactgggaacttggtgaaaatgtagattcttaggctccactccagatctcttgaatcagaaactctgtgggtggggtccagggatctgcactttaaaaaaccctcccaatgatgctgatgcatgttgaagtgtgaggaagtctgctctagagcagaatcacttgggggactgtttaggatacctgtgtcccccatccctcagcagaccccagacaaattgtagagaaatccccaaggatggatccaggcattggctgttttcaaagccactcaggtggtcccaacgtgcaacccaggctgaaaaccacatcacaaccagtacatgatgtaccatgcacctggcacctggggctctaaatatccaatttttcttaatccttatcattagccaatgggggtgggcattatctctctatcttaaagatgggcaacttgagactcagcaaagttgagtagcttgccttaagttgcacacacagcccaggagggctgggaatggaacttaggcctctgtgcttccctttcccctgccccccccccttttttttttgagacggagtcttgctctgtcacccaggctggagtacagtggcatgatctcagctcactgcaacctccgcctcctgggttcaagtgattctcctgtctcagccttccaagtagctgggattacaggcatgcgccaccatgcctggctaatttttgtattcttagtatagagatggggtttcaccatattggtcaggctggtctcgaactcctgacctcaggtgttcacccaactaggcttcccaaagtgccgggattataggcatgagctaccacgcatagccttctttttttctttttaatgggagtagaccttggggccctcactggcaaggaagcagaggcaagaaaagatcctctgtgcttcttggccactgcctatgactacaaacagagccatgaccactgtacaccagccactccatgtcctgcgtctgctgtgtattcctatacttatacacagcaggtgcttaatacaggcttgtgggatgagtgaccagacttttccatctatgccttccacagcagttacgttatttcagtggctgcagagtccctgcctagtcttaatctttcttctctttctgaacatttagtaacacctatttcttggttttaacatcactgacaaaactgccatgaacctgctcatcaactgatgtttcactttttcttctgttcacttgtttccctgggactcaccccaaggaggcagtgcacaggtagtgaatatggcaggtgttcttaaaagcttctcagggctcagggtggcctagaagtgtggcaggggaaaaggtttggtagtcagggtcaaattctagtctagcttcagacccttaggcaagtcattctcctttctgagcctcagtttctgcatctgtaaagtggaaataggcctctctgaaggggacagtgtgaagagcaaatgagataaggtacaggaagtctataggccccagctgataggaaagagtacaacagctccatccaccacccaggtcccaaaggcatctccccagagtcggtagctctgctgtctttcccttctctggagtcaccaaacaccctgcccaccactacaccctcagctgccctgggagctacagccctatgtctgaaggaaccctttcttacacttttggagagcaagtgccccatcactgcttggttcctgacagtacacagggacacagggacaggtcttccggcaaaggtcaggtctgggtcatgaggagtggaagggagggaaggagagagggggcctaacccaggagtgatgggctctcagaacattggcagcagaaaacaggacaggctgggcttttacagtagaagcccagacgttttcccagttaaggcttgagttctgcctccgagcctatattcaccctattccccaactggagtgccctctcctctttctccaggttgtccaaaccctttctccaaagctcaactcaagggtgacttgttccaggtaacccacctgcctcccatctcctacatgcctggtctgcctgtgccagctgtcaggagccgagccatgggccctcccagctctaatggaaatggctctccatccagctctgccagctcaggcctcagcactgcccaggggaccatcacacggctcaaggtcagtctccagtgatcttagttgatccccacaagaaccctgtgacatgagcacagctgggttagtagttcccattttagaggtggagacacttaggcccagaagggaacagtggcttgctaaggcccacagcatcaactacccagctgacttgaatctagggcttcagaatctttgtctagagttctttgctctcctggagccacgccttaacaaatatttgttcattcatttgacaacatcctccaaacatctcttttgtgcctggacagaggccatacaagaaggaagctggagtgtaaacagtgaggtgcccagtataaaccattctgtggccacacaagggactggggatgtatatgtgtcaggctccctgagtactcccagctgaatggattggtggagagagagtcagggagcccgtcccaaagaggtgaggcctggcctggacagaaagatgggccagactaggttagcaaaggagcagggagagcagcaggagaacaagggccagaggtgagggagggcttggctagaagcccttcagtgtgcctaaaactttgggtgcaaagggaaagggagtaagaaatgaggctggaggcccggcgcggtggctcacacctgtaatcccaacactctgggaggccaaggcaggtggatcacctgaggtcaggagtttgagaccagcctggccaacatggcaaaaccctgtttttactaaaaatacaaaaattagatgggcatggtggtgggtgcctgtaatcccagctacttgggaggctgaggcagggaaaattgcttgaacctgggaggcggagctgggatgcggaggttgcagtgagccgagatcacaccactgcactccagcctgggtgacagggcgagcgagactccgtctcaaaaaaaaaaaaaaggaagagaaagaaagagatgaaggaagagtgagagaactaagagggcgggtggctggagggggatgggcaggaggggcgcaggagggagcagtcagacctccagtttgcaggagactgagcaggcctagcccagggccctggctgtcgtgatggaggaggggacctccaggtgacccacaaaagaggctgagtcacaggccttgttcttaactgaaaacatgggctgagggagagcagagagttgaaatggctggaggagcagcagtgggtgttggagaggctgtgacccctgttttggagtttgaggggtctgggggatggccgtacaatgcagaggagtgttctggacagaagcttaaatgttgggaatcaccggcaccgggaaccaagagggtgcaccctgcccaggaaaggttagactaccaggctgggaggtcccaagaaaccctaggtgtcacttaggggagagggtgctgtaactcaggctcacccccactcagcccgggctggcaatggctggctggagagccagagggtaggagatgtggggctctcaggtttcacagctctcatttctcccaccccgcctggcagggtctagctaggctctggcaaagaatcagaacataacactgggactggctccgatgagtaacccaatgccaggctggttggagtgggaacctgggctccccacccccatgaagctactcctcacttctgagcatggcttgcctgcttgcccctgcccactcccaagcctttatccacgctgtcccctccacctggaatgcctcctctgggccccactgggcaaaacccgacctatcttcccaaggcctgctcaagtgctgtatcgtttctggactttgtcccccttccctgctggcctcccactgcccactagtgcccttccctagaacacactccaccacctgcctctatcacaagggccacacactggaggtgagagtctgtctctgagtgtctgagactgagtgccttgggaacaaaaagcacacatggcccagcccagcccactcccaactaaagaagtgagcctaggagtcaagattcgaaatcctgtgtgagccctgaatggctcctcagcctctgtttacacgtctgtaaaatgggctaataatccacctcactgtgatgatcaagtgagttgatgcgtagagggcatcaattactgtgcctggtacacagcaggtgctccataaatgcgtctcccctcttccttcccagggcctcacctggggagctgagaaatccattactgacaactagggcttctaggaggagaaggggcctttgttttaccttcacccacatcagaggacccacacttcacacctgctttccttcacagccaaagtaagcactgatgaaggcaacaagtgcctatggagaccctgttggtgttcctcctgcccagttacacaggccacaacacaatcctgccccctccgcctggggagtcaggggagaggcatcagatgtgggacttgaagggtgaaagagatcctctggaggggggaaaggcatccaggcccaggaaatggcatgggcagagggagagagggagggaggaatgagcctggtgagctggagcaactgcaaatggttttaaggcggctgccatgcagagggcagggaagggacctggggagactgaggctgcagagataagctgagcaattggccagggctccgggtaagccaaggggttgggcttcatcctgcaaccacagcgaagtttttacctgggtgggacggtattgggattccagatctggaaagctggctctggaggcaggaaaacctagaaaggtctaaggaggtggctactgagggcctaagggagctgggagaggtggccctggaaggctgctaccgggcttgcgttcttgctccagttatctccatgctggggtcagaaggagcgaaccccagccgataaacaagacagtcccaagggaagactgcatgtggggactgatgcaccccactcctagaccagacaggacgccagctctcatttctgctttacagagactcgctctcctgggctccttcctggggctggggggcagggagcggggagggcggtcctccgtccagcctagtttactgactccctctccgggccagatgggcgctggaatgggtggctggagaggggttcgggtcctgcctagggcgagagtagctggagagaggcgcgcctgagaggttcttccaactggaaagagctcttattccaccggtggggaaactgaggcacggcgaggggaagtcaccggcccaaggtcacgcgtcgagctgaaggcagaggcagggtttgaacctgggagagctggctctcgggaggcctcggccagcgaccgagaaaagggaggggcggcggggcggcggggcctgtgttgggggccgggcgcgccgagctcacctggtagttgtctagctgctcttcggtgaagatggtctgcttgttccccatggtggccgccgcgccgccgctcgcccgcccgggctccgactcccatcagcggccgccagacccggagccagcgccccgtgcccgcggccctcggcagccccgcggctggcagcggcccacggtggccggacccttcccgccccgcagctcgcctggaggaggcgcgcgggggtctcggaggcggggacgggaacccggagcggcagcgactccgccgccggcgggaagagggcggggcacccggctccgcggctgcagcgcgcccgggtcccggcaggaggcgacctggccccgggagacgctgcccggcacgaacccttg

SEQ ID NO: 2678 - DNA, 4058 bp, Homo sapiens; identical to SEQ ID NO: 1460

SEQ ID NO: 2679 - DNA, 4357 bp, Homo sapiens; identical to SEQ ID NO: 1461

SEQ ID NO: 2680 - DNA, 3885 bp, Homo sapiens; identical to SEQ ID NO: 1462

SEQ ID NO: 2681 - DNA, 14044 bp, Homo sapiens; identical to SEQ ID NO: 1463

SEQ ID NO: 2682 - DNA, 4357 bp, Homo sapiens; identical to SEQ ID NO: 1461

SEQ ID NO: 2683 - DNA, 4007 bp, Homo sapiens; identical to SEQ ID NO: 1465

SEQ ID NO: 2684 - DNA, 4357 bp, Homo sapiens; identical to SEQ ID NO: 1461

SEQ ID NO: 2685 - DNA, 4031 bp, Homo sapiens; identical to SEQ ID NO: 1467

SEQ ID NO: 2686 - DNA, 4357 bp, Homo sapiens; identical to SEQ ID NO: 1461

SEQ ID NO: 2687 - DNA, 95264 bp, Homo sapiens
tgtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaagccacggcggctcctggctacaggttgccccgctgcctggtggggacagtgcccctgtgccagctgaagggtgttgggggctttccaggggcagagccaggcggggcccagcagagcctccgtgcgtcggacacagcaggccggagacctgcgggaagggccaggctgggcccgcggccctggggaacccagcaagggcagagggggctgggagaagggcccctccccttgttggctttgccccccaccctggaggccgcccttcgatcaggccccagcttcgcttctggtgttcctgcggcgcccgagggccttcctcagccccgaatctgcccaagccgagagaaagggagtgatggggagcgctaggggcgggggatgccaacccgaaccaaaacagccaggcagtacacttctaggtggttggacgcggactagcgctgtcgaagcaggctgctggagggaggagggaggcccatctgctcagtgagagcccaggaatctcgtctttcagtggctgcatcgttttcaccattagttgagggaatcgatctgtgccttcattctaagatgccaccgcattcggggcagagccggggccggaagccagggagctgcctgctgctgctgctgctgctgctgctgctgctgctgctgctgtaagatggtttctgtgcagggaaccttggccggctctgcagctgcccgcctgcctggactctccgatatccactcctcagtgcacctgacacgcatggagccggtcctttcctggaagccagaccccaaacaaactggcttccccgaccagtccactcccatgtgggagcttatcctcagaggcactgggtcctctgcctccctcgggcggctcgcctgtttcaggcatggatgcctgggaagggagtgagacgcagcaatgacttgtgcttctgccgagaataaaaatcctgagcgtacgtgtgctctagtcctccccgcccgctcgctgcctccgagtctcatgaagaaagctcggaacacctgctccacggccacatccaggagtggcagggggctggagagtaattattattttggcttatgcaactgaaaagcagggttcgttattacccgaagaggaggaggagtctggggcagttaattatataatgctcctgcctgtcaaagccgtgcccagccccggtctcaggcggccttttctgtgccgttgttgttttcatggagcaggttggagagcttccctgaccctggggcgctgagggccgggcgggagcagacggtgctcccttggttccaggctgtgggcctgtgtgtgtgtgtgcgcgcgcgtgcaggcacagggaggcccgggcagcagatgtgggtggctgagacaggcaggcagcctggcgcttccagctgggctgtttggagcccaggggctgctatcacccccaggctctggccaggaggctctgcagacctgtcctccagaggtgctcctggctgagcctgctccaggaggactgtgcaggccgggctcacgcagggcatggggacgagaggagccagggctttcgttgtctctgaaactcctcagaatatctgggggtgaggctgagcaccccactctgcccacgctcctcagacatctccagagtcctgaggaatcatttctttcattcaacaaatactgatggaatgtttgctatgagccaggtgtgccaggctctgggaaaaccacactgagcaaagcagacagccaggtgtcctaggctttggaaaaaccacactgagcaaagcagacacagatctttgccctcacggagcttacatttgagggagaaggagcggcgattatgttgtgactttttagggaagaaaggatctgattctgtggctggccgtgtagtttaggatctgacgggttaaggggagagatgtttttctctataggtccacttccctgggctctccactccagccagacagctccctcagcatcctgctcccctaagcccttcccctccttgtggtcctgcctgatcatgtccattctacagatgaggccagtaaggcccgggctttgtgattcaggagtcccagcctttggctgcagggatccccgatctgtctgggaccaaacccccctcgttcttgcatcacattgccggaagaagcccagattgtcaacatcctctcaaggggtatgcggttcttagctctcccataagcaaagccaggcagggatgcagatggggagcttcatggccggctctcccttttggttggcaacatggcatgacaggaaatagaattgacccttctggtcttgaggactcgggcctggacatctgggccacttttctggagggctcccagcttcctgttgggaagggggtgattatggcactgagtgtccccaggcagcccatggaaggagcctgcagggtgtggggatcgccagaatggggcagagacctccatgcctccttcccagtcaactggtgggtggtgacagccatgtcgcagtgaggaaggagttaatggccccagctccactctgacttttcctttgcacaagaagtgggggaatattgggcagccatcagcgaagctctggaacctcagcccagctctgggcgctgacttggggaaatggcgattttcatgaatgatgcaccagcggccagcgtattccacatgtagctggaattggtgtggaatttcagctggggacacctgtgccaactcctcctcctccaggtgtgtcctccccttagggtactccctgattgagctgagtagctcctaccgtctgcatggtgaggcctgggggtgtggggtacaggcacacttgcttccagtcacaaccccagcttgcatcctgggcttgaatccctgccctacatgccctgttttgtgaccctggttggattacttaacctctctgagcttgtttcttcatctttacaaaaggttgataacaatacctgtaaggtgggtgaggattaattgagaatggtgtgcgtggctatgccaggaatatagtaagcatacattattatttaccgttagttttttcattacagtttccaggcaatgcatgtcacttacaatgatcattattagaaccaacatctggacaggagactggtgatcatgtaaatgatgttaaatagcaacattagatacttactgtctgccaagcatgtggcaagtgttaaatgaattacagcccttaattcttacacctctagagggtgattttcttgttattctcattttccacactgggaagtggaggctcccagtgggtgtgggttgggaggaaccagcaggcgtcacactcaggacagccatcccagagcctgggcctttgctaggtacgtcgctctctaaatgcccctgtgcaaaaacacctcctgttctttcctctcgtttatatctctcgttctcttgtgcgtacagtggcccagaattgcaggtgaatgcccatgcacagacgggcaaacccatacactgcccaggacccctggccccctgaggcccaccatgcatgccggtgctgcaccgcacaggtatagatctttccttcgggtgctgtgtacacagaacccctcgaatcgaaagttaccccctccaataagccctcctacaccctgaaagatatgagtcatctcacgcccaagcctctccccctcatactcaggtcccgttcaccggcccagattcctcaacccacacaaatcacacacacccacagtcggaattcagatccccccaggcgcctgcgcacacacacgcgcacaaaacacctgccacccggagacattttccaccccgtcccccagaacgcagccactgcgcccttgcggccttgcttgctctccactggccaaggactctgaatctccaccaggcctgtaaacggggagctcagatgacagaggcagtggtgtgcttcgtttccattttaaacacacgtttatgctgttagtgcccttttagggagaaaaatccctcatctcaacaaaataaactaccatggggcgtatgctttgtgcttggctatgactatgactatgcaacaagtaatttctttttcaaatgagtgcccaggttagaaggaatcaggttcattggtgcggagattatgccaacagaaactcatttcagaaacaagaagcaagccctgagcagttggagacgaaagcgttttctccgagattctctttccgctacttcggggggcgggtggtgaaaggctccgtaaggtgaaaagagaaaggaagaagcaaacagctatttttttgttgccagttatagctgagaaacaaatgtggctgaagggcacccctacccacgttggccgtgaggccgtttgatgggctttgtgtgaggaatcctgagatgagctggccggggagtgaggaccggcacccgcctacagcagcgatctggagtagtgagtgagcagccccagctgacacagagaaggagagagagaactctgaccccttctcttctgaggacacccagccggagagagcaagaaggggtggagtgtgggggtgggggcaggagcctctgctgttcctttccaagactttttcttcctgttttccccaagcctccacaactctaaatatgacgagctctcaactgtgagctaataatgttgaatgtaacgccctttgtgtccttagatgacaaaaagacttgtgagtactagaggagagggtgatgttggtgtgaattttccacattggtccgtgtctccgtggactggccgcttcccccgctggtagcttcatggctgtgagaggccatgcggtggatggagccaccgctgcactggggtcctggctcgaacttgagtaaggtgctgtcttccaagtctggagaggagaggaggagagaagagaggcagtcccttcagcaccttggagagcgctcccggctgcctgcctgggttgggtggacggctggactcactttcgctctaggcatcctcttcaagccaaaccatctctccttgccagtgaccgcctggtcccggaccctccagcacactcaaccaccagaagtgtgcctatgcctgtgccagatgtgggggccacgcctgcgatcccaacactttgggaggccgagatgggaggttcacttgagcccaggagtttgagaccagcctgggcaacattgtgagacccccgtctctacaaaaaatacaaaaattagccaggtgtggtgctgcacgcctgtggtcccaccactcaggaggctgaggtgagaggatcgcttgagccccggaggtcaaggctgcagtgagccaagatggtgccactgcactccagcctgctgacagagccagaccccatctcaaaagaaaaagaagaagtgtgcctggtcctactcagtcggtgcatggattccatgctccaggaagggctgccacttggcatgcctgcctatgttttcacccctaccctgtcagtccttcctgaagaagtgagtgtcttctgaggtaacatcctctgctggtcaactgggagagcagctcccagcttgtggaggtgggtttgggggtgagactttatttttttgtttttatttatttatttatctgttttgagatggagtctcaccctgtagcccaaggtggagtgcagtggagtgatcttggctcattgcaacctctgcctcctgggctcaagtcattctcatgcctcagcctcccgagtagctgggattacaggcatacaccaccacacctggctaatgttttgggttttagtagagacagtgttttgccatgttggccaggctggtcttgaactgaactcaggcgatctgcgtgcctcggcctcccaaagtgttgggattacaggtgtgagccactgtgcccggcctagggtgagactttagtaagatgtatagaagttgctctgaagtctaaggtgtattcctgccataggatatgtgtgttcacttctcttggagcataacaggggtcataggtgcacagccgaaggcaggcagaggaatgatttgtctgtaccagtcagtgaaactgtttcaccaccattctctttacatctgcctcaatgggtgagtcctctagaccaatggtccccaacctttttggcaccagggacctgtttcatggaagacaatttttctaccgcccagggttgagggatggttttgggatgattcaggcgcattctatttattgtgtgctttatttctattattattacattgtaatatatagtgaagtaataatacaactcaccatcatgtagaatcagtgggagccctgagtttgttttcctacaactagacggtctcatctgggggtgatgggagatagtgacagatcatcggacattagattatcataaggagtgtgcaaactaggtccctggcatgagcagtttccagtaggctctgcattcctatgagaatctaatgctgctgctgatctcacaggaggcagagctcaggcagtaatgcaagcgttggagagcggctgtaaatacagacgaagcttcacttgcttgcttactcactcgccactcacctcctgctgtgtggctgggttcctaacaggcaacgaaccagtaccagccacatttcacgggctcaacagccacctgggactagtcgccaccatattggacaatgtaaatccagaacattccatcagtgcagaaagctttattgggcaggcagcactggtctggagtgtaagttccatatgggaagcggtttgtgtccatgctggtcactgccatgtgcccagtgactaaaatggtgctggcacgtggtggtcaataaatatttgtggaatgaatgacctgtgcaagtaaatgcggtagtatttggtaattttgtttaccgtcattatttcgtatgcctgtttcattgcaagaccttagaattggacgtagttaaaggaaagtttttccgtgagaccctcatgtccacaggtcagtctccctttacaattagcattaaaacatgcctgttctaattccttgatcagttttgttttgtggttggctttgtcattgctccttaagagactgccagtgtttcatatgagaaagatgatggtgttgaatgcagtgaataatggagcgataccagcagtcatgactgggaggcatttttggaccacgatttaatgagtagcattcattgcaaagtgcaaagaaaggcccatggaaagatgagtaccctccagtctgcttaattcctcactatctttttactgctcccttttccttggcttgattcgttcagtcattggagaagcatttgccaagttcagaccgtgttcaaggcacaaagacagaaaagctcaggtccaacctcagtgaatcagccttaagtatttgctgagcattgagtatgtacgcagtacagagtttgtggtaacgtggaagattggaaaaaaagaaacaaacacataaaaatgaaaatgcaagaaataggatgtcctatgttctaccaggaagaataaggagtctgaacagggatgcaaaaccgagatatatggaataattcagggtttctcatgccacagtgggggtcctgaatgggagcaccacagggcagggacctgaggaggggcagggcaggtgtgtgtgtccctgaaggagcggcagaggcttctgggggtaggcagtgcctgagttgagtctggaagggcagtagggtgagagttgttatcccaagcctgaggctgcagatttgttcgaggccatgtctccctcagcctcagcttccccatctctatgatttagtcatgacatttttttccttctcaacatgtgccatctccctcctacctatgaatgtcacgggtattgttctggacccagggaaggctcgctggtgcaaatgctttccaaaaacaccgagagtcgctctctctgctgctggtggagtctgagttgggcaggacatgggcccgcctctgtctgctgctctatgccagtgcttcccaagcctgagtgttacaagaaccacctggaaggtgtgtcaagacacagatttccagccccacccctgagtctctgggcctgggatgccacccaagaatttatatttcttacaaatttcaggcgatgctgaggctgctgatctggggacctcacattaagaaccacagtcctgggcttgtgcctcctaagcctggctacacattcgagtcactaagaatgtccctgggagacggttagaaatgcagcgtgtcaggcctgcctgacctccagggtcaggatgtgtgtttggagatgctcaggtggctgcagtgcaggagatcctgctttggtgcactcactttaaccctagctgtgcatgagcttcatctaggttgctttagaaaatgcagatgcccgggccccacccacaggtgctgattgaggtcctctgggtacagcctgggcattgggattctttttattttaatttttttcagacgggggctggctccgtctgtcgtcctggcgtgcaatagtgtgtgatcgtggctcactgcaacctctgcctcctggcctcaagccatcttcccacctcagcctcctgagtagctgggactgcaggcatgcacccccatgcccagctaagttttgttatttgttgtagagatggggttttgtcgtgtttcccagactggtctcaaactcctgagctcaagcgatccgcccaccttggcctcctgaagtgcttttacaggtgtgagcaacttttttacaggattacaggtgtgagcaactgcacctggcctgagattattttttaaacattccaggtgattctaacgttcagcgcaggttgaggaccactcatctggagcgtctgtagctggacatcacttgggagctttgatgactgacccatgccggggtccatccaagaccactgacactggaaactttaaggcgggggtctcagcctgagtatctggtcacagcaagcagggcctagagttgcagctgtagataagagtttttcacactctgggtcaagtggttcatgaaattaatatagtacattaaaatagactagaggccgggcgtggtggctcatgcctgtaatcccagcactttgggaggccgaggcgggcggaggccgaggaggtcaggagattgagaccatcctggctaacacagtgaaaccccgtctctactaaaaatacaaaaaaaatattagctgggcttggtggcgggcgggcacctgtagtcccagctactctggaggctgaggcaggagaatggcatgaacctgggaggcggagcttgcagtgagccaagatagcgcccctgcagtccggcctgggtgaaagagtgagactccgtctcaaaaaaaataaagtaaaataaagtagactagaaattttccaagcacaatacctacgtttctttctttctctttttttttttttttttttgagacagagtctcactctgtcgcctaggctggagtgcagtggcgcgatctcggctcactgcaagctccgcctgccggattcacgccattctcctgcctcagcctcccgagtagctgggactacaggtacccaccaccacgtccggctaattttttgtattttgtttagtagagacggggtttcaccgtgttagccaggatggtctcgatctcctgacctcgtgaaccgcccgcctcggcctcccaaagtgctggaattacaggtagcgtgaactcagctcactgcagcctctgcttcccgagttcaagccattctcctgcctctgcctcccgagtagctgggattacaggtgcccacgaccatgcctggctaatttttgtatttttggtagagacggggtttcaccatgttggccagactggtcttgaactcttgacctcaagtgatccgcccacctcagcctctcaaagtgctgggattacaggtgtgagccacctagcccagcctattgtgttgtttttgaatatatttttgatctgcagttggttgaatttgtggacttggaacctgaagctatagagggctgactgtgtatgataacctagaactgcaaagccagggaattcctttgaaagaaaaacactttttctttctaaaacatctattttgttccaagtattgtgctgggcattttatcatagacgttatatcttacattccttaagataatgccttgagataaggcattccgctcccatttaaaagacaggaaaggtgaggctcacagggtcacactcgctgagatcacagcgctgcaaacttgtttctggccgcagaattgtttccggcgctccgagatgcctttcttgatggagccagcattccaggggcccacttgctttacagatgaggaaactgaggcccaccaagggaggggccctgccccaggtctcacagtgaagcaggggcagagaggtttcactcccagcaatttgtaagcttgggggactgccagcgtggtgtggacacagagctgcgtgacccctcccaggataaaagcaggtccctgcagatacgaggagccgcgtgtcccctcccaggataaaggcaggtccctgcacacaggagctacacgtcccctcccaggataaacacaggtccctgtacacaggaggagctgtgcgtcccctccaaggataaaggcaggtccctgtacacaggaggagctgtgcgtcccctccaaggataaaggcaggtccctgtacacaggaggagctgtgcgtcccctccaaggataaaggcaggtccctgttcacaggaggagctgtgcgtcccctcccaggataagtgctggtccctgcacacacgagggtccgcgcgtcccccgcaggataaacgcaggtccatgcacacaggaggagctgcgtgtcctttcccaggataaaggcaggtctctgtacacgtgtggagctgtctgttccctcccaggataaacgctggtccctgcacacaagggggtctgcgcctccccgtcccaggataaaggcaggtccctgcacacgtgaggagccgcgcgtcccctcccgggataaactctggtccctgcacacacgaggagccgcgcgtcccctcccgggataaacgctggtccctgcacacacgaggagccgcgtgtcctctcccaggataaacgctggtccctgcacacgtgaggagctgtgcgtcccttcccgggataaacgctggtccctgcacacacgaggagccgcgcgtcccctcccgggataaacgctggtccctgcacacacgaggagccgcgcgtcccctcccgggataaacgctggtccctgcacacacgaggagccgcgcgtcccctcccgggataaacgctggtccctgcacacacgaggagccgcgcgtcccctcccgggataaacgctggtccctgcacacgtgaggagctgtgcgtcccttcccagaataaaggaaggtccctgcacacatgagggttggtggctctcctgagggttcacaggttcccggggacccatccacagatccccagataagaacctgtccatcctccccggggcctaagcgtgcccagattgatctcagtttgcccagtgagtagaaaaataggccgggatcagcagattcctatagacctggtggaggcctgggctggagtagacccaggcagagttggtctttcacctcgcccccttccggaggccccgtacccttggggtcagcatccaggcaacatgggatacccagaaccttctttcttgtcctgagcccttctctcccagctcggcatggacttgagtgacagctgctgtgtttctttcctgcccagtgagtggggccgggccctggagctttccctgttcatttgtttcgtctccttgtggggaaagcatggctcccccattttccagatgggaagcaggctcagagatgcaacagaagtgggaagtgatggagcagggactccatagctccagtcacgagtctcaaactctgtgcgcatctgggtcgcctgacccggcctccctgacccgggctgcccagaagggagcccaggaatgccggggagggtcacacagccagggccattcaatgcaggtggtgctgggaccacgccttgagaagctccagtcgccttccctcctctgcaatgaggcattgctagggggaggcgagtgggggaagagaccgggtctgttggggtcagccccgggcacagcacccgacagcagaggagacctccggaaatcatggctggatgggtcaatgagtggtcaatcaggcgagctctgagcgacaggaggggccggtggtgtggagagagggaagaagagcctgcaggagggagacggtgcgtgcaggggcaccacggccagagcctgcttggtgttcagagagccctgtggctgccgcagttgggagaagggcacggggtctgagcacagacagcttccaggccccagggttgggggactttgaattttctccagggcccgggaacgacattgtctgatttaagcagaacagcaacgcaatctggttttgtgtgtgtgtgtgtgtgtgtgtgtgtgtgtgtgtgtgtgtgtgtgtatttttttttttttgagacagagtcttgttctattgcccaggcgggagagcagtggcgcgatctcagctcactacaggctccacctcctgggttcacgccgttctcctgcctcagcctcccgagtagctgggactacaggcgcccgccaccacgcctggttaagtttttgtattttttttttttttgtatttttagtaaagacagggtttcaccgtgttagccaggatggtcttgatctcctgacctcgtgatccgcccacctcggccttccaaagtgctgggattacaggtgtgagccactgtgcccagccaggttttgtatttttgtaattacactttttattttgagatcaccgtagattcccaggcagtggtgaggaatagatcagagatccggtgtccccctcatgtggtctctcccgaggtggcatcctgtgcaactgatgacatgtcggaaccggatattgacgtggacacagtcaggatggggagcacccgcgccccggggtcccttgtgttgcccttttgtagccatacccgctgccctggcagcctctgagctgttctccattccttcagtttcgtcgtttccaaaatgctctgtaaacggaaaagtacagttcgtcattttggggctggctttcgtcactcagcctcatttgctggagattcttaggtgttgcctatatcaatagttcgttccaggctgggctccgtggctcacgcctgtaatcccagcactttgagaggcctaggcgggtgggtcacctgaggtcaggagttcgagaccagcctggccaacatggtgaaaccccgtctttactaaaaatgtaaaattagccgggtgcggtggtgcgtacctgtaatcacagctactcggaggctgaggcaggagaatcacttgagcctgggaggcggaggttgcagtgagccgagattgcgccgttgcactccagcctgggtgacagagtgagactctgtctcaaaaaacaaacaaacaacaaaccaaaaaaccaaataaaatagtcctttctttcttattgctgggcggtgtcccacggtgtggatgggccgtttgtttaaccatctgtcccttgaagggcatctggggtgtctccagcgtgggatgtcgtgaatttaaaaagctgctgccaactctcaggtccaggttttcctgtgcacagatgtcttcgctttcccccagtggatgccaggagagctggtgctgggccgtgtggaagttgtatggctgagttcacgtggtcactctggtgctggcagggcagggaaatggggggccagagaggaagctgggggtcatgggagggatgccacctctagggaggggtgcctgtgtccaaggagtggagatagtggctgggtctggtgggggctgtggaggtaggggggctgcatggtagggcagaggccaggagtctgggactgggtggtcctgtctttgagggaatttggagaaggagcaggtgcaggtgcaggagctgagagtcacctgtgaaacatgctcagcagagaagctgtgcgcagccggggcaggggtgcgtccatggtggggatggtgtgtctgggtggaaggggcggggcatctcccactcccggtggcattgaatagtgcgaggggagtggctgggcgcggtggctcatgcctgtaatcccagcactttgggagactgaggtgggcggatcacttgagttcaggagtttgagaccagcctgggcatcataacgaagccccgtctctacagaaaatacaaaaattagctggggcatggcagcctgcgcctgcagtcccagccactccggaggctgaggtgggagaatcacttcagcccgggaggtgcaggttgcagtgagttgagattgggccactgcactctagcctgggcgacataatgagacgctgtctcaaaaaaataaataaataaataataaaacttggaaataaggcaaaaaatattatttaaagaaaacagaaagtgggaggggagaaatgcacaggatggagcctaggggagccccaggactcgagaagtgggcagaggaagaggaggcaggaggagggagggaggccgggcagcagctgggggaggagggcgtggacaggccgggaaaaggagcaaaggcaggatgaggacacaacactggcctgtgcctggccttgtggcaaacacctcatcccttaggccattggccatcgtccctgctgtcctacagccccgagaggccaggtacgtccatgtgtcgtgcccattttacagacggtggagctcaggcctgggagacagactgacagtgttcggcactaactccaccccagcctttttccacctggccacactgtttactcgttcccgccagcagcatgggggctctggtgtttctgcgtcctcatccgcacctgtcatcgcctgtctttttggttgcagccacttctgggatggatttcctggaggctggtgctgagtctctctaggtgcttgtcggcccattggtacatctttggagcaatgcctgttcagatccttgcccatttaaaaattgggttatttcaggccgggcgcagtgctcacacctgtaattccagcactttgggaggccgaggtgggcagatcacctgaggccaggagtttgagaccagcctggccaacatggcaaaactgcatctctactaaaaatgggaaaatgagctgggcgtgatggcaggcgcctgtaatcccagctactcggaagctgaggcaggagaatcactcgaacctgggaggcagaggttgcagtgagccaggattgcaccactgcactctagcctgggcaacagagtaagactctgtctcaaaaaaaaaaaaaagggggggcactgcgcaccagcctgggcaacatggcaaaaccccatttctataaaaaatgcaaaaaattagctgggcatggtggtgcctgtagtcccagctatgaggaaggctgaagcaggagtatcacttgagctcaggaaatcaaggctgccgtgagctatgatcacgccactgcattccagcctgggtgacagagcgagaccctgtcttaagaaaaaaaaaaaaaagaaggattatttgtcttcttactgttgagttgtgacattttcgtaggctgtagacaccactgtgagccaccggctcccctgcaccccagcccacctggctgcaggctgcctgctccgttggaggttggacttctgagataaactgcgctgggtgtctgtctcttggctccagagtaccaggcacagtgccatgcacacagtaggtgctcagtaagcggcgacaggacaaagccaggatctcagtctgcggcttggaggggtctggggtccggctgtcactatctggctctgcttaccagctccggtcctcggacaccacgacggctgcaggcagagggaggagccacggagtctggggggatgttgggccacacaagtatctactgagcgccgactgtgtgctaggcaacaagctggccctggggacagtggtgaacaaagagccctaggacttcttggttgggggaataggacccgtcagtcagccctgcacagcttcctgcggggcacggatggggcgcaaggaaggggctggagatgccttctagggagtgaggctggtgagcgggttggggaggaaccatggggcctcccagacttcaggaggcgcatctgtgagcaccagggacagaaggaacagggccaccctgggacccagtgcgcaaggagcccaagggccctcacacgtcacccttgggtgtgccagagccagtccagttgttaagaaaaacaagagccggaggtaaaccccttgggaaacagaggtcccagcccacagtactgcgtgggagggagaagtgtgggagtcacctgggctctggggtccctcaggccagcaatggggactgggatcccagcgcaggctgagcctgggtggctatgtccacactgcagagacctatcgtgagcaagtttatggtgcattcctgtgtggaagagtacagcagaggccaggggggtggggctgcagcgacagtgaccaggagtcacccataggggcagggtcctggtgtcatgggccagagcgggccagagcggggacggggggcaaagggaaggagcatttgagcctggatgggggtgtggttagcagagaggtgggaggggagggagagagagagagaaggagagagagggagagaaggagagaagagagggagagggggaggggaagaaggagaaaagggagaggggtgggctgtgaggagagggaggggaagggctgcagagggggaacgtcagtcctgccatgggggggacgtgcgttgttcctcgcccctcccttccaggttttgatggtgctgtttcctgcgtttacaccacagctctttttgcgtctttccttggattccacacagcagccctgtgaggcgctgtcctcctgctgcccggaggaggagactgaggccagagatgcggcaaatttcccaaggccacacggttctgctgttggggcggcactgggcctccctgcccgcctgcctcagtctggccctgtgaagaggtctcttggaactgttaggagcattcgaaagaaactgggcccctgggctgggtacggtggctcgcgcctataatcccagcactttgggaggctgaggcctgagcacttgaggtcaggagtttgagaccagcttggccaacatggtggaaccccatctctaccaaaaaatacaaaaatcagccaggcatggtggcgggcgcctgtagtcccagctactcaggaggctgagacaggagaattgcttgagcccgggaggcggaggttgcagtgagccgaaatcgtgccactgcactccagcctgggcaacagagcgagactctgtctcaaaaggaaaaagaaaaagaaactggtcccctggagcgcaggggtcagcagctaacttctcgccctggcagctggacccgacttggcccagagtgccagggccagtgcccccatctgctctgtgtcgggaggggctgctggcaggaggaggtggccactccaaaatcctatagacggagtccgggggagggggttcgggacaggaacagcccagacctgggatccgcggctgcgcaaggggcttcagggtggtctgggcctggttctgagccctgtgaatccaaggccacaggactgggcctgggggcttctgaatccccaccagtgccttcttgctctcaggagcgttggccaaccccccaggccccagggcttcccctcgtgattctcctctgagagaaacacacccacctacagccgccagccaggagcaattgctgtgcaaacacccgggactgtctcagacggtggatgcaggcagccaagcccccggaaggctccggttgaagggccgggtttattcctccctgcaatgagggtggacactcccccaggaaccacggggcaagagggtgttgggaagagccccactagggtttggggtttgggtgggtggtggggaggggacagtctagggacgtagggctcactagaccaagtgctgttggaaagggggcgattctcctgtgggtgcgttggtcactgtcgcctgtagacatgggagacctgcaccaaaataatgcggagatgggtcaagaagcagccgcccctccccttagtcgagaggggggatggttggtgatcgtgggtggcacagtgacctgtttctatctcactctactgtgatctcagagtgaccttgtctggggtcactggggtgttctgggagatggtttatatccaacagaagaacgacgcagcctggcaggagctccaggtgtcaggggggggcccctttggggtggaggggatgcctcagagccagccgcatgccaccccacaagctacctctctgccgccgtctgccccagagctgcctgccttccgaggcctcagctggtcctgtgcgtccctgcgtctccaggactcttgggtgatggctcaggggaagtttccagaaagcccagccatttcctcctctcctcctgggcttgggtctgaggtcagcttcccagggggcacccaagcctccgtgagcaaggacagagagtggctggagtgagaacgggtgctgctgacctttggcggtgggagggtgtctccagctgtgttcccatttctcagtgactaccaggtgctgtggcccttggctgcagaggggcgtgcaggcagcctctccttcctgtgaagcagcagctgtggcagggccgggaagtagagctcccctctgtgaggctgtggctggggtaggaggagagctctcccttctgcgaggctgtggctgggatggaagtctgccagaggcgggctcagaagaagttccatgaggaactgagggctgggacctgcaggaggagctgagggtgcatggggtctgggggagccccagagatggtcagggtctcctcctgataaatcagacccccccccgccccaccctgccgctgagaggcctggtcctgctctaaacctggagtggatggggagcgtgggctggggctggggggctggggaggtggtgtagccagtgccctgccccaactcagcctctggtcacccttccagggctggcaaggcattgggggtatgagagggccctggggtcccagggtctcagaggacttgccttctctgcgatggccgctactacctgggtcccacaggggggtaagttcagagggggacctggtggaggtcggctgtgggcaggggagccacaggagtgtccaggcccctcccaggccagccccacagattctgaggcagcagtgggggcctcaatggaggagtccactctgcccaccccggatactgcccagccagcctgggttccagcgtgggccaagctctcgtcctggtctcctgggagctgtgtggtcctgcaaggacctcagcaccttccttgctttgagcatccctcccccaaggcctggctgacactcggagccagtatccatagagggctgcaggggcaggcgagggtggacactgatgtccttggctcattcctccctggctggctgctctgatgtccagcagggtgggcgtgaggctcatggggggctccccagccagggcaggacctggggtaaccctatcctgggatgtttgctcccgctgtgtgggggacatgccgtttccatgagtgacagagtcaccgatgtggccagtaccactgtgggcttgaggcatcttctagtttaaggaaatgttaaatttcaagtaaagcttagtgaaaataaggatgcaatttcattccccaacaaaacaacctctatttccttctgtgaaccccttgggagctgcagaccccgagttccggaccccctcacctcactctcctccttcggagccaaagtggtgcctgaaatctgaggccccatctctgagtcctgcactggtcctggcccgaacactcccccacaacgcatgggccacaaggaccctctgggcagattttggggtgtctttggaggtttaggggcaaagcttgaaaactgtggggtcctccctggggaccacatgcccagctgtggggtcccccgaggccgcagagcaagctttctggaagatcctcctcctttgagagccaccatggagcccccataatgggaatggagggtgttgccattaaacatggccttggcgttgcccagaagtctaggtgtgtccctgtcagctgggaggggacagggtaactgtgcggccctccccagggctgaggctggggcagcctccagaggccaggttgtcgctgtcactccccaaatggagggtccccctcattccctgattgcagaaaaagggctccagtaagtctggcttttaaaaaatacagctttgctgacatatgtttcacacaccgtacaattcacccatttaaactgtacagtccagtggtttctagaatattcagagttgtgtcactctcaccataatcaattttagaacattttcatcgtctcaagaagaaaccctctagctagctaccccttccccattcccacggctccccacccctggtgaccgagactccattttctgtctttgtgggtttgctgctcctgacgtttcgcatgcgtggagtcatacgctgagaggccttttgtgtgtcgcttctgttgcccagcgttgttttcagggttcacccgcgtgggagctgcatgagtccacttcttcgtatcgctgagtaatattccactgcggggcaccgcgttttgtgtgaatctgccaccactcaggatggctcatgggtggaaacagcctaaagctggcagaggtttgggctgtttgccagccctgggtcacttttgggctgtttccacctgggggctatcctgagtcgtgctgctgtgaccatttgcgtcctttcgtttcctcctgggtggagattgtggggtggcctggctgggtcgctctgggcccaactctctgagaagagctgttgaacacataccccacagctttttttagtttttatttatttcattttattttttgagacagagtttcactcttgttgcccaggctggagtgcagtagcgtgatcttggctcactgcaacctccacctctcgggttcaagggattctcctgcctcagcctccgaagtagctgggattataggcatgcgccaccatgcccggctaattttgtatttttagtagagacagggtatcaacatgttggccaggctggtctcgaactcctgacctcaagtgatccacctgccttggcctcccaaagtgctgggattacaggcgtgagctgcctcacctggccttattttatatactttttaagacggagtctcactctgtgagccagcacacctggcccatggcttcttttaaaaagagacttctggaagctgagaagtcttttccagggctccacctggcgactgaccactgggcatggtgaggtctgcgtttggaggaagtggggtgacagtgacagctgtgactattggagcacacagtcggtgctgggcaggtgggtcattcctgaaccctcagtgtttccctcctcgggggtcctggccagtcactctcctcctccacaccagcccccagcagctcgcaggctgcctgggcccagccccatcatcagccgctgggcacccacctgagaggtctgaaccctgcccttggtgctgcacggtcacttgccattttcgcagaggggccccctgagcaggaggagcagggccagcatgcacactgcagccaaggtcccaagaaggaagtggcgaggaggaggaggaggactggccccacctgttgccctatgtctcacagcgcagactgggggagacgtgaggatctaacaggggttcctggggggccttcatcaagctgtaatgaatgttgtgccaaacccctgtcaacaccagtgggtacagcacagggttcaagggctgaagaagtgacccagggctagcaaaggagacccggggtttactgcgagccgtggggtggggagggaagtgcagggacgggagaaccgcagcggcttgtagacagcgcaaagttcctatggcatgttcaccccataccctcccctgatgacctccacctgccaaccttcattcaacccaaaactcagggcctcaagcccctgcacagcgcacgttccacgggacaggccaggggctcagaagttcctcatagccaaggaggcaatctccagattggccactcctggattccttagctcaggttgttcttggagtatgcgtaagttactgctatcgggggtgtttaccctccaacaggtgtttggtgggggaggagcctccttgggggtgccaagagcaacagcggccggggtctcatgtctgtggggccactcccattgctttgtgcttagtaactgggtcttcaaggcagccctgtggggtgggaatcatttttatcctgtgatatttcattgtgcacacgtgcagactgaggttgcttaactaccccaggccgcacagttatcaccatggagctgggatttgtaccctggtggcttagcacagagcctgagcacacaactcccacccgcctgcctctctccgaccgcgagtcctccaggaggactggggctctcctcccagcaccaccacggccattgagcccagtgcccaggagaccgaggcctgtgaggtttcacctggggcccggagacaggctccaagtggtgtgggggcccctgtgcccaggttttccccgaggtgccggctcatagctacacatgcccatgggcctgcctgagcccggtgctccaagccacaccccgagtgggcggcctccctgccacgcagtcctcggcctgaggccgccacactcagagccactcagcctatggggtggtgcatgtccagaaccctgacccttgggaaggttgggatggttggagatgcagatgttccaaggggaagtggcgggagcgggtgctggctgggaccaagggattctcaagagaagacgtgagcttcactcaggcacagctcttcagcagcaagagtgttggtcctaaaagatcatgtaaatagaggagggcatggtggctcatgcctgtaatcccagcactttggggagggcaaggtggaaggatctcttgaggccaggagttcaagaccagcctggacaacatagtgaagccccatctctatttattaaaaaaaagttttttaaaagataattttaaaaggtggttgattctgaaataagaatcacctgggaagctcttaaaagcctcaagcccgggcctgccccagccccgctgaatcagtgtctctgggccggggggcgaggccagtcattagttgccaaagttctccaggtgattccaactcaagcctctttgccctagagccgtggctcagcttgaggagcattagggcccctggaggttgttaaacccacgttgtggggccccagcccccagttcctgatgcagctgttggggtgagctgaaaatctgctgcagagcctgcatttcagggttcccaggtggcgccaccagcttgagggggtcttggcgctattgtaacgataacagcagcggtctccagaaccttctgtaggcctctgcatgctcacaggttagaccactgagaccacccatggattttatgtagtagacacacagggtgggcctcgtgcccagtgttgtctaacatgctttgtaagtgcagacccgttcctcccagtgcctttggaggtggagattgtggtccttgttttacaggcagggacagtgaagggactgtgaccgctgttggtgccaggcatctggctgcagctcccaggctctcatccctttgctgtgctcctttgcagcttggagggaatgattttttatccccatcttacagtatggggaaggtgaggctcagagaagtcaaggacttctgtctggggtcacgtggctaggaagctaacagccaggatccgagctcagatttgcccgacttccacccatgccggtgggcgggttttctccttggagaggggccagtcctgccccgaggtgccatctctgcacaggtaacagcatcagccaggcaccctgcaggccaccccgcccctcgcaggggtttccactaaccctgctgtctgccaggccagcctgtgggccccaccacctcctgggtgagcgttcccaacatcagagctatgcagcaggcagtgaggggatcatgggtctggcaggggcaggactgggagggacacccttatgtgctgtgtcctgttcctgcctcccctgttcacgccccacagaggagggaggaagctggggttaagggcaagggacagttcctgctctcccaggccccacaaggcatgcaagaggctaaaaatcagaagccagcaggacgcccaggtctcctgagcctgtgcgtctgatctgctcacctgggagacgatggtgctggcatgggcgggtcagaaggagcagcaggacccttccacggcccaggacaagccagccctcaggggccagagcccccatgctgggcacagggctgccaccttgggcggtgccctccctagctgccgcacttcagagtgagcccccatccctggcgtctgccctcctgagtgagtgagggaggggccgggtggggccggatcgtgatcagagccggagctggccttcgtgagtgatggccttgcctgctctgttgcccggtgacagtaaagaatattcctacagagtgtgggttttggaagcagacatgcctgtaggggtcctggctcagacgcttacctgacgttagcacctgggcaagtggcttaacctcatcactcggtgttggcatctgtaaaatgggcacaataacatgctaatgtctccctcgcggggctgtgcgagaatcgattcagtggcccgtggaaacccctagcgtggcccggatgtgtggtgagtggccttggaggcgtcagccttcatgggaggtgggagagctttgccgtcctgggtgaggtcggggtaagagaaagcagagtcggtccccagcaggtgtggctgggaggatgctcagtcactcccaatgttcattgggagtcactgtgctcccagtggacagagtgtcaggtagggtctacagatgagccccacttcttagccttgccctgggtccacaaatcagccagagttactgggtgtggggcttcctcaatgtcagggatgggggtgaacagaagggctgggtccggagtctccaaggctccttccaggctccagggctaacgctgtggggggggcccaggtctccacctcttgttgctgtgtggccttgggcaagtgactcacttctctgagcctctgtgtgtcatggggaagtgactccatgcctgctgctgtctcggtatttcacaagtgctcagcaaatgccagcagaccgtgtccttcagacgcggcagctggggttcctgactgctgggctactgctgcggtggctcatgaaggtttttctgtccccactacaaaacaaaaggcagctgatgcaggagttttagtaaagataatgtatattttagtaaagataacgtatatttgatttaaaagaatgctctttattctgagatttggtccatcccatctttgtgggtttttttttttttaatttggatgtgaaaaagacattccctttatttgtaattgcccaaagtcggaagcagcgaagatgccattaaatagggaagtggataagcaaacagcggtgacgacgcggagcagccttcaatgcctggtgctcagcgggataagcccgtgtgaagaggccacatcccgtggggttccaactagatggcgttctggaagaggtggaactctggagacagtgacaagatcattggttgcccagggttgggggggagggagggacagacaggcggagcccgggggatttgtagggcagtcatactactctgagatactctaatggcgagtatatgtccggatgcctttgtgcacacccatggaaggcgtggaccctgatgaaaaccatggctctggttaataatgtatctgtcttggcccatcaattgcgacagatgtaccacaagatgctaatatcaggggaagtggggggcgaggggatacagtatatgggaactctctgtactttccacttatttttctctaaagctaaaactgctctaaagtattttttaaaaagaaaaagttaaaaaaagaccacatgaacccatgtggagagtggaagaagcaaagtcaaaacattgcccagagtccatgctggaagccagttggggcgtggctgctccactcagttgactgtctgagtcttgtccccacagcacagattggtggaccttcagcccccacactggaggcactggccttccgaatcccttctcacctgagtggggtcaagacgcacctgggtcctatttgctgcccacctctggggccagctgctgttcttggcacctcccaccctagggggatggtgtctgcaaacggtgcttttggcctctggcatgtccaccctgccacaatcatcttcctcaccctcatctgcagaccttctgacaccacctctgctgacccctctccccttgtccttctggggagatcacgaacctgccccttcctggcattccccagccagtcctccctggggagcaggactgtgcatcgaggccaggctcaggtcttcacccacacccacgttgacaacgtacgagtcccctctgagccttagtttctgtggctggaaaaatgaggttaatatcactattgtgagaatcttctcataaacgcatctttccttcccctcctccttaaaatttttaatccttattgagctattatgtgcccatagtttaaggtgacatttggtgctaaaaacaaaatagagcttggagcaaaaatcatgtgtgtcttcagagactgaccaccatgtttttaagtgggtgtgtttgccgcttcctgagctcatggtcacttttagccattatctgttgactcctactgtagtagatggagattttcaatcccttagacccccattctccccactcccagctatctcaatattgctatattgcattttttgttgttaaatccatactcagtgtttttcattatgactatgtaagtattgcttactgctgagccaggcaatggagtctgattctgtacacttctcatgcataacttgagttagtaattgtctcgctttttttcagttgcaattttctttaaatcactggttcttttttcaccttccaactgctcagtgaaacacctctcaaatgcagcttgcacttgagcaaacctgccagattcagtaatacacacaaatgtacaaatacgtttgtttattgattgattgccttcttcccaattcttcccccattttcctgggtatttccttcacttctcctgtgtttgatcttctcatgtcttctttcatggtttcctccctcatttgggtggagcacatcctggagtagcttcctaagaaaggatgcatggaagatatagtttctgtggcttgattatttgataaattggtatgcatagtatgctaggttgaaaatcatttctgctcataatttggggcggtgggggtgcagtttcccactgacttctaggttcagtgttgctcttgagaagcccatgctgttctgattctcagtccttcatttgtgatctgtttttatgtttctctggaagcatttagggtctttgtcatttgagttctgaatttcatgccactgtatcttggttgggtgtctctcccctcattgtgtggtatctgtgagccctccagtctggacgctcacacccttccattccaggagactttcctgtttaaatctttgcccattttccttccctgctttctagaactcctgctgtttagagttcgggtgttctggatgagtcctttaattttcttactgttttgcctacctacctctttttttgatctagtttctgaaagattttcttgatttttatcttccagcttatttaccaaaatatttcttttagctattatacttttaatttccagaagctctttatccctggtctttcctttttaattgcattttattctcattttgtattttatctctgaggatttaaattctggtccctcgatgtcttctcccacctgctgcattttctgattccccctcttttttcccacttatttgtaagttttggtcttttttgtccctgccaaggcttctccttgtgtctgaggaccgttgactgttcatatattaaagtgaggtacgaaaaagctgagtggaaacttgtgtgtgtggcagccttcgcttctggctacagtctgttttttcagaggaattttccacctctctcctggataaagtaatcctccctgtttgggtggggtagcaagcagggtttttggttcagaatgagcactttcccagtgcctgctgaagcattggcgaaaagacgaaaaaaagagcacttccctggcagtcctcccccaccctcctctgcctggtgggcttgtctgattgttggcctagaaacttttcttcctgggttctgcagaaggagagaaaactctcttcctttcattcattatttatatttctcagcaatctggctttttatcctttttcttggtttgtcctaactttaagagatggagtcttgctctgccacccaggctggagtgcagtggcacgatcaccgcagcctcaatctcctgggctccagcccctcctgggctgaagcagctggactacaggtgtgcaccactaaacacactaatttcaacaaaattttggctgggtgcagcgactcacgcctctaatcccagcactttgggaggccaagacgggtggatcacttgaggtcaggaattcgacaccagcctagccaacatggtgaaactttgtctctattaaaaacacaaaaattagccgggcatggaggtgtgcacttgtaatcccagctactccagaggctgaaacagcagaattgcttgaacctgggaggtggaagttgcagtgagctgagatcatgccactgcactccagcctgcacgacagagctggactctgtctcaaaaaaaaaaaaaaaattttggtagagacagggtcttgctgtgttgcccaggctggtctggaactctggggctcaagcagtccttctgcctcagcctcccaaagggctgggattataggtgtgagcctccacgcttctcctgtccttttacttcattatttatatagttaatcacctcgctagagactgagaattctgtgtcctcaggctgccatcacaaaataccacagacagcatggcttaaaccacagtttatttccttgcagttctaaggctggaaggtcagggtcaaggtgctgggagagttgattgttctttgttttcgtgggcttgtccctctgtatgcctctgagtcccttcatagaaagacaccaggcctattggatgaggacccccagtgccttcatttttaactcagccacctctttaaagaccttatctatctccaaacaaggtgacattctaaggtggtagaggatgccgggggtgggggtgggtaggactgcagcatatgcattttggagaaacgcaattaagcccatagtgaattccggcagacataactattcagaactccactaagattaaccaaaaaaaaaaatttatatatatatatattaaatgatgggcggggcgcggtggctcacacctgtaattccagtgctttgggaggccgaggcaggcggagtacctgagggcagtttgagaccagcctggccaacatggtgaaaccctgtctctagtaaaaatacaaagattagctgggtgtggtggcgggcgcctgtagtaccagctactcgggagtctgaggcaggagaatcgcttaaacctgggaggcggaggttgcagggagccaagatcacacactgcactccagcctgggcgacagaatgagactccattgcgaaaaataaaaaaaatctggtgttggtagtaacgatgtaggggacatggtctctcttatagtcttttctgagggtaatttctgaaaaaccataaccccaaacccttgcttttgaccaagcaatttcattctaggaatttatcctaaggataaattttaatgtcatatgaagattagctgtgaaaacggaggagcgacccgaataccttgcggcataggattagcttgtaatttatgtgcttgtgaaacggccgtgcaatgaatggggctccgtgcagccggggacaaagtgggtgcagagaggcaggagggacaggcacggggcatgggggccacccgtggagaaagccctggagctttgtgaatgccgtctgttggccagcgcagggctctcactgtcacgttggacctgtgcccagggtctggtccctgatctgtgagggtcccagagggggcacaacaggcgaagaccccaaagacaggggtctgttccggggcatcctgggcagagagtgggtataggggacagaaacccagccaaagcggctcaagtggaagatgggtgctggtcgatatgggccagcctgaggggtgtcagagccgggaatggggaggccatcggaagcccacaggagccacttctgagttccctcagggtggaggcctggccgccttcccagtggtgcctgtttcttcctttctctgcgggttggcttctctgcgtccctgcctccaggtgggaaggggtccctgcaggcttcgtctcctcccagccgcagagccaccaccttgggctcccctgccccaggcccaggctggtggatctaattgggatttggtaagctgtgacgggaggggggctctggcccgtgcccacccatgggaaacgggccctataggaggcaggtgaggcgggccagagtgaatcagtggtccagtccagaacggaggctgtgacccgccagggtgggagaggacgggctttggggttgggcctcagccccgagtgggcaggcacagcatgggactggctgagagacgctctgtgtgggcttcggatcagctcagcgtaggtttcagtcccgctctagctgggtgacactggggttattttacctgtctctgcctcagtttccttctttaagtggacacagtaagagtgctgagctcccggggtagtgtgtggatgaaaggtgacctccgcctgcatggagccatggaaatgtttccccttttccctccactggactctgggacagtagtgggagcctgggtgggggcttttgcctgccagaactcatgggtcggggccgcacatgagtgagtgtctcctgggcagggctgtggccatgagctcaggtctttagtgggctccttgctcctcccagcaaagcgttcaccttgccccaccctgggacctctcaggtgctctttggaggtgttgacctggggcatctgtccatggccctgaggaggtggagcacctggtgagggctgcgctctctccagctgggaccccgggctccgaaactaaagttttgggaagagtgtcagctgacgggtggggcttcagaggaggaaaagaaacaagggtgtgagatgtgcaggccctggtgagagacaggcagcagcaagagcctgccagccatacttacccacaaggccggctgaggggctgtgctggcccagggctctggctttcggacccagacaatgctgctgaccaagcaggccaggcgctgagtgactgtcccagcggatctccgagcagggtcccttgagcattaggaatgcagcttctcaggccatgccagcctggcagaacaggaagggaggggtacagccctgtggggacgcagctgtggctcgagtgacacctgctggcggcctcatctcatccgctctctgcgagtctgtggtggttctagtcggcgtttcacgggcaaggtttagggggtttgttcctcagctggggtccacccacgtcttccgacttcctctctcagtgtttgggccatcggtgggtgaggtggctgcagcagagccgggggctcctgtgtgcggaggcagcaccgacatccactgcagccacaccctcctgagagggtctggaaggaagcagggcaccctgcgaacccaccttcctctggggtgtcttccggggccccagggccagggcaactggagcagacaggacattatctagctctgggggccgtgctgaccgagccagaccctcgcggcggcccacagagatgggcagcttgcggggcagctttgtccccccgacactgggtcctgtcttcatgcacacaagccgcctgttctgcaggtgaccagttaggttcgatgggacaggctttgggaatcagcggcttgggtttgccccccacagccttggatcttgaccttgggagaggcctccaccacgtgccctggggtggggtgggggcgggggcgtcctgcatctgcgccgttcagctcagttgccctcagccgcggttggccgccaagcactagggtgttgctggcacagccaaggaactgagcccagactttttgtttacttaatcaagcataaatgcaaagggctgggggtggccgagctgatggtgcaggcgtgtgcgctcaatagctccgtcacagtggctgtcgctttattgagcaaccgagggagcgagggagaggagcaactgcggcgagcgtggaggcccagcccgcagagctcccgtctgggggaagccctgtccctcactgcctgttcccggcgctttggtgccctctgctgtggggtgatgaggtcaggctacgcaggcagtcacggcagaactgaaggccgtgtgctttcgtgtagccaaaccccttttcttactgatatcagttataaaatcagagctatgttcccaccaggggcaaaaatccaacaccgtgcagttgcaaacacggggcaggaaagactccggcgaccctcattacactgtgccgggaggcatggccagagctccgtcagttcatgcgtcgcttaaacctagaggtgggtgcgattgtcaccctatcttacaggtgtggaaactaactcagctccgagatgtgactgaccttccccggccatagtacgcgcagcgcagtggggcctggacgcggctgcctggtttcaggtccacacgctccccagcactgccggccaggctccagcatgacgggggtcaggcctccacaaggccctgtcggccacgggagtttgctgcgagatcctgggtccctgactgtgttctcaaagcccctaggatttgaccagccgttcttttatcttaggagtcggaaatcttacatctgtatttttatttcgctgtgcttccgccccctgctctgctaccctcacctcactacgttgttttattggcatagtataaaattcacattttacaatatgcaattcagtggcactagcacattcacggggttctgatcatcagctctatcaggttgcaggccactttcatcaccccaaaaccccagccctgtgagcagccattcctgctcctccccggccatcatccgtctgtctctggatttacctgttcatgttatgggggagagagagagagagagagagtgtgtgtgtttgtgtgtgtgtgtgtgtgtgttttaaatgaaggcttgtggtacggggtctgttctcattttgcgccggtgttgggcctgaagtgtgtcctgtgtgcatgtctctgacccccggagtcatgggacccagtcacgtgctgcgctgacgtggagtccgaagttgtaaagacaaagctgggtgagaccctagtgactcacaggcccttctgctctcctttccagatctgggactttctcggggacaaccctgggataacagccaccactggagtctatgcttgaaggccattccgcctcgtggtgccctgggcgaatgtcgagggaaagcagactccctgtgcccccggggttggcttcttgctcaaggattccagatgctggcctcctgggtggtgttcccatgccgagctccagttgggggtgtgaccagcaccccgtgcgggggctgctggtgttctgtgttgtcagagcagtgctgttttgtgtttttctttaaaaaaaaaatttttttttgagatggggtttcactcttgttgcccagactggagtgcagtggcacaatcttggctcactgcagcagcctctgcctcctgggttcaagcaattctcctgcctctgcctccccagtagctgggactacaggtgcccgccaccatgccctgctaatttttatagttttagtgaagatgaggtttcaccatattggccaggctggtctcgaactcctgacctcaggtgatctacctgcctggcctcccaaagtgctgagattataggcatgagccaccacacccggcctccttttaaaattttaatttttaatgagatggggtctcactatgttgcccaggctggctttgaactcctggcctcaaatgattctcctgtctcagctgtgttttgtgtttgctccagccctttgctggtgaacagacacgttcactggacacctaagtgcctggaccgtggagcacagggtgggggtgctgttcatggccggaacgccagaggctactggggagacacaggagcgaccaccatgatccacagaccaggactgtacagagcacttgaaggggcggcctcaagaattgtgccggaacagtgaacatgagggctcctggctcccctctgaggacaagggttaggtaggaggggacaggggcagggctgaggtgggtcggcttggttcatggcagggcttggggagtgaggagagtgaggagtaccgggacccggggtccctgctctgctcacctgctgagaatgagccagtgttggcctctggtctccatgtctgtagagaggcttctctgcttcccctcctgtagaatgggaacgacaacatccagccatagagtgctgagaattcagggacaggacacagcgaaggtgccccagtcccccttcctgaccccagcctggcgtcaccctctatccaagggaagaagcagggatctgcctacgaatctctcaggatgtgaagtgtggcccccagcctggtgcctttgcagtgggcccaggacggagggtagccttggcacctggggaggacaggtgaacctggatccagactctgcctcaggtgacagccctgggttctaacgctgccgcttccgcttcctggctgtgtgttcctagggcggccacagcccctctccagcctcagttgcctcacctgggaagagaggtgcagggcttttgcgatgatcataatagttaccatcaatcgagcattagcgactttccagcaccttaaggcagttaccctgtgatctgcacagccgccctcccctcgttgcagatgaggagactgagtcagagagaggttaacccagacattcccaaggttgtagattgagaaagtgttgagttgggattcgaactcaagtctgtctgaggcctcctagccccttcctgaccccagagccttccgcacctcatggctccaccagaccctgcatgaagctcctggtgggcaaactgggcaccttcactttaaacgttgagggaaaaatacacataacctacagtgtcccgtctcagtcatcttcacgtgtgccgttctgtggcattaagcacattcacgctgttcaaccgtcaccagaacttttccatctccagaactttctcatcttcccaaaccgaaactctgtcccactaaatgctcactgcctgtcctccctcctgtcctccctcctggcctccctcctggcctcccgcctgtcctcccgcctgtcctccctcctgtcctccctcctggcccctcgcaccctccgttctactttctgtgtctatgagtctgatgactccagggaccccaggagagtagaatcccacaggatttgtcccttccagcctggcttattccactgcatgacggcctcaaggctcatccaggaagcagcaggtgcccggctttccttcctttttaaggctgaggaatattccactgcatggggggaccacgtcattttatccccgatgccttcacttttcagctcttgttcccatctgtatctgtaagctggagcatcccttgatggaggagggatctcagggagtgggtgagcctctcctctttccagggtcatcctccactttgcgggggcagcccaccttcctggagttccagctgagggggggcccaatttaacaagcactttgggaggttgaggtgggcggatcatgaggtccagagattgagaccatcctggccaacatggtgaaaccctgtctctactaaaaacagaaaaaaattagctgggtgtggtggtgcatgcctgtagtcccagctactcaggaggctgaggcaggagaatcgattgaacctgggaggcaaaggttacagtgagctgagatcgcgctactgcactctagcctggcgacagagcaagactccatctcaaaaaaaaaagggttgtccggttacctgtgcatgccaggtaatcgacaaatgctttttatttttatttatgtatttgtttagagacagagtcttgctctgtcgcccaggctggagtgcagtggcatgatctgtgctcactgtaacctccacctcccaggttcaagtgatcctcctgcctcagcctcttgagtacctgggattacaggcacccatcaccatgcctagctagtttttttgtatttttagtagagacaggatttcactatgttggccagcgtggtctctaactcctgacttcaggtgatctgctcgcctcggcctcccaaagtgctgggattacaagcatgagccaccccacccagccaacaaacgctttttaaatataagtatgtcccatgcagcgtgtcccctaaagaacgatgtgttgttcatctgaaactcagatgttaccaggcgtcctgtgtttgatgtgacaaccctgtccacagccctggcacggaaggggcagtcgctgagggtgcagtcttggggtgagggtccctgtgatggcagcctgtgtccagcttggactggccatgggaaggccactgtgtgggcgggtctggccttggtaaagggccaccccctgagacccaccgagcctagttccagtttcctcctcacaaccccagcctggaagggcgttcgggtgtggagcaagccacagggtttccccccagtgtggttcgcattggggtgccgggtggttccgagtcagctgccccctctgcctcctccccgtgcccatcacaactgcccccagtgctgggacctctgggcaagaggctgaggctgacactctggaaaggtgtgcagtggtgttgtggggtccctggggtccggtccacatacatccctgcttgcccggctcttggcatcctgtaggagaaggtgccacagcctagtgggtgggagggcaggagccccatcactggagtcggaggttgcttttgatgttgatggcagtgaggttgcttctgatgttgatggcagtgaggttgtttccgacgttgatggcagtggacttgcctccaggttagctgcctccccaagcagctttgggggtacagaatgaccgaccagtgtgggatcccaaacatcctatccccttgcctgaaagtgggacgaggctgaagctgacctctcgctgagaccacctcattcggccccgtcctctgctgccacgtccttcttcctggtaccccccttctccagccccaaataagtcacgttcacaggatccccagctcaggctctgctcctggagaagctgccctcagaggctgcgttgccgattcctttttcaacggagaggctgcagcgtgtggcaggtgccaccatctcttggagtgaggcagcctcaggggctctgtccggggctgcagcctgattggtgatctttgcacgccccttctctgccctggctgggccatatgccacatggggcgtgaggggcctgcaacacaagtccctctgggggctcgtgatgtggttgagctggaagatacattctggaacatctaagaccccagccactgtcctgagtctggatgccgcgggtgccgggcatgggggctctgggcccgggccctggggtgcttggaggtgctgtggaggaggggtggggctggcttggagcccatgggattcgattggagggtgggagtgtgagagaggagagagcgtgaacagagccttggacagaaaagcctggaaggatcaggaccctttggggggtggcgggtgaaggtggcggggtgtggggataccctggggacggacaggtcacttgaggctacaggactttgaattccacacttagtttggatcccaccctctggtgtggggcgtgtgagtggagggggcctggctagggaaagggggggggcagtggggagtggagggctgcttcgctccgagagatggcggcacctgccacccgctgcagcctctccgtttaaaaagtgactggcagaacaggagcagctgctgccagctcctgtccattttgtcctctgaaaagagaggtcggggtggccaggtcctcatttttcaggagacagaagagagctgaatttttatgtcaaatctcttggttttgagttgttagcaggtaattccaatgttttatgaaaacagcggtgggacgaataaaacctacgtatcagtaagtctcggcctccaggcctctggtctgcagcctgtgccaccgtgagttggaagagtggtggacggactctgttctccccgcaaaagccctttccagggtggcacatccacgccgttagtgcccggctgcagggagaagctcaaatgacaaatgaggcttgaggtttgccgcgttgggcgtcgtgctgaggcccagccgtcctcacggtgacctttggcatgaggagtcctggttccactctacagacgaggacactgagggccagcggggcccagaaacttccctgagtcacagctcacagagcaagacatgggcccaggtctgctgaccgggtttcctttttattttattgtggtaagagaaatacagaatgtaccacgttagctacttttaagtatacaattcagtggtattaattaccttcacggtgttaggtagctgtcatcactgtttacctccaaggctttcccatcatcctactgcaaaactctgtccctattcaacactgaccccacaaccctccccagcccctgcacccaccgcgctttctgcatctctgagcgtgactactctaaggaccccgtgtacatggaatcatccgatatgtggccttttgtgcccagctcagttcactctgtgtaatgtcttcagcgttcatccacattgcagcctgtgtgagaatgttctaccttttcaaggctgaatgatgttccatcgtatggacggaccgcatggcgtctgtccatttaccaggtgatggacttgtgggttgcctttccctttccagccatggaaacagtgctgctgagaacccaggtgcacaggcagctgctgcagtccccaccctcccttcttctggggatatcaggtctgctgattttatgtctgaaggtcatgggccactgtcccttccctatgcccttgaatctcttccatggtgtgtccactgtgtggtcttcctggatacctccagcaatggggagctcactgtctcccagagcagcccattcagggcttagtgtgtagcccacacctgtgtccctgtagctgccactcattagcctcctaacccaggacgcgtttccttgtgcccttggcaggggctccgtattcactctgggttctgtggtcctcactctgcaccacagactctgatgcctcccttctccctccccgatttccaagagagaacaagatctagccatgagaagcaggatggaggtgtcttcaaaaacagccactggtgatagaagttgtaggaaggtaccatggtctgtctgcctccacgcaaacctcaccaggtttcatcaagatagcacaccaggagtggtgtggctcatgactgtaatcacagcacttctggaggctgaggcaggatcacttgagcccatgagttagaaaccagcctggccaacataatgagactgccatctctacaaataatttacaaagtagtggagcatggtggtgcacgcctgtagtcccagctgcgcaggaggctgaggcaggaggatcgcctgagcccaggggttcctggctgtcgtgagctgtgatggtctcactgcactccagcctgggcaacacagcgagaacctgtctcaaaaaacacaaaacaacaggaagctcagacaggactgtggctgcttcaaccctgtccgtggccaggctgtgccccctcctctgtcgctgggcactcacccctctctcattttctccccagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggtaggagggcgagggggcggggggcccttcttggtgcccagaaggtgtttgtgagcccagtctgttcagtcctgctgtcgctcaaggccttgggctaggcccagtttgaggcctacactggtgtttctcaaactatgcccccatggaaccctagggttccctggaggttctcagaggtgactgtggtcaggattggtgcagaggaatggttgatttgtgggggtgtagaggcctacagcctccttaaactgagcagtgtctctttgttctatatgctgatgtttagtgtaaaatattggtgaataaagaaggtggtctgttccgttagtacaatgcattggagtgctgctgtgctagctagtaggggtgacaccaccaggtgggggtggcaggtccagcactgcagggctgtgggaggtggctaggagctgcctcagctacccagacctgcgatctagattcttccgggaccctgggagatggcagcagttgggaggccaattccgagtgcctggcaaggggctcatgcaggcctggtgctttgggggcagccgctgttctgaatcggctgcatgacttacggaatttggggtccagtggggcctctaggccctaaggaatgggtccagaggtgactgtgggtgggatcgacgtggcttttgggtacctttaggggtgggtgcaggatggggcctttagggctggaggaaggtgcccagggtctggctcctgtggaggtgagtgtgtgagccaggggctggtccccgccaagctgtggctggcaggagccacctgctgcaggttggaggaagttcccctgtggaaagccacgggccccacaggtaggcatttgggttctaaagtaactgaggttactaaagggctttgtcaagacttgggaaggcatttcagaaaacccagagcctttgctttccaccggcatttgctttcctgggccagacgagggcccttggggtagcccggagagtcttggggcagggatctgggagctgcgggggagtccatgggctgcccaggcaggaggcttcccagggcacgttcccctgcgtctttctggatggctttgtgttctcagccaggggcagacctggagttcctccaggaaagctcccagcctgggtgcggctcagcccttcccgacctgtcgctaattaaagttcagcccatttggttctgattttcagtgacctttgatctatagtgaaaaacaaaaatggtggctgcggtttgttggcagaatatgttgctcgcgacttctattgttttagagggaatcaagatcgattccaagaagctgaaagaaacatggaattactacctgacaccgaggtccaaactcgctgtttgcccctccctgctccctcagaaatgttcaggcagggaaataaacagcagcccacgtgtgactactcatctggggttttaagaacaaattagaatcagtagttattttttccatcataaatgtaatacttgttccacaggaaaataaataacactgagaagggagaaagcagcattagctctggtctgatggatcggccgagcgctctccttggcattttggtgaatttctttcctctgtgttttgtttttcgaccctttctattttgtatagttgcttttttgaccctagtggacaagaagcagttttgggggctgggggacagcggcgtcacggaattgaggaagctcgtggcagcttccgtgtgacctgcagattggttcatgagttcattggttcatgagttctcagcagctcgaggacttagtggacagtgccctgcaggactgagcttatttcacagccttggcactgggtggatgtctgtaggactggggggacctgcgacctgagatagttttcagacgaattcccctagacattaagagaagcgggttcccattaaggagcccaggtggcatggacagggctgggggcagcacaggtgaggagctgctccaaggcaggttgtcagcctctctggacctcaacttctaatctctgaaggcctgtgaagcttaggtggtaacagctcccttcctggggcatccaacctcttcctggggttttggggggcccaggggctctgtggagcattgctgggggagatgcctacgtataagtgggcatcatgctggggtgaaagcccaggggctgggccgggagggcgagacctgagacccatgcaaaggagccggggccagggtggggtgggcacggctcctactgagtccccagcccttgggacgctggccagccagccttggcatggccagcatccctgtgtctcctggggaggcattttacttaatggacagaaggacagacagacgggtggagggagtgagagggaaaggatgggtttgcaggctggtgcagctgtgaaactgacggagcccaccccctgccaaccccccgacagcctttgaggcccagcagcccatgctccctggcaggttgcggcttgccttctgcactggcggagtccgagctgactccgtcccttcgcccgagcgggcgtcgcggggagggaggtggttcctgcttccgcatgcgcacaactggggtcttggatcgtagctcctttgtgagaaagggactggctcacccgccatgtcctgctgtccacacacacggctctgcacaccactcacggcctcctcaccgctgtgcacagccagcacgtccatgcgcacctgtggagccagggtgtacggctgcacaggtgcgcctaggtggaggtctccaggtcactggaacttaaagtgtccaagagaggaggtgtcaggcctcaaaggggcactaggaactggcgtctcacccttgcctctgagacccgcagacccacatccagcctgggctgtcgtggctgagtgccccaggccggtcgcctcccctctctgggctgggttccctgctgaaggggggcggggctccctgctccctgtagtggcctcggcgtggggccgggcctgtggttgcaccatctccattggtgtcatcctcccccagccctgctgtgacaggcatgggaggcaggtgtgtttgtgagctcactggtgcgacccttggaggtgggaggctacacagtatttttggtcatcagaggatggaggatgagcctgcattctgggctgcagggcctggagctgtgctttctcaatggacttagaatttggggaaaaaaaaaaggaaaaaaaggagggaagagagtctgccgccctggagagtgaagctgatgaatggctggctcaggcgcccacagccccagggccaaccctccactggagcatgagagcggccgcaccacgtgggctgaggagtgactggccccgggcgggctcctgccactatcacagtcgagagatgcgagggagttgtagggcagctggcactgtcctcacccgccccggccggcagggcttgtcaggccgcgtgaagtgagaaacggtttgcggtgtcctccgcggagtgccgggcccttccccggagagcagctctgcagggaagggaagtgggttttcctggaaaacggggcgggaggtgtggagctcggagagactgaggtcctgcactgctaaggggactggccccggccctgggctgggagagggggagctgggactcagcccagggtggagtcaccatgggttctaaggcacaggatggataccctcctcggccatgtgacatcattgtttgggatgcgcccagtgttcggagccttcgaggctctccaggtgcctggagggcttgtagaaatggtggtcaggccccacgccccagactttgtctcatcatgtctaggtgggggccccagcacctgcatgctgacctggtccccaggacgcagatgctgctggcctgagcgtccccggctgtctcctgtctggtgtgggtgctgccgccgggaggccttggccccacggggagatgaggcatcacacacgcagccacaacacgggtcggaggcagagtccagcccagcaagggtgtggcagtggagacgagggaggggtgaagctggtggttccaggaggttccgtctgggtgagaccctctgctgcagagaggggcgggagccagtggccccgcggagctgaggtcatgtgagaaggggctgcagtctcttctgtgtcattctcctgtggggtcagcctcaccccagtgggaactcccactagtgaaagtctgagatggccccatcctgccgtgtcgcctagcagtgcaccacagggcattcggcccctcctgccttcacacactcaagacgttttcatgactcatctcctgccaggagggcacacacagggcacctttgcacggcgctgcctgtcctgaatgcctcgctgtccccgggtggacataggaattcatcacagtcctcctcgaagcccgggttgctctagaagatgaaactcaattgctgtccttgatctgctgctcactagaggccctgggttgggaatcggaatgtaaatgtgtcacccatcctagagaagaaagtcctgcagtgtgacatggcttcattttcaacagctgagaccctctgccacaacaactctcacagccccctcatccccacccgccgtggaaaccaaataaaagcagaaagctctggtggaagccgagctgggggcgatggggcagattgtagcccgtttctccttcccgtccccctccccactttggcccctgggacctgctcagaaccccagggtgaaggagacatctcaagtgtgacccattggctgcttctgctgcgggagagggagagacggggtggcccatgtgaaagctatgcctcctgcagccccgcaaagcctgcaaaagctcagccaggatttgatgggattgtttctgctgggaccccctctctgctgcgtctcgtgcaaacgttgctgtgaagggatgccaaggggttttgcaaagcagaaacccaagctgagaggaggagaagggattgttctgggggcaggcccaccttgattcagggggtttcgcttcattgtgctttgcagacgctgtgtttttacacattggaggtttgtggcacccgtgcatggggcaagcctcttggtgccgttttcccaacagcacgtgctcacatcgtgtgtccgtgccacactttggtaattctcacggtatttcaagctttttcatgattatatctgttcatggtgatctgtgatcagtggtctttgaggttactagtgtggttattttgggatgccacacatcgcacccatataagacagtgaacttaataaatgctctgtgttctgaccaatcctccaaccagccgctcccccatccctctctctcctctggtctccctattccctgagacacaacagtattaaaattaggccagttaataacactccaatggtctctaagtgttcatgtgaaagaagagtctcacatctctcactttaaatcaaaagctggaaatgataaagcgtagagaggaaggtgtgtcaaaagccgagacaggcctcatgcaccaggcagcctagttttgaatgtaaaggaaaagtaattgaagaaaattaaagtgttactccagtgaatacatgaatgataagggagtgaaacaatgttattgctgatatggagaaaattttagggtctgaagagaagatcaaactaaccacaagcctgatccagagcaaggctcaactctaatgctgtgaaggctgagagaggtgaggaagctgcagaagagctggaaacgagcagaggctggttcatcaggtttaaggaaagaagccgcttccagaacataaagtgcaaggtgagggagcaggttacccagaagatctggctaagattgttgatgaaggtggctacactaaacagattttcagtgtcgatggaacagctttctattggaaggagattccatctaggactttcatgctaggaagaagctaatggctggatttgaaggacaggctgactctcttgttaggggccagcacagctggaaatgttaacttgaagccagtgttcattgaacattccaaaaatcctagggcccataagaattgtgtaaaatccactctgtgctctagaaatggaacaacaaagacctggatggctgcacggcttacagcatggtttccagaatagttttaagcccagtgttgtgatctactgctcagaaaaagattccttttaaaatattactactcaccccggagcgcccatggagatgtacaggaagatgaatgttgtttgcgtgcctgctaacataacatccagcatgcagctgtggatcaaggactaattttgactttgaggtcttattatttaagaaatacatttagtaaggctgccatagatagtgatttctctgatggatctgggcaaagtccattgaaaaccttctggaaaggattcaccattctagatcccattaagaacattcgtgattcaaggttggaggtcaaaacatccacattaacaagaatttagaagaagttgattccagccctcatggacggctttaggggctcaagacttcagtggaggaaggactgcagatgtggtggaaatagcaagagaactggaattagaagcggagcctgccgatgggactgcattgctgcaagctcacgaccacactcgaaagactgaggagttgctgcttaggggtgaaacgagaaaatggtttcttgcgatggaatctactcctggcgaagatgctgcagacattgttgaagtgacagcaaagatttagaatgttccttcaatttagttgataaaacagcagcagagtttgaggggattgactccagtttccaatgaagctctaccgtgagtcaaatgctatcaaatagcatcacatgctacagagaaatcttttgtgaaaggaagagttcattgatgcagccaacattgttgtcgttttttttttgttttgttttgagatggagtctcgctctgttgcccaggctggagtgcagtggcacgatcttggctcactgcaagctccgcctcccaggttcacgccattctcctgcctcagcctcccaagtagctgggactacaggcgcccaccaccgtgcccagctaatttttttgtatttttagtagagatggggtttcaccgtattagctaggatggtctcgatctcctgacctcgagatccgcccacctcggcctcccaaaatgctgggattacaggcgtgagccaccgcgcccagcctgttagaagttgccgcctcagccttcggcactcaccacgctgatcacccacagccaagccaagatcctccattgaaggctcagattattgttcacattttttagcaacaaagtattttaaaattaagatttgcaattttttaagatataatgctatagcacgcttaatagactacaatatagtagaaacataacttttttctttttcgtgacagggtcttactctgccgtccaggccggagcgcagtggtgccatcacgactcactgcaaccttcacgtcccgggctcaagtgatcctcctgcttccgccttccgagtagcgtgtggggagggtgcacgcagctgggctaggatggcctggctggggtcagcccccgtctgtcctggaggccaggcaggtgcggagcttacggaggtggccacctagatgatggtgcctactctcgtgagttgaggcccttggatctctggcagtcagcaggactgtggtggcagccggtgtgctggttgtcagctgatgtccctgtctgtgatttttccgtgtgaatgcagccttgactgggcatgtagatcagaggtgacaagtcctgggcacctctgccactcttcttcctgccctgcacccactacagacacagctaattggtggctgcgttgagaatcttgtcaccaggcaggctcttctgtcggctcaggactgtcctgcgggcatagcaggaagtgaactgcagggggaagttggggcctggttgctgaggagggcagtgcgtggtctccaagccagtcagtgcctgcgggggggactagaattctcacccaggcctctgctctcagtcctgttcctcctctcacattcttcacacccaggctgggctcagggatccttgttgatgatggccttgaaatgtcctctgaacagtgtggctctgggggtgtgtaaaacccagggtgatgcctgctctgaaaggggcttccagatccctttgtgtctccagcacctgccgtgtgcctgccccaagctggggtctgtgagctgtgccttggggcccctgcctgtccccgctctgctctctgctgtggcttgctggctgcagggttctccagtgagtgagggatccctgctggccatgcctggagctgagggtggagggaggcccagcaggaagccccacaggtaggccccagtgagggtgcattatctacaggaaagttgcctgggacactctagtgggccgtctaggaaatgcagcctttaaggacctgaaatggagggggatatttttagtttttaaaatttatttctcattaaaattataacacagcctcgtaaaaatattaaaacagcgagacagatgtgtcaggggttatgtatatgaaggaggtagcacagttctcatcacgggtgtgcttagtgtccccctaaagttcatgccagttaatgtgatcgtgactgtaattggaaatagggtcgttgcagatataattaagatgaggtccttctggagtcgagtgggactggtgtccttagaggagaagagacacggacacacagaatgccacgtgggacagaggcctgctgtctacacctgtgcagaggagacaacaaggagagtggggcatgacccctgcccacgacactcgcctccaggaaggcagccagctgcccatctttggtgcggtcatctctgcaggcaacagaatggcagagtggcagtctgatcactctactccattgtgtgagagtctccaggatgaagaccaggctccccagcaggacgtgcggccctcatggagttctggccttgttttcggctgttgcctggctgatattctgcacatctgcccaccgtcctctgggcggtccacgaatacattgtgccttcctctttgcatatgctggtccctctgctggcaatgcccttccttcttggtgagctccaatgcatccctcaagactcagttcagatgcgcctctctggactcatccccaactcccagacggggttggctgctcccttttttcagatcctgaaacacttacttgtccccctttatgtgggcatttatctgatagtagagtttttctgtactgttggaatggtgagttccctgaagctaggtcagcttccttctcagcattcagcaggcggtgggggaggagggaaggagaggaacttcctaataaagatgaacacctctttgtggttaggtcagaccagcctgtgcctgtgcgacctggtgcagaccttcacctctcagagcctcggtttcctcatctgagcctcaggcacgacaatctgctagactctgcttcccggtggcagctggggaatgggatgggaaggagccctgggatgctcaggtcatccctgccaccagaatgtccccagagtcatgaccatcagcacctcagcctcgctgctttttccttggggtctgcaggggcaggacgcaaaccccacacgctcgctgcgcagtaagctgcaggggcttctccagcagcacctctgaggcctgcctaccacgtggagatgctgctcccgtgggctctgaccaccgctctgccctcttctcacaggaaccagcgaccactcggcccggcgtaaccacgcatgtccactggtcacctggtggccttcgacaagaacgtgtgataaatccctgccggagtgcggctccgggaaaacgctgtcaccgcaaaccagctcctctttgttgcagtcccccgggggcatggcccggcaagtttccttagccaggggccagtttgcctggggtcagtgggcagcgcctgggagtcgagtgtctcgagtggggctctgcttggtttctccttgaaggtctggcagggtcagaccctgcatcggcagtaaccgcggagatgggagagccgagtctgccgctgtgggcttcctgggccttcccgccacccccgccagggcccttgggctgcatattcgaggcgcgcagcctgccaggccctccggcctccctgcgtggccaccagggaaaatggcttcactttgctgagcctctgtctccctggttacaaaacaaataattttattttttgtgacagggtgttattttttgtgacagggtgttgttctgctctgtcccccgggctggagtgcagtggtacgatcatagcccactgcagcctcgatctcctgagctcaaacgatcctcccacctcagcctcctgagtagctgggaccgcagccgtgcaccaccacgcccagctaacatttttatgtcttgtagagatggggtctcactgtgttgaccaggctggtctccaactcctggcctcaaaaattctcctgcctcagcctcccaaagtgctgggattacaggcgtgagccactatgcctggccaataatgttctattttaatttcctgtattccctaaatagtcataaccgtttccaagggcgatattcagaacacgtaatgagtgcagtgcaggcaccagcccacgtctcggccccccgtgtggggaaccagtctggccatctcatggtccctgcgtctgctctgcccacctcgtaggaggctctggattgaatgaggttcgacagtgctgactgtgagcctggccctgagtccgctcaggggtctcacttgccactctgctgctgtcactgcgccgttccctttgcccacatgccctcctggtctctgcatagatgtcctgagtgggactgctgggagtggggcactgctgcgtggcagtggagcctcgatagtgggtctcttgggggattattggcaagctgcaccccttgaaagttaaccgatcggggtgcatggcgtgaacttcccttcctgagctggtcagcccagtgtatgctgtgagccaggagccctgagggcgtctctgcccgcctatctcagagcacactctgtgttgcaggtgccgtgacacctattttacagcccaggaaacagagtctttcatgctgttccttccagccgaaccctcagctggagtcactccagaagccgcaggcaggagagttcccacaaaggactggatgcacaccttcctgagacggggggtgggttaggattccagcaaaggaagctctaaacaccagagtggccagtccatggcatttgttgggggacttacagagggggcttcagcttcctgtgggaatggggagatgagccacgttctgccccggtatgtctgcaacgacgggatcagattacggagttcatatgagggtgaaggaactcggctcagggccgggcccagtttccaggcttgatcttgcagtgtttgggggcaacaccctgaataaatgaatcagtcagtgcctgggaacattcgaggccctggcttgggttcaagcctgcaggaaaaacgtgcagctggcgggtcaggggcagttaggacagaggacgaggaggaacgggggcccctacgtgccatgggcatgtgctcgtctctctcctggtgtccgcctttctcctctgccttgtggctcagcttggactgccataacaaaatacgatagagtgggtggcagaaatgcattttctccccgttctgaaaactggacagtccaaatgcatggtgcctgtggtgttccgacaggggatcactcctcgggctccttctcgctctgttcacggggctttccttggtgcatggagaggatctccctctcctcctcttcttataaggtcaccagtcccatcagattagggccccacccatatggcctcatttaaccttaattacctccttaaaggccctatctccacatataggcccttgtcatagcggaggcttcacataggaacctgagggggactcagcctggagcacctggtgtgttaggaggaggccaggccagcgctgagcaccctgcctgtgggtgagccctgcttctcaagcaacagtaataaataaaaaggaggaggccaaactgaccagacctaaaaaaacagtatcttaaggtctgacacctgccacggcatgaatgagccagagaaagtgatgctgagtgaaggaagcctgtcacaaaaggacaaatgtggcatgtgaaatctctagaacagggagattcatggggacagggagtggactgggttaccaggggctggggtgggaacaacggggagtggcttcttcatgggtgtagggtttctgttgagggcgacgacagtaccctgcaagtggaccggtgaccgatgcacagcgttgaatgtactgaatgccactgaactgtgaactttaaaactgttaaagtggcaagttttatgttatattaaaaaaatcatatatagaaaggatgttgtattaaacgagaaaaactcatttctctcaagtaccagtcactcattgtggagactgctcttgaggtcactgtgcccaggcctcttctgtcttgagccagtccatctctggggtgtgaccctagcttacccccatgaccacaggaagaccatgagctggtcctttaaggatgcaacctgggagttgccccgaggactgtgctcacattctgttggccaaaactcggttacgtgaccacacctagctgcaagggaggctgggaaatgtagtccttagtctgggggcatgtgcctggctgacaatggggcttcagtgctgtgggagaggaggagctggtggctgccaggggatggacagctgtctctaccaacctggcctcacagtggtcacgctccaggacataaatgtcccctctgcagcaaagacttcctgggtgtggaggggactgggggcccacaccctggtcttcacaagatggtctcctaccccggaaggcaccatgcggcccacgcttcagtgtgaagacaccacctgtgtgttaatgggcccaacaccaacctgggtgcagggcaggtattcagcaaacagtgaatggacaccagggagctggctactatagcgacctcctgaggtcgcagggctaccaaacagtgcacggcatttgcaccccagctcaggcgtcccggcagggattctgcattgtctgcctttgaaaaaagggtgggagagttaggacaggaattttctctgtttccctctctctctccttctccccgcttctccccctctctttttccctttctcttttcctccctctctgtccctccctctcttttcctctctatctccctatctgctttgctctctgtctctctgtcctatttttctccatcactctttgtccttgtctctttttctcgttctctgtcactccgtttctgcttttgttcccccttctctctctctccccaacccccctgtttctctatctcttcacctgtgaattcctgaaacagacccagggcatgatgtcgtggagggcaggccccagaggcgtccaggtgacaccgtgtgggcatttgtaaagcaggaggccccagcaggtggagcaggaggactcacccccctgcagtgggtggtcaagaagagctgcctttcctaagcccctctctcctccagccacccctcacctggggcctgctgagagggacaaggtggattggggcttgctgtggggctggtgctgaggcaggggtgggtggccccccagcccctatttcctcctctccaaacccagccatcccagttaattatttgcccagcagggcagcttgactggctggtgtcttgctgagcaataagcagctgaataagggtgcaattgctggaggcggggtcgcagctgcagacctgggcggtcacttagtctgggacagctgcggcggccacagcgaaagccatgcagcctgccccatgcctggctttgtcgcgacggctgctggaacagacgggtgtggtggctcatgcttgtaatctcagccctttgggaggccaaagcaggcggatcacttgaggtcaggagttagagaccagcctggccaacatggcaagatcccctctctactgaaaatacaaaaaaattcagccgggtatggtggcaggcacctgtaatcccagctactcaggaagctgaggcatgagaatcacttgaacccaggaggcggaggttgcactgagccaagatcaagccactgcactccagcctgggtgacagagtaagactgtctcaaaaaaaaaaaagaaaaaaaaaaagaaaactacacacacatacacacaacataaaatgtatgattttggccaggcacagtggctcacgcctataatcccagcactgggaggttgaggtgggtgaatcacttgaggtcaggagttctggaccagtctgggccaacatggtgaaattccatctctactaaaaatacaaaaattagtagtgtattagtgggtgtggtgacaggtgcctgtaatcccagttactcaggaggttgaggcaggagaattgcttgaacgcaggagacgaaggttgcagtaagccgagatagcaccactgcactccagcctgggcaacaaagcaagactccatttcaaaaaaaaaaaggatgatttttaaccatttttaagtgtaccgtaagtggcattaagcatgtggtgcaaccatgaccaccatctatctccagaactcctttcaccttgcagaaatgacaccctggacccttgaaacactaactccccctcccaggttccctcccccagcctggggattaggcatctagcagctgctgtctggagagggatagcatggccctgctccgtcccttctgggcccgttgagctctgctgtgaaggggattcctttccttgtccctgtcactcctagtgtggaggtcgggggtaccaagccccagccctgccacctggaaaccctgggaaagcagcgtcacctccctgtgcctcagtttcctcatctgtaaaggggagctgaggacaggacctgcctccgagcctggggagagacggcagtgcacagggactagctgtgcgtctcagtaatacggagagaactttgcaggccaatggcgtccctctgagaaagactctccctggattctgtttcagagagttgagcttttccccagagcagatgctttgaaactgtctcaggtggacagagggggctgcagggagggcacagaggacttcctgggagtgaggtttcctgggattgagtcccagccctgctgtagggctggagtgaaaggggcctccccagagagcctctcccagggctctgtccccaagtggccaagctaattcggttccgtgctccccttttgcccacccccaccagaggccacaggctggactgggcgccactgctcatgcttctgtcctgggatagcacagaccagtacaccagggtctggcacatgtccgttgtagtcactgcagccctcccagtctccccgttttgtagaggaagccacagctcggggcaaagccgcacctcgcagtggacaggtgagtctctgcctccccaccagctgcctcttccacagatggacccccaatcacactgtcatatcgcctgtctgagcctcactgtgctagtctgtaggagggggcacctcctcttgggccatccatataaggctggagacaaacagctccacccagttatgggagtcccatgccatccaggacacatccaagtggatctctcatagcctatcatggttcctccaagactcagttttctcatctgtccagtggaatgacaatggtacaggctgtgagaatcccttatctgaaatgactgggatcagaagtgtttcggatcttggctttaagttgtagaatatttgtatgcacataatgagatatcgtgaggatgggacccaagtctaaacacgaaatttataatacataagtttctggaggctccagggagaatgtgttccttgcctttcccagcttccagaggccgcctgcgttccttggctcgaggtccctcctccaccttcagagccagcggggcagcctctcctctcctctccgacctcctgcctccctcttacaaggacccttgtggttcggggtcatctgattatccacccagataatccagggtcatctctctctttcctgatccttaactcagtcatatctgcaaagtcccttttgccacataaggggacacattcacagacgggttctggggatcaaaacagggacatctttgagggctgtgtttctgctgaccacgctctcctctgggcctgccctttgcatctgcagatagcagtggactctctttagggggagcaaagcctcccgctctgagcatgggctggactttgggggtccaggactggggaggggtcgacattgtaggtcaccaccatgtgtgactgtccagggaggctgggggatgaaacagccgagggtctgactgggggagagccgagaacacaccccactttatccggaaggccagccatgtctgctcagagacgaagagtcacgggacagccctgtccaagagcaaagacccgtccaagagcagggtcagcacctcggagagttccccgcaggccgccacggggcggggagagaattcatggggcttcgacttagaaggggaacatacaatgctgtggttttcactgcctctgggtgcaactcagcatttccccaattacgaagccagggccttggcccccagcaggaagcctggggtatttcattgcctcacactcacgtcccatctgctgaggggcacgtacgccaccactactcctgagtggcagttgattttacgctcacagattcgtcctgttatttagtatgttaattcaggcggctatgcatggttgtctcacaaatttgatttttaaggaatttaacatttcaaaatacttggtttcccttgtaacccctcaccttttattttctgtacctacggtcatccctcaagagggatccgtaggcctcccctgcctgccctgggcacagggacatcccgaagcgccggtcccagagcctgggctctgctgctgtttctctgtgacttgaggcaagatatcctacgctgccgagatagcagcccctctgcctggggaggtgagtgtgaggaacccggtgtactctgtcgatgtttaagggtcagtgggcgccgaatgaatggtttctgtcagcagcacattctgcatctcccaaaaccaaaaccaaaaggacagccggattttcccctctgcctgacttcactaggctcgcgtctgattttttttttttagcaccgtcagcataagggcctgggtttattttgtggttgtttatagtggaattgggtgtagtgtcctgatttgttttccaggatgttcgttttggggtcaagggtctttggggtggatgaggcgggagaaccaggcttgagtgaggctctgccctcctttcctggccccctggtggcccctccagagtctgtcccggccatggaccccagtccccgctgagccatgcggagagtttgggagaagtgcatacctgccttgggggcttgactggcaggctgctttcctctggctcatcttgaagttaaaatgtagctcagaccctcctcagcccccacgcagggttgcaacctcttccgtctgtctccctgtgaaatccaccttccagggggcagcctgggacctgggatggccctccctacctgaaacctttcaggccttccactgcctgcagggaaaagcaccggctcctttcacggacttccagcaccccttcggggctgctgctgcctggttggtaagccctgagctcactaatctcagccgtcacatgctgttgggcaccagcctgtctctttggaccataaaaacgccatgttgggttggcaggataagtcggcaagttttgatccagggctacagatttcctggttgtattgtttcaaggttaatttctttctttttttttttgagatggagtcgcgccctgtcacccaggctggagtgcagtggcacaatctcggctcactgcaacttccgcctcccaggttcaagcaattctcctgcctcagcctcccaagtagttgggactacaggcctgtgccacgtgtccagctaatttttgtatctttagtagagacaaggcttcaccacgttggtcaggctggtctcaaactcctgacctcaagtgctccacctgccttggcctcccaaactactgggattataggcatgtgccactgtgcctggccaaggttaatttcttgatagagttggacagtcggttttgctacaaagcttgttttgaaaatgagagttggttccagcatgattgatatatcagggaacagtttcaagataacacaagtttcccgttttcctttgtgagatttcacccaccagaagcactgggtgaacacagccactgcccccagctggcctgatgcacctgtgttcacataggaacacataggatgcatacgcacctcacacagccccagccgccccagggaccccatcctcgtcagggcacaacttccccgtctccactgccccgtctctgccactctgcaccagctctccagcccacctccctcggtaaacttacagcgttttcaagcccaagtgccgtgttaatgtgtctctgaaccccttgacatgtgaagctgtgctgccgtttttattagggtttctgtctgttttgagtgccctttccctaaccccattccccaacaagccctgtggttttgactgtgcggttttgcatgcagtgatttctaggaatgcagacgtcgagttgtggtggaatcgactcttctgtgctcatgtgagggaatggccttgttttgaggaaatatgcgctgaagtactcaggggttaaaaatcatatggccagctgggcgcggtggctcacgcctgtaatcccagcactttgggaggccgaggcgggtggatcacgaggtcagcagattgatagcatcctggctaacacggtgaaacctcgtctctactaaaaatataaaaaattagctgggcgtggtggaaggcgcctgtagtcccagctacatgggaggctgaggcaggagaatggcgtgaacccgggaggcggagcttgcagtgagccgagattgcgccactgcacctccagcctgggcgacagaatgagactctgtctgaaaaaaaaaaaaaatcatatggcccgtcaggcgcggtggctcacgcagtttgggaggctgaggtgggtggatcacttgaggtcaggagttcgagaccagcctggccaacatggtgaaaccctgtctctactaaagatacaaaaattagccgggcgtggtggcatgcgcctgtaatcccagctactgaggagactgaggcaggagaattgcttgaacctgggaggcggaggttgcagtgagccgagatcgcgccattgcactccagcctgggcaacaagagtgaaactccgtcgcaaaaaatagtaataattcgtccgtctcctcggcgagtggaggctggggccagggtggaacaggagctccacggtgagccaccccggagtgaaggccactggccctccttatccttgctgcggtgtgggggtgtgggtgtatgacccacagctcacatgtggaaacatggaggccccggggcctgtgtgacttgcccagggtcccagctagcaggtggcagagcaagacctgtatgcagaggcccaaggaagcgtcatgaggacccaggtcaccagtgcatctccagggtgaacctggcccctgcccagcgcatttgcctgtcccctgaaaccgccaccacacaaaaccatgtgcatcttcagagcaggaggcgtctccaccatctgtttgctcccgtttgacaaatggtcggtgctccttgaacggataaacaggaaccatccggccctcttccttgccggagctcatccctttgactccagggagggaggtcatgagcaccacagtctttatgggggagatcactggcctgcccctgggcggagaagccaaactagaaccttctccccagggtgagctcacaggcttttcccatccgggacccctgagccgattggctgcccgggacctgctgttatatcgggggctcccattgcaaagcccctgcgtgggctggcttccccgggtttggtttctccccattgtgcagggtcttggggtagggtctgagccaggtcaccctggagaaccgacagcaccggcccagccccgctgtgacctgctgaccccggaccccgcactttgcttagtgctttaggtctgtaggagtaatctttggagaatcgtgattctgggacccgagctctgagggaacaacctcctctgagcctcccaaggccccccaacattgtggggtgagccccacctcacagatgctgagacaggcctagaggcgtggcgctcccagccccatgccccacatagctctaaggcctggcctcacttgcaggtgagggtcctaggaagctgggggtgggagcaggcctaggagaggcactcaacaaccacggctcagcatggtctagaactgccccctcttcctcccggctgccccgagtctggcttccgtcagacccagcctccttccccagcccatccctctccctctttgatgaggccgatggggcaaagacctttgcttcccagaatgttctgtccctggttggaacactggtccctgggacacagccctgtcctcagctttgaagtcagttcccatcgctgccccccaggtagctggctggcttctgccaacctcagcctggtcgcagctggcacctcctcaccaggtactaaaccagggtgtgcagaggcccgctcgatccatggggcagatcagcaaatggtagtgcaggatgccccatcatatgtgaatatcaggtaaataacaggtacttctttttttctcttttttttttttttgagacagagtttcgctcattgcccaggctggagtgcagcggcatggtcttggttcactgtagcctctgcctccctgatttaagcagttctcctgcctcaggctcccaagtatctgggattacaggcacctgccaccatgcccagctaatttttatatttttagtagagacagggtttcatcatgttggtcaggctggtctagaactcctgacctcaggtgatccgctcccctcgacctctcaaagtgcttatattacaggcatgagccaccgcgcctggcctatttttttttttttcccttggcaacagggtcttgctcttttgcccaggctggagtacagtggcgcagtcatggctcacttcagcctcaaattcctgggctcaagtgagcctctcaccttagcctcctaagcagctgcaactacaggtgtgcaccaccatgccttactaattttctttaaaatttttttgtagagataggggtctccctatgttggtcaggctggtctcaaactcctgggctcaagccagagaggggctggcctggtgctctgggttctccagaccccctcctgccttggtctcccacagtgctgggattacaggatgagccacggtgcatggccacctgatggataatgtctaatataagagaacccctaatttagctgtccctgtacccttgtgaggtgagcagtattgttgcctacattctatagatggggaaacagaggccacagaggcctagcagcctgcctcgtcaccgagtgggagcttggcagggctgggatctgaacccaggccgtcggctcctgggcctgtgtgccccctccatgaccatatcagcttcctacagcttccatgacaaagcaccacaaaaccggaggcttaaacacagaaacgcagtcccccagctccgggcagaagctcgagacgagggtgtggcagggccgtgccccctctgcagcctctggggagggtcccttccggcttctgggggctgccggcctccctggagtggccacgtcacttgttgctgctgtctccctcgtcacgtggcctctccttctctgtctcttagctccctctgccccgtcctgagcacagctgtgattgcattagggcccacctgtataaccgaggatgccctcttctcaagagccgtaccttgatctcatctgcagagatgcttttcccgacgtgaatggaatattctgaggattaggacgtggacctaccttgttaggggccaccattcagctgactgtctttgccaagcacaggcagtggagactgtgtcatgctctgatccgaacaatcgtccttctgtctgccgcccgacttccccagccctgttcagaaagacagaaggaactcctgccccaccctaagctgaagtcgggagcgtgaggaccctttatctggtctttgggggccaggtgggttcacgggcacaggacagcatgacaggcagggcctggcattgggacacctgggtcttagtcctcacctgtgacagcggggggtcttgggcaacgtcccacccctctctgggccttgaagatgaaggggttagatcctggcctcccggagcttcccctggtgtaggatcaacacactttttctgtcaaggactagagagtattttaggctttgctggccctgtagtctaagtcacatactcttctctgtctgtttttgtttgttttgttttgttttgttttgtttttgtttttcctacaacccctttaaaatgcaaaacccgttcctagctccaggccatggctgccattgggctgtgttgagcctgtggcgcgtgcacaggcccctgcccttggtggacactctgattccacctgcaaatcctgagcgcacaccggctctgaacaggctctgtggcttcagaaacttatcttctggcttcgtcgatctggctggtttgccctggggatcccgcatcctctgactaccgtgatgagcagagcgcagcgcccggctccgtgggccaacttttggtgtcttgccctgcctgagcctgttcctccttcctctccctgcccctccagccgctccgggtcctctgggaagctctggcctcttcaccagccctgcgcggctgctggatctggaggccggagccggcacatgcgtctgacagcagcgctgctgtctcttgtttttcgtggtccatgtttgggggttacatctgggcctgtcccttctctgtgtagcctgaaggcagttcccaggcttgtgtccctcacctctccgcagacgccctttccagatcctgttcaaatcctggccctactcacgggaacttgggtgagtcagttcccttcactgagccttcatgcctccctgttaaggagaagcttcactcggcatggcgtggcccgtcacactcatcctgcatctgttacaccaaatgcagtttcctcttctataaatgggagaaaatcacctgtccttgccaagggtccggtgggaattaaatgagctgagccagggcacgggtggagcttgctgagtgttaggtcgtgtgcctgctcttcttggcggagtctggccagatacctcatctggttccattgctgtcagtctctaaatggggcctttcctgcccagctcccagccctggtgctcacaccatcacaggccaaagaactggattccagacactgcctcctccactgtccccacagtgaaaatggggagggatgtccctgtggagccctaactgggacccagacagccctacccccagctcccaccccctccggctgtcccggaggccgtgctccgtggatctcctctccctcgcctccacgtgggctccaggtagctgcacacgcattacaaacatctcgttaatcttctcggaggtcctgcgaggcgaggcctgtggtagccctgcccttggagcactgagaattagtaaggaaatcgccgctgcatctcccggtggcacaggggcgtggaggcgtggcgggccttccctcttgcaccactttggatcctgggtcctcacagcagtgttctctgcaggggaggtgcaggcattggtctgctctagggccaggtggtctaaaaagtccctggtcagccccgagtcctgcaggaatctgcatgttagtgggatttggggttcaggatgcttgcctgctgggtaggatggggttgctgagtgaggctgaaatcccagatgggatgtctgggctcctccatgcctgacttgggaggggtgagaaaaggaaggagacttggccatctttaggctaaaagcctagtgctgtctcacaggagggaagagcaggtctctgcaacacacgcctggggttccgtcccctctggccacttgtctgtcaccttggacacgttgcctggcagcctctgagcctcagtgtgcttctgtgaattggggtgaccctagcacggtgctcacgacagaaagcatgggagtgcagacgtgggtcagtggcccgcggtgagagctccctgtctgccccatggtgagtttccacagcagtgagagaggcctggcgtgtggggtggaggccgggacagtgtgagggccgcctggtcagagcgggaggcaggaccccgtagggagatgaaagccaagctggacccaggcagaaaaagaggaacgaaggacaggaagtccaagagcagtcactgctgacgtgagtgcggcctgcaggcagccagtgtggatggactctcaggccctccgttgtgtgttaggggaccggaggagcagagaggttgcagcagccggccggcctctctcggtgagggccggactgcacatggggctcagaggccgtgggtgtgcctgcccgcctgtgtcagctccagccgtgggggcgggggtaatccgaggctgcgtcccgaggctgtgggagctctgccttcatccttccattcacaggtagggacacaggcgtggggattccacggtgcccttgaggcagctgtttcctagacccccaaggccctgacggagactcccccacccctcaggagcagagggtgaggcggggtctgcaccggccgatgtgggcaactgttgcaccctcggagcccagcagcgagggtgggggtctgtggggagtcagccgcagccaccagcattgctggaatgtgtcagaatggtggtgcctcctgcaaacaaccttagcctctgttcatcctgtcaccagggtcctgggagaagcaaacccacgtgtggcctctgcagggtgggtggggaggttctcccggccaggcctgactgacgcccctgctgctccctgtggtccagcctggacttgccaccgattattctatcaatggcactgcactgggcaccaggatccaagcagtggactgcgggacaggacctgtccctgtgagcggcctgtccctctccccaggcccagcctcctgttggttatccttccaagcccatgcctgggctgtgcgatccacctttcctccaggcactcttcaggcaaatctctggagcacccactgggtgccacacactgcggatgggacgcagggtaccgcacagccccggtcctcagggacccggcggggacagcactggtgaaaaaccacggaagtacattgatgtgtcacttcaacaggggcctacgcaggggcctgccctgtgccaggccctgtcgttggtttgtggggtgaagaccctgttcctatggtgtggacgtggtagagatccaggggctctggcagcttgtatgggggaatggggacgggaggggggtcaggaatgggcttctcgagagaagtgacatttggtcagaggcccaagagcgggaattgatcctggccctccctgaatcagtgtggtgtgacccctcccgccaaggtgagggtagcaaggtgcctggggctggaatcctggggctgtggcccgtacagtcgcccgggacccatgcccagcagggccctgcacccggagtttaacactgaggtccccaccttgaaattcctaatcattgagtctttgtaacttgtgttagggagtccagcgagacaatggggtatgtgcggggtctttggagcttcagcccatgcacagacacgtctctctgttcctcgactcctagcatgctctcacctgcctgccccagagaccaagccccacctggccccttcgtcaccccgaggtggcgactgggttgtgctgaaggagggaggcccacacgccaccactgccctctgacccgtcaggggccccgagggcctggttggtcagggctgggcactccacccaccccggatgacagcaccaggctcatgtgccaggtgactcagccagggccactcaccagcgccacctggtatgtcctgggtggcggccgctgtgcctgctcctatccaccatggttgggcactggctgggaagagaggtgaccaccaggccctaatagcaggagtcacccacacaacccttgtacccagccctggggtccaggccgcctgcaccggctcagttctgcgcctgagctcccagctctggggtccaggccacctgcaccggctcagccctgcacccgggctcccagtgctggggtcccccaccccttggtgttgccgcatcctccctgggcccaagattcctggagctggagaacccccttcctccctgaggcatggagactgggctggtcctgagcccactccaggcacaggggacacacctgcttccttcttaactgagtagagcagagttattttgaagatcggttttcagcaggacagtaaaaaggcgaactgggagattgttcatgcagcagcttctaaaaccagtttttagataaatgcaccttcgtctgtggggggtggccgcacccagcctcgcttcaggtgcctgacggggtacgtgctgcgttcagtcccaggcaggtgtagggctgggcaggtggagatgcggtgccctcgctcaaccggggtctaggctcctcgccgggcggggttcacctgctatccccagtgtgtgggggcgggggtgtggggtgagggagaagagtggggcactgagtctaaacataggctgtggcctgtaggtgaggggaggcggcagcaaggagggggagatcaactcctgaagagactccgtttctaacacgccgggagccctgcgctttgtcatggaaactggcaagagtccctctccatccctccctactcccagaaacaagatggtcccaggctaacgggcttctctctggcctggccctgctcccagacccccgctgagggtggtaaacaccccagccgcgcccttggcaggggttccgtcccaggggcctccctgttctcactgtgagggtgggcatgatgggcagctttgcggagcctcctcagcacagagccgcacatgacgggggtggacagactgtggccccacagccgtccatcactttcatcctgtattgggggagaacggggcttgcttgaggtctgtcctggatattcgtaatgctggcattgacggggccagtgaaggctctgattggtgcgggtgacgaggacacagtcgcagcaggcgtagaccaccagagcagggtgtccacgtggctggccacgtttagttgataaaagtggcatctataaatgggtggtggtgcggaatgggtggttgattaaatggtattgggccgctcaggtggccattggggaaaggtaaagctggatccctacctcataccaaaattattctaggtggataaaaagtttaaatgtaggccaggcagtggcttgtgcctataatctcagcactttgggaggccgacatgggcacatcacctaaggtcaggagttcaagaccagcttggccaacatggtgaaatgccatctctactaaaaatacaaaaaattacctttgcgtggtagcacgtgcacgtaatcccggctacttgggaggttgaggcaggagaatcgcttaaacccaggaggcggaggttgcagtgggccgagatcgcaccgttgcactccagactgggcgacacagtgcgactctgtcattaaaaaaaaaaaaagtttaaatgtaaaacataataaaagctggtttccttactgcataaaacacttctacaaatcgacaagaaaaaaaaatcaaccgcactcttaataacagaaatgtaaattaaaactacaaggagataatgctgggtttcacttgtcttgggagagatttaaaaaaaaaaactgatctactgaattacagaagatgcgaggaaacagaccccctcgtgctttgctcgtgggggtgtaaatgtcctccctggagagaaaattgtgaatctctagcaaagttcagaccccaggaacatttaaactgcagctttaattcaacagcggcacttctggaagtatcttctgaagatggatttgtgtgtgaaatatcaaatatacaaggttgttattagactgtgaattctaataggagaacatggaagacagccttcatgtccatcagcatgggcggacttcatgtgttctggaacggtcattaaaacaagaggctgggcacggtggctcacacctgtaatcccagtactttgggaggctgaggcgagaggatcacctgaggtcaggagttcgagaccagcctgaccaacatggcgaaaccctgtctctactaaaaatataaaaatgagctgggtgtgatggcgggcacctgtaatcccagctacttgggaggctgaggcagaagaatcgcttgaacctgggaggcagaggttgcagtgagctgagattgtgccactgtactccagtctgggtgacacagcgagactctgtctcaaaaaaataaaatataaataaataatttaaaaattatttaataaataaatagaataagaaagctgtgtttgctgatatggaacaatctccaagatacagtgttaagttaaaaaaaaaaacaaaaacaggccaggcgcagtggctcacgcctgtaatcccaacactttcggaggccgaggcaggtggatcacgaggtcaggagatcgagaccatcctggctaacacggtgaaaccccgtctctactaaaaatacaaaaaattagccaggcgtggtggcgggcgcctgtagtcccagctactcgggagtgtgaggcaggagaatggcgtgaacccgggaggtggagcttgcagtgagccgagatcgcgccactgactccagcctggacgacagagcgagactccgtctcaaaaaaaaacaaaaacaaaaaaaagcaggggcagaactgtgtgtggtgggccaacacttgtgtccaggtttctagcatgtgagagtgtttgaaaactggagcctgtcctgtgacggagtcttgtgcagacatgaaaaacaagagatatcctagtgagctcccaaacagggacacccatgacagagtaaaagcagaaacaagtcacaggaaaaaatatgtagagcataaccccatttgtgcggcaaaaataaggtgtgtatgtcgatcactgcatgggagaggaagcgaaagagaaccactcagaatgaagagtcattttctgtgggaagctggacacatgtggaagggtttgaaggaggagttttactttcattctgtacattgtaaaattttttctaaagaacttgtgttttacttttgtatatttttatttatttatttattttgagatggagtcttgctctgtcgcccaggctggaatgcagtggcgcgatcttgtctcgctgcaacctctgcctcttgggttcaagccattctcctgcctcagcctcctgagtagctgggactacaggcgcctgccaccatgcccggctaatttttgtatttttagtagagatgggggtttcaccatgttggccaggctggtcttgaactcctgacctcaggtgatccaccagcctcggcctcccaaagtgctgggattacacgtgtgagccacagcgcctggccaacttttgtatattttaaaaataaaatatccagccacaatccctgagaatagctaggcagtggaaggatgatttctaccaccccatgccccaccccccagctggcagaagctttcaccccccgcccctcccccgccgtttccccgactcgctgacccctcctctgcccctgggccttttgcatcctggagctctcttccccttgccaactcctcctgcctcccaggcctcagccacgcctgcttcctttgggctgatgctgagcaccaacccagagtgtcggtgctgctcattgctccagtgaccccgtccagaccagcctccccgtccagccttcctcttgctcctgggcaggacctgccctgtgctttgaggccctggggcctgcacatatccagcatgtgggtgtgccctgtctgtgtgtaccaggtaagcgggcagatgagcccagcagacactgctgcagccggaggctgccggcagcccgcagtggcacagccgtgctgtgggagggcctttctgtgtctggggctgtgttttccacactccccctctggcttttactgttttgctccgggagtgtggctttctagagttttgtctgattttatagcagagtttctgttaactcaaaaagggactccacagtgaaggtttaaaggtggtcccagctgcagcaggaagcaggtgtggggtgcctgctgcccaggccctgttccccagcactgcttctgacccaggaggggctggggagaggaccactattcctcacctttcatacacccactcccatcctatttcgcaccccttcctccaggctgcctgcacctctgccctgctggcctttcgctctgtaattcctttctgaaagaaatgttttccatgaaacaacaacagcaagaagaaagcagatcagctgttggcaggagctgggaggagggatggggagggcagctgatggatatggggtttctgtcgcaggcgacgaaagtgctgtaaagttagatcacgatggtggtgacccgcctcagtaaatgtgctaaaaaccagtgaattatactctcaacaggagtgtaattgctgtcttcttagaacgtgtggccatggaaatgtgctctttttatgtgtttacctttgtatcagccgtcttctcaatgagaccagaatccctatcagagcaaggaccttgtttgtgtctcccttttcctctatgtcctaatatacaacagtgtgtttagcttgtagcagacactcaatttaacaacatctttttgaacgagtggatccataaatgcattaagtggctctgtgacttcagactcttcttcaggtttacggtatataaatatatcatttacggtaccttcatttatggtatataggtgatattttagccggggtgcagtggttcacacctgtaatctcagcaccttgggaggcagacgcaggtggatcacgaggtcaagagatcgagatcatcttggccaacgtggtgaaaccccgtctctcctaaaaatacaaaaattagtcaggcatggtggtgcgcgcctgtaatcccagctacatgggtgcctgaggcagcagaatcccttgaacctgggaggcggagctcgcagtgagctgagatcacaccactgtactccagcttgggtgacagagcaagactccatctcaaaaaaaaaattgttatctcagccaggcacagtggctcacacctgtaatctcagcactttgggaggctgaggcaagtggatcacatgaggtcaggagttcaagtccagcctgaccaacatggcgaaaccccgtctctactaaaaatacaaaaattaggccaggcgcggtggcgcacgcctgtaatcccagcacttggggaggctgaagtgggcggatcacgaggtcaggagatcgaaaccatggtgaaaccccgtctctactaagaatacaaaaaattagccgggcgtggtggcgggcgcctgtagtcccagctactcgggaggctgaggcaggagaatggcgtgaacccgggaggtggagcttacagtgagctgagatcgtgccactgcaatccagcctaggcgacagagtgggactccattatacacacacacacgcactatatatatatacacacacacacacacacacacacacacacacacacacacaaaaaaaaaaattagccgggtgtggtgggcgcctgtaatcccagccacgtgggaggctgaggcagaagaattgcctgaacctgggaggcagagtttgcagtgagccgtgatcatgccactgtactgcagcctgggtgacagagcaaaattctgtctcaaaaaacaaacaaaataaatgatatctcaataaagctgctaaaaaaaactcgcccaccaggtacccatcaggtatcttatccagcataagaacagctgggctgtgtgctgtctgcacctcatcccatgaatctttgcaggggttctacaagggtcctccttactaaaccccctgcacaggtgaggaaactgaggcccagagattatgcagcctgcccaggtaaagcagctggtgaacgtggacagcgtggcccccgtcataccttctcgccagctgacggtgctgtccagggagtctggaaagcagagatccaaaggaattggctgggctggaaggctccttacagaagagctcgcttgcccattcactcattcatttgttcagctgaacacccacctacgagtgtgtaccaggcagacccgctcctgtctccacgaaccacaatcacagaattgtgtaaacgaggtaaagccggaggcctgagattgtggggatggggattgaggtcaggactgtcttaccaaggagtgacatttggcctgggattgaaaagtcacgaaggaactgaacattaagaccctgtatgtaaggctgggtgtggtggctcccactgtaatcccagcactttgggaggccaaggtggaggaatgcttgaggccatgagttcggaatcagcctgggcaacatagtgagaccccatctctacaaaaataaacaaaattagccaggcgtagtgtcttcctgcccacttgggtggctgaagtggaaggactgcttgagcccaggagttcaagactgtggtgagcagtgattgtgccactgcactccagcctgggtgacaaagggagaccctgtctctaaaaaataagattataaaccagccaggcgtggtggctcacatctgtaatcccagcactttgggaggctgaggcggttggatcacctgagggttttgagaccagcctggccaacatgacaaaaccctgtctctactaaaagtagaaaaattagccgggcttggtggcacatacctgtagtcccagctacttgggaggctgaggaaggagaatttcttgaacctgtgagaaagaggttgcagtgagccgagatcatgccactgcactccagtgtggacagcagagccagactccatcacacacacacacacaatatatatatatgtgtgtgtctgtgtatacacactcacatactcacactctctgtagtgggctgaatggtgtccccaaaagctaggtctgcctggcaactcacttccaacttcttggaataagggtctctgcaaatggaattagttaaggatctgcagatgagattctcctggatcaggctgggccccaatccaacgaagagtgccctcgtgaggcagaagaggagagagacacgtgccggagaaggccacatgagggcagaggccgagaggcgggagtaaggccaccacgagcctgggaacgccgagggcgccagcagccgccagcagctggagagaggatggatgggaggattttctaaagccttccgataggggtgtgacttcttgattttggactccgggactgcaggaccgtgagaaaaggagtgagtgttaagtccacctagttagtggtcattcattaccgtagcccgggacacttacgtgaacttcagacctcaaatcctccccatcttgcagccccaggcgcagacctgggcagtggggcccccgtgtgcccatcccccagctggccaggctcagctgagagctcctcgacctcctgcctgtccctgccacccttaggagtccgagaaactggacctgcccgtggcctggacaccacttcctttattgcttagggtttctctctttctttctttaaaaattttttaaatgaaaaatggggctgagggaagactcggtctaaagataagagaggggtcacctggatctggaatgttctctggctttccaggctgctctgatcgcagacctcctgtctttaacaacccagcctgggtcaggtctgatgaaatgcactttccagggaatggggctggtttgggctctgcagaagcttccctcttccatcctggcaccggcagaaaagcccattaaaataattgcagggagagactgttacctaagtttcctccccttgagctgttggagctcttctttgacctttatggtttttaaaaccctgccaatccttgccttgtcccccggacgcattcatccagtgggttgggaagctggtgttcgctgtccgggctgggtcgtgccggctctccgtgtgtgcacgtgtgggtctgggctgggtgttgacctgctcctgggccagggcccaccagagccttagtccgggtggccaccatctgggaggcccggccgtgtcctctcttaccccagttctccaggcactggccaggggccccctcagcacacatgtcatagttggtccctccctgcccatggcccttcagaggcccccagctggtcttgggaggagggtgcctgtgtgggccagctttcagcacagcccccgccctctgctccagccttgggtgcaccccaaccccacccagctgaccagcctgttggggggcctgtggaccccgcctctaagcctgggtcttcctctgggcacccgttggggacagggcagccacacacccagcccagggtgtggtctccccacccagctgcctcccttgcaaaggcagggttgccttggcaatgacacctgaggaggagacgcttgccctgggtgcgctgtttccctgtcttcagtaagggaggaggctggcttcctctggcggagggaggcagcagctctcctttgccttggaacccgctttgctccagtgatccctgagccaccacattggtaagactggctggagctgaaggtccgagtgtggcttcaggactggtgacgatggccagggatgaagggctgcggcgtgtggaggggctgcgcccggaaggaagcggtgtggacccagaaggaagcggagccctggtgggcagcctggctgtgctctggcccaggaaccgggccttttcttgcctcttgcctctgactcagagcggcttgtgggagcctcgcatgcagggccaggcagggcaagaacgatcgcgaccttttcctccagggaaggttgcaagaaaggcgggatctgtaacgtgactaggtggaggcactacggagccatggtgcaggggtggggggccccaggtgagctcagatgccctccctgcctgtgccaccgtggcctgaccctccacaggtgggagccataggcgtcaggagccattaccccttggagaactgggtgccaggccgagacctggtgtctcatttatgacaaaccgctgcagtgcgtttgggagtctcctcctccatgacgtgcttgtctggattggttttattttagtgcaggcaccacgtcgtctttttatatacgtgtgaacgtatatatgtaaacacacgtatgatgttggtgagttcatgttggtggtatttttactaagcaaagatgtgggaaccaaatgggcccatccggggagtttcccatttggtccctcgtgctgtgtgtggtggggggcattgtggtcgaggtctgaacagccggggaagtgaaagaccccgtcctctccgggagcttacgggagtgggagagacattgacgaaatattacccatcgcaggagtcaggtgcacacagtgatgatagttccgggaggtcaggtgcgcgcggtgatgacagttccggaaggtcaggtgcacgcggtgatgacagttccgggaggtcaggtgcacgcggtgatgacagttccgggaggtcaggtgcgcgcggtgatgacagttccagaaggtcacgtgcgcgcggtcgtgacagttccagaaggtcaggtgcgcacggtgatgacagttccgggaggtcaggtgcgcgcggtcgtgacagttccgggaggtcaggtgcgcgcggtggtgacagttccgggaggtcaggtgcgcgcggtcgtgacagtgccgggaggtcaggtgcgcgcggtggtgacagtgccgggaggtcaggtgcgcgcggtggtgacagtgccgggaggtcaggtgcgcgcggtggtgacagtgccgggaggtcaggtgcgcgcggtcgtgacagtgccgggaggtcaggtgcgcctggtgatgacagttccgggaggtcaggtgcgcgcggtgatgacagtgccgggaggtcaggtgcgcgcggtcgtgacagtgccgggaggtcaggtgcgcgcggtggtgacagttccgggaggtcaggtgcatgcggtgattgttccggaaggtcaagtgcatgtggtcatagttccagaaggtgtccccggggcaggatatgttttcctattttccttggcttccggggagcttggagcctgctttcctttgggtcctgggctgattttcgggcaggtgctgggatgcagtgtcctgggtgctgcagcatggctgagcctcggattctctgtccagggctagctgtgttcaggccgcgcatctttagttttggggcatcgcaaatcctcctggaatctgatgaaagctgtggaccctctgcttgtggcggggggtcatgcagaaaactttgagtacagtttcaggagatgcacggaccacccaagggcctggaatcggagcccccacaagacagggggtgtgctctctgggccagcgtttggagcactctctggctcttggagccctggtggggcattcccagcagcttgcttcatttcctggacacgtgttcttggctgtggtttatattactctctgtatgtaaatgtcataggttttttttcttctagtaaaattgttcctagttagcacagtggaatcttgaaacaagaaagccatctttcatgaacagtgtgtggtttccaggcttagcccatggagttggagtgacaggtatggcagagatggggggtcaggctgcgtagaaggtgtttgcgccccctaggtgcaggtgttaatcctcaccaccagggcgatggtgctaggatgtggggcctttgggaggtgatggggctgaggactgagcctcatagtggggattagtgccctgatgaaagaggcctcagagagcaccctcgcttcttctaccatgtgagcacccagcaggaaggtgctgtccaggacccagaaagtgggtcctctgcagacaccaaatctgctggcaccttgatcttggacttccagcctccggaactgggggaaagcaatgtctgctattgatgagccgcccaagctgcggtgctttgttgcagccccaacaggctaagtcaggaaccgtgaacaggagacctcccagggagtctgctcggaggggggatttgtcgtgggggaattggtcattgtgcctcagtttccccattgttggggaagtggtgcccatggccactggcaggcccccccgggggccagcacaccaggtaggaagaaatgcaagccccaggctgctgagatgcacagagccccacattctgccttcgggacgtctgtctagtcccttgtcttacaaagggtgggcaggtcccctgcaggactcagcagagggagagacacagtcagggagcggccagaggggtgacgtgcccggctgcccacaggtacaatggctccttcgtgtcacacatgggtgtcggcgtcatctttcggctgggtgagggaactgcccagctgcccaagccctgggttcccaagtcagagttgctgggattactgggcagggaggtggtcccgcaacccacaccggggcagtggcaggaagcacagacacacacagcacagcgggccggcaccgccggggtgggttgtctgggcttggactctttctgtgcacatgctgatgtttgttgataataagaacagaaacattttctttttttttttttgagatggagtcttgctctgtcacccaggctggagtgcaatggcgtgatctccgctcactgcaacttccgcctcccaggttcaagcaattctccttcctcagcctcctgagtagctgggattacaggcacgtgccacaacacccggctaatttttgtaatttttagtagagacggagtttcaccatgttgtgcaggctggtcttgaactcctgacctcatgatctgcccgcctcagcctcccaaagtgctgggattacaggcgtgagccactgtgcccagcccctccccttttttttttccttgagacagagtcttgctctattacccaagctggagtgcagtgacgcgatctcagctcactgcaacctccacctcccagattcaagcaatcctcctgcctcagtgtcccgagtagctgggaccacagatgcgtgccatcacacccagctaattttgtatttttggcagagacaggcttttgccatgttgcccaggctggtcgtgaacgcctgagctcaagcgatcttcctgccttggcctcccaaagtgctgggattacaggcgtgagccaccatgccctgcccagaggtgttttcaagcatgtcctgtgcactgggcctggttggttgatgctcagtgatgtttattgaatgaatgaatgaatgaacgaacaagatccagaagtctgagggtaaacatggggtgccagcatcttgtcttagcccagcccgttgttggggggttggcagagtacctcaacccagacccctgtcacctgtgccccctgccccccctcacgctcctccctgtctcccccaggacctcccactctcgggcaaaggccgaggcagccctcacagcagctcagaaagcccaggaggaggcgcggatcgccaggatcactgccaaagagttctccccttccttccagcaccgggaaaacggtgagtctcgccgggcctgatactggcatcgtggggagggggtgcgtggatggctgggcagtcctggcagcagatgtgtcctccagagcgggtaggcttagatgggctcagccccagctgctcccctgcccggtgtcttcctctcccgccgaaggtgcttgtttgtgccaaggcctggcctggctccccgggacacaggacatgtgtcttggcaggtctctcccattcccacagtccttggggcaccgcgtgttgcttgccggctgtccctgacggtgaattcccacctgcccagcctgtgctgtctgctgcccgccctcccccagtgttgttctagaaccttctgggatgatggaactatctgctgggtccagcgtggcagccattagctgggtgtgtctgcggtcctggctcttgacctgcctctgatgtgaactaacttaccattaaacacacccagtggctgctgggttggacagcgtcacaaatggcagctcccgctgtgcccctcggaaagagctggaagctgctgcctgatttaggaacctcgtcctcccttcgagggggggatcatgggtgatacggcccagtgacagtggcgggggcgtggagggtgtggggtgggtggcggagaggccgtggccagctgcctcccatctcctacctcatcttggaggaagcttcctctgcaccaggaggccccagagaatggggttaggagcgcgccccctcaacccgagctctgaccggtgagcggtattcggatgaggctctgcgcgctggaggtccgcacctgacaccacagccctgaacttgctcgcaacgcctgccactctggccaccaggacaggatgaggagcccagcctgggggctgcggggctgggcgctcccctgactggaacgcgagaccacatcatctctagaggtgaccgtccgccaccactccaagaccttgccttcactgggcgagtgccgggccctgcagagcctgcagctgcagcctggaggtcaggaggacgagcccccgcacccccaccgccttgggcagcttctattccactgcgtcccctccactctcctggcccctccagacacacgcaccccaaagtgtccaagtgggagggcaatgggccacgtgcccctgtggccattggcatcctccatggtctcgccctcaggccctgagtttccttctccctggggcccctccttgcctcgcccacgaccagctgcctgggctgggaggcggtggggcgcacacttgggggcacacgtgtagcgtgcacgtgcatgtggggagtgggtgcagtgctgcgggatggacgaacggaacagggatgctggagaggaagccagtgccgtcgggggcacctgccagaaccctggctgggccactccacgcagaatgcacgtaggacggcatgggattccacgtaccaaccctggcccatggtcgcctcagctccagccctgcctgcgactcacattccactgcctgcggcctgttttgtttcctctcagagcctcagttccatgtgtgaaaggaaggggaccagacagggaacattgaagcctccatcctgtgccaaatcccccaagagacgcatccaccggaagctcccaacgtgacttatttgggaggagggtctgtgcaggtgtcattatggaacagactttgagacaagatcagcctggattggggtgagtcctagatccacgcggcgtccttagaagagacagaagaggaggagacaggggcggatggagtgatgtcagagatcactggagactccgtggctggagggtggctggagcggagaccctggaaggaagcagcactcccgacacctggatcacggcttctaacttccagaaacacgagtttgccttttgggtgtttctacccccacccccgcgtggtgctttactgctccagtcccaagaaatgggtgcaggctcccccaccctgagaattccagttaagactctggagtcggagatgcttcctggagggctcagtcctggagtcagaggagatgcttcctggagggctcagtcctggagtcagagatacttcctggagggctcagttctggattcagaggagatgcttcccagagggctcagtcctggagtcagagatgcttcctggagggctcagttctggattcagaggagatgcttcccagagggctcagtcctggagtcagagatgcttcctggagggctcaatcctggagtcagagatgtttcccggagggctcagtcctggagtcagagatgcttcctcgagggctcagtcctggagtcagagatgcttcctggagggctcagtcctggacttggagatacttcctggagggctcagtcctggattcagaggagatgcttcccagagggctcagtcctggagtcagagatgcttcctggagggctcagtcctggattcagaggagatgcttcctggagggctcaggtccctgcaggaggggccttgggctgaccttttaagtcctgaagctgcctcctccgacagttcttgtcttcatgatacagatgcgggcccctgtgggggccgctgtgatggagagacggggccgctgctgcctcactggtgggagtccagtcctcgagggtctggccaagttggcctcacctcctgctgctgcaccttggagcctggctcactctgagcacctcggtccgatctgccacctctttgggtggcgccccggagccttctctgagcagcatcttccctggagggggcgttgggaccgtgtgttttttacaagcgctgggactggcatgagatttgatccaagcatttcttgtttccgccttggatgcattcaggatcagtgttcccagaccaggcaccccggggccttctcggctgctggggaggggtggggctgggggaagctgtccaggtccttcctcagtcgtcctcacagccaggagctgaggtcaccaatgacagatgacagaacagagcctccaagaggggaacagggttgccagagcgctcaggcaggatgtggtggaatcaggatttaaaacgaggctctgaagcctgggccatgccggcttctagagaagcaaaccatccagcgcttcggctgcagagagtggctggcgccagcctcttgctgcctgtctgggaggtccctggcagcctcccagcccgagaactctgaccgtcagggttctgcccaaggccacgtgaaggcaggaccatgaaggagcctggccatgcggtgtccagtgcccaggccacttccggtgccatccgcccccgccccagaggcaggaggactgagcgtcggaggctgcaggacgcaggtggcttgaaggcacaggaagaagctgcaggggcttcacgaggacccgccctgcatcctcaccacgaggcttctaggaacgttacctgctcagcagctcattctagctgagggtgccctcctgctggtggtgctgggagtcggggcccctctagcgtggggtctcctgggccagccaggcctgatctcggcagcagtgggtggacgacctggtgggaaaggccggggcgccatcgggggatggggggggccttgatcccagcctgctaggtccatagcgtctaaggcacaggaatgccagccccttggaagtcccatcctggccaaggaggaggtacgatgtgggtgatccgtgggcatgattgggggcctctgatggggccagggctgccctccacacaggaccctcacggggagagaggtggtggggctgggcgtcaggtgggtacgtggatgtcagcacagttctacacagaccttctctggcccattccctgctctgctcgggggacacccaaccagcccagccctgtttctggggagtgaccacagagaagcagtcattgagacctcagagtggcccacccacacccccgtgtgacaggaactcagacttgggagggctggccacccacccagagctacccagctgtgccccaagccccaggccagggccatggcctcgctctgctcagcactgcctcttagaccagcaaggaggaggacacagcagcccagcctggtggcgtcgcagcgtgccccgaatctgcttgctaacgtctctttacaaacggagggactatctggtgccacaccgagggtagccatgtctcccagaccttctcctgccaaaaggtcagactggggtacaggcgtctcccagaccttctcctgccaaaaggtcagactggggtacaggccaggagaatgtccgagcgtgagagactctaagatgggcagtggctcttggtgtccgagctggtctcatgaggtggccgccccgggtagagctctgagacctccgtcctcagagggaagactccccaaattcccacagagctctgcaccattttggctcgggcaggacggggatgctgggggcgggggtcccactgttctgtgctgagcctaggacgctacttgagatgaacgtgtaactgttccccggagggtaagaagcgccgcgttcttgggtttctcctaatggaataaagtcgggcatggctcccgtgtccctgcgttggcaggaaatgagatcccagtcaatgttcttggttctcacctcctgctgggggctcacggagctccggagaagtctcggggctagtcctacaatgctgcccctccctatccaggcctccgggtgggggctgatggggactgagccaccggcagacgacagggactctgctggctgcagagctggcccctgggtcctgtggtgacctccccttccggggagccccgccctaggacttgaagccccagcagcctcgaaaggtggggagggaagtcggctcctgggctctcacgctggccccggcactggctgtttctcagcaagactgtcccagcaccctgagacacagtcccaggcgggtaggggtgttggcggccttgctgtgacagctcggcctccccagacaggtggtcagctagggtgaggggcttcctcttaccctcaggacaggcgagtcagggttggtgggacctgagtccacaccccagcgtcctcacgcactttccgagccttgggtctcccttgtagcctgggagctgctgtccgcccttcctgtggtgcctgggcctagccagtctccctccaagtgtctgtggggtggggaccacgggggtcccacagagggctttgggagccacggtccccactcccctcccttgcctgcagcctttcggtgagtgggaagcgcctctgctgccctgaggttccctctggcgccctggcccggggaccgcggcctcgctgtggaatgtgctgggtaacgccgtctggcgtcgtcttgtgtccccatacagggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacggtgagtgggcggccaccaggctggtcccagtggaggcaacatccacctctctgctgacctggtgtttcctgagggtttccagcaaggtcactgctcccctgttcctctccaggggtggagtagggtgggggtacagccgggagtggtggccctcaggtcgctgggaccctcccctaggaagccaggtggggcaggtgtcatacctctttccgtgagaggctgcccccaggttgtccagaaagcacacgaaactcctggtttccaggcagcatgggatccctgcgctccccgcaacgtgctcaaccccagctgctccaagagtctgtgcccctggtcagtagccttgggccgtgagatgaccgcttgagtgtcctgtgtcctggataggaacccagaggcgaaacagctgggggcaaggctggccctggggctgggagtcaggtctggggttggggggagctgccagtccaggtttctctcacccatggggggtgttggggttggagccggctcccacgtgaggcccgctgtgtgcaactcaccgtcagcctcacccagcaccccccccccaaattcgttcctccagggcaggcagcttggagggaagaacagcgtccccctgggctagactcggcgcgaggctgggggtcccaggctagactcggtgtgcgaggctgggggtcctggtgcctcacacagggctggcctccccttgaagggaccttcactctgcaaatcccaccctgctcccttgaccagtgctgcaggaatgaagggctttgggaatgaagggctgtgggacggtggctacataggatctgcgcacggccaggccctcaccccagcagggctctgctcgctcgtggctgccaggcagtgcgtggtgctgaacagaagtgctgcaagccagtctgcccctcgggtgtgaggacgcaggggggtgtccgcagggggcgctcagggcgtgtgggccgggcaggggggaccattggtaggtttattgtcgacgctgcggcaggggtcggtgtctgtccctgcccctgacctaggggagctgtggttttctcctcctgccagccccacccccagaggggtcaccgcgtgacacccctttgaaggggcacgtcctgccgggcggcaatgcctgtttctgcctctccttggaaccactgcggacgtctgtctgtcctgttgggttcctaagatgcctccccgttccccaaagcccacagagaacagcccctatgctcctgctgggaccaaaataccagctcacacttacaacttgattttccccatcgcagccggagatgtgtgcgtggctgtgcgcgcgcggttattttaggaacagccaagcagtgggcagggtgggaggtgtagggacgggttctatttttagcctgcttaatgcactgacacttttgggtgcttttaaatgaacctccctgggggtcaatgcacaagctggggacaagtgccaagctggcctctgggatgagttagcgacacgcagggtgctacatgctgccctggtcctgcccggtctccagctggggctaatctggaggtcccgtcagctgcagcatcatgtcccacccaccctggaggatgccagctgagctccttggaagtggccaccctggggtacctggtgctggtgcaaacaaggtttccctccctgtctccctccccgtctccctccccacagctttggagctgtgttttctgccaggtctgtgaggggagatggtgtgtagaggcgcggtcaatcctaagcactgttccaggccctgttggtgggaagcaggaggggcccgtgccagccggcatccatgtcaggggacaggtgtcagggcagtcgggtgccaggctgggctgagtgccttcagtgccaccccctcacaggggtacagctctctgcagtgtctcccctgggccaccagcagggtctggggtgctgtcttctggccatccccctccaccattcccaacatgctgcagagctcacacgccagaggccctgggtcccactggccacagatgggcctgggattctagcccacatagggtcccactggccacagatgggcctgggattctggcccgtgtagggccctggcaattcagggtaaagtcccttaggatggaagcacaggttctccctaccgctctactggtgaaggaactctggccctggctgtttccctcttggtgaaatgatggatatgacctgatggtggggtccagggttggaggatggctggggagacagaagcttccctcctgcgggcagccacgccctcgcccacagcgtccgtacctgcttcccggcccagagcacgggctggactgtggcagaagaggtgccactgaccaccccactctgtcctgctaccccactacaggctgactagcatccggcccttcctcctcgctggggtgggggaactttgcaccaggggtggcatcagtgggcagggctgggcccttggctgttctctgccccctgcaggctggcccggcccaaccaagttgtcatggggcccaagactcacaatacacctgcctgaggccacgatgccacggaaagctgggctcagggcagcttgctttctctctggctgagtggaggcccttgctgtgtccacaactccacttccatctgcgcctcaggtccctgataggctgggaggttgcggagggtgtgggcctggtgctgctgtggctgcaggtgccccctaggcagcacctcaccctctgaggaccctcctctctgagctgcatcccaaggacagtttacaaagccctttgctgactggggttcagcttatctgttgagcaaactttttctttaaaaagtttcttggccaggcacggtggctcacacctataatcccagcactttgagaggccgaggcaggtggatcacctgaggttatcagttcgagaccagcctggccaccagggtgaaatcctgtctccacttaaaaatacaaaaattagccgggcatggtggcacacgcctgtaattccagctactcaggaggctgaggcacaagaatttccagaacccgcaggaggcagaggctgctgtgaactgagatcatgccactgcactccagcctgggcaacagagcgagactccatctcaaaagtttctcaagccagtgtctctagggcctgagggctccaatccccagtgtgaggtgaggcgctcgggcctgggagctgatgcccagcatacagtcgggggtgcccctgccaggtgtggtgcagagcacggcgggggtgtgtgagacctgaggatagcgtctggatgtttctctcacgttaacgggaatgagataggctcattggctgctcatccccaaatccaaatggaaaaccgccattcgggccaggcagaggcaagtactcccacccgttgccgctgccgtgttgagcccaccgtgccgagtggtgttggcaggagcctcccgaggaagctgtgccaacgcaggagtggtcagagcctgtccaggccacagacggggctacgatgagcactgctgcccagggcatgttgggggcagctcctggagaccacagggaggggaggtgggcacccaggtgtgggcagaactggaccaggaggaggaggggcagcagcttgctcaaggcacagggcctcagccacagggtggcgggctgggaaggggcgagggtgtggtgggttctgagtgccccatgcaacggctgttttgggccacgtgctcaagcaggcacccagggaagaccagcctaggtgctggcgtgaggcccttcaacatcagctacgatgctgcttcatcaggagcacagcctggggaaagaatgaaactgacccaggagacaaaagggtccccgggccagacggtcaagcaggaggctgcttcgctgccgcgggatgtggcatccaggctaggcaaggggacggcaggctgccatccccagagggagttctccgggcaaggccgtgaccccactggggctctgagtttgcatccttcctgtgtgtcaagagcagagccggccactgccagcccatagctcccatggtgcggccctggagagctgacttcatgcgggatgtctgctgttctttgcgtagctttactgagacagaaagcgtgtactgttcacttcaggtggccacagtgtacaagtcagggattttagtgtattcccagttatacagccatcacccccaattctatctagatcagctccatcaccttaaacctcagggccattgagcaggcacttgctgtcccctcctcccccagctcccggactctgctttctgcctggtgcccagcttctcacgcagcatgcactgctcctgcgctttctctgtggcagccgcggttgcacggcccatgtcttccccgctgtgtgttcatcctccactggacagctggctctgcttccactccgtggctgttgtgaatcctgctgccgggagtgtgtgcacacacaaggttttgagtggaggcttgactttgccctcttagatttaggcctgggagtggaactgctgggtccccggtgttctcatcaattctcttccagtctctgggagaggagccagcagcagctgcttcgttgtgggtggggggaagggggaggcccgttgttcgggctcccctccttaatgcaggcctgagcagccctcacctggtgccacatgagctactcagtcttaacagaccaccccatcatgtctttgaaatttgaccagaggccagacttgggggcttaaaggagtccatggaaaaccagtctgttaacagggagggggaggagagtagccatccctgaggaatgtgcatcctgggaccttcaggacaagccctggtccatctgtgtcgcacagcagcaggatgtctgcgtggtaggaagtggagggctccgggggctctgaacagctccttaccacagtggggtctacatctccttccaggtggctgcgagatgcagggcgtggtgggggtggggagaggcaggggcaagtgtcctctggaagcagactgtgggcaagactggagtgggtgtcccagccattcctgggctggggccaccgtccaggaggcgtccattccctgtgcagcaggtactgtatctgtagggcagcacccacccctgccgtcctgggagcttcccagaggggccacgctccctctccccctgcctggtgtgagcagaacacagcagagtgcaggactgcaagaatcactgcagaagggcgcccccggaaaaggctctgttgtgagacgtgtcctacctggccccggcaagcacagggaaggtggcagcttggtccgagtgcccaggctgtgcggctgaagggggagtctggcacttggggctccggcggaggctgaggacttgtgagccacttcagggaggtggtggcagcagcattcaggaccataacctaaatccaaggcagctcgcaattggacacagtcctccagagccagttggcgtgaggggtttgttgaggaaggtgtggtgagggggggttttgttgaggacactgtgctcacggactttgggagtcctctgagttccagggcctctctgctgggctgcatctgacactggccatggcagccatgcgggcccttctgagattctgaggtcccagttccacagggcaggagaagcctgctgactggcacaaaggccacacgcaccgagacgtttgcttgcagggaggcctgggtggttctctccaaggggaccctgggagagctggtactcagggtgtcggggccacaagggaattccaagggaattccaggaccagcaacctcagacgtacaggcagctggggcttctctcccgcgtctggacttcacggagctcaggttctggtgggcctttggtgtccaagcgtttctaacatcctcccgtacgcttccacccccgagggtctgctagcttggtgaaaagacgtgggtgggaggcgtggtggcccaggcagagccccccgcagctgtcgctcacctcttcccctcgctctcttccagggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattgggtatcactcacagtttgcctttttttctgggtaatgttttttggattttagccaaaattctttgcttgtataacactctgctgtgtggcatggcagaaggaggccagcacgcagcccctccagctccacgtggagacagaagggatcccggcacatcagtggtaacagcggacgttgtcctcgtggtcacacgtcccgtcttgggtgtggatggagggcagcccggggcagagcctcagccccgcggcccctgagtggcagggctgactcccgtcgacacgagcttagaaagtggattcactgctttctctgtctagaacagacgggtgacaagtatgggcaggaggcatggggcagggtggcccaccccagtgggcagtagcctggcctttttctgtgtgagatctgtgctgcacacctgagggagggggagggatcggccacctcctccctgtgagacggatgcaggtccttccctcttctcggcactgcccccggccttccatgagaagccgactccccacaccgagttttaaagcaaagcccttttcttctgctgcccactcactgtgggtcccattcggctgtttcccccaccagaccccagggaagccggggcccactccgatccgcctgggctcagctaagcacggaagccaagggggctgtgccgtggagctgggctcgcgccggggctctgggtgtgtgcgcttggcgtgcagggtggacgcgtggggttccgtgtccccagcagtgagggccctagaggacgccttctcccatggttactgatctccacgggttttcacatctctgtactgtgcctgcctcaacttcccctaacagatatgcatattccttccagatgcctcagtgctacaccacagtgggcctggtcccaggacaggaatgcggttcaaacccagtggcttgaaacttcctgagaaactgtagcatatccagccccctaaaatgtacaatgtaacttgttcagtccaacaaaaacaggttccttatgtttctgccttctccaccagggtcgctccatcacccaaacaaaagaacaaggtttgccaggatgtccgagtgccccctggccctggctctcgtgtgcatggacgtgcctgaggggtccgggcacggccatacgcaggacccctgtgcccggggaggcgctgcagggattccccatccggtcgtcttggggccagcccgtcttatggactctgccttgctttgcttatgtttagctgtttctctgctacctttcgagcagacttctttactacactgcactggattgctatatttttaaccagaaataaactaaagattagagcatgttccagttaa

SEQ ID NO: 2688 - DNA, 58182 bp, Homo sapiens; identical to SEQ ID NO: 1823

SEQ ID NO: 2689 - DNA, 58182 bp, Homo sapiens; identical to SEQ ID NO: 1823

SEQ ID NO: 2690 - DNA, 58182 bp, Homo sapiens; identical to SEQ ID NO: 1823

SEQ ID NO: 2691 - DNA, 55724 bp, Homo sapiens
tttggcatttttaatttaggtttgttttatttaagtttaatgttaattccatgctgtgtttcagtaagaacaatacagattctgtatctgtggctccagtcagatatccagtagtacaaattagcttcaagttacacatactgaacaaaagaggttgagcgagcgaaggaggggaggagtgaggggaaggaggtagggggagggggaaggagaagaaacaaaagaattgaacaggcatgcaggcttttccataccaccttcaacgctaacctgcttcagtgggagagtaaagtaggcaagaatgagcagccacggattgttgaactgttaccagcaccatgcttttcagcaacatttcagcggagttggaaacattttttacagcaaaaccattacaacgaagtccctccccaaaccacctttaaccatctcaagctaacacccaattacttgcaaacactggtataaaacacagtttaaacaattagaaaaatgaaaactgataccacttatgcctctatagtgtgattaacctctctcttagatgcttgcatcacctataagtctaatggctttcaaatgtaatttccatttgctaatggtgatcttgccacatctggcacggagacgacacagtaatgctgaaaaagcctctatgtagtcctgttagtgtcttaaagaacctaaaagctgggaccagtaaaatccacagaaattcactcttgcctttaagaacttttgaaaactgtttaaaaaaaaaaaaaaaaaaccaacagggcaggaacctaaattctgagaccaaatgtaaaagtcagatttggtggttctcagtgacaatggggagtttccaaagggtgggatggggaggagggggtggtcagagatggtttctcttgttggcttatgtctcactgattttcgtcttccacgtcctgcagcgcttctttattctgctcttcacctgttaaaaaagaaaaaaagtcaattatttcgtattgactacattaggctatggcagccacaaacaaaggtgtcattccaagcataaagactcttctacttgctacaattggtattaaacgcaggcaaaggacttctatcatccttgacacctgagatgcctaagccaagaagggattatggtcctgaaagtatttattggtcaacagaatgaaaaaaactgatgcgcagtacaactcaatgtttttacgctaaataagctcttgacgtagacagccaaggaaaccatcttactaaaatgacattcaagctttcacataaatcttgggtcaaaatactctttctcaataacctcacctcttcaagaatcaagagtattttgcaaactttttgcaaaatctaatttacccacaagctaattatcagaaatgcttcaaaatagttaactgagcaataaactgttgccaagaagttctatcgtattttattgtggggttctgctgttataaatatttcagcttttgtatcttggccagatacaccaaactataatcagattttacttcagagtgaaacacagcatgctcaaagtaaatcagaccactgaggttattaaagaatggcatttggaccacttcactcatgctatttgtcttttgcctttaaagagggtgattaccctaaggagtttcaactgcactatgacatgcaacagaaagccacctattggttggagggtcatctacctattagtatgcattaaacaagtcagccaaaataaagaagcatgcaggcttttcccttaaaaatgatgtaacaggtaaaagttacattcacttgtacttttttaaaaaaaccacttacaattactacacagttaactagtttgaaacaaaataaatgaaaaatcaacccaagaatcataaatgttcaaatgactatccattcataatgcttgttaaattatttaattaggatggacaaataacaccaaactagctgcctacacacatgaagcatttacactgagtacagctttgaaacagcctaaatgatctcaaaatgacaaatgtcacagcatcaaggtttcagtagttttcaaatctcttctgcggcggaaacgcttgacattgctgtgtgacttcaaaacccacttacagcctcagcaacacagtgaagccctgtctctacaaaaaatgaacataacgccgggcacggtggctcacgcctgtaatcccagcactttgggaagcaaaggcgggcggatcacgaggtcagaagatcaagaccatcctggctaacacagtaaatccccatctctactgaaaaaataatacaaaaaattagcctggcgtggtggcacatgcctgtaatcccagctacctgggaagctgaggcatgagaattgcttgaacccaggagacggaggttgcagcgagccaagaacatgccactacactccagcctgggtaacagagtgagactccgtctcaaaaaaaaaaaaaaaagaataaataaaactaaaagtaaaaaactatgtatgctggagccaggcatggtggctcacgcctgtaataccagcactttgggaggccaagagaggtggatcatgaggtcaggagatcgagaccatcctggctaacacagtgaaaccctgtctctactaaaaatacaaaaaaaaaaaaaaaaaattagccaggcatggtggcaggcgcctgtagtcccagctactcgggaggcaggagaatggcgtgaacccaggaggcggagctttcagtgagccaagattctgccgctgcactccagcctgggcgacaatcgagactccgtctcaaaaaaaaaaaaaactacatacgctgggcatggggccacatgtctatagtcccagctacttggggggctgaggtgggggagttctatttctgcagtgagctttgaacgccactgcactccaggcggggcaacaagagcaaaactccgtctcaaaaaaatgtataaaattttaaaactacttaaaatacatgaagatctttaattcataagacagaaaaaaaatatgcaaaggcaaaaaaaaattgcttagggatgaaagaactgatgggcacccaactgttctccaaaggacaataacgtattcaaacgtaggaaacatgataggaacattcactctaacagcaaatcactgccaaagtatcattaacacaaacactagaacacaactcgcttgtaagcaaccatgagatgtgccagaagttccaagtaactttggcataaaaatgtcactgtcatatacatcacatccaaccacagtaggcaggaggagcaggccggaaaaggcttaggtcagcgccctggaaggtggaacaggcagagtctgtaagcaacaggacgatcatacgcaggcatgattagtgaagaaccaaaactgaaagcggaattcactgtgccatgaacgtgacttacaaagtagagtttttaggaaaggaagagttgggttttcctttaggaatctatattgcaaggaaaaagggagggagaacaatcatatgaaagcaacattacaagaaaaataaaccaacagagcaggacaaaggaaaacaatgatacaggagccggactttggtcttacttcgtgtaaacttcactctaagcaacaatctgtctactcctcctcccttctactctgagaaggaagtaatatcctcttgaaagacatacagatattaggggaaaaaggattccttggctatgtttctttgcccagtgtatctacattttggagagaggggaacaggcagggagaacatgtatttcctacctatggattcgtatatgaaacaatcctcttaccacagggtgaagagactaaaatcacttgagaaaaagcaatgatccctccctttaaagaaattatgttccaacatgctgggacagacattaacatattctaaaattaaaagacataaataccgtctctttaaaaaacaaaaaaatctaaataatccttaaactaaatgcaaagtcacatcctagtaaactgccactttcatgacgattctcctatattcaccacggaacccaagtcacaaaagtagtattttattttgtgagatgaagttttatcttgcccaagctggtgtcaaactcctgggctcaagtgatccttctgcctcaccttgctgaacagccgagattacaggcaggcaccattgcagtttcaaaaccaatttattaaaaaatgtaggccgggaacagtggctcacgcctgtaatcccagcattttgggaggccgaggcaggcggatcacgaggttaggagattgagaccatccgggttaacacggggaaaccccgcctctactaaaaatacaaaaaaaaattagccgggcatggtggcgggcacctgtagtcccagctaccaggaaggctgagacaggagaatggcgtgaacccgggaggcggagtttgcagtgagccaagatagcaccactgcactccagcctgggtgacaaagcaagactctgtctcacgaaaaaaggaaaaaaaaaaaagatgtaatactaggccaggtgcggtgactcgggcctgtaatcccagcactttgggaggctgaggcaggtggatcacgaggttaggagattgagaccatccgggctaacacggggaaaccctgtctctactgaaaatacgaattattgccaggcgtggtggtgggcacctgtagtcccagcaactcagagaggacgaggcagaagaatcgcttgaacccgggaggtggaagctgcagtgagcagagattgcgccactatactccaccctgggcaacagagtgatactccatctcaaaaactctaatttttgacaaattcaacttctcaaactgatgaacaatttctttgtacccacaattatttgtgtattcagagtttgttagttgtaccggaatgtcaacagaccacctgaatttttcactgttgaactatttcatgactggaagcattatataaataaaaagtatttcacctaataaaaattaagtgaaaattactcttcttaaccaaatttaatcaactgatttacagactcaataaggaattgaacacaaatgaatttcactagattttttttttttttgagacggagtcttgctctgtcgcccaggctggagtgcagtggtgctatctcggctcactgcaagctccgcctctgggttcaccccattctcctgcctcagcctcccaagtaaatgggactacaggcgcccaccaccacgcccgggtaattttttttgtatttttagtagagacggggtttcactgtgttagccaggatggtctcaatcttctgacctcgtgatccgcccgcctcagcctcccaaagtgctgggattaaccggcgtgagccactgcgcccagccgaatttcactagatttttaaaaactgcgaaagtattaccctgtattttttttttttggacgaagtttctctcttgttgcccaggctggagtgcaacggcgcgatctcagttgatcacaacctccaactcccaggttcaagcgattctcctgcctcagcctccccagtagctaggattacagacatgtgacacgacgcctggctaattttgtatttttagtagagatggggtttctccatgttggtcaggctggtctcgaactcctgacctcaggtgatccacccgcttcggcctcccaaagtgctgggattataggcgtgagccactgcaccaggccgtattaccctattttaagatgatccatttcctaaaactgtactcgacaaccaagaataaggattatctttagttctgtacatagactgacaggtagtctactttgattaatcaactcttggttatcagtgataatgagctacagaagtaatccagacttggttatgagttggtatcaaatgtgttttcttgttttgtttcgtttctttgagacagagttttgctcttgttgcccaggctggagtgcaatggagtgatcttggctcactgcacctctgcctcccgggttcaagtgattctcctgtctcagcctcctgagtagcagggattacaggtgcccgccaccacacctggctaatttttgtatttgtagtagagacggggtttctccatgttggtcaggctggtctcaaactcctgacctcaggtgatccgtccacttcggcctcccaaactgctgggattacaggcatgagccactgtgcccagcatatgtttttattaaaataataataataaaaaaaaatggccaggcgcagtggctcacgcctgtaatccaagcattttgggaggccgaggcaggtggaccacgaggtcaggagttagagaccagcctggccaacatggtgaaaccctgcctctactaaacaaacaaaaaactagctgggtatggtggcgcacgcctgtaatcccagctactcaggaggctgaggcaggagaatcctttgaacccaggaggcagaggttgcagtgagccgagatcgcaccattgcattccaatctgggcaacagggagagactccgtctcacaaaacaaaacaaaaaatcagccaggcgcggtggctcacacctgtaatcccagcgctttgggaggccgagatgggcagatcacaaggtcaggagttggagaccagcctggccaacatagtggaaccccgtctctattaaaaatacaaaaaattagctaggagtggtggtggcagacacctgtagtcccagctactagggaggataaggcaggagaatcagaggcaggagaatcacttgaacccaggagatgtaggttgcagtcagctgagagagcaccactgcactccagcctgggtaacaagagcaaaactccatctcaaaaaaaaaaaataaaacacacacacagaaaaaactttcaagtcaggtcactttcattacttattacttttactctcaaaaacatgtccccagaggtgagaggtgtatcatttcctgaagtcaatcccgcgccccaaactctccgcatgctttccctccatcaacaggcagagagatactagcatctgagctggggatgaccattacgagtccacagctgtttgaccattcttcttcataattgttgttacaactttttttcttccctgaagagatggcatctcgttcagtcatccaggttagaatacagtggcgcaatcgaagctcactgcagcctcaagatcccccaacctcagccgtctgagaagcatgcgttgtcacacctggctgttgtttttgttttttgttttgagacaaagtcctgctctatgaagcctcgctctgccacccaggctagagtgcagtggggcgtgatctcagctcactgcaacctccacctcctgggttcaagcaattctcctgcctcagccttgcaagtagctgagattacaggcacataccactgcacccggcattttttttttttttaaagacagggtcttactatgttgcccaggctggtcttgaactcctaggctcaagcatcttcccaccttggcctcccaaagtgctgggattacaggcacaagccactgcaaccggcataggacagattttccagctggaagccacttgttcacagttggtaaattatttctgagtcccaagggctgggagtagctgcctgaaatgctgcgctgggaagtgttctgtggctccatctggcactgttgcaagtgtgtaagtaagtcctacgtatgtgaatatctcatgccaatcctgatctagtcaaatcctaaacatatcataaagctagtaaatgttaaaagctgagtcacctaattctcactttagtaccataacccaaaagtcacaaatctgatttgatccttccagagaaaagacacatacgtgcccactttcagaagcattttcaaaaagtataacacttccaaagacaatacagcaggtccgtttccccaaaagaaactacagatagcctcaagcaacgcgacatatgttttatgtttcagcctaagaaacgttatctcttttttttttttttagatggagtcttcctctgtagcccaggttggagtgcaatggcgtatctctcagctcactgcaacctccgcctcctgggtttaagcaattctccggcctcagcctcctgagtagctgggactacaggagcccgccaccacgcccagccaattttttgtatacttagtagggacggggtttccccgtgttagccaggatggtctcgatctcctgaccgcgtgatccacccgccatggcgtcccaaagtgctgggattataggcatgagccaccgcgcccggcacagccttagaaacattcttaaaggaaccgcagctaaaactgacatcagactttgtttacaacctcctaccagcaccaccaccaccaaatgtaaaactatcctgtaatactcctatcacactaatttgtcctcttctccatccctgttcaacaatctaccatggatcaaaatgattctctagacagagaataaaatttcctttaaaatcaacaaacataacaaatttgggctcctgtatttaaagtaaacattaacacacactcaacatcacaattaagtttactaaaatactctgaagcgtttgcaatgaaaacctcttaagaataaaaacaggccgggcacggtggcttgcgcctgtaatcccagcactttgggaggccgaggcgggtggatcacaaggttaggagatcgaggccaacctggctaacacagtgaaactccatctttactaaaaatacaaaaaactagccaggcgtggtggcaggcacctgtagtcccagctactcgggagactgaggtgggagaatggtgtaaacccaggagacggagcttgcagtgagccaagatcgcgccactgcactccagcccggtcaacagagcgagactccatctcaaaaaaaaaaaaagaaaagaaaagaaaagaaaagaataaaaacagcagggcgcagtggctaacgcctgtaatccctgcactttgggaggctgaggcgggcagaacacctgaggtcaggagttcaagaccagcctgaccaacatggagaaatcccgtctctactaaaaatacaaaaactaggtagtcgtgataacgggtgcctgcaaccccagctaccctgggaagctgaggcaggagaatcgcttgaacccgggaggcagagtttgcagtaagccgagattgagccaccgcactccagcctgggtgtcgcagcaagactccgtctcaaaaaaaaaaaaaagagacccaagggccaacattcaatttctctacagaatcccagagggaaatgggaaaccagttcccttttagataaaatatttcaacaaagagaaaaacttcataaatacctactgataccatctggatttaaatacacttaacttcagccccctaaaattgaattgaatgaagataaaataaactgcttgctctccactcctcctgtcctcaacctttgaaacagtgtaaaggaagagctaaactaagttcccaaaatggaactccgtactgtagcaccatttcctataaaggcagcaattacaatttcatagagggcaggcggtgaatctaaattctagcttgatataacgacaagccaaggaatgtctaaagagagtacaaacaaatcctgcaactgaaagaggtgcctgtttcactccgtgcttgcttaccgtcaccctgcatgtctgaagtccatagtgtcagattatcacgtaacaactgcatgataagtgtagagtccttatagctttcttcactcagcgtatccagttctgcaattgcatcatcaaaagctgcttttgccaacctaaaggtatttcaatagaagtgttataaaaattaagtccaaaatcagaattagaaatgacatgctagacagcaatcttttcttcagttattccagtttgtaatagtcacaatgataatgcaaagaaaaagcaaatacaataaaaattaacttaaaggtatgtggaacactacttcttactatgctttaagcctgctactgatatgctataatatacatatcgactaataaaatacatagaacaacttccatcctaaaccatcaccaaaaaatatacctccaagttctaggcaatagttcacttatttcaaaaagttttgtttgtttgtttttaagacggagtctggctctgtcgcccaggctggagtgcagtggcgtgatctcggctcactgcaagcttcgcctctcaggttcatgccattctcctgcctcagcctcccgaatggctgggactacaggcgcccgccaccacacccggctaattttttgtatttttagtagagatggggtttcaccgtgttagccaggatggtctcgatctcctgacctcgtgatccaccagcctcagcatcccaaagtgctgggattacaggcgtgagccaccgcgcccagcctagtttttttttttttttttttttttttttttttttaagggattcgttatgttgcccaggctggacttgaactcctgcgttcaagcaatcttccgaaccttagcctcttgagtggctgggacaaacggtacacactaccacccccaagattttttaaaaaaaaaaaaaaaaaaaaaaaaaaaaaaaattttttttttttttttttttttttgggggacggggtctcgctctatcacccaggctggagtgcagtggcgggatgtaggctaaatgcaagctccgcctcctgggttcacaccattatcctgcctcagcctcccgagtagccgggactacaggcgcccgccaccacacccggctgatttgtttttatatttttagcagaggcagggtttcaccgtgttagccaggatggtcttgatcttctgacctcgtgatgtgcccgcctcagcctcccaaagtgctggattacaaggttgagatatttaacaaagtattaatgcaaaaagaaaatcttggacaatacctcaaagtttaaaaaaatttaatttcacgttaatggaggcagggaagcaaagaaaataaaaggcaacacagacgccatggaaatgtgattatgtaagccatttacagttttaaaagaaaatccacacttactgagtactgtgtactatgtccaacaaacgatacgatataccaatagaaaaaaaagagacataatctaagtccacatcaacttaaaaatttagaaatggagggtagacaaatacataactattttacaaggaggaggctggctgtggtggctcatgcctgtaatcagcacactttgggtggctgatgcgtgcgcgcagatcacttgaggccaggagttcaagaccagccgggccaccatggcaaaacctattaaaaacacaaaaaattaggccgggtgcagtggctcaagcctgtaatcccagcactttgggaggcagaagcgggcggatcacgtggttaggagatcgagaccatcctggctaacacagtgaaaccccgtctctactaaaaatacaaaaaaattagccgggagcagtggcaggtgcctgtagtcccagctacttgggaggatgaggcaggagaatggtgtgaacccaggaggcggagcctgcagtgagccgagatcacgccactgcagtccagcctgggcaacagagcaagactccgtctaaaaacacacacacacacacacacacacacacacacacacacacacacaaaattagccgggcatggtggcgtatgcctgtaatcccagctactcaggaggctgaggcagaagaatcccttgaacctgggaggcggaggttgcagtgaggtgaaactgtgccaatgcactccagcctgggcaagagagcacaaaaacaaaagaagaagaagaatgaagtgctattccaaataaagtatttcagggacccagaaggaggagcaattaaagggaaagtcaaatttgaactaatctcaatggataaggagaaaacaaaacacacttcaggtttaagcagaagcatgagcaaaggcatgcgagtgactttaaactggagctacacgtgggacagctagactggagtctgacaaggaaaggtgcaaccaccagtattagctaaatagccacagcttcttcagttacgatccctatctggacaaactcaactagccatttagaatgtttttacattggctgggcgcagtggctcacgcctgtaatcccagcactctgggaggctgaggcaggtggatcacctgaggtcaggagttcgagaccagcctgaccaagatggtgaaaacctgtctctactaaaaatgcaaaaaaaaaaaaaaattcagtcaagcgcagtgaagcatgcctataatagtcaacattaaagttccaatgtatcagttaatcccctttcctcaaactttgaaaggctttcacttaaaaaccctactttgcttaagcagttgtcctcaaacaaaccaaaaaaaaacacatacaaaaaccaaaaggggccgggcgcggtggctcacgcctgtaatcccagcactttgggaggccgaggagggcagatcacgaggtcaggagatcgagaccatcctggctaacacagggaaaccccatctctattaaaaatacaaaaaataggccgggcgcggtggctcacacctgtaatcccagcactttgggaggccgaggcgggtggatcacgaggtcaggagatcgagaccatcctggctaacacggtgaaaccccatctctactaaaaataccaaaaattagccgggcgtggtggcgggcgcctgtagtcccagctactcgggaggctgaggcaggagaatggcgtgaacccgggaggcagagcttgcagtgagccgagatcgcgctactgcactccagcctgggggacatagcgagactccgtctcaaaaaaaaaaaaaaaaaaatacaaaaaattaaccgggcgtggtggcgggtgcctgtagtaccagctacttgggaggctgaggcgagagaatcgcctgaacccaggaggctgagctttcagtgagctgagatcacgccactgtactccagccacagcagcagagtgagactccgtcaaaataaaaaaaaaaagcaaaaaaaccattttgctactgcaatatttactgtaaaaatttaaaataggctgggtgcagtggctcacgcctgtaatctcggcactttgggaggccgaggtggctggatcacttaaggtgaggtgtccaagaccagcctggccaacactgtgaaaacccatctctacataaaaatacaaaaattagctgggtatggtggcgggcgtctgtaatcccagctacctgggaggctgaagcaggagaatcgcttgaaaccgggaggcagaggttgcagtgagctgagattgcaccactgcactccagcctgggaaacacagcgagactctcctctcgggggaaaaaaaaaaagaaaaagacaatagcaaaaaacaacaacaacaacaaaatgccaacctacagaagaggagaaaatactcacaaaccatttacttgctaagaggttactatctggaataatgaactctcaacacttaacaaacgaaaaaaacatgaattcaaaaatgggcaaaagggcctggtgcagtggctcaggcctgtattctcagcattttgggaggctaaggcaagaggattacttgaggccaggatttcaagaccagcttcggcaacacagccagaccctgcctctacaaaacaaaacaacaaaaaaaaattttttttttgagacggagtctcgctctgtcgcccaggctggagtgcagtggcgtgatcttggctcactgcaagttccgcctcccaggttcacgccattctcctgcctcagcctcccgagtagctgggactacaggcgcccgccaccacgcccggctgattttttgtatttttagtagagacggggtttcaccacgttagccacgatggtctcgatctcctgacctcgtgatctgccctcctcggcctcccaaagtgctgggattacaggcgtgagccactgcacgcagcccaaaaaaaatttaaaaattggccgggcgcagtggctcatgcctgtaatcccagcactttgggagggaggctgaggtcaggagtttgagaccagcctaaccaagatagtgaaacctcgtctctactaaaaatgcccccaaaaattagccaagcatggtggcacatgcctgtaatcccagctacttgagaggctgaagcaccagaatcgcttgaatctgggaggtggaggttgcagtgagctgcgatcgcaccactgtactccagcctggccagcagagcgagactccatcttaaaaaaaaaaaaaaaaaagggctggccaagcacagtggctcacacctgtaatcccagaactttgggaggccgaggcgggcagatcacacgaggtcaggagttcgagactagcctggccaacactgtgaaaccccatccctactaaaaatacaaaaaattagccaggcatggtggcaggcgcctataatcccagctactttggatgctgaggcaggagaatcgcttgaacctggaaggcagaggttgcagtgggccaagatcacgccactgcactccagcctgggtgacagtgccaggctctccctcaaaaaaaagaaaaaagaaaaaaaaaaggaaaagaaaaggccaggtatggtggcatccacctctagtgacagctacttggaaggctcaggtaggcgaatcggctgagcccaggaagccaaggctgcagtgagctatgagtgcacaactgcagagacagaacaagatcctgtccggaaaaaaaagttacccacagaattttcagtcccaattccacctcaaggtgaagttaaatacaaggactcaagcaaatacttagtgcacccattttcatagcagcattgtactcaccatagggaaaaggtggaaacccactgaccaccaaaagtttaatgactaaacaatgtgtgcaaaatacataaaatgaattgtgtaaattcagtcactaaaaggactgaagctctgatccatgcttttacatggataaaaacattacgctagatgaaataaagacagccacaaaaggacaaatattatatgatcccacttacatgaggtatctagaatgggccaaattcatagtgacaacgtaaaataaaagttactagcagctagggagaggggaaatgaagttattgattgtttaatggctataattcgctttgtgtggggtgaagagaaagttttcaaatagtggtgattacacaacactgtcaatgtattcggtgccactaaattgttgtgtgtgtgtgtgtgtgtgtgtgtgtgtgtgtgtgtgtgtgtaaaagtctcgctttgtcgcccaggcgagagggagagggagacggggagagagagggagacggggagggggagggggggaggagggggagggggggagagagggggagagagagagagagagatttgaaaaaaagtctcactgtgtcacccaggctacagtgtactggtgcaatcgaggctcaccgcaacctctgcctcctgggttcaaacaattctcctgtctcagcctcccgagtaactgggattgcaggcatgcaccaccacacccggctaattttgtatttttaatagagacagagtttcaccatgttggtcaggttggtatcgaactcctgatctcaggtgacccacccacctcagcctcccaaagtgctgggattacaggcgtgagccactgcacccaggctatcacaactttttaaaagtaaaaagttatgtacgtataaatattccttacatatttatctacattatcaaaaactgggaacaagctgaagtataaatgggggaacagtttaacacacattagtaagactgaaacttgtttatgctaaaacagaaaatataaaattatgtttgctacgagagtaactattaaaaacatgcccatagaaacagaacactggctgggtgtggtgactcatgcttgtaatctcagcactttgggaggcgaaggcgggcggatcacttgaggtcaggagttccagaccagcctagccaaaatggtgaaaacaccgtctctactaaaaatacaaaaaaaattagttgggcatggtggcaggcccctgtaactccagttactcaggaggctgagacaggagaatcacttgaacccaggaggtgaaggctgcagtgatctgagatggcgccactgcactctagcctgggagacagagtgagacatggtctcaaatttaaaaaaagactgaaaactaatataacaaaaattaaaataattctaattcctctcatttccttcctctactcattttaacatgttagatttcaatctaccagcaacaaaaatatcccacatcaaaataattatgctgactgctatgctagtgggttgagacaggtctgttttaatactatccaaagtagtttcagtaagagccaaaagaattactatgcagccaagtctacaaagacaggcccaagaaacaacacggaaaacccaaacagcgccccccttaactttcacgctgagcgctgctgttcttccccacaacttacctgcaggcacggtcaggggaattaagaatttcgtagtagaatacggaaaaattgagagcaagacctaagcgaataggatgcgttggtggaagttctgtcattgcaatatcactagcagctttataagccactaggctgttctccgcagcctccttcctgtcgtttcctgtggcaaattctgccagatacctgtggtagtcccctttcctaaaacaaaaccaaaattaaaaaaaaaaaaaaaatttaaactaggaacgatttttaaaggaaaataagctaaaattgttctatattatataaaatgtgacaaaaatatatgtaacaattaggtgtacttcaataattttaaacactctcaggaataactggcttcgtttcatttttttccttagacatttcatattactaaatataagcaaaaatcccaggaaattaactgaggagcctctaaaaattaataaaattatcacctgatagaccagaattaaacaagcaagtggttccaaggaatggcatgacagtttattaatcataaaataaaatgtctatatataacactaagcactgtgaaatgtatgccgtttgggggaggggaatgggataggtctcacaaaaacaaaagaatataaataagcaaaagctaatacattttcataatagcccaaccaccttttcattacaatattaactatccttctaacattgaacaattattcttaaataaaagttgaaaacctacatagaacaaagttatggttctaaaaggaccaactttcaatcttacattttcccttctagtatagaacctacattttataatagaaaaccttggactcgccagtgttagctgctggaatgaggtgtttgtccagtacatccagaatgtcacaacagattaactttagctcagtctcaacctaaaaaaaaaaaaattttttttaaatcagattaagtctagaaattctacaaattattacatattctatctctggttttgaggtagagagcttagtattaaaaagaatttgtatccctctccaaactcccttcttccttcttgacacaaaagcagagaaaagctgcctctaggttataaaaagtatcttttcccttctgcatgctgcctattgttacacacacacatgcaggcacgcacacacgccagcccccacacccccttcacagtaccacagtacagctacagaattaccaatgactaaaactgaacactgatgcttcttggtaaatgctggtcaattacatgaattaccttctttcacaaggtagcaacgtaaagacattgctctaagatcaacaattaaataagaatttaataagcagagctaggatttgaacccaggcaggctgcaagggacagaatcaaaatttaaacccaggcagtttgccttcagcactcacatccttaacaacattcaccaggcaattcctttagtggcagagatccgtaactattaaaacaccgaaaacctatctaccaaagtagctactgccacccatctctatccactgatcatgctgaacacgcacaccacctctcaacgcacatcctcagcttgcttcctgtttgctattaactcatgcagcactactgctgaacctttcatgagggtcctctccgtgcccctggaacctccgtttcactgcagaaaattctctctttttcttctataatcacatccttatcccaagcaaaactactttctgaataaacgacatccctgacagcttttccaatagagactggtctaggagaaggaagacttctaagttctcctagctccttgcatactcaatgactgctctattactccaaactcttcctcctcacaagctgatgatctacattctatttctcagtttttgtcatcaatagatctctacacccttctcccagattcactgagtatctacagcaaacccacccaatacctgagatcacaccaaggtatggtgcagccatgttccattcaacagagttctttgctctctactcctagactttcacttgtccacacccatgaccatgctgctccatactagaagtctgaattgcaacactccactcttggcccgtggcttcctttttcagttcctcttctcttattatttctatttagggactcatcaggacatctggactctttattttttactttttctttctttgattcagagtttccctcttgttgccaaggctggatggagtgcagtggctcgacgttggctcattgcaacctccacctcctgggttcaagcgattctcctgtctcagcctcccgagtagctgggattacaggtgcccgccaccatgcctggctaatttttgtatttttagtggagacggggtttcaccatgtcggtcaggctgctctcgaactcctcacctcaggtacctgcccgccttggcctcccaaagtgctgggattacaggcatgagccaccacggaaggccccagctcacaactttctatgtgacctcaggtatgtcaaacacccaaaaccctggtttgtgcattcatagttgggataatacctcccccttccagtgccattttaaagatttcatgtactaccttgcacaaatacatgtaacaaaaatatttctctactcaggacagtgcccagtacagctggcgagtcagtaactgtggttcccccacccttccctcccccaaccaacctcactttccacctgccctgtaattctcttccctgttctttcctgtatttacgtgcctgtctcttctactagaatcggttactcaacagcagcactcccgacagtttgttgtggggcccgtgctgtgcccagtagaatggttagcagcaccccagtccccaccccactagatgctaggaacaccctccagaagttgtgacaatcaaaagtatttctagacattgttaaacgttctctgaagtacaaaagcacctctaattgaaaactgctgcattacagtgatggctgtccaacttttttttaacaagacctacaataagaaacattttatatatgtatatacacccacagtaagtaaaataacttcattaaataatcctcagggaaaaaaaaagaggaatcagacaaattaacccaatatattggtttttgggtgcttttttttttttttagatggagtctcgcgctctgtcacccaggctggagtgcagcagtgcgatctcggctcaccgcaagctccgcctcccggattcacaccattctcctgcctcagcctcccgagtagctgggaccacaggctcccgccaccacgcccagctaatgttttgtatttttagtagagacggggtttcaccatgttagccaggatggtctcgatctcctgacctcgtgatccgcccacctcagcctcccaaagtgctgggattacaggcctgagccaccgcgcctggccaacccaccatatttttttaaaaaacagtcatcattttgcttgaaaatacaatagttcccccttatccaagagggatccattgagacctgccagtggatgtgatgaaaccatggaaaataccaaacctgatacagactatgttttgtcctcatgcatagccacgggtaagtttaacttataaaccaggcacaaagatcaatatcagaaacattataacatactgtaatacaagttatatgaatgtagtctccttttctctcaaaatcttaagtgtaccgtcctacaggtaactcaaactgtggataaggggggatgatggcacaacaatctcaccatttgccgatattcccgaatcatttttagcttgtcttctcctcccttgttttcttctttctgttcaatgctgctgattattctccaggaggctcttctagctccaatcacattcttatatgcaacagataggaggtttctttcttcaactgtcagctccacatccatccctgctactttcttcattgactccaccatttctgtatgggaaaaggaaaagtcagaccttacaaatttgaagttttcttaacatattcctttcaaagtagtttttttctgtcaagctactgcgaaaaaaacattttaacaaaaataatttcataatcatcaaaactaatatgagtaaaaagccaaaaacatgtaaaggaaaccaaactaagagccaatacaaagactccagaaggtagttaggtggagtgagaaagacttcatatactatctaatataatttagtgtggtctgaaagcacctctcattaaataaggtaattaggcacacctaactattttccagcaaaaaaaaatgagctgtcagtttaagagaaagattaagaatttacaggttctaaaatgtattgtctcacaaataaatagtatttccaaaaatacaaaaggaaggggaatttgttcatacagcaaaaatatacggagtatatggttggccaccaacagactttggatgttttctatccttcctcgtatgaagctccttcattggtaaaacttctgatgattcctacttgttaccactaggtggcgagcaaagaaaggggcccagaaaagccttggcatctaccgcaagcatagggaaacacaacggcgtgtgaatgcaaagcgccacaaacagcacaagaaatagtaactgaataaatacattaataaaaacttatttttgatgccatattaccatgtggctctccaacattacccacgtttcaatctttggtgatgagactcaagaatctgcattttagggccaggagtaagtggctcatacccctagcactttgagagctgaggcaggagaatcactcgagctcaggagttcgagaccctgtctctaaaaaataaaaacagaggctgggcacagtggctcatgcctgtaaatcccagcactttggcaggccgaggtggcacatcaccaggtcaagagataaagactatcctggccaacatggtgaaacactgtctctactaaaaatacaaaaattagctgggcgtggtgatgcacgcctgtagtcccaggtactctagagactgagacaggagaatcgcttgaacccagaaggtggagattgcagtgagccaagatcatgccgctgcactccagcccagcaacagagactccacctcaaaaaaaaaaaaatagaataaataaaataaaaataaaaataaaaataggctggatgtagtggctcatgcatataatcccagaactgtgggaggccaaggtgggcagatcatttgaggtcacgaattcaaggccagcctggccaacgtggtgaaacggtctctactaaaaatacaaaaattagctgcgtttggtggtgcgcgcctgtaattacagctacttgggaagctgaggcagcagaattgcttgaacccaggaggcagagattgcaactgagatcgccccactgtatgccacctggggcaacagagcagactccatctcaaaaaaaaccaaaagaaagaatctgcatttaaataagcatccttagctttcattaacaccctaagcataagcataccttaactaataggtatgaaagagatggtgacttcataaaacactactaaattggacgggcacggtggatcacacctgtaatctcagcactttgggaggccaaggtgggtggatcgcctgaggtcaggagttcgagaccagcctggccaacatggtgaaacccgtctctactaaaaatacaaaaattagctgggcatggtggtgcacgcttgtaatcccagctaccaggaaggctgaggcaggagaactgcttgaacctgggaggcagaggttgcagtgagctgagattgcaccactgcattccagcctgggtgacagagtgagactccgtttcaaaaaaaaacacaaaacaaaaaccaaaacactattaaattaaggggagtgtgcctaatgtatccaggaaaatatgtttcaaaaattaatcctttcgggaatataaaaaaaattaagccatattttgtaaagtctcttcgaaaaatattcggcaatgttttaataaacatgtaccatatgactcagcaatcccaattctatgcatcatccagaagaaaaataatctttacaaagacttttacacactcactcacagcaactctattcataatagccaaaaagtggaaacccctcaaatgtgcatccagaggggaaatgtataagcacactgatgttcacatatgtaagatgggataccactcaaaaataaagaattaactgtccatgcacagtggctcacatctgtaatcccagcatttggggaggccaagacaggaggattacttgagcccagtagtttgagaccaacctgggcaacatggtgagactctgcctctacaaaaattagctgggtgtggtggtgtgtgcctgcggtctcaactactcaggagattaaggcaagagaactgcttgaccccaggaattcaggcctgcagtgagctattaggttggtacaaaagtaattgcgcattttgccagcaaaaaccacaattactttgtataatcctaacgctgtactccagcttggatgacaaagcgagagactctgtgtccagaaagagaagaggagacgggaggggagaaaaataattaactgatacaagcaacaatatggaagaatctgaaaaacatcatattaagtgaaaagagtcagattaaaaggattttatcattccatttatatcaaattgcaaaaaacacaaactaaaaagacagaaagcaaatggttatcaaggtacagaggtgaactgaggggcttttgtgcaaaggacaggtcacagaattgtacatgtaaaagtggcacgtttaactgtacacctcaagctgattttttaaatgcaattctgaaccattaaagaaggatgacatgttgggtgctgtggctcacacctgtcatcttagcactttgggaggctgaggcaggtggatcacctgaggtcaggagttcaagaccagcctggccaacatggtgacaccccgtctctactaaaaatataaaaattaggccaggcacggtgactcacgcctgtaatcccaacactttgggaggccgaggcaggcagatcacctgaggtcgggagatcgagaccagcctgaccagcatggagaaactaaaaatacaaaaaaatttgccagacgtggtggcacatgcctgtaatcccagctactcgaggctgaggcgagagaattgcttgaactcgggaggcggaggttgcactgagtggagatcgcgccactgtactccagtctgggcaacaagagcgaaactccatctcaaaaaaaggaaaaaaaaagaaaaagaaaaatacaaaaattagccaggcatggtggcaggcatctatagtgccagctactcgggaggctgaggcaggggaatcgcttgaaccccggagacaggggttgcactgagctgagatcgcgccattgcactccagcctaggcgacagagtgagactctgtctcaaaaaaaaaaaaaaaaaagtattacaatatggtaataagaccactcattaattcatttgtaggagtctgaaagcattcatctaaaacatgcccaattttgttttctaaaccagtcacgaaacagtctaaatttagaagcagtggaataggtaatcgtacctccatactagtttaattctcaaaaatcagcaagtcaaacataactcagaggtaagcctgtaattaaactttctaaactgatcgcaaagtaaatcttaagtaacccagctacacaaaaacagtgccattaattcttttaaggctttacaatattacatacagaaaaactatgcagacatcaaatactaccaaaaatttaagttacatatctcgaatatcattccttatgatttaattttgttcaaatttctgtgctttacaaattttcaacaacgaagacttagtatttttataatgcaaagagaaatatatttgtaacactcagtgatactctactgttccagattcaagcataaatgctttcatttttacatatacacaaaacaatgcacagactgtgtggtaaaattatagaagcaacaattatccctttaataatacctttatttatatataattcccctacctaacaattcacccatttaaagtgtactattcggccgggagcaggggctcacccctgtaaaccttgggaggccgaggtgggtggatcatgaggtcaggagatcaagaacagcctggccaacatagtaaaaccccgtctctactaaaaatacaaaaattagctgggcatggtggcaggcgcctgtagtcccagctaaccaggaggctgaagcaagagatttgcttgaacccgggaggcggaggttgcagtgacccgagatggctccactgcactacagcctgggtaacagagagagactccgtctccaaaaaataaataaactgtaccattcaatggtttttagtatattcacagaattctgcaatcatcataattttagattttcatcacttcaaaaagaaaagccccaaacccattaaccatcaattcccatgtacccgaaccccagcccggtcaaccaccaatctattttccgcctctacacacttgtctcttatgcacatttcaggtgcgggcataccttggaagatactgcgggttcagttccagagcactgcaaaaaaaaatattgcaataaagcaagtcacatgaatttttgtgtttcccagtgcatagaaaagttatgtttaaactacactgtaatctattaagtgtacaacagcattatgtctaaactgtacataatttaaaaacaccttattgctaataaatgctaatgctcatctgagccttcagcaagtgataatattttgctgttggaaggtttttgccttgatgttgatggctactgactgcttagggtgatggctgctgaaggctggagtggccgtggcaagacaatgaagtctgccatgttgatgggcttttcctttcctgcatgatttctctgtagcatctgacgctgttggacagcatttacccacagaaaaacttttttttttttttttttttttttttgagacggagtctcgctctgtcaccaggctggagtgcctgggcgtgatctcggctcactgcaagctccgcctcccaggttcacgccattctcctgcctcagcctcccgagtagctgggaccacaggcgcccgtcaccatgcccagtgaatttttttgtgtgtatttttagtagaggcggggtttcaccatgttagccaggacggtctcgatctcctgaccttgtgatccgcccgccttggcctcccaaagtgctgggattacaggcgtgagccaccgcgactggccagaacaactttttgttttttgtttttgagacagtgtcttgctctgtagcccaggcagtggcacaatctcggctcactgcagcctctgcctccagggttcaagcaattctcctgcctcagcctcccaagtagctgagactacaagtgggcgccaccacgcccggctaacttttctatttttagtagagacggggtttcagcatgttggtgaggctggtcttaaactcctgacctcaggtgatctgcctacctgctgtgttaacaggcataaaaacaacattgcaggctgggagcggtggctcacgcctagtaatcccagcactttgggaggccgaggtgggcagatcacgaggtcaggagatggagaccatcctggctaacaaggtgaaaacctcgtctctactaaaagtgcaaaaaaaaatcagccgggcatggtggcgggcgcctgtagtcccagctactcaggaggctgaggcaggagaatggtgtgaacccgggaggcggagctgcagtgagctgagatagtgccactgcactccagcctgggcgacacagcgagactccttctcaaaaaataaaaaatcaaaaaacattgctctccttacacaactacatcagagctccagggtgaccaagtactgtgtgtgagtgtgtggtagtgtgtgtgtgttttgaaacagagtcacactctgtcacccaagatgatacagtggcaccatctcagttcactacagcctcaacctccccagctcaagcgatcctccaacctcagcctcctgagtagctgggactacaggtgtacgccattacgcccagctaatttttattatttttttgtaaagacagggttttgccatgttcctcaggctggtcttgaactcttgtgctcatgtgacccacccatctcggcctcccaaagtgctgaaattacaaatgtgcaccactgcacccaacctcggtgcattttcaatgtgcagtaatacattgaagggaattttttttttttctgagtaccaagcttcaacagtgggcttaagatattcagaaaaccatgctgtaaacataagtgctgtcttacaggctttgctgttccatttataaaccaggcagagtaaatttagcatgattcttaaagaggcctcaaatttttcaaacagtcaatgagcactggtttcaatttaaattcaccagctgcattagtccctaagaagctgcatcagcctgtcctatggagctagacacactgacttctctctagttaagtgaagtcctagacagcattttcttctaacacaaggctgttttgtctacgctgaaaatctaagtggtgtggtcaccatcaataatgttagctaaatctggataatttgctgcagcatctacatcagcacatgctacttgaccctgtactttttttttttttttttgagacagaatttcactttgtcgctcaggctggagtgctgtcacaacgtctcagctcactgcaacctccgtctcctgggctgaagcgattctcctgcctcaacttcccgagtagctgggattacaggcgtctgccaccacgcccagctaattttttgtatttttagtacaggcagggtttcaccatgttggccaggctggtctcaaactcctgacctcgtgatccgtccgcctcggccccccaaagcgctgggattacaggcgtgagccaccgcgctcagccgaccttgtactttttaagtaatggagatggcatctttccttaaaccttactaaccaacctctgctaggttccagctttctatctgtagctttctcacctctctcagctttcttaaatttgaagagagttagagggttggtctgaattaggctttggcttaagggaatagtatggcaggtttgatcttctattcagaccaccaaaactttctgtcagcaagaaggctgttttgctttctcatcattgctgtgttcactggactagcactttttaatctccttgaagaacttttcctttgcattcacaactgtggtgcaagaggcccagctttcagaccgtgtctcggcttttaaggtagccttcctgactcagcttcatcatttctacctttttatttaaagtgagagactgggactcttcctttctcttaaacacttagaagcaattgcagggttgttaatcggcctaatttaaatattgttatgtttcaggtaataggtaagcctaacgggagggagagagacagggagtcagaacacaaacaagagctcacgcctgtaatcccaatactttgggaggccgaaggcaggaagatcatgtgagcctaggagttcaagaccagcctgggcaacaggtgagaccctatctctacaaaaaatacaaaaactagccaggcatggtgatgtgtgcctgtcgtcccagcttctcaggaggccgaggcaggaggattgctggagcctgggaggtcaaggctgcagtgagcattcctgcctgggtgacagagtgagaccctgtctccaaaaattaatagtaaaagaacacaggccaggcatggtggctcacgcagtaatcccagcactttgggaggccaaggcgggcagatcacatgaggtcgggagttcgagaccacctgaccaacatggagaaaccctgtctctactaaaaatacaaaaaaattagccaggcatgggggcgcgtgcctgtaatcccagctactcgggacgctgaggcaggagaatcgcttgaactcaggaggcggaacttgcggtgagccaagatggcgcccttacactccaacctaagcaacaagagcgaaactcagtctcaaaaaacaagcaaaaaaaggaatacacacatctatcaattaatttccctcagttcacggatccccaaaacaattacaatagtaacgtcaaagattactgatcacagataaccaccattaacatgtaatgaaaagtttgaggccgggcgaggtggactcacgcctgtaatcccagcgctttgggaggccaagaagggtagatcacaaggtcaggagatggagaccatcctggctaacacggtgaaaccccgtctctactaaatatacaataaaaaattagccaggcatggtggcgggcgcctgtagtcccagctactcgggaggctgaggcaggagaattgcgtgaacccgggaggcggagcttgtagtgagtagagatcgtggcactgcactccagcctgggtgacagagtgagacttcatctcaaaaaaaaaaaagaaaagtttgaaatactgcacaaggtaccaaaatgtgaacagagacaagaagtgagcacctgctgttggaaaatggcaccaacagacttgctcaaagcgggttccagaaaccttccatttgttctgtaaaaatgtagtatctgtgaagcacaatcaaacagggtgtacctacgaacagagccatacagtatggagcctcccatgactggcttctttcccaacacaacctaccgtatggagtcggctgtgactggcttctttcccatagcatggtctcaagtttcatgcctagtgtagcatgcatcagtacttcacctactgtatggatatactatgctttaaaaatccattcattaggccaggtgcggtggctcacgcctacaatcccagcactctgggaggcaggtggattacctgaggtcaggagttcagaccagcctggccaaaacatggcaaaaccccgtctctactaaaaatacaaaaattaggctgccatgatgtctaggcgaatgtctgtaatcccagctactcgggaggctgaagcaggacaactgcttgaacacgggaggcggaggttgcagtgacccgagatcgtgccactgaactccagcctggcaacagagcgagacttggtctcaggaaaaaaaaaaaaaaatccattcgttagttaatgaacatttgggttgtttccatttttggactattataaacaatgctgctacgaacgttctttaagtttttgtatgaataaatgctttcagttcacttcagtatacacctagaaggaacttcaggatcacatggtaactagctttttgaggaaggacatcccaaacttttctacaggagcggcaccgtttttacactcccaccagcaacacaggattctaatctggccacgtcctcaggaacacttgttagttattctttaaactagtcatcctagtgggtgtgaagctgtatctctttgtggttttgatttgcatttccttgataactaatagtgttgaacaccttttcatgtgcttatgagccttttgcgtatgttctctggagaaatatctattcaaacactttgccaaatatttaattatttgtcttttcattattggtatgtaggagttgttcatttttaaaaccccactgactcctcttaattcccccaaccccctctgcatcccttaaggtagcagattaaggaacagaagtagcattgagtcaggagacacttctattgcttcaagagacagggtctcactacgttgccctgactgtatgtcgtgcagtggctattcacaggcccatgatcacagcgcactatgtagccttaaactcctggcctcgagtgatcctcccacctcagcctcccaagtaactgggactataggtgcacactaccaagcacatcactccttcaagagtatggaaagtcaacttctcaatctctccaaacattctacgaccagtgctttgtaccagtttgtacaaataacgactacaatgacactctcttccaatatcactgtcatctttatccttttaacaccagcaacagaaacataatactaatgataatgtaccccaaaactatataagaaaagctgatttatccaaaactctagactaactacacccttcagccctccctcagtagaggatgaactccaaccattatattcacataaaggccctcaacacaactagcatttcctgaaatcacctttgcggcaagtattttatcagtgggatgtgggcatttcacgggtgggggaaggctgtcatgtgtttgcagcaggtgggatcgcaatttaagaaccaaaaaactgaaatggttgaaatcacttcttttggatccacgggcagttttgctacagtaattttgagtaacaaaatcgaatttctgggacttttcatggtttggggacaagggtgggtgattaaaatcgccactctgaaaaacatactcctcacaagttaattaaacatagttaagtctctttagttccaagtaagtttcccttcattgtatggtaatagcctagacacagatccaccacatggaaccagcttgtgtctgggacacccatcatctgctgctgccagtagagtcacaagtttttccccttgacttgttaactgaggtttggtttgtggttgtgttctttcaactatgttgttcattcaacagactaattcataaataaaacaccccatttcaactatgttgttcattcaacagacttattcacaaataaaaccccccatgctaaaataggcactgttccaaatgcttcgctgtattaatgtgcttaatcttctcaacagacctctgaagtgggtaccagtattatcccattttagaatatctccatatactgaagaacacgaaggttaaacttgttccagatcacaaagccagtggactacaactcagggaatctgacttgagttgtgctttgatttaatcatattgcctcagatttgaatatttatttgaatgcatctgtacgaggatccttttgtttgcttctgtgacaatagaggggaaataactggtttcagtgactctaccagagaaacaagtttcacatactaaaatgtggttgagacccaggcatggtggcgtctgccaccatgagagaaagaacgaagacagaaagacagacagaaagacaagaaagacagacagacagacagaaagaaagaaaaagaaagagagagaaagaaagaaaagaaaagaaggaaagaagttcactcctgcttaaaacgcatttctttttccacctagaggttcacccctctcccaaaaaaagcttactttattcttttctcttaaagagacgggagtctttgtatgttgcccaggctggtctccaactcctgggctcaagcaatcctcccacctcagcctcctgaatacaaaaagcttagtttcatacctctaatatctttacatcaacatcccagtaaacctgattttcccaagactgtccttgccaggtagtaaaacaagtctctgctgagcttcaacagtttctgataaacacaaagtacaaaatcataaaaggagcaggtctccaactatcaggctgacaagtcacaaggcacaatttacagctcctaatgaaattcagggtcaggaaaaaagcaaactgttcagaatctgccatgggaaaaacgagcaggttctgtactggctgacaggattaatgttcctcttaccaaagcacacagggtcataaccctaacttttttttttttttttgagacagagtctagctctgttgcccaggctgaagtgcaatctcactgcaacctccatctcccatgttcaagtgatgctcttgccccagcctccctggtagttaggactacaggtgcccgccaacgtgcacggctaatttttatatttttagtaaagacagggtttcaccatgttggccagactggtttcgaactcctgacctcaggtgatccacctgcctcggcctccctaggtggtgggattacaggcaggggttaccacacccggccctaatcctgattttaagggcagaaaaatgaagctaagagtaatgttcctaaagtcacacaatggtaaaacccaaactcaaacccagacaatctaacttaagagtctgagcttttagccatcacacttcaatgactttgcaaccagagtgctcacagaaacaaattccttagcccaagaacagtaaaagcaatcacaccaagggaagaaaagggcacagcatcaggcactgacataaaaaggttctgtcagaaccggaaatgtggctcacacctgtagtcagtcccagctactccagaagctgagacaggaagatcgcttgagcccaggagtccgaggccacagtgagctatgatcatgccactgcactccaccctgggcaacagagcaagactctgtctctcaaaaagaaagagttcagtcacttaggttctggaaaggtcctgagcttgctttatataaaggctaatcaattagccaatgacctttcctttttcctaggaaacatcatccctctggatcaaactcaaatgtcttactatgtaaagacttcctggctggaagcagtggctcatgcctgtaatcccagcactttgggaggccgaggcaggtggatcacctgaggtcaggagttcgagaccagcctggccaacatggtgaaaccccgtctctactaaaaatacaaaaattagctgggcatggtggcgggtgcctgtaatcccagctactcgggaggctgaggcaggagaattgcttgaacccgagaggcggaggttgcagtgagccaagatcgcgtcactgcactccagcctgggcaacagaggtgagactccgtctcaaaataaaagtctcaaattgtttttatggtttggaggggatagtatgcaagtttgttggagagaaacttacaaggtgctacttactaagaaatttaccttgcggatattttcttaaaaaggagtcatcacagaaaatgtatgcctagatttacatgtgagaagcagtcttcaattggatacttctgaccccatgaaataactgaggacatttctgcagaaggctgacatatgagaatgctcaggaattgtgtggctttcaaataatctgattcagcttggacaacctccaaggaatgaataaaattaggcaaaagcttgacaatcactaaacatagtcaattcacagataattcatgacaatcaacattctgccttactgatttctaaaaggtcccaatatcttgctagtcacatgacaactctcttgttactattcagaaatataaagatggagcaaaattttttctaaaacgattatcacgcaccttctctatcacactgacaaataatctgggaagcatcagttctgtactaaaaagcatgtctaaaaagcctgactcagaccatttcaggagcaatactactcgtttactataaaagaaattcagtacaggccaggcacggcggctcacgcctgtaatcccagcactttgagaggccaaggcgggtggatcacctgaggttaggagttcaggaccggccttggccaacatggtgaaatcccgtctctactaaaaataccaaaaattagttgggcatggtggcacacacctgtgatcccagctactcgggaggctgaggcaggagaatcgcttgaacctgggaggcgaaggaagttgcaatgagcaaaggtcatgccattgcattccagcctggcgacaagagcaaaactctgtctcaaaaaaaaaaaaaaagaaattcagtatgatccccaagaaagttacaaaacattctcagatggctaacctgaattatactggtttttaaacattaaatctctgcccaaatttggcaattttaattttatcataattaattcagctgcttgaagcctgcttaaagtttgcgatgtcatcactttaaggttgactatactcatgtcagtgtacttccaaatcacctaagagccctatgggatgttaagacacacttcagattttacatggcctcacgcctgtaatcccaacactttgggaggatgaagcgggcaggctgcttgagctgaggagtctaagcccagtctggggagcacggcaaaactccatctctactaaaatataaaaaattagccgggcgtggtggcacacacctatagtcccagctactctggaggctgaggtgggtggatcaactgagcccaggaagtcaaggctgcaatgagctgtgatcacgccactgcactccagcctgggcaaagaaagcaagactctgcctcaaaagaagatttcatacatgcaaaacttctaattcgaatgacgaaaaaaactatcaactacactaattctaatagtaaataacatggaaagaatctaagaatgtaacaaaatgtcaaatctgtagcttgaggagtcttaaatcatattttcttagaaaaacaaaatgcaagaatagtgatcactagttctactcaattaagatgagcaaaaggctgggatgtaccctggagcgtgttacgatgagttatgaaggaaggagtacttgaggtaaacagttggacaagatttaggaaacactcctggaacttgttttaatttaagcaaagatttaaaattgtgtaaaatgaacaggattagttggttgacatgtaaattatactttgtgttcagtacggtgaaagaaccagaatgctgtaaacagaaaataatggaagtactcagaagcttttctgaagaggccctattctagtctactaactttgactattattgtagtacccacataccacgtgcacttttattagacaaaaatgacacacactttgggaaacagcacaggaaagtcccaccacagcacagcaaacaccacacttacagcaaagagtttcagactagaagactagacttttttttttttttttttttgagacggagcctcactctgtcgcccaggctggagtgcactggcacgatctcggctcactgcaacctccgcctcccgggttcaagagtctcctgcctcagcctccgaagtagctgggattacaggcgcacactaccatgcccagctaaattttgtatttttagtaaaggtgaggtttcacgatgttgaccaggatggtctcgaactcgtgacctcaggtgatctgcctgcctcagccttccaaagtgcgtgagccaccgcgcccagcccagactagattttcattcctgcttattcatatgctatttgacctcaagtatgccacataatctctaggagcttgttcctcatccataacatggaggatatccagccctgagttatgagagtttaaaatgagattgtagagtaaattgtctggcatataatatgaattcaattaaatgtttaatttcttttcttcgcctcacttccaagattaaataacaaaaaaacaaaaccggaatccagacgggtgggggtgttaatgtgcctgatgtaggaaagagctaaataaagaacacagcgtttagaatctaagtctaataaagccttttgcagaatacagctccattttttctaacccagactttccattcttacatctcatatatttaatcccatatctgtgcttttggtaacatatccaaagaacctcactctcccaacatccaaatcttatcccccaattaatgtctcacctactattcaagttttccccgacaactgcagcacacaatcccttgttccccttctctacaattcctgtattatacaagctagaaatcatcattctggtttctagccacagcttgcctgattagactgtaactcttccatagtaggtattataagtaacgattttattactcacaaggggaaagttgttccccatacatgctaaagaaatacatattgattaaatggtccaagaggctgggcgcagtggctcacgtctgtaatcccagaacttcgggaggctaacaatcacttgaggtcaggagttacagactggcctggccaacatggcgaaaccccacctccactaaaaatacaaaaattagtccgggtgtggtgggattacgcctgtaatcccagcacttttggaggctgaggcgggtgactcacctgaggtcaggagttcgagaccagcctgaccaacatggagaaaccccgactctactaaaaacacaaaaaattagccaggcgtggtggctgtaatcccagctactcaggaggctgaagcacgagcatcccttgaacccgggaggtggaggttgcagtgagctgagattgtgtcactgcactccagcatgggcaacaggacaagactcatctccaaataaatcaataaactcaaaaaaataagtaaataaaacacgaaaggctcaagaatgcatgtaaaggggggaggggaatttcaaactatcaactaatcaaaacgtaacataaatgcactgaggaaggccgagcgcaaaggctcaggcctgtaatcccagcactttgggaggccaacgcgggtggatcgcttcaactcaggagttcaagaccagcctaggagacatggcgaaaccctgtctctacaaaaaaatacaaaaattggccaggcctggtggtgcatgcctgcagtcccaggcataggactgaggtgggaggatcactggaacgtgagaggtcaaggctgcagtgagcccagactggcccactgtactccagcctgcacgagagagcgacactatgtcaaaaaaaaaaaaaaaaaaaaaaagacaggcagacagaaaaggaaaaaaaaacacagatatataggcactggagcaaagaaaaagttattaaaggagactcaaaccactgacaagttacttgcggcataagtagtagtttttttgtttgtttgttttgagatggagtctcgctctgtcacccaggctggagtgcagtggcgcaatctcggctcacggcaacctccgcctcccgggttcacgccattctcctgcctcagcctcccatgtaactgggacttcaggcgcccaccaccatgcccggcaaattttttgtatttttagtagagatggggtttcaccgtgttagccaggatggtctcgatctcctgacctcatgatctgcccgcctcggcctcccaaagtgctgggattacaggcttgagccaccgcgcccggccttttttttttttttgagatggagtctcactctgttgaccaggctacagtgcagcagcgcaatctcagctcactgcaagctctaccggcaagctccgcctcccgggttctggccattctcctgcttcagcctcccaagtagctgggactacaggcgcccaccaccaggccaggctaattttttttttgtatctttagtagagacggggtttcactatgttagccaggatgatctcaatctcctgaccctgtgatccacccgcctcggcctcccaaagtgctaggattacaggcgtgagccaccacgcctggccagtagttttcattatttacttgatatggctgtactgctgactttacatttaaattcatcttttgcagtaagaaatgaaaaacaggccaggtgcggtggctcatacctgtattcccagcaatttgagaggctgaggccagcggatcacttgaggtcaggagatcgagaccagcctggccaacctggcgaaaccccatctctactaataatacaaaaattatccaggtgtgttggcatatgactgtaattccagctacttgggaggctggggaaggagaattgcttgaacctgggaggctgaggttgcagtgagctgacctcatgccactgcactccagcccaggtgacaaagcaagattccgtctcaagaaagaaaaaaaaaaaaaaggcaaaacaaaagtggaaaaactggctggtcgtggtggctcacgcctgtaatcccagcactttgggaggccgaggcacatggatcacctgaggtcgagagttcgagaccagcctgaccaacatagagaaaccccatctctactaaaaatacaaaattagacaggcatggtggcgcatgcctgtaatcccagctactctgggggctgaggcaggagaattgcttgatcctgggaggacgaggtttccgcgagctgagatcgcgcgattgcactccagcctgggcaacaagagcgaaactccgtttaaaaaaagaaatggaaaaactatttcacatactgtttaacttttttttttttttttgagacggagtcttggtctgttgccccggctggagtgcagtggcacaatttcagctcctggcaacctctacctcccgggttcaagcaattctcctgtctcagcccctaccagaagatgggattacaggcacgtgccaccacgcccggcaagtttttgtatttttagtagagatgggtttcgccatgttggccaggctggtcttgaactcctgacctcaggtgatccacccgcctcggcctcccaaagtactaggattacaggtgtgagccactgcacccggcccttgtttaaacaattttttaaaacacaagtttttagttaaattttgtgctgcacaatcgtaagttgctagtattataaacagttaataaaccttttcagaaaatagagtattcccgcaatctccgcactttgggaggctgaggtgggaagatttcctgagcccaagagttcaagaccggcctgggcaatatggcaagaccccatctcttcacacatttaaaaaattagccgaagagggctgggcacagtggctcacgcctgtaattcaagcactttgggaggccgaggcacgtggatcacaaggtcaagagttcaagaccaacctggccaacatggtgaaaccccatttctactaaaaatacaaaacaattagccacgcgttaagcaggtgcctgtaatcccagccactcgggaagatgaggcagagaactgcttgaacccaggaggcgaaagctgcagtgagccaagatccagccactgctctccagcatgggagaaagagcaagaccctgtctcaaaaaaataaaaataaaaaataaattagccaggcatggtgggcacacctgtagtcccagctacccaggacgcagaggtgggaggattgcttgagcccaggaggtgagggctgcagtgaggtgtgtctgctactgcacaccagcttgggcaagagtgagaccacatctcaaaacattaagagtacacatgtaaaaagatttatgctcgaccgggcgcggtggctcacgcctgtaatcccagcactttgggaggccaaggcgggcagatcacaacgtcaggagatcaagaccatcctggctaacacggtgaaaccctgtctctactaaaaatacaaaaaaaattagccaggcatggtggcaggcacctgtactcccagctactcaggaggctgaggcaggataatggagtgtattttgtattttgagggtttcaccaggctggtcttgaactcctgacattatgatccatccgcttcagcctcccaaagtgctgggattaaaggagtgagccactgcgcccagcccagagtttttctcttgttgctcaggctggagtgcaatggcgctatctcggctcactgcaacctccgcctcccgggttcaagagattctcctgcctccgcctcctgggagtagctgggattagaggcatgcgccacgaagcctggctaatttttttttgtatttttagtagagacgggtttctccatgttggtcaggctggtcctgaactcccaaccacagatgatctgcctgccttggcctcccaaagaaattttttttaaaatcagtttcaggtttgttttttctttttagaggagtctccctatgttgccctggctgccttgcagtggctattcacaggcatgaccataacactccttggctgaagctcaccctctactgcactccaccctgggtgacagggaaagactctgtctcaaaaaaaaaaaaaaaaaaagtaaagataaaatgaatacagaaatgttggcagcattctgaaaccagaaaagttaaaggttaagaaaaaatctgcagcaataagataaaggcattaagaccatgttaatgatgtgcagttattcattgttgagaagatgaaaatctaccagcaactggtctagaggaaaacaccaaggtcccctgtgatcagtcccccaggcctcccaactacatgcctcaaaagtcatctactgaaaaggtacacaacgaaaaagtacaccatactgcaatttactaagttcccagagcttcttatccagccatttataaagctctagtcccaaatatcagtggtccccaacctttgtggcaccagggaccagtttcgtggaagacaatttttccacagaccagtatgggtgcatggcctgggcactggggacccctgcatgtatcaaagagttaaaaacaaagtaggtttttcagagggtgggggaggagggaaggaaggaagacggaggatgcaggtggcctgctcctgaatttaatggctcctatcccaatactagttccattacctgttacctgcaaaatatactcagcctacattccattctgtcttcttcatacattaaagacaacactattcagagagaagctgagccaaaagactgctataatcccagcactttaggaggccaaggcaggaggacttcttgagcccagctgaaagaccagcctgggcaacacagagacccccagtctccacaaaaaagggggaaaaaaagaaaagaaagcctcaagcagtctggactgacgtttacacacaagaaactccttccgaagtggaaggagtaccagctttgcagggcaccagccttggcagaataccagtgacatttcaaatgtgttgtcacttttcctcaagtactggatccttatctgtaaaatgggtagtactttgcatggctgtttggataacaagtgaaagaaatagccaataaacagtagatgatattattattacagggtttcatcacaatgaaacactttaaagaggtttttcaatttgttagtaccattttacaccagtagtcagtgaagaaacactgagctttctacagtctttaacatgggacacccagcaactgatacagtaccctgcatataccagacaccattggtgctaattaatttaaactaactcttaattacacataggaacagagtaactccgaaagcaatcatacattcactagaatataaagtccttgaaaagatcttttgtctattttgttcactgatgaatcccaagtgtctaaagtgtctagaacagtgcctggtacatagtcggcattcagtaagtatttgtcaaatgagtttgggaacttgttttttagtactttaatactttgattaaggcttttcaaaagacaataatcttgacactcaaggacaacttttactcttcatataccagcctatacagaggtacctctcctcactctaaaagtaactacatgagccaggcacggtggctcacgcctataatcccagctctctgggaggccaaggcaggcggatcacctgaggccagaagtttgagaccagcctggccaacacggtgaaacacccgtctctactgaagaaaaaacaaaaattagccaggcatggtggcaggtgcctgtaatcccagctactcaggaggctgaggcaggagaatcacttgaaccaaggaggtggaggctgcagtgagccaagatcgcgccattgcactccagtctgggcaacagagtgagactccgtctcaaaaggaaaaaaaaaaaaaagaggaaaacatgaattgtgtaaccttctatgaaactttaagactcctttccaaatcagcttttgctaggttaaaaagaaacaaaaacaagacaatcttttaccaagattctacaattttgactgcaaaagctacttttccctttggtctcaatatttagggcagggttgtgctcactttggcagcacatgtactaaagttggaatgacacaaagattaaaaaacaaaaataaaaatattgggggtgggggagtaatcccctgctccatcagaatgggagatttctcctctcaatttacgaggatactccctcataaacacgttcggctgcagtagaaccaaacaggtgaagctccagtgaaacctgaggtggaaaataagaggctggggagatcaatgacctaaaacactaagtacaggaaaaacaggtagatcaaagtctgaatctttttacagtttttatggaattagaaaagacactgaaacaaaaaatactttaaaattctgttttggaatactaaggaagaaaatgaccacaaataacccttgggtccaattcggtttagtagaaggattaactttacattcagatttttaagaagtttgacatgttttctcaagtggttgagagtgttaagcatttctttgcgggggtgggggcagtaggcggggatggagtcttactgtttcccaggctggagtgcagtgccacaatctcggcattctgcagctttctacctcccgagttcaagcgattctgctgcctcagcctcccgaatagctgagattacaagcgcacgccaccacgcccgtctaattttttgtatatttagtagagacggggggtctcaccatgttcaccagcctgatcctgaactcctgacctcaggtgatccacccttcttggcctcccaaagtgctgggattacaggagtgagccactgcacctggctttttttttttttttttttttgacggagtctcactctgtcgttcaggctggagcccaggggcactatctcggctcactgcaacctttgcctcccgggttcaagtgattctcctgccttaacctcctgagtagctgggattacaggcacgtgccaccaccacgcctgggtaatttttgtttttttttttggttggttttttttttttttttttttttttagtagagacgaggtttcaccctgttggtcaggcttgtctcgaactcctgacctcgtgatctgccctcctcggcctcccaaagtgctaggattggccaggcgctgtggctcacgcctgtaatcccagcactttgggaggctgagttgggcggatcgtgagatcaggagatcaagaccatcctggctaacacggtgaaaccccgtctctactaaaaatacaaaaaatgagccgggcgtggtggcaggcgcctgtagtaccagctactccggaggctgaggcaggagaatggagtgaacccaggaggtggagcttgcagtgagccaagatgcaagtggagcgccactgcactccagcctgggcaacagagcaagactctgtctcaaaaaaaaaaaaagtgctaggattacaggcatgagcaaaccatgcccagcctttttttttttttttttaatagaaacggagtcttgcaatgttgcccaggctggtctcaaactcctggcctcaaatgacctcccaccttggcctccaaaagcaatgagattacaggtatgtcaattctttgatgagctaagaaacccccatcaaaatttcaacactttaatattttaatgtttcctaagtagtatattctgcattaagtatttcatactcatgaatgtgtttctaaaaatctacaaaaactgtcataactgtcatacaacagtgacaatattttctggtcaaataacgttcttgaaaatttcacggtaatcctatcataaatcttaactattttacaagtaaacctattacaatcaaatacaagtcattaatcccactaaatctttctcctttcctttttgagacagggtctcactatgtcacccaggtgggagtgcagtggtcttatcatggctcactgcagcctcgacctcccgggctcaagaaatcttaccaccttggcctcccaagtagctgagactacagacacatgccactaggtcaagctaattctgtttctttttgtagaaacagggtctcactatgttgcccaggctggtctcaaacttttgggcttaagggatcttcccgcctctgccttccaaagtattggaattacagggattattagccactgcacgtggcccctactaacatttaaacacttaaatttcaacataaaggtgttcacaacaaccactccaaggtcctacaaagtcttcagctgactaacccagggattaagtagtatttagtagctttttattaatcaaaacccattcactgtccaaggcttatattatgcctttagaatcacatttcacaaaattggtcatagctaacaccatttttcttaagtaatctgagatggctaaaatgcgaacatttaacaatgatttacgttttctttctttttttttttttttgagatggagtctcgctctgttgcccaggctggagtgcagtggcgcgatcctggctcactgcaagctccgcctcccgggttcatgccattctcctgcctcagcctcctgagcagctgggactacaggcgcccgctaccacgcccagctaattttttgtatttttagtagagacagggtttcactgtgttagccaggatggtctcaatctgctgacctcgtagtccgcccgcctcggcctcccaaagtcctgggattacagccgtgagccaccgtacctggccaattatttacattttctttctttctttttttgagacagagttttgctcttgtcgcccaggctggagtgcaatggtacaatctcggctcactgcaacctccgcctcccaggttcaagcaaacctcctgcctcagcctcccgaggagctgggattacaagcgcctgccaccacttcaagctaattttgtattttttagtatagatgggatttctccatgttggtcaggctggtcttgaactcccgacctcaggtgatccgcccaacttggcctcccaaagtgctgggattacaggtgtgagccactgcacccagcctacattttcatattacagcagctttcatcccaaattcagacaaaaggtgttacgtttgctaaggagaaagtctcttattaatctaaaattaatatcaaaacaactatataccagctcaacatgacaaaattattatttgggaataatctggacgacctttactttggatatgcaaatttacagatgtaagattaaggattttgagaatatttctttgtgcatatcttacataaggactaagcccagaagactacacttgctaagaataactcaaaaaggtaggttatcatctaatatgatcctagcacagcagtaacaaaaacaattatctgacctttcacattagataagaatgtttcacaacaaatagtaccgacaagtattacactttacagtttacaaaagcccaaaatttcataaccaccctgcaaattagtaggcaagagagacatcactaatccccatttgaaagataaggaacccagtgattcctgtgcattctgtgatggcagatttaccacatctgccaaatgatgaaatactgtcataactcttacagtaatgcatctccttcaaactttagatatgaatgaagagttaaacacatttcatattgctttagctcgataaaatcctgatctgatcacaaatcaagcccaccaacaacagatccgtccagctactatggtagattgttggaagggcaataaattcaagataaaaatttcagaagagataagccaggatcatggtcatatggtctgaactacacagtttggcattctaaacataacagttgtaacaagatatgggtgagcctttaaatttttatgtgggtatttggtatgaaagacacttgtaaaaataaaaaaataaaatgtatgtagggaaagctctgagcttaggacactgctaccaacacctaggtctattatatttttaaacacagaactggctcaaggtagccataagaaaaccaacacactaggtgttgacaccatcagaggatttggaatgccagcaagctctattttcagcaactaccacatccttaactagcacgttcccatttgtgggggagggagctaggaggaggaaattttcacttttcctttgacttatattctgccaaaggctaacttcatttgaaaaaaaaaaattcaacctcctagagacgtagatctaagctatctctgtgataaaaagctggacaacgtttaggaaactgttgtatgagtctaaatgacaaaatctagtaacaaatggccattaagtagggtgaccacaaggcaagtttgttgcccaggacaatcccagtttatgcctgctgttgtagctgatgaattagtctgtcttttcaagatatactcatgtggatgttaaattatggtgactttcattattatttgctacaatttaataaatttaaatgaacatctgaaattgttcttagggccatgactagcattaacatttagtcagagaaccatgaggttctgttggcaaccaattcgtcaatttggatatatcaatacctaaatatatcaagctggccgggcgcagtggttcatgcctataatccctgcactttggggaggccacagtgggaggatcgcttgaacccaggagttacctggacaacacagtgggatcccgtctccacaaaaaaaaagttttaattagctggtcatggcggtaccagctacctggtgggaagatcacatgagctcaggagttcaacatcagcctgggcaatccgctgggaccaggcctctaccaaaaaaatttttttgccagccatggtggctcacgcctgtaatcgcaaaactttgggaggccgaggcaggtgaatcttgagctcgagttcaagacctgggcaacatggtaaaatcctgtctctacaaaaattagccagaagtggtggtatacttctgtagccccagctacttggcatgctgaggtgcccagggggtcaaagctgcagtgagccataaatgtgacactgcatcccagcctgagtaatatactgagatcttgtctcgggaaaaaagaaaaagaaaaagaaaaaaaagttcttttaaattatccaggtattgtggtgcacagctgtgggcccagctaagtgggaggctgagatgggatgatcatttgggcctgggaggttgaggatgcagtgaatcgttactgcatcaatgcaatccaagcctggccaacaaagcaagaccttgtctcaaaaaagtatatgtatctatctcaaactgttaactgaccatttcaaaaatagtgaaaatagccatttttcttgctgctctttcctactccttaatggattccattagacagctatctagccaaccacccggaacaacactggtgaatcatatgccaacctttgtccctcctagaagttgtatgtctatatctggccgggtgcggtggctcacacctataatcccagcattttgggaggctgaggcaggcggactacctgaggtcaggagttgaagaccagcctggctaatatggtgaaactctgtctctactaaaaatacaaaaattagccaagcatgatggcccaagtctgtagtctcagctactcgggaggctgaggcaggagaatcacttgagcccaggaggcggaggctgcagtgagccaagatcacgccactgcactccagcctgaatgacaagagggaaaatccatctcaaaaaaaaaaaaaagttgtatgactacatcactaacctaacaacttaatagcattcactaagacaaaggtggccgggggtggtggctcacgcctataatcccagcactttgggaggccaagtctgacagattgcttgagtccaggaattccaagaccagcctgggcaacatggtgaaaccccatctctactaaaacacaaaagaaattagctgggagtggtggatcgcgccactgtactccagcactccagcctgggtgacagagcaagactccatctctccaaaaaataaataaataaataaataaataaataaataaataaaatttaaaaacatacaaacaaacaaaaaaaacagctacttaagaggctgaggtggggggatcacctgagactggaaggtagaggctgcagtgagccaagatcgcaccactgcactacagcctgggtgaccaagtgagaccctgtctcaaaaaaaaaaaaaggaaaaagataaaagtgagaggagaaaatattttaaagctactttacagaaatgcatagcatcagccatatcccagtacagacattatgataaactacggggcttttcttttcttgagacaggctctccctctgtggcccagactggagtgcaatggtgcgatgtgggctcactgcaatctccacctcccagggtcaagcgatttcccacctcagcctcctcagtagctgggactaaaggcacaagccatcacaggccagctaatttttgtatttttagtagagactggttttcaccatgttggtcaggatggtctcaaactcctgacctcaggtgatccgcccacctcggcctcccacagtgctgggattgcaggtgtttgagccgcggaacccggctggggcttttctttttttggttgtttttttcttttgcttaaagaggtgacatctgcctacaataaatcatgttttttaagaatctgtatgcgaataaacattctgagagtacctaaacttcacctcattttaatttcgctgtgccttgagatgggattttatctctgaaaaaaaccatcaggtttctttaggaaagtgaaaagattttgtctacaattcaccatggatatcagtcatcacaaacatcaagatgtgaagtagatgctattagaattgttaaagaacaagcatcaagcatacgctactcaccccctactcccctgaaaggcaccaccttacttcacagaggtcttttgagtggctgagagtaagtgtaccgatctaaaggtcagcagacactaagttctggctttaccatttaataactgattagccacatgatcataaaaaaatctctctctcaaactcactttcttgaaccagaaaatgggagtaacgctctacctgcttcaatcttgttacataaattaaaaacttttgtcaacgtgggctgtgaactgaggtactgcataatgtcatatacacatatgtaaagtttaggccagaagcagtgactcacacctgtaatcccagcactttgggaggccaaggtgggagtccaggaattcaagaccagcctgggcaacatagagacctcaaatccacaaaaaaaaaaaaaaaaaaaaaaaaacacaaaaattaggccggtgcaacagtcccagctactagggaagctgaggcaggagggtcactggaactcaggaggtcgagcctgcagtaagctataatggcgacactgcacttcagcctgggtcacaaagcaagaccctgtttcaaaaaaaaatttttttttaatttagccttcccataaatacatacacctaatatgtgcccattaaaaaattaaaaatttaggccaggtacagtggctcatacctgtaatgctagccctttgggaggctgaggcgggaggatcacctgaggtcaggagtcagagatcagcctggcaaacatggtgaaaccccatctctactaaaaatacaaaaattagccaggtgcgatggcgggcgcctgtagtcccagctactcgggaagcagaggcaggagaatcgcttgaacccagggggcagaggctgcagtgagccgagatcctaccactacactccaccctaggtgacagagcaagactgtctcaaaaaaataaataaaaataaaactgcagcctttactccatgcttgtcattactgtttgtgtacacagtgttcttgaaatataaagaaaaaatatgcctgcagtatcagtcacccttacagtcatccatgaaaaaaaaaaacaatcaggccgggtgtggtggctcacgcctgtaattccaacactttgggaggccgaggcaggcagatcacctgaggtcaggagttcaagaccagcctggcaaacatggtaaaaccctgtctctaccaaaaacacaaaaattggctgggtgcggtggctcacacctgtaatcccagcagtttgggaggctgaggtgggcagatcacctgagatcaggagataaagaccatcctggccaacatggtgaaacctcgtctctactaaaaatacaaaaaattagccgagtgtggtggcacgcgcctgtagtcccagctacttgggaggctgagccaggagaaccgcttgaacctgggaggcggaggttgcagtgagccaagaccacgccattgcactccagcctgggggacagagcccagtcgtagaagggatttttaacactacgttactcagttctgtctatgcatttaagaaggagaaaaataaactttactccagaaagttagtccattaactgaaacggcaatggaaaattactggcctacagtcaaagaactggtagttaatctaaatacttctaaacttattaacaacgttaatttactactacctatttttttcctaacaagaccgtagtaaaaagttcattccacacatgctcccttccctgttcttcactaactagcagaataagctagctagagatgaggatctggtgttttaaaaggacagctctcagcgggctcagtggctcacgcctgtaaccccagcactctgggaggccgaggcgggcggatcacctgaggtcaggagttcgagatcagcctggccaacatggcgaaaccccatctctactaaaaatacaaaattagcctggcatagtggcggatgcctgtaatcccagctactcttggaggctgaggcaggagaatcgcttgaacccaggggatggaggttgcagtgagccgagatcgcgctattgcactacagcctgggcgacaagagcaagactccgtctcaaaaaaaagacagctcttgaccaggcgcggtggctcaggtccttaatgtcagcactttgggagactgaggtgggcggatcacctgaggtcgggagttcgagaccagcctgaccaacatggagaaaccgtgtctctactaaaaaagaaatacaaaattagcatggcatggtggcacatgcctgtagtcccagctactcgggagggtgaggcaggagaatcgcttgaaccctggaggcggaggttgcagtgggccgagattgtgccacttcaataaagcctgggagacagagcgagactccgtctcaaaagaaaaaaaagacagctctcaagtaaatgactcaacagatgcattcctagggaatccaacatgaccatcaaaacttcatcctaccttccatgaagccaatcttgatagggaagagactaggaaaggacaaaaccaacaacagccccacaagcccaaatgtagtttatgttacccctctgctccccaaaaacgggtaaacttttcccctctatattccccgttttttattgttgctgttgcccaggatggagtgcaatggcgcaatctcggctcaccgcaacctcggcctcccgggttcaagtgattctcctgcctccgcctcccaagtagctgggattacaggcacccaccacccccggctaattttgtatttttactacagacggggtttctccatgttggtcaggctggtctcgaacttctgacttcaggtgatccacccgccttggcctcccaaagtactgggattacaggcatgagccaccgcacctggcctcttttttttttttttggagacaagagtctcgctctgttgcccaggctgtagtgtaatgccataatcctggttcactacaaccttcacctcccgggttcaagtgattcttccacctcaacctcctcagtagctatgcccggataatttttttatttttgtagagacagggtttcaccatgttggccaggctggtcttgaactcccgacctcaggtgatccacccgcctcgacctcccaaggtgctgggattacaggcgtgagccaccccgcccggcctttcttccccactttcttgtactatttcatatacgggacagtaagagctgtttgagaaatgctaagaaataatggacttgcttaatatggtttcaaaggaggtaaaaacgattcgaatagactactggcttgttaaagtgatgagatgctagatttaatcttcaactcccagccccaaacttaaatatttcctgtgacccaaaattgtcattttcctgaacacaggttagctcttcctcccgtactgttaaataatccatataaattgattccaacgccccaggatagaattaaatgaggatacaaagaagtttaggcactaattcaacacagcaagcaaaataaaataagcctgctgcagtaacagagagataaaagggcagctggaaacccagcatttgggtacaagtacccaacaaagaaatcctgccaatacactgtcttaccttcttccacccccgacacctgctaagttctgtttggtgaccagaactccgggaaaactttgccaccagaaacaaaaaaataccgcactcaataaaggaatggacacaggtagaggacacaggtagaaattcctggtttctgtctcctcctcctcctctcctttccactgagtccctaccttatgccccaagtcacagcaatagctcctcaccttgtagatcctatttccttacccctttagatcctgaaggggacacctaacattaacaactgtaataatgtggctgtatcagagtcccatgttcaataaccaataagggctctggtcagaaatcctcaccactcacatcaaaaatataattatcactaacctgtactttatttggaaactacaatcacaagctttcaaatcagttttttaaaggagctttcaaaaagaaaaagacctttcctcacatcctttctagttatcacagcaagtttacttaaaaagccccaatacccacaaaatagaaagcattcaagtacaatttgtttcctcccaagaacactaacagattaagaggggaacatctggagatgagggggcggaggaggagacttccaatacaagcacattcatatctctttgatttttaaacactgaaataaagacaaagcagaccttgagctgtacttccccatcttatccccccccccaacaggaaccttgttgaatacaaatagcaatttaagaatttacaagacgaaatttagttcactatatttcctaaatatgagttctagaggccttgtcttattttcaaatccctgaatcttatttctgatgataagggggactaaccctgaggttattcacatgactaaatccgcatttcgaggaaagcaagggccctaacattttgaaatataggtattttaattaggaaaaaaatctaagaatcaaagatacttgattccaaccatgtctcaccccaccctaccacgcaaaagcattaaaaccacaggacccacagacatgacctttcgtttaatactacagtatcgcacaattataaatgtgtgggtatttcaaaaggtggtccaaaaggtggactgggagagaggattaagaataaacttcctgacaatgactggacagacacaatggacattcgatgaagttctgaaaaaggactggagaacccattaggggcaaaagaacaacgaacaaagaggacctactaatatttctacataaacccatttatttaaaacggaaaaaaagaaagcaacaggatcttcaaccttcataactcaaaaaacccagcctcagccgagcgcctggaataggttaagatcccccacgaagtacagaccagcattccgagcctgcagagtcaaccaaaatacagttactgaacactattggaaataactttatttcaacaggtcttcccatttgtcatcacggtgcgcacaaactgtaaagtcatcgtttttacaaacggggggacggaggctcgggctctacaaaggctcgaactctcagagtcgtggcctcctggttctatccatcagaacccacgggtgatggagccagagaaaggttacaggaacttcgagatctcctgttttaagtctgaggaaagggagggagtgaggattttctgggcctccccagaagacgacgaggaggaaaagccccgaaacccctcactacgaggtgccggcctacgggaaagaaacccgatcgcagcatgggagcctgccaccgcccgaagacgaactgcagtgattcccactcacccctctccccccaccatcatccacgactgtcccccacctcaggcctgaggaagcccatcgctctcaaaggtcctcctttgtgagactccacggccgccgccccacacggggcctccggggaaaagccaccgcccccacccgccatatttccctgaaaggcgcccgcgctacagctcccggtcttcgctctctcccatgtggcgggtgctgcttcccccgtcaccccacccaattgttctccacatcccaaggccgtcccagaagctcccatgagggtggctcgttcggagacagcacccgccatctcctccccctcccccgccccgggactcgccctccccccagccgccattttacaaccaactcctccaccccgtcgccccggcctcccggcccgcgagttgtttgcagttaaggacggcgaaggggtcacattccagggcatagagcctcccatcgccccgggagctcccaggccatttcctgcttcccgaacccaagcccccgggccaggctcgcagacgatgccgccattttgtctcctgttcccggcctctgtgggcggcggcagagggtccgagaattccagccccccgttgcccccccaactcaccgtcgtatcgctcagcctgctcggccagcttcgcctggtacaccagatcctctcgatcatccatagcggcagcggctccggcagggtctgcgcgacggatggaagcggatagtgtctccgactctctcagcctctcgctccgcgtccgggcagcaaaaatggcggcgcctcaatccgggacttccgcctgcgcacgcggacaactgctcagctcta

SEQ ID NO: 2692 - DNA, 55724 bp, Homo sapiens; identical to SEQ ID NO: 2691

SEQ ID NO: 2693 - DNA, 11319 bp, Homo sapiens
cactcaccgcctgtccttcctgacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtgagaaggctggcaggggagcccgggccagctggctgggtgccacctaaggggttctgaacaggagggagagggagagaggaataagaatggttgcttgggagaggatggcaatggcttcgtgggggctagcagccctctggagtcagtcctggaggagccccagggtcccaagctgaatgtctgtggggcacagaaaggacgagagcctcactgctctaaagagctcccctaccgggtagggagcatgtcctgcctgtcctccctgtccccactgttgagcagatgctgggaaaacctcactacaatggtcgaggcagaaggagcagctggttgtcagagacgtcatcggggcaggataataacaggcatgagggtggggcgcagtgaaattacccagagccagggactgccctcacggatcagtcaccctcgcttgcctccacgtccattcactctcaccccacatttctggaagcccaatctgtgcggactgctaaggataaactcagaacttaggtcagtatggcagggaggatgccctcaagtcgtcttccgggagatgagaatctatttgccaggggcggaggtgggggttggtttttgtgtttgttttttgtttttttttttttttgagacagggtctctctctgttgcccaggctggagtgtggtggtgcgaacatggctcactgtagccccaacctcctgggcccaagcagtcctcccacctcagcctccgagcagctggaaccacaggtgggcatcaccacacccagctaacttttaaatattttatttatttttattattattatttttttgagacggagtctcgctctgtcgcccaggctggagtgcagtggcgccatctccgttcactgcaacctctgtctcctgggtttaagcaattctcctgcctcagcctcctgagtagctgggattacggtcacgtgccaccacacccagctaatttttgcattttcagtagagacagggtttcgccacgttggctaggctggtctcgaactcctgacctcaggtgatccgcccccctcggcctcccaaagtgctgggattacagatgtgagccaccgccccagcttacattttttgtagagacggagtatctctgtgttgcccagactggtctcaaactcctggattcaagtgatcctcctgcctcagcctcccaaagtgctagaattatagatgtgagccaccacgcctggccaagactaggatctgtcagaagtggaggaaaaggagacacagatttccccaatttactaacccccatcttccaactctccacccattcagggaaactttgggatggtcaacctcgtttaatatcttcatgcgataaagacaaaagatctacccagcacagttccccacttctcaggacagttggctaatgacattctccaggggagagctccccttggtcccttttgctggtcacacctcgctggtcacacctctatttgctaaaagaggatacctctcctttaaccaacaatcccctcttactctctagtatcttttcttctactccctcctcctgcatggattcttggctgctgtactctactctatcgctctaaactcaactctctttgagagtcacactcctctcaggctgacacacttagccattgtcacggggtgctccctctgcaacctgaaccacccctgtctccccacactcctctgccccatctaaccagcttgcttcagcggagctccctgagtctgccttccccaaatatgcattcacagctgccttccctccacctctgtgcccagagtcactctcaagaagcaccacccggtgggcatggtggcttacgcctgtaatcccaacactttgggaggccgaggcgggccaatcacctgaggtcaggagttcaagaccagcctggccaacatggtgaaaccccgtctctacttaaagaaatatacaaaaattagccaggcatagtggcgggcgcctgtaatcccagctactcgggagactgaggcaggagaacccgggaggcagaggttgcagtgaggcgagattgcgccattgtgctccagcctgggcgacagagcaagactccatctcatacataaataaacaaataaataagcactgctgtatatcacagggacacagacaggttcctgctctccctgaagcttgtgttccctttggtaaggccaccagtctcacggaagcaaggctggaagtcccacgagagcaagcactgcctgctttgttggccactatgtacccagtgctagaccagcaccttgcactaaacagacacccaattaatagtcatggaatggcagcgtgtgcctgtagtcctagtttgggcccagaaatgaaagattgcagtgagctatgaccacgcgccactgcactccagcctgggcaacagagcaagaccttgtctcaagaaaataaaaaataaaaaagtcattgaatgaagtatagaactaggcaaggcaatttcagatagaagtaggtaccatcggccgggcgcagtggctcatgcctgtaatcccagcactttgggaggctgaggcaggcggatcaccgaggtcaggagttcacgaccagcctgaccaacatgcagaaatcctgtctctactaaaaatacaaaaattagccaggcgtggtggcgcatgcctgtagtcccagctactcaggaagctgaggcaggagaattgcttgaacccgagaggcggaggttgcagtgaaccaagattgcaccattgtactccagcctgggcaacaagagtgaaactctgtctcaaaagtaaaaaataaaaataaaatgaaatggtgctggcatgaagagctcctaggcaaagcagatgccactttttataggattttcagggacaggctctatgaggtgatgtctgaactgagacccaaatgacaagaagaaggtgtgagtgttgcagacactaggggctggtagtacaaagcctaaggtgggaacaagctctacacttctgaggatcagacaggtggccggtgaggtgagatgtaatgagatgaggtctgaggagggcagaggctaggcctggaacaccctgaaaagccacagtggagtcatttgaatttttattattataagtacaacagaaaactattgaaggacttttttttttttttgagacggaatctcactgtgtcgcccgggctgcagtgcagtggtgcgatctcggttcactacaagctccacctcttgggttcacgccattctcctgcctcagcctcccgagtagctgggactacaggcgcccgccaccacgcacagcaaattttttttttttgtatttttagtagagatggggtttcaccgtgttagccaggatggtctcgatctcctgaccttgtgatccacccgcctcggcctcctaaagtgctgggattacaggagtgagccaccgcgccatgccctattgaaggacttttggcactttgttttttgacggtttaaaactttttatttaagtcacacagacaagtacccagatccttagtacacagctcaacaaacttttacaaagtgagcacatctgagcccaggtcaagaaacagatcattaccagaagcccagacatgcttctcaccacacacggaaccccagaatcacttcaccaacaagcgtaaccactattctgtcttctaaccccatagacgagtttggcttattttgcactttacacaaatggaatgatagagtatgtgtctggcttttttttgagacggagctgttgcccaggctggagtgcagtggcgctatctcagctcactgcaacctccgcctcccaggttcaaatgattctcatgcctcagcctccagagtagctggggttacaggcatgagccaccacgcctggctaatttttgtatttactttagtagagatgggggtttcgccatgttggtcaggctggtctcgcactcccgacctcaggtgatccacccacctcggcctccccaagtgctgggattacgagcgtgagccaccgcgcctggcctgtgtctggcttctttagctccatattacgtttgtgagagccacccatattatcaggtgtagctgtagttttctttttttcttatacattctattatgtgactatacctcatttatacattctactgtttgtttgtttgtttttttgcttttttgcttttttgttttttttgaaacagagtctcgctctgtcacccaggctggagtacaatggcgccatctcggctcactgcaacctctgactcccaggttcacatgattctcctgcctcagcctcctgagtagctgggattacaggcatgtgccaccgtgcccagttaatttttgtatttttagtagagacggggtttcgcgatattggtcaggctggttttgaactcccaaccttaggtgatccgcctgcctcggcctcccagagtactgggattacaggcataagccactgtgcccggcccattctactgttgaaggagatctggatcattcccagtttggtttttttgcaaataatgctgctataaatattcttgtagatgtatttaggtacaaatacgtgtgcatttctattggataaaaacctagcagtaaaactgctgattcttaagacatgcaagtattcagcgctaatagatattgccagttttctgtagttcttagtgtgagaggtctggttgctccacacgccactggaatgaagaagactcctttgaccactgtgtggagaatgggtagtagaaggtctgcaatatatacagaaaaagaccaaactgagctgggcgtggggcctcaagcctgtaatcccagcacttttggaggccgaggccagcggatcatgaggtcaggagttcgagaccagcctgaccaacatggcgaaaccccgtctctactaaaaatacaaagttagcagggcatggtggtgcatgcctgtaatcccagctactcggaaggctgaggcaggagaatctcctgaacccagcagacagaggttacagtgagccgagatcatgccactgcaatccagcctgggtgacagagcaagactccatctcaaaaaaaaaaaaaaagaaaaagaaaagaccaaactgaggtcacggaagacatccaggagagatgagagtggcttggactaggccagtggctatggaaatggagaaatatgagctgattcaggctataagcacagtgttttcttcttcatttatgatgacacttttcactaagacaaaaagatggtgaagaatgagacagagaagcacatactacaaagggaagcaaacactttaatcaaaagagtaaaaatctcaaatagggccaggtgtggtggctcatgcctgtaaaatcccaacactttgggaggtggaggcaggagaatcgcttgagtcccagcattcaagaccagcctgggcaacatagtgagactctatctcaacaaaaattttaaaattagctgggtctggccaggtgcggtggctcacacctgtaatcccagcactttgggaggccgaagcaggctgatcagctgaggtcaggagtttgagaccagcctgaccaacatggagaaactttgtctctactaaaaatacaaagttagcagggcgtggtggcgcatgcatgtaatcccagctactcgggaggctgaggcaggagaatcacctgaacacgggaggcagaggttacagcgagccaagatcgcgccattgcactccagcctgggcaacaagagcaaaacttcgtctcaaaaaagaaaaaattagctgagtgtggtggtacaagcctgtaatcccagctactctaatgctaaggtgagaggatcacttgagcccaggaggtcgaggctgcagtgagccatgatcatgccactgcactccagtctgggcaacagtgtgagaccctctctcaaacaaaagcagaaacctcagacaagtagatcattcaaaattggtaaatccaaaaggcaattctaggtgtgtttggatccacaagcctccagtaagtgacctaaccagggaggtaaagtaaggtgtcagcatgggtcctggccctgccatgagacaggaagaagagagagcaggtgtttctctgaggttgctggggatgatataatagaactgaaactctcagccctttccctggagaagcacaaaatgctgccttggatggtatgtgccagataagacacatgaggagccaggcacagtggctcatgcctgtaatcccagcaatttgggaggctgaagcaggaggattgcttgagcccaggagttcgagatcagctaggcaacatggtaagacatgaactctccaaaaaaattagccaggcatgttgttccgcacctttagtcccagctactcgggaggccgaggtgagaagatcatttgagcccaggaggttgaggatgcagtgagccatgattgcaccactgcattccagcctggatgacagagtgagatcctgtctcaaaaagcaaacacacacacacacgaaagcaagaagcaagacagctgtggaattccagagataggagacaggcaaagaacctgacctggtgcaacgaagataaaggtaacggagccagatgaggaggcttaaatgccttacaagagttaggcgttcaagttacaagtcttggccaggcgcggtggctcacgcttgtaatcccagcactttgggaggctgaggcaggcggatcacgaggtcaggagatcaagaccattctggccaacatgatgaaaccccgtctctactaaaaatacaaaaaattagcccggcgtggtggcatgtgcatgtagtcccagctactcaggaggctgaggcaggagaatcacttgaacctgggaggtggaggttgcagtgagccaagatcacaccactgtactccaacctggtgacagagtgagactccgtctcaaaaaaaaaaaaaaaaaaagagttcagtcttgatgggcttctctgtgaagagaccctaaaggatttgagcagagaaaagaccagttgaaagctatgtttaggccagatgcagtgacttacacctgtaatcccagcaatttggtaggccagggcaggaggagcccaggagttcaagaccagcctgagcaaatagcaagaccccatgtctacaaaattttttttaattagctgggaatgatgacgcatgcctgcgataccagctactcaggaggctgaggcaggaggatcacttgagcccaggaggtcaaggctaaagtcagccacgatcaagccactgcattccagcctgggtggcagagtgagaccctgtttcaaaaagaaagaaagaaaaaaaaaagctatgtttaacctgatagaggatagagtgtagggtggcatggggcaagagctatgagagtgtaatagggaggctgagaacaccctcatgggaggtgatgagggattcaatgtggggaggaactcacagattcaggagccacttaagtaaaagttgagaaaatttgatgtctttctgggtgcaagattaaagctttccagcctggctgacctagtagatgttattttttccactgatggagacaagaaagtcaaagggagatgaatttgaggaatattgtgagatgagcgtgaggctggttgaatttgagctaaaaccaagatattcaagtgaacataggatctggaggcatcagttttggaggcaacttctggcagagtgaagagctgattccctgaaaggggatgggcattgttaggaaagccacagggagaaaaaaagaccaaggcttgaatcttggaaaatgctacactccatatcagaccatccactagcactcttccacactctactgtaatcccaattcaccagacactccaacacctctatcccttcctgctgctgagggaacttataaatattgagttactctgagctggtctttttttttttttttttttgagatggagtttcgctcttattgcccgggttggagtacagtggcacgatctcagctcaccacaacctccacctcccaggttcaagtaattctcctgcctcagccccccgagtagctgagattataggcatgcgccaccacgcccggctaattttgtatttttagcagagttggggtttctccatgttggtcaggctggtcttgaacttccgacctcaggtgatccaccagcctcagcctctcaacatgctgggatttcaggcgtgaaccaccgcgcccggcctctgagccagtcttaacacctagtcagcttgttctcccattaaatcctgagaacagacctgtgaggtagatcttccagacccattttatacaggcaaaactgagaccctgagagatgaatcaattcatagcatgtgaagtagtttccctgatttccattcagtagggcacctactatgtgccaagattggggaaaataatgatattgggccctaccctctagaggccacaatctggacagagataaggtaggcacgtaaataaggataaagtaaggtgaagcccagcagctccaggagacgtagagataaggtcttctacagtccaaagggctgaaggcatcacaggcagcttcctgaaggaggtaggcactgatgcaagtcaggcctggaggatctggggggacgtgctataacaatgactcttgtcccacaggtactgtgtccggggattgcagccgttcgggcagggggcaagggctgctgtggtgctgggtgctgtggaaaccgctgcagggtaagatccagattaagaaggaattcagggctgggggtggtgtctcatgcctgtaatcccaacactttagcaggctgaggtgggagtacggcttgagccaggagttctagaccagcccaggaaacatggcaagatccctatctctactaacaatacaaaaattagccgggcgtggtggcaagcacctgcaatctcggctacttgggaggctgaggtgggagggccgcttgagcccaggaggtccaggctgcagtaagcagtgatttaaaaaaaaaaaaaaaaaaaaaaaaagaagagaaaagatacagaaattagccaggcgtggtggcgggcacctgtaatcccagctactcaggaggctgaggcaggaaaatcacttgaaccctggaggcagaggttgcaatgggccgagatcacaccattgcactccagcctgggcaacaagagtgaaactctgtctcaaaaaaaagaaaagaaaagatacagaaattagcctggtgtggtggtgggcgcctgtaatcccagctactcaggaggctgaggcaggagattacggtgagccaagattgtgccattgcattccagcctgggcaacaagagcaaaactccgcctcaaaaaaaatgtatttttattttattttacatttatttatcttatttattttagacatagtcttggtctgtcacccaggctggagtacagtggcacgatcttggctcactgcagcttccgcctccctagttcaagccattcttgttcttccagcctcccaagtagctgggattacaggcgcctgccaccacacccagctaatttttatatttttagtagagacggggtttcactgttggccagagtggtctgaaactcctggcctcaggcgatctgccccccttggcctcccaaagtgctgggattacaggtgtgagatatcgtgcccagcctcgagtcaggtttaaaataaatttcccttcaaaccccgggcttgcagttaggctaacctgaaagccagcggccgccgagattcactggggttgtagttcccccctctccccttcacccgcctacccctcaggatcattgagatctgagatttgtgggtgccagggaagggtggggtggggcctgggagtccgcagaggagcttgtgtagctaggaattccatagagagtgctgtggttctgcaaggacaggtgcagaaacagagtccgaatttctaatttttttttttttttctttttgagacggggtctggctctgtcgcccaggctggagtgcagtggtgcgatctcggctcattgcaacctccgcctcccatgttcaagctattctcctgcctcagcctcgggcatgtgccaccacacccggctaatttttgtattttcagtaaagacaaggtttctccatgttggccaggctggtcttgaactctcgacctcaggagatccacccgcctcagcctcccaaagtgctgagattacaggggtgagccaccgcgcccggcattaaaaaatacattttaacaacccgactggagcagatttcgataatgcgtgggggctggcgctgagcgtcgtcacccacaggtggggagattgggccttacctccccttccacaccacatccagatgctgcgctcggtcttctcctcggcgttcggggtgcttggtgccatctactgcctctcggtgtctggagctgggctccgaaatggacccagatgcttaatgaacggcgagtggggctaccacttcgaagacaccgcgtaaggtttagcctgtattcgtgtcctccattctctgcctcttccctcccgcccttcccccgtggactgggacacctgggcgggactcgacttcgagggcactcgctccacgtgggctacctgggccttagcaaatcccctgggacgtattcttgggggcggggtggcgcacgcgcacgctgccttctcccacgtggcctcacccctcccacaggggagcttacttgctcaaccgcactctatgggatcggtgcgaggcgccccctcgcgtggtcccctggaatgtgacgctcttctcgctgctggtggccgcctcctgcctggagatagtactgtgtgggatccagctggtgaacgcgaccattggtgtcttctgcggcgattgcaggaaaaaacaggtgaaatggcttgcggtggagttgtagagggaacctgcctggtcctggctgcgttctcaccttctcttttccgcaggacacacctcactgaggctccactgaccgccgggttacacctgctccttcctggacgctcactcccttgctcgctagaataaactgctttgcgctctc

SEQ ID NO: 2694 - DNA, 26270 bp, Homo sapiens
tttatttccttgatatacaggacagtgacaaagaacttcacatttcgtgcatttctttggtcacattttctttcattagaatgaattactcttcacttatgacttttgtgtgaacctcccgactcttcactctcagcttgttgacttgggactcagcaatgtcagcccgttccttggcctcctccagctcgtgctggagcttgcggaacttggcaaggttgacattggattgttcctcctgagaacagagatgcatttgagataacaagaaaattggacatttcctgattgttattgcttttgttacttcaggatttgcctcatgaatgagaaagaaaaaggctccgttgtccaggcatggtggctcacacctgtaatcccagcactctgggagactgaggcgggtggatcacctgaggtcaggaattcgagaccagcctggccaacatggtgaaacccccatctttactaaaattagcccagcgtagtggtggatgcctgtaattccagctactcaggaggctgaggcaggagaatctcttggacccaggaggcagagattgcagtgagctgagattgtgccattgcactccagcctgggcaacaagagcaaaactctgcctcgaaaaaaaaaaaaagaagagaaaaaggctttattatttagtaacatagttatttgagagcaaggcatcccacaaactcgcctatgtaaatgaatgtgcttatgaccctcctcaagtctctctctcacttgactctctttctggcaaactgaagaggctgcagtgataactggaagaacaaagtagcagggatctgaattcaatcttgtttctaaaaaagaaactttaaaaaataggtgcagtagtggcatttggtgccaagaaccctaaggaaggtttcagaattaacagaatgaaaaagataactgcagccaaattgaaaaaaaaagtcccaagatggatttatcatgaagttaaatgaagcttagaattcatactctcatttgcacaggtccatatgagtgctgggggttgtagaatgttctagatagggagggaagtggattgcaactaagaaacatttgtatgttaacatgtctggaaaattgcttaaagaggtctcagaagaaataaactcaaatctataaggctccagtaatttatggttcatttttctcattctaaatattcatgttcatacctaattatgtattcccaatttaaagaaaaccccctaaattctataaactttaggccccaaaaaacctggatgtgcatctgaacctttcatttccactgtggagatactcacagcctcttcagcttgtctcttgtaagctttgactttggtttgcaatttgtccaccaagtcctgcagcctgagaatattcttgcggtcctcctcagtctgaaagaggtgcaagtagatggtgccattattttaaaacaactcatgattttcttgaaaactataggcctggaagatatgaaaacactggtcacctggtaagtgagttccttcactcttctctcatgtttgcgaagacccttgacagcctcaacattgtgcttctgttcactttccacctcactttcaagctctctcacctggaagggaacaaagacgtttaccagtttggctgtaactggccacaaggaattgagtgaagttgtggagacctaccctggcctccagtttctggatctgcttcttcccacccttcagcgccagctgctcagcctcatccagacggagctgcagatccttcacggtctgctccatgttcttcttcatccgctccaggtgggcgctggtgtcctgttccttcttcagctcctcagccatcatggcagcctagttagcaaataaattttgaaaataatgaattctgatgatagcaggcagcatgcatgtgtcagtaagacaaatgctcatcttgcttacatcagtgatggccttcttggccttctcctctgcattgcgggcttcctggacgatgtcctccatctctccctggatttgggaaatgtctgtttccagcttcttcttggtgttgatcaggctggtgttctgtttcaaattaatgaaagagaagagaagcacatttacttataacaactcacattgtcattttacctagtgtacacaggcaaaaattattgatcataagaaatgtttagaataaaaaccaaattagaagataattctaagtttatgccttttctcctttctatatatagctctttaatcaaacttctaaatttaatttttgatgtcaaacatattcaactattaccattgccatttgtaagcatgaaacacagcccacaaaactcaaagtgctgtaccatggagcaccacaccacagctcatttaaaatgaatcagtaatttttagctattaactcatgttggttgactccatatttataaatgcataaatagttgtcttgttggctgggcgcagtggctcatgcctgtaatcccagcactttgggaggccgaggtgggcagatcacggggtcaggagatcgagaccatcctggctaacacggtgaaaccccgtctctactaaaaatacaaaaaattagtcgagtgtggtggtgggcgcctgtagtcccagctactcgggaggctgaggcaggagaatggcgtgaacatgggagtcggagcttgctgtgagccgagatcgcaccactgcactccagcctgggtgacagagtgagaccccttctcaaaaaaaaaaaaaaaaaaaaaaaaatagtagtcttgttgggataaaaatgagccaagaatcccttctgtttttggcaagttgatggtgtttggaatagtcaacttcagatactgttaataagaaaaatgttgcatattaatttgattttaaaattatataaagcatgcaattttaacacttctataatagttatgtttatatagtgcaactttctgaagtatacagtactatatatttattgtaaaagatagtagaacatacaaattagcagacaagaaacaaaaaataattactgtgctctcaccagagataaaggataaacttttatttatctttctggatgtttcctatatgtttatacgggaaaaaagatcacacagcctatattatttttaagttgcttttttaacttactataatataaacatcttcccatggcaataaattcatactacagtggttacatattagccattgtgaggatataccaccatttatttaacaaattcactatatacaacaaatgctaactagtattaataatggcctccatgaatttgaactaaagagcttctctttgtatcccatgaggttagcattctgtgcatatgtgatacgtaaatattatttagtggctttttgtttttctcctctattttatttgcctatctttttgtagcttagagttgcataagacaagacagctacaaatgttgtgtgtatgtttatttgtagatggtcttctgtgctttttaaataaaagtttctagaattccagattatttcaactcaacatgattatgccagcccataaatatactcgtgaaccagctaggtcccagtaaatccttacagcaccctgtacattttccagagctccaggaagggacgaagattactttttactttataaacaagcttatcttctcaaattatcttcagcttcagggagtacattttctaaaccatagtcttgaacctcacctgagtgtgcagaagttgcacacgttcactggcatccagaagctcttgctctgccattttcctgcctctctcagtccgttccagggatgccctgagctcttcaacttcagcctgcatcaggttagctctgcgctcaaccattgccagttgttccttaaggtcatcttggcctctgatggcatcatccaaatgtagctgagtgtcctacacagaaagagaaaaagcctcttactcatgctgcacttaaagcaaatgcaaacttatggtcatgtacactctttgatcttaatgacttagagtatgattagataggagcaatcggcaagtacctttaataataaattctttgtagctgagggttgcagttctactcaaaagaacatgatgttttattattttagaccctgaatcattaaaaaataccatggctagctctacaaaattttggatcaggaaagtatccttagacttcagcgagtccagtggtgctattttacatattaagcaaatgaagtccagattaatgaagtgatttaagcagtggcatgtagccaaactctttcatcacttcctctatctccctacccctcaccacagtgcttctctgcagataacaaagcaaactctgtcctgggccttccagaattaagctctttttcagttgtgtgtgtataactttgaactttgaactgattaccatgttgcttaggtgatttatgacacatagtcctcgtaaaacattaaaatttgagttacacagtagcactgagactgtacaacactatgtgtatttaccccagcataccttcagtattccttgtgtgtttctaagattccttagtgcctcagcagcctggcggttggcatggttcagctggatttccatttcattaagatctccctccatcttcttcttgatcctcagagcatcatttctgctcctgatctcagcatccagtgtactctgcattgactccacaactctgagatggttcctctttagctgatcgagttcttcatctttttcagcaatttttcggtcaatctcagatttcacctgatttagctcaagttgaatgcgaagaattttgccttcttcatgctcaagagatgccttaataaaagcaacatttatttaggttacctaaagagctttttatttctttcacattatgataatttccccaagaaggcattaaaaaacccataaactatcatacgtcttaatgtagcctattagctctgcattctcaaggtacaattcagtatttttcactgaattacttgtgttattccctaaagatttgcaacatgatagagatctcagttgctattaattttcaatttatttataatgcagagctaagcaaatgaaaaatgtacctctgcttcctctagggaagtctgtagttcactcttctcatgatcaagttgtttctttactttctccagttcatggatatgctttccaccctctgcaatttgctctgtcaggtcagaaatctcctctgtaataataaagtaccaaatttcagttaagtagaaagaaaaattgaaaagatgtctccctaccatttttgaaatagaatgattacagtgactcacgttgtaagttcttattctctcgctttagagtttcaagatgatccagggattcctcgtaggcattcttcaccttgaacagctcagtgctgagagaacgcgactccttctgggaggcctcaagttcagcctgagtttcctcatacttctgtttccattctgccagaacctggaagtatatagaaaataagcctttgaaaccaagaatgatgtcagtttcccccaaggggagctggtactgtggaccaccttgtcaaagtttctttgcttcttatcgagagctatgcaggcagcattagatcgttccacatcaatcatgaggtcctctacttcattctgtagcctctgctttgtcttttcaagagaagcacatttggaattcacagcttctacatgttcttctgcatcctgcagacgctgggctagcttcttcctgaaaattgggtcagtatgagtgaccaagagcagactcagagtcaccacagtgccctttataaagctgctgactaggaaagcatatttccccaagagttgtctacaagttgttgaatttttctaaacattttcactctcttagaattctgttttccctgttgagttcttatttttatccatctcaggtattgccaaacatatttacgaagcacctgtgtgtgtgtatgtgtgtgtatgagagaaagagaatataagttagcactagagctgagtgagcaatgtgaaaatttgctcctctttctttgtttttatttcactaagctggccctctatagtgtggcacattttcttgaactttgcctggggtgagaagtagaaaacaggaagagacagtacatttctcttttgaaacctgggatttagagatctgtaactacttgtggaaaagggctgagttttatttactttgaggaagaaatggcaaccatgaacaggaagcatatcaccaaggaatggtagcattgagtagtatctttaagcattttctagtatggttctgtttattttgcaaatgaggaaactgcggcccagagtgatatgttcaaggtcatacaatgaatcagtaactttctggatttggtggcctttgataataaatattactgcattattgcatttcccaaatttcctctaaaatcttgtctactactcttcaccaacctatgtaattcatgacctttcccagcccacactcttatctagaactctctctggaaatgcttgctacaaactctttcatcctgtttaattctaacaactactgagataaattaaatttagaaaggcttctttcactaggagtataatgctttttttccttctatgtgtaaatctgtaaatctcatgacttgtagtccgcaaacagtacgtgtaattagtgaatacatccattgatataggttgttagttgaaataatgacagcatatgacaaccttaatataaacattcaatactccatctgaggaaaaactgattattgttaattgtaatactcataataatttaccagagagtctcaatgtctcaatttttccttctattaaaagatactaattctatttaattcataaataatattctgataattaataatccatcttggtggaaagaaatttaagatgcttctggacaagaatgggtggagggatctggtctcattccattctccagtggacatacactgggctttaagaagaagaatatggtggaatccaccaacctataataaaataagctgaagtctttcatgtgtccccaagcccggaatattctctttcttctatttttccttcactgcctttacttttatttcttcctgctcccctgcactaaaagcacatacttggcctcctccagctcctctgtgcgctggatggcgtccgtctcgtacttggtcctccactgggcaacctcactgttggccttggacattcccctctgcagctcagccttggcttcctgctcctcctcatactgttcccgcagcaggtcacagtcatggcgggctgactgcagggcatgggccagagtgctcttggcctagaccaaccaaaaactatgtgatataagtttatcttctgatcattgaaattctctatgcaaagttcaatagtgtgttatgttgcacggttcaagtgattgaaagtatcagctggagaattctcaccttagtctcctcttctagctgcctctttaattcttcaatctgttgtgtaaatgcttgtttgcctcgggatagctgagaaaccatagcatctttttcatctagctgtcgtgaaaactcacctgtggaagacaaaacatcaatgatttagttctgttgtctaggtaaacaataatttaaagaatggaataacattgtaaccctcttatttcatatgatgaaaaaacccctcaagattttcagtgatgttgagaaggttatttcttgctttttaaaaaatgtatgagttttctttgatattttagaattcgagaacttttgagtaatgctgagtcacaaaaaatctcctgagcccagggagcttaattcttttccccaattgtcgcttagaatcattgcattttactgtctcataataaaaagatggaggaataagtaagacatgataaatgaatgtacagagcttgagaaattacttgtatttgataggtaggtaaaggcttgtctttcattcgtcacctctccgaaggttgatgctatttatttactgacctgattctgtgtgtaaacgtgccttctgggctgacaactcatttattaagcgttgttgctcttcttcctttgtttttatttcactaagctggtcctctagggtgcggcacattttctcaaagtttgcctggggtgagaggtagaaaacaggaagagacaatacatttttattctagaggctgggatttagagatctgtaactacctgtggaaaggggctgatttttatttacttttctatcaatcttgcatggtggctataaagtagtagaggcatttaatttggctaaataatgaacacatgattatcaaaattatattctctttgaaagtgtgaacatcatttaaattctgcatcatttagagtatggtttttagataaaccttttttgtaattacattttttttcatggtaatagtatcaaaggttaaagtgttttctacaaagaagttaagagaacttaagtgattcaatacaataatgtgtactaggagtaagtttaagcttcagatgccatctaatgtttgtgtaatttggctaaaaatagtcatatataaacttggtcattttgaattgttgcaaataaagatgaaaagggcacaagttaatgaagaccttggctttggagacagtctccatgttactagcaaggtcattgatctccatcttcagctcactcttttccttctccagcttctgcttgacccgctgaaggctgtcaatctgctccccaagctcagccacactatctgcgtgcttcttccgaagagcagctgccgtggcttcgtgctgcagggtggactcttccaggtccctgcgcattttctggaactcagcctcccgcttcttgttcatctcaatctgggctgaagtggccccaccggcttcttccagcctctcactgatctcctccagctcccgggagaggtcagagcgctgcttctctgctttggcccgggaggcccgctctgcctcgatttcctcctccagctcctcaatgcgggcctggttgtgatatgtcaacattaatgtgaatttatgtcagttttgtttcctgtaatgcccagaaaaggtggaggttataacttacctgtaattctttgatcttcttttgtagctgtattgcaagggcttgttcatcttcaatcttgccttgcagattgctcatttcaaactctttcctattagaagagcaacacattagcttataatcacttctcttaccaatcttcttttctatgtataatctaagactttttttatactgctggtgttgaaggagtgagtagtacaatgttttacagattaataattgtattagtttaattaaataaaaaggtcaaagatgtcattatttttttccatatgtcatgatgtaacattttggagatctttttagcgtatgtttcatttgcattgacatacaacaagcaggttatagctgaattataccatacttactttttgagtttctcattaagttgctgtttgtcattttctgtatccattgtggattcttgggccaattttaggtcaccctccagttttctcttggctctttctaagtccatgcaaagtttcttttcttgttccagagatccttcaagctaaatttatgatgcattttatttatttcagctcttaagcactgaaccctatgctagtagccttcaaagatacataagaaaaaaatttaaagatacaacaaatagcacaagaactttattcacagaccaagcgttaaaggcttatgactatcagtgctggtttcatgtcacaattgtttatttcattgcaaggggaaacattttctttttcacacttacatcgtccacttgctgttctagcttggttttagctttggtcagggtgttgactttgtcctcctccatctgcaggtcatccagggtctgctggtgggcctcctggagagccttcttctccttggtcagcttagcaatggtttcatccagacctgccatctcttctgtgaggtttttcacctttagattagaacagatgaccagaatgtcaatgacaacgtattatcttgatgaaaaacatgatgctgtagtatcttaggataatgtcagcgtaagatggaaaatgagaaccaggagctaacccaggcctataatggctgaaaaaataggaggtaaaggtcaagtaagtacattgaggtggtgaagactaaagagatgaaatagttatgacagtggtattttttatattcaatcatcttaagattaaatttttaattaaaatacttcagtatcaaggtgcttataaatattctaaaatggatcatgatttgtaccttgttctctgtggcatgtttctccttctcaaccttggccagtgtcagctcaaggtcatcaatgtctttcttgagctctgaacattcatcctccagtttcctcttcttggctgtcagctcagcattgatctcttcctcatcctcagctctttcagttacctctttgattttggcctcaagttggattttggttttaatcaactgatcacatctttcctctgcatcagccaaggcatctgcttcctaaagggagaaattaagcattttcatttgtctgagctatatctataagcacacaataatttattataaggtggaaatttcagtgactacctgtttggtcaacatgtataccagttgctaacttttaaaatgaaacagacaaaatgttaatactgttatctactgatcaagtataataacaaatttccttcagatattcatgtgtggcaggccaaatcaggaaaactagccctttggcaaaaatctgccactttactaacctttgcaactttggaaaaatcgcttgttcattgtaggactcagttttctcacatttaagaggggattaacttagccatttctctgccctgataaaaacaacataacttctattttatgcacaaaaatacactaaagaaagaataatctgatctgagagaaagttccataaataaaggaaaatgtctattgatatttttatgaatttgctcactgatgaccaaactgtgtgtgaatgcacatatgaacgtgtgcagcatgatatgtgactttgcatctattgcttctttatgcccgagtcttggtgtttttgaacagcaaacaatcagaacaaatgtttcagtggaaaccattcattttaaaacgttaaaagtaataagatgtggctgaactgcaatgtataatacttacagcttgaacttggagttgtaagtcatttttctcttgcattagcgtcaccatcttttcttctagttctttcctttttgcctctgtcttagccagctcttctttggttttctcaaattcttccttcatgttggccatctccttctctgtctctgcactcttgaggaggggcttgatcttgaaatacagcttcatccagggccagtgcttcacattcatgaaagcacggatgttgtactgaatgcagaagatggactctctgtaggaaaagaaaaaaagatgcaaatggagaataatgtggaaagtgatcatcactcaacaaaagtaatgactgcagtggattcatttatgaaagtgtggagcaggaagacttgtgtgtgggctctcacctcctctccatcatctttctgaactccactctcatcaggaaccctctgcatatggcttgagtgcgcgtgatgagttgagctagcttttcatctcgcatttcctctagagttcccagcaggccagctttgaagaaaaccttatgaaagaacaagttaaatatgttatttccacttacaggaaagtctaaaagtgatagaattatgacagatagaaatttggactggtgataccttggtatgaccgaatttgtactgggtgtggtcaatttcaatagaccctagaagtttctcagaagccttcttgctgtcaatgaactgaccctctgggatagcactcgcatttagaaccttgtatctgtcagaataaaaagaatataaaaatgtggtttttcttcactgaaaaaaacagtagaacatttggtagctatcattgaaaagatgatagattaagttttggtgaacaaaatgccatttaaaaagtcagtgctttatttaaaacttcggaagatatgatgaaaaacttatgataatataaacctaagcttctttcttttatgatcaattttcaaataattgcatgtcatttttcaaggaaaagtttaaaaatgttggaattatatagtgattttgtgtagactaagacattggaagggaaaaataatgagacacaaacctctgtttgaagtctgcataaaggattctgcttgggaagcctttcctgcagatgcggatgccttccagcacaccgttacacctcagctgatgcaggacaagctcatgctccatggcacctaagagaatgaatccacatgccatacttcgtggtctatcgcacacacactggagcttgtctggatatcagaaatgtcttaccaggagttttagtttcattggggatgatgcaccgcacaaagtgggggtgagtgctcctcaagttggtcatcagcttattcaaattctcctgtggaaccatatgaaaagttttaaaatcatttctagttgcatcgacatgagagtccctatcaatatttgtctttcatttcacattttaatgagctgtctcaaggaaaaacaaattatcataacagagaggaatcatataagtggagcacaggtaggaaattacagattacacaaaatcagttaatttcagtttgttattctcaagcaccaccagtcagagaaactttgtattgcgatttttgtcacatgaaggagatgtaattgaatacagtggttatttttaaaagagcatttgatttcatgtgaaatttgtacaataccagatctcttggatgtagggctcaggggcaatggttcacgtatcataaagattgatgtgaagagatatgtagtttgtttttttgtgctaattttttttcctaagccatttaaaaagtttacaaaacctttagtagtatactaaaaagtatactgtactactttattcactttcaccataaatatcttttaaaaaattttctgttttgatggtttagttttttaatgaaagtatttatctgtaattcaagaatatactgtaccctgaaaagagctgacactgtctggaaagaagaacccttctttttgccacctttctttccaccaccaccctctaaaaaacaaaatgggaaaaataaagttatttgcaactgccttttaagtactatccataaacatcaggactgccaaaattccctttagaatttaaatttgcactcattcacttgcatcattcctattctttccatatctctcctccctcaattgtagattaagaaagtctaagatttggctgactttatagtcattcatgaaaaaaccaacaacaaaagaattgtgagtgtaaggggtagatgtgggtaggggatgggactcccctactccaagtcagcaatgtctgttctctgaaggaagggccaaggagacagagtagtaatgccttgttagtgcaggcctcacttggacaacaggcagagttgcacacttggtcccaggtaggtgagcctctgctcacctgcagggaaatcctggctcccatttgcctgtgcttccatggtgttacttgcacatctggtcttagaacacttaagagaacagaacttcagttccccaagcactagggccctgacaaaggatttccttatctccagcctagctggagaaccttgaaagaaccaatactattaaaatgatagaaatgagttttatgatcctgagcaaatcacttaacctctctgagattcttgttttctcatgagtgaaatcaggctgtgggctaaatgctccatagtgtcacttagctctgaaagtctgtgactgtaagactgtatcacagttattaaatacactttctttcattaggcatgtattggccagtgtttttgtgtcaggttttgctgtaactacatttgtctctgttgaacagtgtatatctattttgtgactcttgtaacatattagtgctattaaacatgacctgcttcagcagtttgtgccccagagaagaggaaagccagagtcttcattgcagacttctggtacagccccaccacagtctcattcagggggtccttgtttttgtccagccagccggcgatgttgtagtccacggtgccggcatagtgcaccagtgagaagtgagcctcaggcttgcctttggcaggcttgggcttctggaagttgttggattttccaagatgttgttcatacagcttgttcttgaaggaggtgtctgttgccttggggaacatgcactcctcttctaggatggagaagatgcccataggctaagaataggaaaaaagggatgataatgatgagtccctcagaaagttatgctccatgtaattgatggaaaactgaaaatacaatgtttcaaaagaagactttgaatgataaattaaataggcatgacatgtgaagcagtcattatgtacccagaacatatgggaaatatacttgctagaaagactcagttaaaaaaaatacatctgaactatttggcacactttatgttcagtgtataaaatcagattctgaaaacatcacttcaaaattgaattctttattccataaatgtatatatctgactactttctttcctactgacaatataacttcctttacctcgaatctagaggtgacagaagtatgaagggaagagagattatgtgtaaggactaaaaatgatccattcctaggaggaaattgcatcttatattgtatcattaaaattctgtactttaacctatattctctaccactgtggagttaagtgatagtaatttggttttgctttctaagagtttggcttttttcttaatgtatttgataggaaagactgaaagaaaattcaacattgatgatttaacaaattcacaaattgtacccctaagactattttggtgatacagaaactgaaatactagagaataaaataaatgccttttctgaagaccataaagttttcatgaatagtagagatattatatcaccagattaacgtatcttttccccaaattgtgcagacctagtctgcttttaaactcttatctttcatatttttgtgaattttaacctgagtattttaagttttcctaggtggcaattgcatttacgcttcctttcccactgcttagggtagggttcacacatacactttattgatatcaataagtatatgacaagctcccaagatacttttggaagtgtttaacgattgcttgatgagtgttaacatatctagatctgatgtaactattgcttcacccccttagtaatggggaattcagggcccattttctaggtaagtgatacagaggtttggtgtttattcagtagttatcatgaacggggaaagacttaatgactgcaacagttgaaggactaaccttccaatctttaagacgtgttgacatagcctgccttgttacacatgagggatgatgataaatgcacaatacactgtcatgggtacaccagggttaattacacaacccagaggaatagctgtaatttcatccctttctcccatatgcatgaaatagtgtaggaagaaaagtgagggagaattaagtttttagagggataaatgcgaatccatatgtgtgtgagtgataaacatttttctacaaactgctctacttattaataacagatcacttggaacatacctcacaaccaatcagaatatacgagtgtgtcaggaaacagcactgcttgttctttgagaacagggagtgtgattaagcacagggaggcaagcaatttggttttcatgttttgaaagctagaaaagtcatatgaaccttctcgatgagctcgatgcaggcagccaggtccatcccgaagtcaatgaactcccactcgatgccttccttcttgtactcttcctgctccagcacgaacatgtggtggttgaaaaactgttgcagtttctcgttggtgaagttgatgcacagctgctccaggctgttgaactacagaacaagataaatataggaaattacgcataacaagtattctatctacagagtatctattagtattttcttctgaatttaaggcattttggtttattaaattataaaccttcagattgttttcctattatatagttctaaacaaagtagaattgattctttgaatacttattttccaagtaactgcatgagatcatgcatactaggcaaaatactgttaaatgaggactctgaaatatttccttagagtaattttaaaaaggtgttctcatgctcatctgcttggatccaggatagattttgactattttaacctctcagggatcaacttttgagacttctagactcaaaagaatagaattttctcttttcctatttatacctatttacttttcatatcttttcaaagactcctttcagtaggaattacatttgtatattttgtaaggtacattttgtaaatgtgattttgtatgctctaacaagaggatttgcactggctaattttctgtcagttcactactcacatcaaagatctcaaagccagcaatgtccaagaccccgatgaagtactgcctgggctgcttggtgtccagctgctggttgatgcgggtgaccatccacaggaacatcttctcgtagatggctttggccagagcacccactgcattgtacaccttcaacagaagtgatagtttagttttttaaattgaaaacagtgatgaactcctgagtcacttgcggttcaaataaatcagacaatttaagtcatgtttacctgctgcacagtctggcctttggttacgaactcattgccgaccttgactctgggatagcagagagatttgagcaggtcagcagagttcagacttgtcagataagcagctttgtcagcaactgtgtgaacaaggtgagaatggtgaaactgaccatggcttacacaatttaaaatgtaaatgatgatgacaaagaaaaaaggtttcactcaaaaagtaagatgtgcaaatgtcattgaaaccttttcatttgttcatattgcctcaaaagcattgccaccacttgcactaattttagtcatttcttgtgatgataaattggaggttggggaatcgatgctgtctgtgatatttaacctggcaaaagtagaccacagataaaaataatttgagaaaccctaacctagaggagtagtgacagaaatattcagatctctgtttctttcagtgcctgtgggcacacagattatcctgaaataaaatatgttttagtcaaatagcaaatatgagcttatgaaaagccaatgaataatggaatgagcagaaatcacaaatctgctaaataatgtaaaacgtcaggcagtgtgtaatttccttctcgtaatacttttgcccttcacgagctaggtcagagaaagtaaaaacacggtccctgcctctgaaaagttcactatgtcagctttgtcaagtggaagataccaacagggggtggtaccttccgtgccatctggctctgcctgctcttccctttgcttttgcttgaatttcatgttcccataatgcatcacggctccagtgagcttgtaaatggccaccttttcatcagcagtgaaacccaggatgtccacagcactctgtcaaaagagttgaatttgctcatccccaattagcaccatggaagaatccctcagaacaccggggctgtctcccacttttttctcatcacgccttgccttatatttgactagcactttgccatcttcaaaaggtactcatatgctttaccttttgatccacatggcaacacgaagaggtatgcatcagtctttccatttgagtcatgagtccatttggtcacagcatatgatgtgacttgtccacactcactgaaccaggactaagagccatgacttttgatgccaaggccagtgctttgccccttttctccaccccagcccccctttgcttctcaggcacatgctcctcttggtcttttggctatttttgtttcttttctccagtctcacgagtctctctgttgctccttcttctcctatttgtcctatcctaatgcataatcccagtctaccttcccctgctaatgggcatgagtgataaagttggaaagagggtatgaggagaacagcaatggttgtgagtctttctccacatgcctctctgatagcaagccacagctcagcgaccacgagatgcctggggtagcaaactttacctagttatttatttctcatgcagagaagagacatttatgaaaagaaggaattttgccatttagtataatatttctgtgtcttttttctctatcgaattttgattacctttttagttgcccacataggctttgaaaaggcttataaatgggggcaggattcagagcaggcagaggaaaatatgtttatttaccattcttacctaagactctttccccagattattgacttccacttccagctcactaactctacctatttacagaaactagacattattacggaagtcttagagcaagactgctacatttttttaacctcgcagaccagggtgtgtttcttaactccctatcacttttggacatacaaagataataataagttatagagagttaaagctgatatttataatataaagccacacaaatgaattattgacttcttgaaaataatattttaatagaaaaagcagttttgcaagcactgtcaactctaacttgggggtattgggatagtcccactgatattaaagttaaaaataaggaagattattcagaaatcaaaagaaagcatgaaatatacataaagtttacatataaagaaagtaagccaaaaagcaataatccttaaaaaagaggtgatggtggggagagagtgcgttgtttcaaaaataaatataaaggcttatggagtccccaaaatgagtgtttttgaagtagacaacccacttcttctaatgctgcttagggagtagagagggatatatcattggcccacagaggtttattcaaaataaggcttatgtttacatgtgactgtagaagaacagtgggagttccatgtttagttgtaataatattgcagctccttcccagaatcttgggtgtgaggtgtggcataaaatagcagagaaacattaatattggagcataaatatcaaccaaaaatgactaataagaaagatagaatgaaaggagcctactagctaaggaatactaaagacccaacatttattacaggcagtgaaagctttttaacacatgtagggggagggtattgaaatatcctacaatttttttccaaaagtaagaaagcccaaagggttgtattacctatttatagtctttctgccactgctttccaccctaatagaggagagtgttgtacactggaaaatgaatttactttttactactttgtacctattacttacatctgtggccatcagctcttcctggtcatcaatgctgggcacagtaatttccccttggctgacaaatgcgaagtcatatgggttggtggtgatcagaagcatttctgaacacatggaaaagaacagtatatagacagcattgctttggtcatcaaaaacatttcagagaggcttcttagaagggctgttattctttggtagaaataaatcaaagatgtgtcttaccaatgagctctggtttcttattggacaggatttgataaaatatgtggtagcttctttcagcctttagctgaaaagtaactcgggacttctctagcagatctggaagtcagattaagctcatttaaaagaagatgccacagtgaaaaattaagtgtttgaaaatttcacacaacagaaataagtacaagattttctaatatgtacccacaaagaaaaagattctcaatcactaatatttattaacttacatgtttcaatatctgcagaagccagtttgcctgtggcaccaaaatggatcctgatgaatttacccttaaaaaagaaaaggagggattattatacacattaaaatcagaaactatttctttagctgtggaccaaacaggtggaaaaaatattgacaccacatgcacacaagaatcagtgctgatcctcaagaaaatgaagatcaagagacttacaaagcgagaggagttgtcattcctcacggtcttggcattgccgaaggcttccagtagggggttagcactgatgatttgatcttcaagggtccccttaagagaaatgaataagacagacaaagaaaaaagttgcagtaaataatttcccattgacctctttcccttccccattgcccctgcacagtattctgtaactttgggaaaggctttctaaaatgagttaaaaagaaggtaaatcgggaaggggagtgggacactccagtgatgtggtcttgatttctgcatcccccaggcccagaaaagcacctaaaaaatgattgtgagaatttttgcctattatacttgccaatacattgccctattcatctcattctcatgagctcttccaagagttattttccaaattctggcatcacttgcaattggctgctatgattttgaagcaccacagtcagttaaaaaaattaacctttattttggattcaggggatacatgtgcaagtttgtacatgggtatattgcatgatactgagatttagggtatggatgatcctgtcatccaggtaatgagcatagatagtacccaataggtagttttttggctcttgcctccctcctacccttccccatctagtagtctccagtgtctattcttcccatctttatgcccattcatgctcaatgtctagctctcacttataagagaacatgctgtatttggttttctgttcctgcattaattctcttaggacaatggcctcctcatgttgctgcaaaaaatatgattttgatcttttttaaggctgcatagtattccatggtgtatacgtactacattttctgtatacagtctactgttgatgtgcacgtggttagattttaaaatctgttattctgtccttagatgaatatcatgcccacctgcattttgccagaggcaggttcctcttttttcttctctccagtaactgcaattgttgcaaagtactggatgacacgcttcgtgttcacagtcttccctgcaccagattctccactatcaagttcaaacagaagaaaaggtcagaatctaaggtagtagtagccactacaatgatcaaaacagaaagaaagtaacgaaatctacatacgtaatcaagattgactggttttcacgatctgtaaaagagaagccaaagataatatttagaaaaacacacttaacacataggtcaacgcagtacttataaactcaaaattgtcttttaaaactccccatttgcaaaaataactatatgaatttgtgctttgcttctcataaggtttttctaaaaataagtatcaaagatgtgctaattaataatcccattacctttctaatgtatagactatgtaatgcatcattttaccattttgtccatgagaataatctatcaatatcagattaataacaattttgtgtcccatccagtcacctggttcatagtacaaaattatgtcaatgtccaatttaaagttttgtactgtgcttgtgataacttgtcactgtgagtcttcaaaacttactttttaggagagattatgtattatctataatccaaatgcagagttgatgcctaaatttaattaattttgaggtggaactagcattagttaatttggattttagcatagaaatctaagcaaaatttcctctatttttggaactagtgcttagcatagaaatctaagcaaaacttcttctatgtttggaactagtacattttattctaaatatatttccctaattttattatttctgttatcatgtttgtgctgaacagttattctcagaatactagccctatgttttttctgatatcagtatacaactattttacaaatggctatggaaattgtaattctcactcaccagttagcatgaactgataggcattgtcagagatggagaagatatggggtggggcctcctggcgctttttgcctcggtaggctgtcaccacctcagggttgtacaccggcagccacttgtaggggttgacggtgacacagaagaggcccgagtaggtctgtgggaaaggacggggttcctcgatcagcaatcaccttgtttatctatcttggaaatactgtttaagggcaagtagagcaggacctaagtactgtgttagttctcataaagtttcattcatttgttgcctccttccatcattgctgctgcacaaaatgcttcagtttttcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggtgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccagtttttcaactaattcagttaagtaaatggttttccacatgtacattttaaaacatatcagagtttacaacattaaccaaacaattggtcataaaagaacagttcaatagccaaatgtattgaaaccccttaatttattttagctaacatgtgtagaatgtggagtgagtgagaaatagcgttgaaagggtgctcacgtagatcatccaggctgcgtaacgctctttgaggttatacagcacagcaggctcatgcaggtgagtcatcatggccatgtcctcgatcttgtcatatttgggagggttcatggagaagacttggtcttctttcacagttacagtctgttaagaaaagaaaaaacaagtgcatatcaaataagtagcagaaaaagccaggtcaaaaaaatatcacctaaattaacccaaaatgaggcagagtctaattagctccaggtgtttttactcacagctccagcttcggtcttggctgtcaccttccccccttccctgctctgcactattgctttcacgtaggactccttagggtccaccacaaagactgatgtcttggcatcaaaaggcttgttctgagcttcaattcgctccttttcagactttcggaggaaaggagcagcctccccaaaaatggccatctcagagtcagaactcatggctgcaggttattgatggcagtactggactaggtatacctagaggaagaaacagagccaaatgatgattcagggttggggtggagaattgttctgttgatttcatattaatgtgcttaattttccatgcttgtttcctcacccctgcctttagggaccactcctgtatactatgtcaaggagctgagagatcagctcattgatttgaaagcactatgttgatagcttaatttttgtgatactttaagcctaagttccatcctctatgttgtaaaccttagttgagaaatgtggaggaatcaacattcaatcagcaacatttgtgatgctccaagcatgttcagaattttttctttttcttgctacttttcttttctttcttatttccaacttccccctcttaacatcgtgatgatacaaagaaatggacaataactgtttccactggctttacaatataaatgaacctgtcttaaaaactcaaatacagatctttatgcaaattttcctctcatcccaaattattaaaattggatgtcagatttactaaaattgaatgtagacagatacacctgttctttccggacataagtccagatctaatcattacaaataaacacctagttaactgacaggtattaggtaagtaaaggaaaaaataactacaatgaaagctgaatatccaacatataattttgccctaagttaaaattaaaatctcctttattagttttgaaattgtttgaaagtcagaagtagtatctaaaccaaaaacaactttaaaagattcttggagaaaaggaacttcttaatttttaataaaattttatagtgattgtatgtgttgatctgtatttctctttgtttttagttggatttcaacctaacatattttaaaatctgattcttattttcttaggtttataatctcgttctttcttctcctctttttaaaaataccaaccagtcttctaaatatttttctgaaatggatagccagtataaagtttcaagccaaaatgaacttaaaaaattttccctactgacaaattaattatgagaaaataaaataagtcctgctgtcctgatggcaaggacagggtgagtggccagaataaaagaaggtgacctctgtggagcagaagtgtcttggttgccaatgacaatgacagcaatgatggcgacaacagcaatagccaccaccttctgtaggctttccagagtcttgatcttttgtcatcagcattaactttccctcaacttaaaatgttagctatggaatttccacatactctattttcaaaatcagtcttatctgtaaaagtgtcctgatgacactgtgaaacttagacatattttcaggggatatatattggaacatttaatgtcaggttttttttctttgaagaagaaatgttatttatattacattatattttgtttctgtgtttgtttttacaccaggcaacttgaattaacaacacactaccacgtggaggttactataatgcagtgtatccaggaaacacagaaagatgattgctacccttcccatctcctgtcttattatagattaattgtttcccaacttggggatcaagccccaatagagcctcaggttgttgcagggggttcttgaatccacccacacagtgatcattgcctcaagtttaaggaaggaacatttccacatgaacagtgttttctgttcttttctaaatgaatatagctgctatgttaaatataaactcatttaaaataattcttaagtgtagaataggttttcatgattatatatatccttaacatcatactaaaagtacatgtctccacatgaacaattagcaggattccattagttttgattctccattagcagggttccattaaatgttttgattctgtggaggagtccttgaaaaccactgacgtcaatcacagttggcaagagctggaaggaccttagcagtcaatagaatccagcctcctcgtttactgatgaggaaactaaggcctagaaaggttcagggtcattcagtgtcatagtggtgggtgataagtggcggtactgggacatgagtcctgttccgctaaatgcaggtttgttaattccacttgcaacacactgtatttcaagatacataaaggctaactggcttgacccaggcaaatagaatcagtgaaaagcctggattggcacctagaaatatcgacttccagataaacacaccttgattttatcatgcggtctctctgatatatctttatgggttaagttggagtagtagttcacattaaatattacatatgatggctgcattctttctgtagttctaacaacatgtgaaagagaagtttcattaagttttgtttgattaagtggcctgaaaagtcaaaattttatgagaaggcatttttaaagaacagctgccccgatatcctattcccaatactaaactaggaaataaaatggtagctcattaagatgtagcaatatagagattcctttgttctttagagtgtaataataaattattcttacctcttgtattatcagatgaagaaggtggcaggctcaaagcagacaactactgttgaaagaaaaaagagaatgtgggatgcttttttttccccatttaatcacaaaatactagtaactatattgtctacaatgtcgtccttaagaatgttggaaagaataattaaaatttgggaagcagtagacatcccttaaatgaaaaatcatcatcatcaggaatgtaaaagtaagtgttcttccacatatacataccttcaagaattttgaggaaggat

SEQ ID NO: 2695 - DNA, 715029 bp, Homo sapiens
tggttccgctgaggcgtggtaggaagtggctgccgtcaatcactcggggagactccaaacagtgagcctagagctggagactagcgttaaccggcggggcggccggtgagagggctggcagggctttggctttggggaggcttggggaggacgagggactggcggcgtgaggggactgggtcgggctggcaggaattcgacaggagagaggtgtcgatactggagggggaggggaacagtgcaaggggccggagggcggccgggggcagcggtggctccgtgttggaggttaagtgggcagcgccgtacgagtgtctttcaggagactggggcctgagtggctggcgagggtcgtccccaggagacagggcccttaaagggcagggcttgggagactgtggttcgagaaagcaagaatgggatgagaatgagagggctgaggggctggaggtgcaggtatcctctgaggaggtggtggctctgctccttggggcagagggtgttttggttgtaggaggtggggcgcacaggtttagagttttcacatcaggtgtgaatgctccctacttaaaaatggttttcggtgccttcaagatgagttccaggttgtgggcttccctgagccctgtaagagatctttgatattgctgtcagtcctcttttaaccttaaccaagccgactccatgctcttaaaatctcagtgattcagagggtcatgaaacattctaggatcaggatttactgatgtgacgggaaagggtaaagggctgtaacaacgtattagtttatgttagttatttgactacttgctactagtcaaataattacttgacttatttgttatagtagcagggggttacgaatgtgatttaaattgtgatttactcatagattcccaacaggtttaattggaaggtagagtgatatcatgtcacttgttccgtttggtcttgaaatattgtaccatgtgtattttcactatctcaacataaaattgcagtaaattcccatcccatgatctggttctctcacccttgtaatttatgttaacaacagaccaaggggtacagcaggagtcttccttacattgttttgtggttctgagacctggtcctattaaaaaacaaaacaggatgggcgcggtggctcaagcctataatcccagcactttgggaggctaaggcggatggattgcttgagctcaggagttcgagaccagccttggcaacatggtgaaaccccgtcgctacaaaaaaatataaaatttagctcggcatggtggcgctcgcctgtaatcccagctactcaggaggctgaggcaggagaattgcttgagcctgggaggcggagattgccatgagcagagatcgtgccactgaactccagcctgggcgacagagcgagactctatctcaaaaataataataaccccccaaacccctcattataatttgaaaaaaattaaaaacctacttcctccttttttccctttctggtgtaacaggaatttctgggaaagtttcctacatttgaggcatttttgacaagggatctctagtgagtaatcataaatcttcctccctacccccaacaacgatccatgtttttctgttttttgtttgtttgtttgttctggaaacaggttttatgaatgaagctatggctacagattccccaagaagacccagtcgttgtactggtggagttgtggttcgcccccaggctgtcacgtaagcacatttcagataaacccaatagctgaagaaaagattactcagaatactaacatttaggttttctttatgaacagtggttacttttgtaaaaatcttttaactgttggctttatgggatgaataataataattgccaagaccaaatgaagaattggagagttaagttgacgtattcagcacatttacagagtacgtgaagagcactatgctaaatcctgaagagcagtgttttcaaactccaggtttaacaaattagtggattgttaaatcagtttagtgggtcaggagttgtagtagaaaatgaaatagaggccgggcgcagtggctcatgcctgtaatcccagcactttgggaggcccaggcaggcggatcacgagatcaggagatcgagaccatcctggctaaaacggtgaaaccctgtctctactaaaaatacaaaaaattagccgggtatggtggcccctgtagtcccagctactcgggaggctgagtcaggagaatgacgtgaacctgggaggtggaacttgcagtgagctgagatcgcgccactgcaccctagcctgggcgacacagcaagactctgtctccaaaaaaaaaaaaaaaaagaaagaaaatgaaatagaatataatagaaaattagaaaatatagctgagagtttgtattgtttcatgacatgcacataaatatgttcatgtgtatgtatatatttaccagacagtgatgtaaaatgtatctcttttaacttttaagttcaagggtacatgtgcaggtttgttatatagggaaactcatgtcacaggggtttgttgtacagattatttcatcacccaggtattaagcatagtccccattagttatttttcctgaccctctccccgctcccacccaactctgataggcaccagtgtgtggtgttcccgtctatgtatccatgtgttatctataaaaggaatctcttagtctaggtctctgtcagaaagtttcaaagtaagtgtcatagtatatgtctctgtttttggcattctttgacaaagaatgtctatacttactagagtgagtttataatctaatatggtttgaagatatgtatactttttttttttttttagatggagtctcactctgttgcccaggttggagtgcagtggcgccgtctcggctcgctgcagcctccacctcctcctctgtctcccagattcaagcgattctcctgccttggcctcccaagtagctgggattacaggcgagcgccaccaggcctggccaaattttgtatttttagcaaagacggggttttgccatttggccaggctggtcttgaactcctgacctcaggtgatctgcctgtcttggcctcccaaagtgctagaattacatgtgtgagccactgtgcctggccaaagatatgtatacttgaaggctgacatgggaggattgcttgaaaccaggagtttgacaccagcctgaacaacatcctgagaccctcatgccttaaaaaaatacaaaaattagccaggcattgtggcaggcgcctggagccttagctactcgggaggctgagatgggaggatcacctcggcccaggagcttgaagctgtggtaagctgtgattgtgccattacactccagcctaggtgacagagtgagactgtgtcttaaaaaaaatatatgtctgggcgcagtggctcatgcctgtaatcccagcattttgggaggctgaggtgggcggatcacctgaggttgggagtttgagaccagcctgaccaatgtggagaaaacccgtctctactaaaaatacaaaacttagctgggggtggtggcaatagcctgtaatcccagctacttgggaggctgaggcaggagaatcgcttgaacccgggaggcggaggttgcagtgagctgagatcgcaccactgcactccagcctgggggacaagagcaagacttcatttccaaaaaataagaaaaataaatagatatattttatatgtatatatattattcttttttttttctttttttgagatgcagtctcgctccattgcccaggctggagtgcagtggcatgatctcggctcactgcaacctccgccttctgggttcaaatgattctcttgcctcagcctcccaagtagctgggattacaaatgtggatcaccacgcctggctaatttttgtatacatatatatatattttttgagacggagtttcgctctttttgcccaggctggagtgcgatggcacgatctcggctcaccgcaacctccgcctcctgggttcaagcgattctcctgcctcagcctcccgattagctgggattacaggcatgcgccaccatgcctggctaattttgtattttttagtagagacagggtttctccatgttgtccaggttggtctcaaactcccaacctcaggtggtccgcctgcctcagcctcccaaagtgctgggattacaggtgtgagccaccgcgcccggcctaatttttgtatttttggtagagatggggtttcatcaaattggctaggctgaagcaaacaagtgaataagtaaaataatgacaggctgtgattgtgcaccgtgtactacaatggagagtgacaaaggagaatacatataaggctgtcccggaagctctctcaaaggaggcagcacttaacccggagaactaaaaggaagggaaggggatgggaaggaatccagatagaaagaaaggtggtataaaggtcttgattcaaagaagaacttggtgtgtgctaggaattgaagttgcatatggctgaatcagaataaggagagtggcaaaaaatgaggttggagaggtagcctaataattttcttttttaggcctaatcgatttttgtaggtctctagggcatattgcttttttaataggatttatgataaatcatattattttcaagtgtgatttttcacatctcttgaaatggatttgaattagtattttgattttttcgttgttgtttttttgagacagagtcttgcttttttgcccaagctggagtgcagtggcgcggtcttgactcactgcaacctccacctcttgggttcaagtgattctcctgcttcagcctcccgagcagctgaaattacagggtgcaccaccaggcccagctagtttttgtatatttagtagcgacagggtttcaccatgttggccaggctggtcttgaactcctgacctcaagtgatccactcgcctcggcctcccaaagtgctgggattacaggtgtgagctaccacgcctggcctaaaatagtattttgaagaagttgtttttttccacttgctgaaatttacgtactttgtatttaaaatacattaatttagtgtccttacttaattaacagtgttatttttttccccttccctttttttgtttgttttttagagatggggtcttgctatgttgcctagtctggctgccaacttctgggttcaactccacctcagcttcctaaatagctgggactataggcacatgctactgcatccagctttccctcatttttatgcattttaatttttttccatgtcttttctataccaaaagttctgtaaaggcttaatagcttcttctaatgcctgtatctaccagaaaatgtagactgacctgctatatacaggtaagggactaggttcataaccaatttaaggagaaggtcactagatagtgagtcatcagcaatagttttacttgctctaattagggcattcttctgctctgactcaagaggaaggtcctaccttaggtctctgtcatcactcctccaaatatgacttagaagctatctctatcaaattaggagagcatgacttttaaaaagagataatgtttaaaaatgttaaaagcccatttacatttaataacatatataaagacccatgaaacgagaaagtagtttagcagaaatatcaggtgataagagttagcctttttttttttttttttttttttttttttttttttttttgccttttttgaatattatgagtgatgcctgtaatcccagtactttggaagactgaggcgggaggatcgcttgagctcagaagtttgacaccagcctgggcaacatggtgaaacaccgtctctacaaaaaatacaaaaattagctgggcatggtggcgcatgtctgtagtcccagctacttgggagcctgaggtgggaggattgcttaagccccggaggtcgagggagcagtgagccgagatcgcaccactacactccagcctgggtgacagagtgaaaccttgtctcaaaacaaaacaaaacaaaacaaacaaaaaaaccccaaaaaacaaacaacaacaaaaaacaagtgactttattaaggcttgtaaatagagcttttttcatgttctatattaagctctcctgaccagtgttgtccatttcacccttttccagagagcagtcctacatggaaagtgttgtgacttttctgcaggatgttgtgccacaggtaagtgtctatatgtgctttcgcctttccctttggtcaggagagctctgaaatgtttggtttcctaaacttgacactagtaccagcaacttccaaaaggtttttgatgttttagcatcctgagcattcgtagggtgggactacattattgtttagatgtgccgcagtgttgtgatgacagtggcataaatattattccttaggactttgccttcctaagaagaatcaaggtgaattgttagtagagatttgagacctgggactttctttcttaggtttctattttcttgtcctatttaagtgttgcctgccagaagggagaaaagcaatatacactctgcactccttaactagatattagctaagtattgtacctgaacacaaatctacatctcttttatattgagcagcatttttatgccaactaaggtatcctgttactctaactgataaaagattaagtcttttactgttccttttatataaatatgagaataaagaatgagaatagccttactgggattatctagtatactattgccaaacttaacataattatcacttggcatacttattaaaagtaataatttcctctctcagagtcttaacacaattgatttgggatggtaactggtaacttgtagcaatagtaagaatctcaggtgattcttatgaaatggtacctttgggaagcactgttctagtgggactactgaagggaaaggtttccatactttctccttatggttgtagtcttccttgactaccatgggtatgtgtaactggagtgttcaaaaaggacattcatagatccagtgtcccagctttatgagaggatcctagaaaacacagtgccttcaacctgaaaagctgagtgggaaaaaaaggagaaaagaaacagtgttatggtaatatagtagaaggaaaattaaattcagttggaggacatcaaagaaggcttaatgaatgagatgccatctgaattgaggaatagagtggaataaaatccaacaatgatcaatttagtgagaatgtaatggggacaacaggatcctagtaggtgtttgctttatttggcagagaggttataacttaacattttgcacattaggcttagagtagcttagtgattaagaacatagactttgggccgggtgcggtggctcacgcctgtaatcccagcactttgggaggctgaggtcaggagttcaagaccagcctgaccaacatggagaaaccccatctctactaaaaatacaaaaattagccgggtgtggtggcgcatgcctgtaatcccagctactcaggaaggctgaggcaggagaatcacttgaacccgggaggcggaggttgcagtgagctgagatcgcatcattgcactccagcctgggcaataagagtgaaactccgtctcaaaaaaaaaaaaaaaaaaaaagaacatagtctttgatattagatctgactttatatttcagctctgcatcttactagtttcagacaagttactgaacctttctaaacatcagtatccttatgtgtaaactcgggttaatcatcttattcgtcatgggtttgttttgaggcttaaagggtgtcatgtatataaagcataaaataaagcaaagcaaatactaagtagtctttcctggagggagcttgagactggagatccagggtagagatgtagatttttggtgtacaatcgtagtcgaaataatcagatgagccagatacattacaatttctaattgtaatggtgagacgtcgtcattttagcacctactgaccataggttgcttaggaaagcaataataggagtaactttttgttatattagacattttttttttttgagacagagtctcactctgttcccagagtggagtgcagtggcatgatcttggctcactgcaagctctgcctcccgggttcatgccattctgctgcctcagcctcccgagtagctgggactacaggcgcccaccgccacacctgtctaatttttgtatttttagtagagacggggtttcactgtgttagctaggatggtctccatctcctgaccttgtgatctgcctgcctcggcctcccaaagtgctgggattacaggtgtgagccaccgcacccggcctatgttagacattttttctactgtttggttgacatgagaacagtgctttctaacattttttttcccacatttaattcagagtcctgcgttggtactttgtggtcagacattaaaaaataatgttttctgccaatattgtgttctacctcctgctctattctgggaatcatcaaattcatggagcctaggtattctctgggtctgcaaatatcctcctaaagagagaacatgtgttgttggactggtagcagcttctttagttatcactcattgaattctagttgtgataacattgatggatggtagttgcccttggctgtgtcttgatctaataatttcacttatgaaaatttatttatttaattttttttttttgagatggagtttcactcttgtcgcccaggctggagtgcaatggcataatctcggctcactgcaacctctgcctacgagtttcaagcgattctcctgcctcagcctcctgagtagctgggattgcaggcatgtgccaacacgcccggccaatttttgtatttttagtagaaacggggtttcaccatgttagccaggctggtcttgaattcctgacctcaggtgatcctcctgccttggcctcgcaaagttctgggattacaggcgtgagccactgcacctggccgaaaatttattttaaaaaataattcaacaaagaaaaagttgaagcttagaacttttcagtatatatgaaatttttacattttcagtgtaaaaacttgtaaccagcttaaatgtcaattaataagcaaatgatgatatatcatggtccctatagaataatttgctataaataaaaattatggcaatagtacactatggaaattattttctctatagtgagcaaataagacaacatacagaatgacacctacaatgattatagctatgttatataaaattcaaaaataactttgtacttatcagtgtgtgtagtgtgttagaaaccagtgttgaaatataaaagaagtaaataaatcttttcagtagtgaggtgaaagttttgactttaaataagagggctaaatcggttgctcttgtttgaagaagggcttttaatcagtgctgggggaaaaggaaaagtgtggcagtacactgacctctataaagacatcaggtgatcctgggtgtggtggctcacacctgtaatcccagcactttgggaggcctaggcgggcagattgcttgtgcccaggagtaccagaccagcctgagcaacatggtgaaaccccatctctacagaaaatacaaaaattagctgggtgtggtggtgcacacctgtagtcccagctatttgggaggctgacatgggtggaccgtttgagcccaggaggcggaggttgcagtgagctgagatcataccactgcactccagccggggtgacagaaccagaccctgtctcgagaaatacaaaaacagaaacccaaaaacaactttttttttttaaagacatcaggtgaaaggtagaagggcaataggtgagtctgtgtcttactgagaataaaatatctaagcatgggaaaaggagatcataagaggcaaaaaatgacgtgattcacctttgtgcaaagctgtagtaaggaacacacgaagcagagctcaggtgcttcagttgtcttcccagaattttctcaaaaattctgagtaaaaaacaccatgtccactaaggagagaggaaacttgaagacatagtgaaagcatataagcctcattttgtaagacttatttccccctcacagggaaagcaaaaagaggttcaagaatcccaatacactgaaagaccttctttgaccttgttttgttctgcatatcactcagaaatcaaatgtcgcaaaggaataagtctgctaagctgaagaagaatttgaaaatgttattgcttcaccacgttaaaggaaaggaaagcctgatacaggaaaaaaggaagttgtcctaaatgcaggatagcatcctggtttggatcctggagcagagaaaggacattagtgagaaaggttgtgaaatccaaataatgtctggggtttaatagtaatgcaccagtgttacttttgtagtttcgagaaatgcaaatgttagatttgattagattagataatattaggggagaattttttttttgagacagggtcttgctctcacccaggctggagtacagtggcactatcatggctcactgcggcctcaatttcccagattcaggtgatcctcccatctcagcctccctggtagctgggactacaggtgcatgccaccatgcccagattttttttctgtagagatgaggtttctccatgttgcccaagctggtgttttttaaaaaaggtatgttaggcagggcatggtggctcacctgtgtaatcccagcactttgggatgccgaggcggggcggatcacctgaggtcaggagttcaagaccagcctggccaacatggtgaaaccccgtctccaccaaaaagacaaaaaattagctgggcgtggtggcacacgcctatagttccagctacttgggaggctgaggcaggagaatcacttgaacccgggaggtggagggtacagtgagccaaaatcatgccactgcactccagcctgggtgatagagtgagactctgtctcaaaaaaaaaaaaaaagaaagaaaaaaacatgctttatggagagatgcctccttttgaatactgttgaatactgttgatacttcatgccattaatgcttgtcttttgatccttgcaggcttccaggaagcagctgataggttgggtctagaagcttgataagagactaaaaaagtacagtaatactcacaccagtataattgccacaaacacctagcacttaatagttaaaggtagtagttgtgtttgttttctaagccttatttgttgaccagtatagcggatggttagtctttcatttgcctttgaattatagtaatgcttcaaaatagattgtgatcattgtattttaggtttctgcagttcttttttttgtgggggacagagtcttgctcagtcgcctaggctggagtgcggtggcacgatctctgttcattgcaatctctgccttccaggtttaagtgattctcgtgtctcagcctccccagtagctggaattacaggcatgtgccacacctcacccagctaatttttgtgtttttagtagagacagagtttcgccatgttggccaggctggtcttgaactcctggcctcaagtggtctgcctgccttggcctcccaaagtgctgagattacaggtgcctagcctgcagttcttttaataagttaaaaactcttttgaccaaggttatgagactcatggataatattctttgggggtaataatgttctaaaatattctagttaccaagatgtagggttggtgaagttggagaggtatagtgttggctttaagtcactttgttttgaacatcagtaatattaaagctgtaaaatatgtttattcaaatgtttctgtttactatgcaggcttacagtggaacacctctaacagaagaaaaggagaaaatagtctgggtcagatttgaaaatgcagatttaaatggtatggttttaactttttttgggacgtgtgaattaattgtttgtttggagtacctgattccaaaaagagagcctctactttagtcagattactttctcttatagtaatttttcagttttcaaaataaaaggtagcataaccgcagtacagaaactttagaactaatattgtgtaataagccttaaagtaactataacacagtgtgtaagtgttaaactttgatgaagttaaagtgagttaaaattttcttaggcagaaaaatggttttcttaaaaaaggagttattcaagtttggtcagttatataagatttataactgcaaaataatcattagtgttgaactttcttggcttgaaaattgtttttttctgaacagaattttatgctagtccaagtacctcatataagtggaatcgtacagtatttgcctttttgtaactggcttatttcacttagcatagtgtcctcaacgttcatctacattgtagcataggtcagaatttccttccttttaaaggctgaatgaggcagggcatagtggctcacaccagtaatcccagcactttgggaggttgaggcaggaggatcgcttgatcttaggagttcaagacctgcctgggcaacatagcgcgaccttgtctctacaaaaacttaaaaaattaactaggcttggtggtgtgtgcctgtagtttcagctacttgggaggctgaggtgggaggattgcttgagcctgggaggtctaggctgcagtgagccgagatcgtgccactgcactccagcctgggtgatggagtgcaaccctgtctaaaaataaataaataaatacagttaaataagtaagtaaataaaaaaaaatcatttataaaaggctggatgggctgagcactttggctcatgcttgcagtcccagcactttgggaggctgaggtgggaggatcacatgaggtcaggagttcaagaccagcctggccaacatggtgaaacctcgtctctactaaaaatacaaaattagtcgggcatagtggcacactcctgcagccctagctgctcaggaagctgaggcaggagaatcgcttgaacccaggaggtggaggctgcagtgagccgagattgtgccactgcattccagcctgggcgacagagcgagactttgtctcaaaaaaacaaaaacaaaaacaaaaacaaaacaaaagggagtctcactctgtcgcccaggctggagtgcagtggaatgatcttggcttactgcaacctgcgcctcctgggttcaggtgattctcctgtctcagccccctgagtagctgggattacaggtgctcgccatcacgcccagctaatttttgtatttttagtagagacgaggtttcaccatgttggttaggctggtctcaatctcctgacctcaggtaattcacctgcctcggcctcccaaagtgctgggattacaggtgtgagccactgcgcccagcctcctatctctttgagactctacttttgagaattgctggcttatatagtaatgctgtttttaatgttttgaggaaccaccatggttttcctcagtgaacgtaccatttttcattcccaccaacaatgtacaagggtcccaacttctccacaccctttccaacacttgttagtttcctctctctctctctctctctttttggtagtagccatcctaatgggactgggttgtggttttgatttggattttcctgatgattagtaatgtttagcatctttttatgtgcttattggccattcatttagcttctttggagaaatggctcttcatgtccattgcccattttttaattgtttttgtttgtttatttagttttaggagttttctaaatatcctgggtattaattccttattagatatatgatttaacaatattttctcctatcctgtgagttgccttttccttaaagacttttcaaatatgaagcctttttttttttttagagccaccatccacgatgagaaagtctgagtgtcgcttttacagattggtttcatttgaattttggactctctattagcttattctttcaaataataacaatttgttgggtcctctttatggagagtaaaacattagtttttaagggtgattgtttatgatatccatgacaaatattttttgaaatttttttcattttggaacattacagtgactgaaattagaagtagaagcagtaaagccccacccagagtttgcagtgagccgagaacatgccattgcactccagcttgggggcaacaagagtgaaactctgtctcaaaaaaaaaaaaaaatggagaaacacagaagaaaaagtggattggtcatttcaaagttatttcccttaccagctgtcaacaaagaaacaaaacaatagagaaataactgattggttaacatcaggttacttcaggttatcttttgttctaaagattaaaacagagggaactttattttattttattgatatatttatttatttttgagatggagtctctctctgtcacccaggctggagtgcacccaggcgcgatctcagctcactgcaagcttcgcctcctgggttcacaccattcttctgcctcagcctcccaagtagctgggacgacaggcacccgccaccatgcccgactaattttttttgtattttagtagagacggggtttcatcatgttagccaggatggtctcgatctcctgacctcgtgatccgcccgtcttggcctcccaaagtgctgggattacaggcgtgagctaccatgcctggtgaaacagagggaactttattatcatgcatgttgaatattgaaacaggactccttggccaggtgctcacctgtagtcccagctactcaggaggctgaggcaggagaatcacttgaacccaggaggcggaggttgtagtgggctgagatgtcaccactgcacttcagcctgggcaacagagcgagactccatctcaaaaaaaaaaaaaattagctggagtggtggcatgtacctgtaatcccagctattcgggaggctgaggaggagaatcgtttgaacccaggaggtggaggttacaatgaaccaagatcgcgccactgcactccagcctgggcgacagagagatatcctttctcaaaaaaagaaaaaagaaagaaaagttccatgtcaccaaactgaaactaagttgttatctgaccttaggagaaatcagaaaagagacataacagccaatttcccaaggagaatcgcttgaacgcaggaggtggaggttgcccggctaattttttgtatttttaggagaaacagggtttcaccatgttggccaggctgatcttgaactcctgacctcaggtcatctgcccgctttggcctcccaaagtgctgggattacaggcatgagccactgacttgatttatacccaggcttgtttctctcaagacactacactgagaaaggtataagtagccaaagcagtttaatattctgacatttttctgtcaaattctctaaaggtgagaatatagtttgaatcccagactacatcagatcaaattgatgctggtttactctagtataatgggaattgctttctagcctgtgcagtgaaattcttactatcccctaatcccatacttcatacttggccagtttttgtatttttttttttgacagagtctcactttttcacccaggctggagtgcagtggcctgaacttgaacttggctcactgcagccccgaccttctgggctcaagcaatcctcccacctcagcctccttagtagcttggaccacaggcatgtaccactatgcctggctaattttttgactttttgtagttggggtctcaccatgttccctaaactggtctcaaactcctgggctcaagcagtcctcctacctttacctcataaagtactgggattgcaggtgtgagctactatgcccggcatggccagttctaatatcaaggtctagtactatatttgagtgttggatttcatgttcaacaggccctttttttcagttgcaagtaattgttttaagtaaaaaagggaattatttttttttaattttggaaaaatatagcataaaatttaccattttaaccattaaaaattttaattttttttttttttttttgagatggagtcttgctctgtctcccaggctggagtgcagtggcgtgatcttggctcactgcaagctccacctcctgggttcatgtcattctcctgcctcagcctctcgagtagctgggactacaggcacctgccaccatgcccggctaattttttgtattttttagtagagacggggtttcaccatgttagccaggatggtctcgatctcctgacctcatgatctgcccgcttcggccttccaaagtgctgggattacaggcgtgagccaccgcgcccggccaaacattttaatttttaaaaaaattattgattattggctgggcgtggtggctcatgcttgtaatcccaacactttgggaggctgaggtgagcagatcacaaggtcaagagatcaggatcatcctgaccaacatggtgaaaccccatctttactaaaaaaacaaaaattagctgggcgtggtggcatgcgcctgtagtcacagctacttgggaggctgaggcaggagaattgcttgaacacaggaggtggaggatgcaacaagccgagactgtgccactgcactccagcctggtgacagagtgagattccatctcaaaaaaaaaaaatttattgatcattaaaaattgagacaaggtctcactgtgttgcctaggtgtcgaacttctgggctcaagccatccttctgtctcagcctccgaaagtgttgggattttaggcgtgagccaccatgcatggtcttaattttttttttttttttggtagagatgaggtgttgctgtgttgcccaggctgatcttaaactcaagtgatcctcccacctcggtgtcccaaagtgctgggattgcatgtgtgggcaacaatggccatcatcattttaaagtatattgtcagtattgttaaataatttacattgtcgtacaaccagtcttcagaattcttcattgtgcaaaactgaaactctgtacccattgcacaacaactccacagtctctacctcctcccagcccctggcaaccaccactctactttctgtttctatgatttttaactactttagggacctcacatgggtagaatgatagattatttgcctttttgtgattacctatttcacttaacataatgttctcaaggttcattcatgttgtagcatgtgtcagaattttcttcctttttaaggctgaatcatgcttcattgtatgtatataccacatttttttttttttttttttgagatggagtctcgctctgtcacccaggctggagtgcagtggcgtgatctcagctcactgaaacctccatctcccaggttcaagcgattctcctgcctcggcctccttagcatctgggactacaggcgtgcgccatcacacctagctaatttttgtatttttgtagagacggggtttcatcatgttggccaggatggtctcttgacctcgtgatctgcccacctcggcctcccaaagtgttgggattgcaggtgtgagccaccgcgcccagccctgtaccacattttattttattcattcatttattgaaagacatttgtgttgcttctaccttttggctttgggaacaatgctgtaatgaacatgggtgtacaaatatctcttctagtggaattgttgtatcatatggtaattcttttttaaattttttgaggaaccaccatactgttttccatagaagatttaaaattttatttttagagacaagtcttgctgtgtcattcagggtggaatgcagtgaaatgatcacagctcactgcaactttgaactgctgggctcatatgatcctcctgccttagcctcccaagtagctagcactataggcacatgccaccatgcccagcttatttttaaattttttgtagagatgaggtcttgctatgttgcccaggctgatcttgaactactggcctcaaggaatcctcctgcctcagcctcctaaagtgctgggatacaggcatgagccactgtacttgggctcataggggatttaaaaataatctactcatggatctgggaaagattggggcttcatacttttaatctttgtccacttcttgtcactacttctttctgaatgtttgcatctcttctttgacttctttaacaaagagacagttggtgcagtggttactcaaagctctttattcatacctttatgattatatgatacaatcaaagaggaaaaagtattcattaggagatccagatggctcagtctgagtcactctcccattattggaatagttgctgtggccaaggatgtagtactagaattgctcagctggtcatgtgcctatccctgtgcttgatggaggataagattagttaccagaatagagggagttacagagtagaaagtgtgtgaggtacacaaaggtaatagctgctacagctgggcacagttgcatgcacctgtagtcccagctgctcaggaggctgaggtaggagaatcgctcgagtccaggagttctgagctataatgtgctatgccgattgggtgtctgcactaagttcagcatcaatatggtgacttcccaggagtggggaactaccaggttgcctaaggaggggtgaaccagcccagttcagaaacagttaaaactcccatgctgatgagtagtgaaactgcatcagtgaacagccactgcagtccagcctgggcaacatagtgagaccccatctctaaaagaaaatgctgctatcagcttctattgctttagaagcttgggtcccttagctacctgaagatgcctcctagacatcctcacatagatgtcccacagatgcctcaaactctgatttcttttcccatctaattgtctctccttagcagctgtgcactgaccctatttacctttcaggtcattaaagccacagaacttttcatgcctcaggatctttgcaaaggggaccctctaggtgaaatgttattttctgcccctatcattatttaccttttagagtgtacaaaaatgacttgaaaggctgggcgcggtggctcatgcctgtaatcccaggactttgggaggccaagacgggtagatcacttgagcccaggagttcaagaccagcctgggcaacatggcaaaaccccatctctacaaaaaaatattaaaaaattagctgggtatggtggtatgtccctgtagtcctacctactcgagaggctgaggtgggaggattgcttcagcccaggaggtcgaggcttcagcaggctgtgtttgtgtcactgcgcttcagactgggtgacagggcaagaccctacctctgaatgaatgaatgaataaatgagggagggaaggagggaagggaggaaggaaaagaaagaagcaggtttgggaagaaagattcagttttggctgggcgtggtggctcatgcctgtaatcccagtgctttgggaggccgaggcaggtggatctcctgaggtcaagagttcaagaccagcctggccaacatggtgaaaccccgtctctactaaaaatacaaaataaataaataaataactaaaaaataagctgggcatggtggcaggtgcccgtaatcccagctacttgggaggctgaggcaagagaattgcttgaagccaggaggtggaggttgcagtgagctgagattgcaccactgcactccagcctgggtgacagagtgagactctgtctcaaaaaaaaaaaaaaaaaaaaagattcggtttcactttacaccttgacttttgaggtgtgaatagaaatccagtatccctatcctcccaccagttgcaaacagtcttctaaggagggagagtatactgagtgcagtcatggaagattcacagataagttaagactggacaaggttttgaaggatgggtgaatcaaaggaagggaggacattgtagttggctgaaaccatgcaagaatgctagatgtctctataggaaagaccgtaaagttcagatttagaggtagaataagaaaaaagaagccagtaaagaaaataggccgggtacgatggctcacgcctgtaatcccagcactttgggaggctggggcaggcagatcacgaggtcaggagattgagaccatcctggctaacacggtaaaaccccgtctctactaaaaatacaaaaaattagccaggcgtggtgacgggcgcctgtagtcccagctactcgggaggctgaggcagaagaatggtgtgaacctgggaggcagagcttgcagtgagctgagccgagattgcaccgctgcactggcctgggtgacagagcgagactccgtctcacaaaaaaaaaaaaaaaaaaaaaagagcagcagtggagaaaataaatagtgattctatgatagaggatataaaatgaaaggaaagccaaggaaaaaggatttacttaaatgtataataactttgaggaataatataacatttctacaaaattaaggtttttgttcaagaacaataaagtctggccaggcctggtggcttatgcctgtaatccagcactttgggaggttgaggcaagagtactgcttgagcccaggagttcgagaccagtctgggcaacacagtgaaactctgtctgtatttacaaaaagaaataataataaaagaaatctgctgtatcaccaccatccagagaaagtgactaagtgaaatctaaaataagaaaaaggagattttgtatatattatgacctcaggggttttatgtgtggcatttgaacctgggatcaagatggtacttgtggtagaaagatgattggattgagtatcaaaaagccctaagatttctcattcagttatgagtaaagtatacctaacttgtttttgccaatgataaaatgaagttgacctctctgcatataaaaaaggattccagggccaggcacagtggctcacgcctgtaatcccagcactttgggaggctgaggcaggtggatcacctgaggtcaggagttcaagaccagcctggccaacatggtgaaaccccatctttactaagtaatacaaaaattagctgggtgtggtggtgggcatctgtaatcccagctgcttgggagactgaggtggagagaattgcttgaacctgggaggcagaggttgcagtgagccaagactgcatcactacactctaaccttagtgacagagcgagactccgtctcaaagaaaacaaaaacagaacaaaaaacaaaacaagaacaacaaaaaaacaggattccgtctcaaaaataaataaaacagaattgatatgtcagatttgatgatgtacacaaaagcacatagaaacttataaaacaccatttgtttatttatttatttacttatttatttatttatgagacagagtctcactctgtcccttaggctggagtatagtgacacaatcttgactcactgcaacatccgcctcctgggttcaagcagtcctcttgcctcagcctctccagtagctaggattacaagcatgcaccatcacgcccagctaatttttgtatttttagtaatttttgtattttagtttcagcattttggcctggctggtcttgaacttctgacctcaagtgatctgcccacctcagcctcccaaagtgttgggattacaggcgtgagccaccacgcccagccaaaaacaccatttgaatgtcaggtgtaaaaataattatgccctaggtacataagtttataattctgaattttgctggatatggaatcatgtactattaacatggcaacagtgaattcctgtcaaaagaaaatgggcattaaagaattactgatgtattagccatttaataattttgatttttatctttgagaataggaagtcattaatacgggagatggaggtaaagaggtatgtcattattggtgttttaaaaagagcagttggctgggaggtagggattgcagtgagccgagatcgagccactgcactccagcctgggcgacagagcaagactccgtctcaaaaaaaaaaaaaaaaaaagagcagttttggctgggcttggtggttcacacctgtaatctcagcactttggaaggccaaggtggaggactgtttgaggtcagaagtttgagaccagcctgggcaacagagtgaaatcccatctctacaaaaaaattaaaaaagtagccaggcatggtggcacgtccctatggtcccagctacatgggaggctgaggcaagaggattcctcgagcccaggaggttgaggctgtagtgagtcatgtttgtgtcattgtactccagtttggacaacagagtgagaccctgtctcaaaaaaaaaaaagaagcagttcaactcttacgtgaagtttggtgagcagtggtggaagcaggaagccatgtatgcttttggagtagctgttgtagcttagacagggtggtggtggtgtaagaggaatgaagagaactgtttaggaagacacagggacttgggatagatttactggtataggtgaggaagaaagtggttcctggctttgccaatggggtaatgatgcttttcaccaaaataagggaccctggaggaaaatcaggcttggtgaggaagtcatgatctttgagtggagtttgcactcctgtggagacatccaaactctatattgaggaagtcactagcagatactagttgaagtaatgggtggaatgagttaacctaggagaggatatatggtaagaaatggaaatttagaaattggttttgagtaactccaatatttagagactaggtagaaaagaatgctccagcagagagaatggtgaaggagtgactagagaaagtgaagaaaagttagaggattatccctgaaagaccaagggagagtattttaaggaataaatggtgaccattggttctagttgctgcgcagtctaaaaagatgtgcttgaaaattatctattggattgaacaacttagagattattggtgaccattagtggtgaccagaaatgggaggagtgttagggacattctgaagtgggtttggggtaaatgttagatgaaaaataatgacagttgtgaataacccaattaaggaatttagcttctagaaggagaggggaggctgggtgtggtggctgacatctgtaatcccagcactttgggaggctgaggtgggcagatcacttgaggtcaggagtttgagaccagcctggctaacatggcaagaccccgcctctactaaaaatacaaaaattagccaggcgtggtgacgcacatctgtaattccagctactcaggaggctgaggcactagaatcgctttaactggggaggcggaggttgcagtgagccgagatcacaccactgcactccagcctgggtgatggagtgagtctgtctccaaaaaaaaaataaataaataaaagtcggagaggagagcgatgaaatcaagtcgaggaagaggaatgtttattgctttatgattttggaaaacatttattgtacaaaatatggcaaataacacaaaagtatagattagtgaatgagtttttacaaatccaatgcttatgtaaccaacaccaaaaaaatagaatatagttgaccctttaataatgtgggtttgaactgtgcgggtccactttagttatacccaaactttttggaataaatacattggaaaattttttggagatttgtgtgacactttgacaaaacttgcagatgaaccacatagcctagaaacatcaaaaaaattaagaaaaagatatgtcatgaatgcataagatgtatagatactaacctattttatcatttactataaaatatacacaaatctaggccaggcacggtggctcacgcctgtaatcccagtactttgggaggccgaggcaggtggatcatttgaggtcaggagttcaggactagcctggccaatgtggtgacactccatctctactaaaaatacaaaaaaaaaaaaaaaagaaaaagccaggcgtggtggcacacgcctgtaatcccagcttcttgggagactgaggcaggagatgcgctagagcccaggaggtggaggttgcagtgagccaagattgtgccagtgcactccagcctgggtgacagagtgagactctgtgtcaaaaaaataaaaaaagaaagaaaagtatgtctctctctctctatgtatatatgtatgtatagatacacacacacacacaaatctattataaaaagttaagatttatcaaaatgtacacacacacttaacagacagtacatggtgccatctgtaatcatgtaaacgtatagatgtagttgaattgaatgcaattgaattttaactgcataaaattacctgtagtacatactgtactactgtaataattttgtagtgacctcctgccgctgttgcagggagctcaagaattgcgagtattcgcttaaaatcatctctggtgagcagtttatctttctagtaaattgctgtgtcaaagtaaaaagtgatctctttagattctcacctattttgcatcatgttaattgtaaaactataaaccttgaataccacgatgggacccatatgaagtgcccactagtgatgctggagattctcccaagaatcagagagaagtcatgacatcatgataaaaagttgaattgattgatatgtactgtagattgaagtctgcagctgtgattgcccaccatttcaaggtaaaggaatctggcctaaggactattgttaaaaaagaaaaggaattttttttttctttgagacagcgtcttcctctgtcacctaggctggagtgcagtggtacagtctcagctcagtgcagcctccacctctggggctcaagcaatcttcccacctcagcctccgaagtaactgggactgtaggcgtgtgccacagcgcctggctaatttttgtatttttttgtagagatggggttttgccatgttgcccaggctggtctcaaactcctgagctcaagtgatccgcccaccttcatctcccaaagtgctgagattacaggcgtgagccaccatgctcagtccaaggaaaggaaattcttgatgctgtcattgcagtgacaccagcaggcaccaaaaccttgcacattttgcttaatacttttttatctcatattgaaaatgcaggctgggcgcggtggctcatggctgtaatcccagcactttgggaggccaaggtgggtggatcacctgaggccaggagtttgagaccagcctggccaacatggtgaaacaccgtctatactaaaaatacaaaaattagctgggtgttgtggcaggtgcctctaatcccagctacttgggaggctgaggcaggagaatcatttgaacccgggaggtggaggttgcagtgagctgagatcgtgccactgcactccagcctgagcgacagagtgagactctgtctcaaaaaacagaaaaaaagaaaatgcagcttttaggccaggcgcggtggctcacccttgtaatcccagcactttgggagactgaggcgggcagatcacttgagctcaggagttcaagactagtctgggcaacatggcaaaaccccgtctttatgaaaattagctgaatgtggtggcgtatgcttgtattcccaggcaggagatcgcttgagcttgggaggcagaggttgcagtgagctgagatagcacattgcacttcagcctgggcaatgggagtgaaaccttgtctcaaaaaaaaaaaattaattaaaataaatgcagcttttacatgggtgcaggatgctgtaagaaagacttacctagccgggcgcggtggctcacgcctgtaatcccagcactttgggaggccgaggcgggtggatcacgaggtcaggagatcgagaccatcctggctaacatggtgaaaccccgtttctactaaaaatacaaaaaattagccgggcgcggtggtgggcgcctgtagtcccagctactcgggaggctgaggcaggagaatggcgtgaacccgagaggcggagcttgtagtgagccgagatcatgccgctgcactccagccgcctgggcaacgaagacagacaccgtctcaaaaaaaaaaaagaaaaaaagaaaaaaaaaagaaagacttactatagactctaatatgatttgagaaaaagcgaagtcattatatgacaacttaaagcaaaaggaaggtgaaaaatctaaaactggagaatttaatgccagaaaagggtggtttgataattgtagaaagaagtttggtttaaaaaatgtcaagataaaaagaagcaacttctgccgaccaagaggcagcaggggagttcccagataccattaagaaaatcattgaggagaaaggttatctgcctgaacgagttttttaatgctgagagaagtgccctattctgggaaaaaaatgccacaaaagacatttattagtaaggaagagaagtgcacacccggaattaacgccaggaagggatagactaactctattgttttgtgcaaatacagtcaagtttataatcaggactgtccttatctataatgctgctaacccctgagccttggagggaaaagataaacagcagctgctagtcttttcattgtataacaagaagacctagacagtgggaaccctttttctggattgactccattgatgcttgttcccaaagtcaggaagtacctggccagtaagagactgccttttaaagttttttttgaggctgggtgcagtgcttcacgcctgtaatcccagcactttggggggccgaggtgggtggatcacttgaggtcaggagttcgagaccagcctggccaacatggtgataccccatctctactagtacaaaaattagccgggcatggtggtgcgtgcctataatcccagctactcaggaggctgaggcaggagaatcgcttggaccagggaggcagaggttacagttagctgagattgtgccactgcactccagcctgggagacagagtgagactcagtctcaaaaaaaaaaaaaagttttattgatattgcacagtgcccatggccaccagaaatgtcatgaattcaaccccaaaagtatggaagtggtctacttgcccccagacacggtgtctctatcttgttgttgggcctctagatcaaagggccacatggaccttttaaggctcaccacacatgatactctatggaaaggattgtcaactctgtgaaagagaaccctgatagaacatcaggaaagtgtggaaggatcacaccattgaaggtgccatcaatgttacagaaataaccatgaaagtcagcaagcttgaaacaataaattcctgctggggaaaactgtccaaatgttttgcatgacttacaggatttacgatagataccatcaagaaagtcatgaaagagggccgggcatggtggctcatccctgtaatcccagcactttgggagacccaggacggcagatcaccttaggtcaggagttcgagaccagcctggccaacatggcgaaaccctgtctctactaaaaatacaaaaattatccagatgtggtggcgcctgtaatcccagctacttgggaggctgaggcatgagaatcgcttgagcctgggaggcggagtttcagtgagctgagatcatgccactgtattccagcttgggtgacagagtgagacttgtctcaaaaaaaaaaaaaaaaaagaaaagaaaatcatgaaagaagttgtagatatggcaaaaaagatgagatgtgaagcatttcaagatatctgttttggagaaattcaagaactaagacaccacaccagagaagttaagagaagacagcttgatggagctcagtgcttccaaaccagtgccagatgatgaggaagaagatgtagaggaaacagtgccagaagactgatgttagacagtctgccagaaagcttccaattatttaagactgcttttggcttcttttagacatagatctttctataatactggcactgaaatgaaagcaaatgatggaagaaggattggtactgtatagaaacatttttagagaaatttgcaaaaatgtcagagaggaagtacagtatatttccataaagttatactgagtgtgcctgcctctattgccctcccttccacctcctccatctcctctgcctctgttacccctgagggagatgaccgacccctcctgttcttcctcttcctcagcctactcactgtgaagacaaggatgaagactttttttttatggagatggagtttcgctgttgttgcccaggctggagtgcagtggtgtgatctcggctcactgtaacctccacctcttgggttcaagcaattcttctgcttcagcctcccgagtagctgggattacaggcacccaccaccacgcccggctaattttttgtatttttagtagagatggggtttcaccatgctggccaggctggtctggaactcctgaactcaggtgatctaccctcctcagcctcctaaagtgctgggattacaggcctgagctaccgcacccagcaggatgcagactttttttgatgatccacttccattaatggatattttctcttctgtatattcgaagaatacagtatataaaacatatacaaaatatatgttaattgactttattttaacagtaagccttctggccagcagtaagctattagcagttaagtttttgggtgagtcaaaagttatacatggtggctcatgcctttattccctcccagcaatttggaaggccgaggcggatggatctcttgaggccaggcactcaagaccagctgggacaacatgacaaaaccccatctctactaaatatacaaaaattagccaggcgtggtggagactacagtgagctgagattgtgccactgtattccagcctggacaacagagcaagactctgtctcaaaaaacaaaacaaaacaaaacaaccccaaaaacttacactatacttttttttttttttttttttggtggagacagggtctcactctgtcacccaggctggagtggagtgcagtggtatgatcacaccatactgcatccttgacctcccgggctcaagctatcttcccatttcagtctccccagcaactgagactgcaggtgcttttcaccaagcccagctaatttttgtattattattattatttttttgagacagagttttgctcttgttgcccaggctggagtgcaatggcttgatctcggcttacctcaacctctgcctcctgggttcaagccattctcctgctgcagcctcccgtgtagctgggattacaggcatacgcaccaccatgcccggctaattttgtattctcagtagagaccgggtttctccatgttggtcaggctggtctcgaattcccgacctcaggtgatctgcctgtctccgcctcccaaagtgctgggattacaggtgtgagccaccacgcccggccaatttttgtattttttgtagagatggggtttcgccatgttgcccaggctggtctcagactcctgggctcaagcggtatgcccaccttggcctcccaaagtgccgggattactcagtctatacgtggattttgactgcattgggggatggggggtacttagcacccctaccctccacattgttcaagggtcaagtgtacttttccccttccaatctttacatcatttatttttctttcctaattgcactgtctagggcctctagtacagtgttgaatataagttttaagtttaggcatctttgtcttgttctgcctcatagggaggaagcattcagtcttttaccataaatatggtgttagcttagtattttcatagacatcctttattcttgatttgctgagtttttaaaaataaaataactattgcattttagcaaatgcttttttaacatatattgaaatgatcatatgattttttgcctttattctgttaatgttggcaaatgataattgatttttccgatgttaaaccatcttacatttgtgggataaaccctatattttagtgattgattatcctttctatattgtgggattcaatttgctagtctttgtaaagtatttttatatatacattcatgaggtggattgatttatagttttcttgtaatttcttagtctggttttggttgcctcagaacgatttggtgcttattcccttctcttctgttttttagaaaagtgtgtaaggccggaagtgatggcttatacctgcaatcccagcactttgggaagccgaggcaggtggattgcttgagctcaggagtttgagaccagcctggcaacatggcgaaaccctgtctctacaaacatttacaaaaaattagctgggcattatggcatatgcccgtagtcccagctgcttgggaggctgaggtgggaggatcacctgagcatagaaggttgaggctgcagtgagctatgatggcaccactgtactccagcctggatgaaggagtgagattctgtctcaaaaaaaaaaaaaaaaaaagtttgtggagaattgatgttattattatttttagagccagggccttactctgtcacccaagctggagtacagtggtgccatcatagctcaccacagccttgaattattttgcttaaaggctccttccacttcagtctccagagtatctagtactgtaagtgtgtgccaccaagcccagctaataataataataattactattttcgagacggagtcttgctgtgtcacccaggctagagtgcagtggtgcaatcttggctcactgcaacctctgcctcctgggttcaagagattcttgtgcctcagcctccccattagctgggattacaggtgcggcaccacacccgactaatttttgtagtttttagtggagatggggtttcaccacattggccaggttggtcttgaactcctgacctcatgatctgcctgccccagcctcccaaagtgctgggatcacagatgtgagccaccgggcccagcctatttatttgaaatagagacaggatcttgctgtgttgcctaggctggtcttgaactcctggcctcaggtgatccttctacttcgtcctctcaaaatactgggattataggtgtaagccaccatgcccagccctgtttttttttccttaaatgtttgatattatttaaatggtgtggctagaagctatgttgaaatgggccaaggaatgacagatatataaggaaatagatagccaggatggacaactttgagaattctggctatgaagagaagagaggatggttgctagacaggtgtaaagattgaatcaggcattaaagaaatacagttgttttcttgattgccattatgtcttttaaatttgcttctttgttacttaattctaatgcagatacatcaagaaatctggaatttcatgaaatacatagtactgggaatgaaccgcctttgttgattatgattggctacagtgatggaatgcaggtctggagcatccctgtaagtacacatgtggttgaatacctaaaacatacttcccagcatgttagcttatgtgaaatctgtagatactttttttttttgagacagagtctcactcttcgcccaggctggaatgcagtggtgcgatctcggctcactgcaacctctgcctcccagcttcaagcgattctcctgcctcaacctcccgagtagctgagattacaggcatgtgtcaccacacccaggtaatttttgtacttttagtagagatgggttttgccatgttggccaggctggtctcaaactcctgacctcaggtgatccatctgcctcagcctcccaaagtgttgggattacaggcgtgagccactgcacccagcatatgtctgtgtatctttataggataaattcctttcaatggagttactgagtcaaaggctaagtgcatttgtaattttgatatatgttttacattgcataatattggtcttattttgcatttggactcctacatgtgccttttttgggtgaccaaacataaaatgtcctaaatgaagaagaggcatgggagcagtgcatttgttgagatgtagtaaatactgcatattttggcttatttcacttatatttcattatttggcataatctaaataattatcttccagtagatgagtgggcttattatttttaattgagatggggtctggctgtattgctcaggatggtcttgaagtcctggactaaagcagtcctcccaccttggcctcccaaaatgctgggattacaggcatgagccactgcacccagctgagatgacaggacttctgttgtgtgattcttttgcagtcggaggctctgggccagtagaagttgaatttatacctttaataattgtattcaggaaacttgtttgaagccccatgagtatgtgtgtatgtgtgtttcagccagaatttttttctctttttcttttgggtgatattgttgctccttgaatgatgtataagcaaacatgtattacctcagatttaatggaagtcaggatattctcaagtacagaatttgacctcagtagtctaagaattactaaggaacaagcacattcacctttcaattctttaacattttttttttttttttttgagacagagtttcactctgttgcccaggctggagtgcagtggcgcaatctcggctcactgcaagctctgcctcccgggttaacgccattctcctgcctcagcctctcaagtagctgggactataggcgcccgccaccacgcctggctaattttttgtatttttagtacagatggggtttcaccacgttagccaggatgatcttgatctgctgacctcgtgatccgcccgccttggcctcccaaagtgctgggattacaggtgtgagccaccatgcctggccaacattttttaagttaaaaaaatgtttattttttgataagtcacttctgatgaagtttggtgttccattctgttctttttttttttttttgagacagggtctcactttgtcacccaggctcgagggcagtggcatgattgtaattcactctatcctccacctcctggactcaagcgatcctcccacatcagcctctggagtagctgggactacaggcacgtgccaccacacccagttaatttttaacactttaatggagacagggtcctactgtgttgcccaggctggtctcgaactcctgggctccagtgatcctcctacttggcctcctaaagtgtgggcattacaggcatgagccactgtgcctggccaattctattcttataattatcatattattaagtatctaagatgtgggattttttttttttttttaacttggctttactttgcggagatagaagaatcgtgctggtatgtcatgaaattagaagtattctttttcttttgacttttgggaagtgtagttgacatttttcaaggtccctcaatgttctttgtaattttggtattgttccaaaggcgtggagaaagtacttaaaatttggcagtgtttttttttcttacggagagaaatatttctaggttgtgataaaacaaaagggttttgtaaatgtaactttttcttattaatagagactacattttgcttcattatgctgtttgttgacagtactgaagacagaggaagttatacctttaacaagagggttgagcctgtgtgattaggggtgttgactggattgaacacattcctttggtggtattcaggttgttttaactgcccacttgttttggttataattggggatattaattttaatagtttaaagttaatttctgtttatctttgagtaattaaggtctttatttctccttatgcctagattatattttgagagacttgaataattttttttttgatagaattttctttggccaagtgtatattgttgtagtaccactatttcatgaattagggcctggtgtagaggctgacgcttgtaatcccagcactttgggaggctgaggcaggaggatcacttgaggtcagcagtttgagactaacctgggcagcacagtgagaccagccgggtgcggtggctcatgcctgtaatcccagtactttgggaggccaaggcaggcagatcatttgaggtcaggaattcgagaccagcctgaccaacatggtgaaaccccatctctactaaaaataaaaaaaaaattagccgggcatgatggcacatgtctgtagtcccagctactctggaggctgaggcaggagaatcgcttgaacccgggaggcggtggttacagtgagccaagattgcgccactgcactccagcctgggtgacagagtgagactctgtctcaaaacaaaaacaaaaacaaaaacacatagtgagaccttgtctctacaaaaaatttttaaaaattaaccaggcgtagtggcatgcgcctgtggttccagctactcgggaggatgaggcagggggattgcctgagcctgggaagttgaggctgcagtgagccatgattatgccactgcactccagcctgggtgacagagtgagatcttgtcttgggaaggaaaaaaaaaaaagacaatctgggaaaataagcttcttatatttcattgagctctcattatggtcaaagaggtttatatacatattatctcatctaatgtagaagttaccttgttttacaggtggtaaggtcacactgcttttaagaggtggaactagaatttaaacctagttctgtctgaattcaaattcaaagcccatgatctaagagctatacttcatcacttttcaaatgtgattgctaaagatatgacatgtgagtagttttgtagttaaggtttagtttttgtagaggtgaagggaattatcccctctccctctgaaataaattgacaatagactaatgggagaaaaagcatacacatgcatgagagccacataaaatatgagactcaaagaagggccaaatggctgaagcttacatagtgctctcttcataggggagaaggagatggaggaatgtcgtcagttttgagagttagtaaatcattctcaggaaagttgaatgggcccaaagagcagaaaattgtttctaagtgattcacttgggaagtgggacctgagcagagatgatagcctgtgacaaagtctgtctaggtgtggtgtcatttctcggttttccatcctgtaatttgagattaatcttctctggttgaagaaatttcagaaaggggagagggaggcaattgtgttccttctagaagagcttcaggaaagggaacttgagagagtccctccttgtgcttgtgagggagaagcaggagaacaccagaaagtccttggttctgaggacttctgaggccttttaatttcctttagctcaaaatgctcagcatgccaaaatgccagaatttggaatatcgttttctgagccccagtgttttcatttgtaaaagattagtatgtaccttcaaatactcatagttatcttttacattttactttgttagccattactctgtcagaacccttctgaaacttataaccattattcattacatgagcatatatgctagacagtggggagcctatgttggccaacctagaaaaaaatgactctcatggatctttatagtctgtaattaatacgattggccctctatatacgtgtgttgcgcatctgcagattcaaccaactgtggattgaaaatatttggaattaaaaaaaggatggttgtgtctgtactgaacacgtatagagttttctttcttgtcattatttcctaaacaatgcagtataacaattatttacatagcatttacattgtactaggtattataggtaattaagagatgacttaaagtatatgagagaatgtgtaaaggttatatgcaaatactatgccattttatgtaaaggacttgagcatgatggactttggtattcatgggtggtttgtggaaccagtcagcacagatgctgatggacaattgcatttgcatttgctttttttgtttgttgtttgtttttgagactgagtctcacgctgttgcccaggctggagtgcagaggggtgatctcggctcactgcaacctctgcctcctgggttcaagtgattttcatgtctcagcctcctgagtagctggaactacaggtgtgagccaccatgccaggctaatttttgtattttttttagtagagatggggtttcaccatgttggccaggctggtttcgaactcctgacctcaagtgatctacctgccttggcctcccaaagtgctgggattacaggcgtgagctaccgtgcctggcctgctttttaaaaatagagatgaaatctcactatgtcgcccagattggtcttgaactcctggcctcaggcagtcctcctgccgtggcctcccaaaccactgggattacagatgtaagccatcatgcctggccatatatttgcttttgagtaagtgtaggtgggcagaaaatcaacccctgtccaaaccttagcttagtttttgcttctagtatatgctcaggactccctcttgttgagtttaatataactgtcccgcggtggctcatgtctgtaatcccagcactttggaggccaaggcaagcaagttacttgaggtcaagagtttgagaccatcctagccaacatggtgaaactccgtctctactaaaaatacaaaaatggtggtggccacctgtaatcccagctactttggaggctgaggcaggagaattgcttgaacccaggaggcggaggttgcagtgagctgagattgcaccacggtactcttgcctgggtgacagagtgagactgtctcataaagacaaaactgtcccacctgggagtctcaggttaagaaaataagcatatcctggttaaacattttaaaaaattgtctattgaagtgtgtagatgtgaatggaacttagatgatgtctaggaatattattaattagagtcagctcaaaagcagaactgtgcagtagtttactgcccaatctctactgctttgtacatgacaccagctttcctagctttcctgagctgtcagagcccttctttcaacacaccagatgtaacatagaatgattgttatgtgggcgttccagataaacaaccccttttctcaaccatccctaacaatgttattgactcttttttggtgaggtaaatataggctttcttgcttaaaattcttaattaaaaaaatcaaaattatctttgtatatattttaaaaaccaaatagtttcgtgagattcaaatatgaaacaaatgaagttctgtactctttctctttctttttttttttttttttttgagacagagtcttgctctgtggctcagactggagtgcagtggcatgatcctggctcactgcagcctccacctctggggttcaagtagttctcctgcctcagcctcccaagtaactgggattacaggtgtgcgccaccacactcggctaattgttttgtaatttttagtagagacggggtttcaccatgttggccaggctggtttcaaactcctgacttcaagtgatctgcctgcctagacctcccaacgtgtatactctttctttcatcactctttcaaatctactagttattgtcattttagtatttatttcaattatttcaaaatatcatacttcttatttattttttattttgagatggagtctctctgtgacactcaggctagagtgcagtagcgcaatctcagctcactgcaacctccgcctcctgggttcaagcaattctcctgcctcagcctcatgagtagctgggattacaggtgcacgccccatgtccggttaatttttgtatttttagtagagatggggtttcaccatattggccagtcttgaactcctaacctcaagtgatctgcctgcctcagcctcccaaagtgctgggattacaggtgtgagccaccacaccccacctcaaaatatcatacttcttgaagttttttttctcccagtgttaagattgattggtgccatgaactatgaagttattttttattttattttatttttttgagatggagtcttgctctgtcacccaggctggagtgcagtggtgtgatctcggctcactgcagcctctgcctcccagtttcaagcagttctcctgcctcagcctcctgagtagcttgaattacgggcatgcgccaccacacccagctaatttttatatttttagtagagacggggtttcaccatgttggtcaagctggtctcgagctcctgaccttgtgctgtgcccgcctcggcctcccaaagtgctgggattacaggcgtgagccaccgcgcacagccacgaactatgaagatttaaacggtgttcatttattcagcacatgtctgggatatacaggggtaagcacaatagatgtggtctttgctgtcatggagctagtaggagagagagatttaaataaaaataaatggatatacaacttaagttgtaatatgaaaaaaagcatgacatgttaggacaaggaagtgacatataagctaaaaaatacttagggtaagactggaacaataaacactaaacagaggctctgagatgaaagcattcttttctccatagttagaaattgatttagatttcttaaattttttctctttaaagagcattgtagctgggcatggtggctcacgcctatactcccaacactttgggaggctgagggtggtgtatcgcttgaggccaggagtttaagagcagcttgggtgagaccccatctcaccaaaaccacaaaaattagggctgaaacagggggatcagttgaacctaggaggtcaaggctgcagtgacctgtgcaccactgcacgccagcctgggtgacagagcaagaccctctcaaaaaaaaaaaaataataataatattgagataaatatctttatggtcatataatttggagagatcaataaaagtaaggctcctaatagattttccaaattacattcttttccagccatgtcagttatacttaccccatatatttattaattctttcactcagcaaagatttattaattgtctattacatgccagactgtgttgaaggtgctgggacaacactgaacaaaacaaagtcattctctttgtggaatttccattctggtaggtggggaagatagataataaatatgtatcatgttagatggtgatagatagggtggttgttgttgctgtgggttgctcttttatatacgatggtctgggaaagcctctcaaagacccagtgacatagtggtgtgaagttatccatatgggtatttgagggaggaacactccaagccagtacaaacattctgaggtgcagaatatgtttctttctttttcttttcttcttcttcttcttcttttttttttttttgtgagacagagtctctctgtgtcacccaggctggagtgcagtggcgtggttttggctcactgcaacctccacctcccaggttcaagcgattctcctgcctcagcctccctagtagctgggactacagggatgcgccaccacgcctgggtactttttgtatttttagtagagacggggtttcgccatgttgtccaggctggtcttgaacccctgacctcaagtgatctgccttcccgggcctcccaaagtgctgggattacaggcgtgagccaccatgcccggcagaatatgtttcttatatttaagaacagcaaggaggcagtttagctggagttaggagagcaaagcaaagaataagagattatgtccaagagttagcagttggctagggctttgttttcgcccttgtaaggacatctaaaatttcaaatatacagcaaagttggacttttacggtgaaattacttatacccgccatctagagcagcagtccccaacctttttggcaccagggaccggttttgtggaagacagtttttccacagggtggggatagtttcagtatgattcaagcacagtaaatttattgttcactttacttctattataattgcattgtaatatataatgaaataattatacaactcaccataatgtagaatcagtgggagccctgagcttgctttcccacagctagatggtcccatgtgtgggtgatgggaaacagtgacagatcatcagacattagattctcataaggagcacacaatctagacacttcacatgcgcggttcacgttagggttcgcgcgcctatgataatctaatgctgctgctgacctgacaagaggcagagcttaggcagtaatgtgcgcgatggagagcagctgtaaatacagttgaagcttcgcttttgcttgcctgcttctcacctcctgctgtgaggcctggtttgtaaccagtacctggcccagggattgggggacccctcaactagaatatacccttaaaattttactatacttttttttttccagtttttttttcaggcaaccctcagaaccagaaggggttcatacagctgcctactgtactttgtctcacatccatcttattcattgcatttcagaggaaatgcaaacatcaacatgctttcccctaactacttttgcatgcatataattaactagagttcaatatttggttagtttttaaatttttttagacagagtcttgctctgttgcccaggctggagggcagtgatgctatctttgctcactgcagcctctacctcatgggttcagttgattctcatgcctcagcctcctgagtagttgggattactggcacatgccaccatgcctggcgaatttttgtgatcttttaaattttagctattttggtaggtgataccttgaggattcatttagcattaccatttccctgatgactaataatgtggagtactttttcatgtttcttggccatttatatatattttagcaattatttgtataatttttttgcccattaaaaaatttagttgtaggctgggtgctgtggctcacgcctgtaatctcagcactttgggaggccgaggtgggcagatcacgaggccaggagatcgagaccatcctggctaacatggtgaaacgcagtctctactaaaaatacaaaaaaattagccaggcatggtgacaggtgcctgtagtcccagctacttgggaggctgaagcaggagaatggcgtgatcccaggaagcggagtttgcagtgagccaagatcgcgccattgcactccagcctgggcgacagagcgaggctctgtctcaaaaaaaacaaaaacaaacaaacaaaaaaacttagttgtagaagccattggaggatttttgaatagaggtaatatcacttttaaaaataagaaaggtatgtgaagagcagatttgggtggaaaggtagtgagtttggttttaaatgtgtgaaccatagactgttgctggtccataaactggtgatagcgaatcgtttgttattggcagcaaaaaggtaaagtgcagaaaatgagagtaagcctttcaaaacctatagtattcgccagtgcacactatccaaacatatgtatatagtttacagaagtatcatttgtgccaacttttagaaaaatcaaaaaataattcgtcttttatgacaaacagtttgaaaaacactatcatcaagacatccagttggagaaggagtttttgatgagtatgtttagacatgcaatcatgtattattttatttcacacaaataacatttctgtgattattaacattcattttagcattatacattctttgtagtcatgagaataagatacagaattttcaaggaggagatttgaattgcaggatgaggagttgaacttattctttcagccataataatttggactcgttgagaatcttttggtaacatacattccaaaagctgtctgtaatattgattttgtggttgcagtgggatgaatagcaggagaaaagaaaaggttataaggctagttaggagtgaatttcaacactgtctaaatgttagatgttgagagcctgaactaagtttgttgttgtgagaggattaccaaaaaccatggtaagtggttagacgtttagaagagaagaaagttaaagatgtttccagagtcttgacctggggaccagtgctgcttagtatgaaagatggcatcattttagcagaaatagaatttgattattagacttacactatgttaaaaatcatgtaaagcaaaaattgtatagcatattgtcttataagtaataaagggttctcacttaaagtttcagtggtaaaagtcttctgatattttcgcatactttttgctatctgtttaaatggcaacttagttttcttttcttttcttttctttttgagacatagtcttgctctgtcacccaggctggagtgcagtggtgcaatcacggcttcgcttcctgggctcaagcgattccctcacctcagcctcccgagtagctgggaccacaggtgtgcaccaccatgcccaactgatttttgtatatatatatttttttgtagagatggggttttgccatcttgcccagtctgatcttgaactcttgagctcaagtgatcctcctgccttggcctcccacagtgctgggattacaggcatgagccactgcgcccagcgtcttatcttcttttgaaatgcttatttttttcttaaaaaatggagaatatatttattacatcacctaaaatatggcagttgtattgtgtgaaacagtatacagttggccctggatatccatggattctgaatacgtgcattcagtcaatatggatagaaaatatttgggaaaaaagtaaaaaataattcaacaataaaaaataacacaaataaaaatgacagtatagctatttacatagcacattgtattaggtattgtaagtaatttagagatgatttaaagtatataggaggatgtgcataggttttatatgcataggttatgtgcagataccatgccattttataaaagggacttaagcattggaggttttggtgtccacagggattctggaaccaaccccatgtgaatacagagagatgactgtattttcttttcaaaagttagtatttgtagtgttttcttggagctgtgtatatgcggtacttcaatgacctaacactaggtgtcgctaccacattgagctaagaaaagtgcggctgctccttgaaaggaaatttttgccctaaagctttttgtgtagtttttatacactaaaagctttagagcaaatatgcaagggcattcttgaggtaaatgccaattagtctactatttattagaggttgggtgccaatagaccttgccatgttaagattgttagccaggaaacagtttttatgggtttcatttgggagtaatataaagttagtgatttgggtacactggcaagcagagagaggttgaatatggatgaagtccagtgaaaaaaattgcctttgttgagaataggaccttattttgtttggtgcattctcttcttcctggaaagagaataggtggatccttagactgtagatacagtgggaggacattggttgttatggatgaataaaagcagaaatgaagagtaatactgaagtaatttctggaatttaaccatattggtggattaaaatatcttttcctgtagtatgtttcttaaagtatcactccagagaactcttgcatctgaaacttaatttttccctgtgtgcgaatagtggcgtgactcttgttgatttgacataggcagtagacattactgtgagtttgaaatttatcattgtaagttggactctttcttacttgagatctttttgatgattttctactctaaaacaatatattatttggacctaagctgatttataagtctgtggaatgcaatttttttctgataaatgttattgaatatacatacagtaaaatgcacaaatctgaagtgtacagactgaaaatatatatatatataaccttctaaccatcatcctggattaagatctagaatatttccagtacctcaaaagaatcccttgtgccacttccttggcagtactaccctctttccacctccaagtaaccattattctgctattctgacttctatcaccatagattctttttttctattcttgaatgtctaagaaatatggtcatagatttaaaaggtatgctcttatgttctggcttgtctcttaacattatgactgtaagatttgtttttatgctattgtgtgtaacattaattttgctgtgttgtatctatcatatgaatacaataaattttgaaaaatccattatatgactgatagacatttttgttcccagtttttgagtattattaataaagttgctctgaaaattcttatatatggtaatttttcatggatgtaaacaaaaaatggtaatttttggtgtacgtaaacactcatttgtcttgggtgttgacctaggcgtagatttattgtgtcataggataagtacatgtttaccttcagtaggtactgccaaatagttttcaaaagtgtttttgccaactttgtactctcaccagaattatgtggaagttctgtttgtcctgcatcctcagcagcacttggtattgtcagtctttttgattttggccattctgttgcggatgtgttgatatcttctgtgaggttttaaaaatgctttttagggggctgggtgcggtggctcatgcctgtaatcccagcacttggggaggctgaggtgggtagatcacgacgtcaagagatcaagaccatcctggccaacatggtgaaaccccgtctctattaaaaatacaaaaagtaggcaggcatggtggtgggcacctgtagtcccagctattttggaggctgaggcaggagaatcacttgaacctgggaggtggaggttgcagtgagccgagattgcgccactgcactccagcctggtgacagagcgagactctgtctcaaaaaaaaaaaaaaaaatgctttttaggctgggcacagtggctcatgcctgtaatcctggcactttgggaggaggtgggaggatcctttgagattagaagtttgagaccaccctgggcaacatagaccctgtcttgaccaaaaatgtggcatgtgcctgtggttccagcaactcaggaggttgaggggagaggatcacttgagtctaggagatcaaggctgtggtgagctatgatcacgttactgccctccagcctgggcgacacaggacacagcaagaccctatttcaaaaaatgctttttattttgcaataaatttcaaacttccagaaaattttataatgtatataaggtattcctgttactcattgtggagattcaccaattacggattttgccttatttgctttgtcattctttcagtctctgtatctatgcatatattttctgaaccataatttccataaattattattattatttttgagatggagtcttgctctgttgcccaggctggagtgcagtggcgtgatttcgcccactgcaacctctgcctcccgagttcaagcaattcttctgcctcagcctcctgagtagctgggactacaggcatgcaccaccatgccaaggtaattttttgtatttttagtagagacggggttttggcatgttggccaggctcttctcaaactcctggcctcaagtgatccagccgcctcggcctcccaaagtgctaggattacagacatgagccattcattgtgccttgcctgttttcataaattatttagtataatttcctacaaataaatatatagccatagcactgtcatcaagcccaggacatttaaatttgatgcagtagtattgtggaaactattgttcatattcaaatttcatccattgtcccaatagtctactttatagctattgttactttttcactttctttctttttttttttttttttttttttttgagatgaagtctcgctctgttgcccaggctggagtgcagtggtgcgatctcggctcattgcaacctctgcctcccaggttcaagtgattctcctgcctcagccttctgagtagctaggactacaggcacccgccaccatgcctggccaattttttttgtatttttagtagagacggggtttcaccatattggccaggctggtcttgaactcctgatcttgtgatccacctgccttggcctcccaaagtgctgagattacaggcgtgagccaccgtgcccggcctactttttcactttcttaaaattttcttttgatgaaaaaaatctggttccgattttttatcttttactctattattatttttgtatctttgtttactctaaggacatgcaaatattcttctaggctgggtgtggtggctcatgactgtaatcccagcactttgagaggccaaggcaggcgggccccttgaggtcaggagttcaagactagcctggccaacatggtgaaacagttcgctactgaaaatacaaaaattagctgggcatgatggtgtgtgcctgtaatcccagctgcttgggtagctgaggcgtgggaattgcttgaacccgggaggcacaggttgcagtgagctgagatcgcgccactgcactccagcctgggtgacagagtgagactgtctcaaaaaaaaaaaaaaaaaaaaaaggccggatgcggtggctcatgcccgtaatcccagcactttgggaggcggaggcggtcttatcacctgaggtcaggagttcgagaccatcttggccaacacggtgaaaccccgtctctactaaaaatacaaaaattagccgggtgtggtggaatgcacctgtaagcccagctacttgggaggctgaggcaggagaattgcttgaatccaggagtgggaggttgcagtgagccaagattgccactgcactctagcctgacaacagagtgagacttcctctaaaaaaaaaaaaaattcattttcttttagtgggttgttgtttttacctttaggtttaagattcattaaaaaaaaaaaaacagctttgtatatgtgtggtatgagatggggtcagggttatttcttttttgtttcatttccttttttgtagagacagagtctcactctgttgcccaggctggagtgcagtggtgccattatagctcactgcagcctccaagtcctgggctcaggtgatcttcctgcctcagactcctgagcaactagtactataagcatgtgccaccatgcccagctacttaaaaaaagttttttttgtagagaggggctctcattatgttacgcaggctggccttgaactcctggcccaaagcagtccatctgcctaagccttatttcttatttatctctatttttagaatagtgatactcaattgattcagcaccatttcctgaaaagaccattctttacccaattaattggaataataccatagatgtgtagtaattcttatactctattttttcattggtttaattgtctgcttttgaattctaaatatgctagaaactcaatctgagaaagtcccaaaataaacttcccaatttcttgctctttgctttaaatctattttatttccactctagcccttcttgctaacatctatatttttattagaatagtaccataatttttccattcagccacactgaaatgttcgggtctatgtcaagtattacgagatacaaataaagtaagatgtgagcattgtcttgaggcgataatttcctacttgggggaaaggtcactaaatatttgcagtctgtgtcagtggttcccgaccaggagtgattttgttctccaaggggccatttggctatttttttcattgtcatgattggggattgctgctggcatgtggtaggtagaagccagagatactgctacacatcctataatatacaggacagactcctcgaacaaagaattgttcagtccaaaacatcagtagtgctgaggttgaaaaaccttggtctgtgtgatcagtattaggatagaggtatgaatacagtgctgtagagcccccaaagaatgacaggatgcctgggggagggtttttttttctttttgttttttaatccaggatcagacctgagggagttttgttgttgttgtcattgttgttgtttttgagacggagtttcgctcttgttgcccagcctggagtgcaatggtgtgatcttggctcactgcagcctccacctcctgagttcaagcgattctcctgcctcagcctcccgagtagctgggattacaggcatgcaccaccacacttggctaattttgtacttttagtggagacagggtttctccatgttggtcaggctggtctcgaactcctgacctcaggtgataagaccgccttggcctcccaaagtgctgggattacaggcgtgagccactgctcccggccagagggaggattttttttttttttgagacagagtctcactctgttgcccaggctggagtgcagtggcacgatctcggctcactgcagcctccacctcccgagttcaagtgattctcctgccttagcctcccgagtagctgggattacaggcatgcaccaccactcttggctaattttgtatttttagtggagacagggtttctccatgttggtcaggctggtctcgaactcctgacctcaggtgatctgcccgccttggcctcccaaagtgctgggattataggcatgagccactgcgcccagccagagggaggaatttttttttttttttttgagacagagtctcactctgttgcccaggctggagtgcaatggtgcgatctcagctcactgcaagctccgcctcgcaggttcacgccattctcctgcctcagcctcccgagtagctgggactacagatgcccgccatcacgccaggctaattttttgtatttttagtagacatggggtttcaccatgttagctaggatggtcttgatctcctgacctcgtgatctgcctgcctcggcctcccagagtgctggaattacaggcgtgagccactgctactggccaagagggaggagttttaacacttgtgctgcctagtaaaatttcgtagaatatgaaaaaaaattgttataactggaatattcagaatgcaccatacattgttttaggcatattgcatatattatttattatcctgtcaattttactagttagtgttagtcttattttacacttgaaaaaattaagggctatatttaactaggtcaagttctttaacagataccttttaaaaaacagactttaaaaaaaaattatttatttattttttaaacatatcactgtatttattttctctcaggtaatttttctatggcttcaacattttctcttcaaaattaaaagaaaaatatcccaaagtttagaactggatctcttggccctttctcttcttatctcctcccggttcaaaatgcttacatctctgaatgaccaccatcctcttggatctgcagttaggctcaacacattctggccttagcacagtcttctttgtggtcttagccttcttcaggaaaactggccttctctgcccaccatagccactctgcttccgatcatagcgcctctttccctgggcatacaaggaatccttgctcttatactgtgtcactttgtgaggctgatgcttgccacacttcttacagaaggttcttcgggttttaggtacgttgaccatctttgcagcagggctgttccgtctatgtgatgaaaacgagaaatggcatctgagactctcgcctcgcaaagctctcgcctgacaggaaaggaaaaaacagactttatttttaagggcagttttaggttcacggcaaaactgagtagaaagtatacggaggtcccgtatacctcctgcctccacatcgtgcacaacctccccaactgtcaacacccccagcaccacagtggtaaaattgttacaatccatgaacatacattgatatattattgttacccacagtccatagcttacagtaggattcatttttggtggtatacttttttcctttttttttttttttgacacagggtcttgctctgttggccatgctggagtacagtggtgcgatcttggctcactgtagcctctgccttctaggctcaagtgatcctcccacctcagcctcctgggtagctgggactacaggtgcatgccaccatgcctggctaatttttctatttttttgtagagatggggtttcgccatgttacccaggctgttctggaactcctgacctcaagtgatctgcccacctcggcctcccaaagtgctgggattacaggtgtgagccaccgtacccggcctggtttttggtggtatactttctatgtgttttgacagataatataatgacaggtatccaccattgtaatatcacacagaatactctcactgccctacacatcctctgttctctatctattcatccctccatccctgataagccctgggcacccctgatctttttatcatgtccattcttttgccttttccatgtagttggaatcactacatggtaggtagccatttcagattggtttctttgacttagtaatatgcatataaggttctttcatgtcttttcatgacttgatagcttattcagatgctgaataatatttcattgtatggaataccacaatttgtttatgacagatacctttttatttttattttattttattttatttttgagatggagtctcactttgtcgcctaggctggagtacagtggggtgatcttggctcactgcaacctccacctcctgggttcaagtgattctcctgcctcagcctcccaagtagctgggattacaggtgcccgccgccatgcccagctaatttttgtacttttagtagagacggggtttcaccatgttggtcaggctggtctcggactcctgacctcaagcaatctaccgcctcagcttcccaaagtgctgggattacaggcatgagccaccacacccgataatatctttttaaaaataaagataatatacatactctgaaatgcacaaatctcaggtctatattttggtgatttttacttgtgtatatgtgtttgtatatatgtgtgtttatgtatgtctgtaagcatgcttgtgtgtatacacaagtacgtgaaaccaccattggggagaaaatgtagaacatttttgtactcataaaattttccagtcaatatttctcctccttccaggataagataatcactattctgaccccatattagttttgcatgcattgaacttcatataaacaggggcacacagtatgtactcttttgcatctgttctcttttgctaaatatactttttagattcgtctgtgttgttgctatatcatggtagtttgcattttttgtttgtttttattattgtgttttatttcactatttaaatataccataatctgtttagttattttctttttgatgggctttgtgtttctggcctttgcctataatgaataaagtgtctgtgaacattcttgtagatatgtggactctttttttttttttttttaagatacctagtgaaattgcttagtcacagggtaggtggcatatgtttaactattagaaattgtggccccatcacctccaaaacaaaaagaaattgcccaaggttttccaaataggctgtattgttgtatatttccatttgcagtatctgggagttacagttgttccactcactgcttacattgatgttgtcagtcattaaaaaaaatcatcttgttaatcttacaagttaatatgatagctattttatggaaaaaacttttagacttctatttaatataaacagtttctccttggttaattatctattgcaaatctatcttctttaatcaatgggttaaatcaagataggtttacaataccattaaaatgtaacaaattcagtcttttaaaagtggaaagaggcgatgaaccaaaattggtttatctgttgcactgctttctctcttcacttttcaattgaacacctatcagcttgtaataaaataataaagagaatccagtttgtatgtctgagtgattatgaagtgtttatgacagccgctaggccgacactctctataatggtgttacattgacttctgaacaccttctcgtctgcctccaggcgtgtgtgtcactgtagtctgagtggttttacattaacatctaccctgagtaagatcttttgactaccaaagtgttagttgcaaatggaagataccattaaggcggcttcaaaggactggaatgatatttggattggtgcatgctgaagtaatggctagagttttgaagtgtaatatctaaatcagtgttgcataactgaaggaacatgtgagttcaaacggcttttgtttgatcttcctttagaaaatcaggctgaaggggaaaggttaaagttgccttaaaacactcctttctatgtgtgcaaaaatctggaagtatgaaaatatgattacaagttccattcattatttgtgttctgtggttttcgtattgttcttgaaatttacttcctgcctgcctgaagttttgtattatgaatttagtgtcaagaccaaaatacagaccgggttgctgttttctttatgtggtcagcaaatatctgttctataagttgttactcctcacaaatatgcattttaggcgatttttatggcttgcattttttttcttgatggtatacacagtaggttacagagatactgacactctgatattaactgaatcatttgtggttaggcaggcaaaaaacaaaacaaaacaaaaaacttgttcccctcttcctcctaattttaggagctttcaaaaggactgctctttactattaggaaaactttcctcaaagtatgctatcttaagtttttaaaattgtggaggcagagctgtaaaaaataaaataatacactaacagtgacttgttagagaaaaaaaggcctgagtttaagaactattttgaatatagtgtatttataggagattctgatgcctctttgggctggttatttttggcagcctttttctttgtttccttatctataaaatgaaaatatattatcaaattggcttacagggtgttttgagggagagactgtcagctttcagtagagctggctctgtagttactgtggccactcatgtagctaggtgagttctttttgttgcttcttaaccgaattccttagtataagatgatacctgccatgcctcccacattctcctttacgtttttacaatttctccctaattaaaagtaaattgttattaatttttaagttaaaaaaactataatgaataaatcttctttttaaggaacttcattccttccagttgtatctgtatgattagtacatgtgaagtaattagcaaattgataactatacacgtgtttttttgcttgtttgtttgtttatttattgagacaaagtcttgctttgtcgcccaggcctgagtgcagtggcataatcttggctcactgcaacctctgcctcccagttcaagtaattctcgtgcctcagcctcttaagtagctgggattacaggcgtgcgccattacgcccagctaatttttgtatttttagtagagatggggtttcgccatgttggccaggctggtctcaaactcctgacctcaggtgatctgcccacctcaccctcccaaagtgctgggattacaggcatcctggccttaatgtgtatatttaaatgggttacgtgaggtgtttttgttgctttaggaactgaattccttagtagaagactttctttctctaatctgtatatttttaccttttatccttgattttttttcttcctattatggaagattaacatttatttgtgggattttaacattttctatatatgtttaaattaataggctttatttatttgagtagttttaggtttacagaaaattgaggtgaaaatacagagacctctcatgtatccgcttatcaccctcctattttttttttttttttgaggcagagtctcattttgtcgcccaggctggagtgcagtggcatgatctcggctcactgcaaccaccgccttccaggttcaagcaattctcccatctcagcctcccaagtagctgggattataggtgcttgctaccactgctaatttttgtatttttagtagagatggggtttcgcgatgttgtccaggctggtctcaaactcttaacctcaggtgatccgccagcctctgcctcccaaagtgctgggattataggtgtgagccaccgcgcccggccagccctcctattttcaactattaacatttgcattagtgtagtacatttagtacaattgatgagcttatattgacacattattaataactaaagtccttagattaactttttctccccaataggattttattggtgttactttttagctttttaaactactgatctttttaactactgatcttcatttgtctccatatggttagtacatgtgaaacaattagataagattggtaactctgcatttatatgtttaaatgggctatttttagatcgctggtagcaaggaaaacaagttgcaagtaaaaacatataaatagataaaacttagggagggtggagactggcttgatcttggatgagattatgaagactagtgtgataaaacctgctacatagacaagatgctgcttaccaccttggtagtagttcttttctccaaggctataaatcataggaagtaatgtattagtgagttcaagaactgggctgggtgtggtggctcacacctgtaatcccagcactttgggaggctgaggcgggcagatcacgaggtcaagagatcaagaccatcctggccaacatggtgaaaccccgtgtctactaaaaacacaaaaattagctgggcgtggtggtgcgcacctgtagtcccagctactcaggaggctgaggcaggagaatcgcttgaacctgggaggcggaggttgcagtgagccaagatcgcaccattgcactccagcctggcgacagagcgagacatcgtctcaaaaataaataaataaataaaaaagacctgagcactgagctgtaccaaaatatattcttcaatatggtattttaacaaatttctacgtattaaatattaatagcatgatttgagatcaggagagctaaggtacattatgctaaataacattaaggtagaatagtgagaccaatatagactgaatcattcattcatcaatttattcattcaacaagcatctctttggattaactatcatttattgagtgccaattattatatactatcaaatatacaattatacatttaacaaatatacaatttatatattgttgcctggttagataaatatgttattaaccttattttaaaacgaaactcagatttagtaaatttgtatagctaataagcatagtccattttcttttctactaaactgttagaatcattgattttgttgatttgtaaaatttgtaacagatgatctggtgtatttttcatattttgcattgttgtgataggacatgatttttggaataagaccaaaatgtccggggtctcaggtattggctgctcttgctccctctcttcccaggtgaaattagagcagttactaattcagaagactcttgacatgaaagatatttttgacagaaaggcaaaatgcactggagataaacatgaggcattcttttcctatgatcttccatgtctagtggccaattttaaatactggatgtttggttgggtgtggtagctgacgtctataatcctagcacttctaagagactgaggtgagatgactgcttgagcccgggagcttgagaccagcctgggcaactttgtgagaccccagtctctacaaaaaaatttttaaaaagttagctgggcatggtggcatgtacccgtggtcccagctacttgggaggctgaggtgggagaaatgcttgagcccaggaagttgaggctgtagtgagcattgatcacgccactgcactccagcctgggtgacagatccagaccttgtctcaaaaaaaatcagattgttttcttattgttgagttttaaaagttctttatatattttagataacagtactttatcagatgtgtcttttgcaaatgttttctcagtttatggctcggcttatgctcttgacaatgtcttttggagtgtagaagttttaaattttaaccaagtctagcttatttttttcttacatggatggtgctattggtgtatcaaaaaagtcatcactatacccagtatcatctaggttttctcctgttatttatttagtttgagagacaaagtgttgctctaatccccaggctagagttttgctttactacccaggcttctattacccagtaatgcgatcctagctcactacagctttaaactctgggctcaagtgatcctcctgcttcagcttcctgagtagctagggcaacaggtgcacactaccacacccagttaatttttagatttttagtagagatggagtcttgctgtgttgcccaggctggtcttgaactcttggcctcaagcagtcctcccacttcagcctcccaaagtgctgggattacaggtgtgaaccactgtgcccagactcctatattattttttgagttttagactttcgtgtttcacatttaggtctgtaatccatttggagttaatttttgtgaagggtgtaaggtctgtgtctacattcattttattgcatgtgggtgtccagttttttcagcactatttgttgaaaagactatcttggctccattgtattatctgtgctattatgtcaaagatcaattgactgtatttatgtgggtctatgaactctttgttctgtcccattgatctaattatctagtctttcaccaatactacactgttttggttactgtagctttaaagtaagtcttgaaatcagatagcatcagtgttctgactttgctttctccttcgtatttagttggctattctgaattttttacctctccatagaaactttagaattgatttgttgatagctacagaataacttgctttgattttgattgggattacattgaatgtatacattaagttggaaagaactgacatcttgacaatattgagtcttcctatccatgaatatggaatgtctcttcatttatttagttcttttttgatatgtttcatcagttttatagttttcctcatatagattgcatacatattttattagatttatacctacgtatttcatttttggtggcactaatgtacatggtaatgtatttttaaatttcaaattccacttgtttaatgcttgtatataagaaagtgacttttgtgtattaaccttgtatcctgcaaccttgctgtaattgcttatcaattccagttttttgttgaatcatttgtattttatacatagatgatcatgtcttctgtgaacaaagccagttttctttctttctttcccatttttataccttttatttccttttcttgtcttactgtattagctagggtcatgttaaaaaacctggtgagaggggacatccttaccttgttcctgatcttagtggaactgctttgagtttctcatcattcagtatgattttttattttatttattattttattgtattttattttatttttgagacagggtctcactctgtcacccaggcttgagtgcagtggcacgatctcagctcactacaacccctgctttctgagctcaggttatcctcccaactcagcctcctgagtagctgggaccacaggtgcatgccaccatgcagcactaatttttgtgttttttatagagacagggtttcgccatgttgcctaggcttgtctcaaactcctgggttcaagcgatccactcacctctacttcctaaagtgctgggattacaggttaagtgatgttagctggacttttttttgtagatgttctttaatcaggttgaggaagttcccttctattcctagtttctgaggagtttttttcttttttttcataaataggtgttggattttgtcatatgctttttctgcatctattatttgaccatgtgatttttaccgtgtagcttatcgatgtgatggcttatgttaagtgagccattaagtgagtgtaagtgagctattacattaagtgagccattcaacattttttgaaggttgaaccagctttgcatacctggtgtgaattccacttggttctttattttattttcagagacagggtctcacttcgtcacccaggctggagtgcagtggtgcaatcatagctcactgttaacctcaaactcctggactcaagtgatcctcctgcctttgcctcccaaagtgcttggattacaggtgtgagccactgtgcccagcctataattcttattatactttgttgggtttgatttgctagtattttgttgaggattttcacatctatgttcatgagagatattgatctgtggttttcttgtaatgtcttttttttttcttacaggcgtgtaccaccatgcccagctaatttttttgtatttttattagagacggtgtttctccatgttggccagggtggtctcaaactcctggcttcaagtgatccacccacgtcagcctcccaaagtgctgggattacaggagtgagccaccacacacagcctaacgtcttttttatggttccggtgttagagtaatactggcctcctaaaatgatttaggaagcattctatatgcttctgtcttccaaagagaatgataaagaattggtattatttctttcttaaatgtatggtagaattcaccagtgaattcatctggtcctgggtgctttctattttggaaggttattaattactgagtcaatttctttaataggtgtagacctattcaagttgtctatttattgttgtgtgagttttggcagattgtgtctttcaaggggttggtccatttcatctaggttatcaaacttgtgggcatagagttgttcgtaatgttcctttattatccttttaatgtccatgggatctttagtgatctcccctcttttccttccctccctccctccctcccttcctcccttcctcccttcctcccttcctccctcccttccttccttccttcctatttttgagaccgagtcttgctcttttgctgaggctggagtgcaatggcgcgatcttgtctcaccgcaactgctgcctcccaggttcaagcggttctcttgcctcagactcctgagtagctgggattgcacgcatgcaccaccacgcctggctaatttttgtatttttagtagagacagtgtttcgccatgttggccaggctggtcttgaactcctgacctcagatgattcacctgcctcggcctcccaaaatgctgggattacaggtgtgagccactgagcccagcctcccctctttcatttctaatattagtagtttgtgccttctctgtttctttttcaattagcttggctagagtcttaattttattcatcatttcaaagaaccagcttttggtttcattgatcttctctattgattttctgttttcaatttcattgatttctgctctattttgtattatttattttcttccacttactttggattcaatttgctcttctttttctagttttctttaaggtggaaggttagatttttaattttagatctttcttgttttataatatattcagtcagtgctacagatttccctctatgcactgctttcactgcatttcacaaattttcttaagttgtattttcattttcattagttaaacatgtttaaacatttctctggagctttcttctttgacctatgtgctatttagaattatgttgtttaatcttcaaatatttggttattttccagctttctatttttaatttctactttaataattctattgtggtcatttaatgatttctgttcttttattttttattttattattattattattttttttgagatggagtctcactcttgttgcctgggctggagtgcagtggtgcaatcttggctcactacaacccttgcctcttcggttcaagcgattctcctgcctcagcctcccaagtagctgggattacaggcatgtgccaccacacccggctactttttgcatttttagtagagatggggtttcaccatgttggccaggctggtctcaaactcctgatctcaggtgatctgcttgttggcctcccaaagtgctgggattacaggcgtgagccactgtgcccagcctgttcttttaaatttgttaaggtgtgttttgtggtccagaagatgccctatcttagtgaatgttccatgtctgcctgaagaatgtttattgtgctactgttgtaagaagtagtttatagatgtcagttatatccagttgactgatggtgctgttgagttcaactatgtccttttgtgcttttctggctgctggatctgttcgtttcagatagaggggtgttagagtctctaactctaatagtggattcatctctttctctttgtcaatttttgcttcatgtattttggtgctgtgttgttaagcacatatgtagtaagcaccgattaagtcttcttggggtattgacccctttatcattatgtaatatccccctttttccctgacaagtttctttgccttgaaatctgctctgtctgaagttaatacagctgtggttgccttcttttgattagtgttagcatggtatatcttcctacatcctgttacttttaatccctgtctttatatttaaagtggatttcttctatacaacatacagttggatcttgtgttttaatccgttttcacaatctctgttgtttgacatatttaattgatgtttaacgtgattattgatatagatggataaataactaccatatttgttgcccttgttttaatttttttgtatttttaaaagttttttcttgtgaaagggtcttggtcttctgcccaggctgcagtgcagtggcatgaacatagctcactgtagcctcgaactcctgggcttaattgatcctcctgcctcagccttccatgtagcaagccatcatgactggcaaattttattttttttaattgttgctttgtttttttctttttttatctttcatacttttgctgcttttttagtttgagcattttatatgatgttgtttcttacctttcttagcatatcatttttactacattttaaacttcttttagtgattgtcctggagtttgcaatacatttataaccaatgcatgcccactttcaaataacactatactgcttcatgggtagtgcaatacctaatattaacaaactattcataattctctcttgtttcttgtatcattgctgtcatttatttcacatatgcataagtgcatatatatacacacacaataccacacatatatacatacacatacataattgagtacattattgctattattttgaacaaactattatctgtaaaaaaatcagtaagaaaaataagttttgggtcaggcgcagtggctcatgcctgtaatcccagcactttgggaggctgaggcaggtggatcacctgaggtcaggagatcgagaccagcctggtcaatgtggtaaaaccctgtctctactaaaactacgaaaattagccaggtgtaggggcaggcacctgtaatacctgctacttgggaggctgaggcaggagaatcgcttgaattcgggaggcagaggttgcagtgagctgagatcacgccattgtactccagcctgggcgacaagagcaaaactctgtctgaaaaaaaaaggaaagaaaaataagttttatttcaccttcacttattcttctctgttgtttttctttccttatgtaaatctgagtttctgacctatattgttacctttttccctgtagaacttcttttaacatttcttgcaaggcaggtctaccagcaacaaattccctcggttcctgtttgtccaagaaagtttttgtcttttgtttttgaaggatgagttttcaggatacagaattagaggttgctgttttttttgtttttgtttttttttttccacacaacactctaagtgcttcactctcttcttgcttgcatcgtttatgaggaaaaggcaatgtaattcttatccttgctcttctacaagtagataatttttcctttggcttctttcaagattttttctttatctttgatttgtttgaaatttgaaaatggtatgccttggtgtagggttttttggggcatttatcccgcatgctgttttctgagcttaccagttctgattctggttctgatgcttgttgagtctcttcagattgtattgtttgccttttagtatgctttctaattttttgttaaaaggaagatatggtccatgtgtggtggctcacacctgtaatcctagcagtttgggagagtgaggcgggtggatcactgaggccaggagttcaagactagcctgggcaatatggtgaaacctcatctctacaaaaacatacaaaaaaattcagctgggcatggtggtgggcacctgtagtcccagctacttgagaggctgaggtgggagaatcacttgagcccaggggggccgaggcagcagtgagccgagatcatggtactacactccagcctgggtgacagggtgagaccctgtctcaaaaaaaaaaaaaaaaagaaaaaagaaaaaaaaggaggatatgatgtattgggtaaaaggaactatggtaaatgggacgttagtaattgagtggcggtgtgtggggagggaaaccattctacagtcctgtgggtaagttttagtcctttgtttctcattatttttttgagagtgtgtggtgtgttttttaacatcctcgagtgagacagaaaggtaagaggagattggatttgggtatttacctttccccaggtaggttaagctctgatataaccccagcaagttaggctctcataaagtagtttctgtcgaggccaggctttgttaagaacagaatgatctggtctggcatgtttcaagatggttccattttcacacccactgccagaggctcgaggggatttttattcagtattggctgttagagcctggtggagctcctggaggtaaaacacatcagtgtgagggcccctaggtctgggttcccctggaatttttactttttacaatttttaatttttacattttacaatgtcttgtccacattgaacctctagaaatttgtcaatcacagtttaggtgttcctaccttggtactgagtcctgaggttctcgcttgtggatttctgccctggtaaattgtgattctctgtatctgcctgtttgtctctccaatttttggggcagcagtttgctctatgacgtcatttttctgacggatgtaagaagagctgttcagctttttacctgtggtcagatctaagtgaagtcttctgagctgcatgtgttggcctggaaactgaaagtctgaatgttcacaaatcagtgtatttcagcttcgaaggacattgtgttgctagaacctaatcattgcaccttagtttgagggaaggattggtcattattgtatttggaattaagatatgaatttcattatgtacaaaaaaactctacttattccaagagctgcttaatcgagtccttgaatctcattaatatcctgtactatcatacctatctgtggtccttcaggacaaaagtcttacatcatctgccctcatggagggccattataataaagactaattatttatatatttactttgaggcagcattacatatccattggagactgatttatgcatttcagttaccatgcatctattgatttaaatccataatttttggacacctaccagaatggctgacactaaatattggctaggatgtggagcagatagaactcttgtacgttgctggtggaagtgtaaattggtacaatcacattggaaaattaaatctacaaaagatacacatgtgcctgccctaatatacagaagtagttactctactagatatatatccaagagaaatacatatacatgtttactaaaagacatttgtgagaatgtttacatcaatattctttattatgttgttttcaaaatggtaaaacagtgatctcatacaactatataagggacagatatcctgcattttttttaactcattgattagggatttgggatgttattatagctggttccaagaagaaggtgaatatcacagagaagcaattaggaatactgaaataaattttctaatagatacaagcttggttaatattctgttgggcactaaaatgtactgtttggaataatcttttctacagagtggaattcacttgtatctctaccagacaaaattcatttgcatttctgtgcacaagaatcaattgcattactatcagtttttgacagctcagagtattgtacagtagcccagtcaaagacaaagtgtggatcccctatagaatcagataaccccaaagggtctgctagagagctcttggtaatccatagaaaaaacacagaacacaaagtaatctattcagcatttcaaaatctttcacaattttccttgacatcttttttttttttttttttttttttgagactgagtcttgctctgttgcctaggctggagtgcaatggtgcaatctcagctcactgcaacttccgcctcctgggttcaagcaatcttcccacctcagcctcccgagtagctgggactacaggtgtgtgccaccatgcccggctaatttttgtatttttggtagagacagcttttcaccatgttggccaggctggtctcgaactcatgacctcaagtgttccacccaccttggcctcccaaagtgttgggattataaggcatgagctactgtgcctggcctccttgacatcttaagagctaaaaactagaagtaaaaaagtaaaaacaactcagaggtccatgaacagtagtacaatggataaaattgtaatattttcggccaggcacggtggctcacgcctgtaatcccagcactttgggaggccgaggtgggcagatcatgaggtcaggagattgagaccatcctggctaacacagtgaaaccccgtctctactaaaaatacaaaaaattagccgggcatggtggcacgtgcctgtagtcccagctacttgggaggctgaggcaggagaatggcgtgaacccaggaggtggagcttgcagtgagccaagatcgcgccactgcactccagcctgggtgacagagcgagactccttctcaaaaaaaaaaaaaaaaaatttgtaatattttcatacaatggaaatctatatagcaatacatataaaactacaattccatgcaacaacatgaattaatttcataagcatagtaatgtgtgaaagaagccattcccaagggtacatattgtgggaacccatttacattaagatgaacaagtagaacttaaagtaatagaaatcaggattgtagttatggccactcttgagttgggattatgactgaaaagagatgtagcaggaccttctgagtatccataatattctgtttcttgatgtcttttggttcagaggtacgttaacatttaaaattcatgttatacatatacttaggatgtatgtattttttctgtgtttgttacctcttgataaagtttgctaaaaaaaaaaaaaatcatttgtggaccacaaacatccatttaaccagtatctataggggaaagtggggttgtgaatgtgtactcttgtcctaataatgcagcattataaagcagtatttttattgtcttttggtatttgaattttctatattataattggtctatgaaaagtcatcagaagtttagaaataagtttgattctgagggcaagataaccttcatttgctttcagaattctctaaaagcacttctacagctctcccagaacttgtgtagccttttctgtgtgtatattattgtcttagctgttgtaatttccttttgccttagatcgagttgtgagattctaaacttgtactacccccaccccttttttggtttggtatgtaatttgcatattttcaccatgcgaaagctattttctatggttggaaaagattttttttcctacagtgtgaacaaatcattctttgttctccttattgtgcctccaaactggtacgtccggtttatgccccaaacaacaaaagtctgtcatcagaaattaaaatgccagtaagaacaaaggcagagaccatgaggagctgttggagaggctttctccctgttcgctcttctccccaagttaccacagttgccaggaagttggaatactgcttggactctctttccttgtagttctactcttgtatttattgctattgttggtttaaaagtgaacttacagtttagtatacttcttttcaggatctagaaaatccttatctctgccatttttaatgagctcttttcttaaaacctaaaaaatcactcttgacagccttataaaaaatcagttttggcacttatttgaaggcaaaattatcagtggacataatgtataaaattattattcagaaagatagctaaagcagaatctgtaaagactaaccatcctctgtgtgtcctttctaaaacgtatggatcatatctgtataaaccttaactctgtttctgttctgaaatggtactctaatgtagaattcccacagactatttggagagttctctcctcgaggaagtttgacattttgtgactcacataggatagtttagaattatgcttctaatttcagtaggttgtacaatcctgattttaatatattcagaaatatctataaatgtgacacaatgtttcctctgctccccccaacccccacccccgagttataattaaacacagatcctaggaccatagaggtaatgaagaatggacagtgaatgtggggatgcattttaaaatcagtccaaatgtttttttcctcccctcacccattgccttatgtgtaaggagggatttaagatacaagcttagaatagggcatttaggtttgttttgaaagctgttttgctgaaaagtgttgtatattcaggtttcaaaatgttttttgatgtcagaataagctcttgtgtattaaatacaatgatagcaaacttttatattgtgagtatgctaagacagatttgttttattctttttttttgaataattgagtacagcagctcatttaaatatggttacacttctttaacataaaggttttatttgataggaccaaaagctaaatactagaactggcatatgcaaataatagtacagagtggtggattttgttttagaatactataatttattataagtgtaaagtgagaagtatttttcattacttgaaatataatttcaatgtaagttctatggtattattttaaaatatattttttattttattaatagaaatagcaggtatattgggtaacacttatctgttacaataatttatttttaaaatgtaaatggcttggcagtgtttttattcttttggctattgttaaaattttaaaaggtaggtggaaatagccaataacacatctgtaatataattagattacattagtgttacaccttttagcatatatatgcttaaaataaaaaagactgtaatttttagatttcagagaatgtacgatactacattgcaggggaagttgaacaaataacctttgaagactttttctaaattttaaattttgttctataataataaaatgtggactataatggccatggtttttattctgaaaattaaaagttacaaaggaatttgtagagtaaataagttcttatagtttggaataatgagtttatagcttttacgtgtttcattggtgataggtggtgctattgttgcacagttagtcctagcattcttcacatctgcatcccaagtgctacagaaggatttcttgctaataaataatttgtagtaattatcataagcaaaatgaatgtgatagtcatttaggcgttatcacaacttaacattttaagaaacaaaaatatttgtagtttgcagctcttaaattcagatagaagctgaaaatctaaaaaagtagttactctaaaagagagctctgtagatttatagtaatattgtaagatttatacacttctaattttatcatgtatacatctttgatattttaaactgcttgtatggcaggcagttatttaaaaaaataccatcagtatgtttcctctattgaatttatatctttattacattggttgtaagttcttttgtatcttgaactagttttataatgtttgccattttctctgatagtgcatatttcatcaaacactaggcaattatgaaaatggtttaagaactacagtaccacgtacagtaatttaatctgtccattccccttccccacctcctccaaagataaactcgtagttctgtcagttgagatggaaataagaaagctattcttaactataatttaatctgctcagtgcttcaatgagcagtttgaaaagcagttgttttcacactcaacacatattaccatgcctctttaccttttgttcttcttttaaaaaaatttttatcccccacaaaatgtcctgaacataccctttaccttttgaattaatagaatgaatgactgaaagtgcttggatattcataatgtttgagctatgtgtatatttatgtgtataataaaaatgatgacttttaaaagttgtatatatatatagaattttttgttcatagaatattgaaattagaagtatcctggcagctttttttagcagcttttccttttcgttttatgattgtgaaagaatataggcttattgaggttacatgatttactcaaggttaacagacaattagttgcctaaccataagtatacctaagttattcacatttcacctacgtgttctttgcaataagtattgctttttctcatttacaacatatttgttaaagttgctataatatttaaggtgagattttcagagtagtattacagttgttttgttctcaaagaaggcagttgtgcaggaactgtacagatttctaatggtttaataagataaaaattatagacttccagaacagaccctttttttctgttcatatcaagtgtgtgctcttacagttttctaaaattacttgcagtaatttaagatatgaatatacttaacatgtatgaccaatgataaatgggtgtgggtgtatgtatatatatttcagacaaaatattgttataaaatttagaagatcttgtttttatataatactgttgtgaccttcattttcccactgaaatattttctttcttctcttatgcagatcagtggtgaagcacaagagctcttctctgttcgacatggcccaattcgagcggctagaatcttgcctgctccacagtttggtgagtgtagtccttaagaaaagaatctttcagaaaagagtttctcttttgttggtcttggactacaggcagcaagaatgataactaaagtctgttttcctccaagtgtccattccccttccccacctcccccaaagataaacttagttctgtcagttgagatggaaataggtaatcttaaccaattcaatatggccattcactttctgctgtggttttgatttatcttcatcctctttgatctcgatttagcctctgcctttgctggctctttcttgaagccctttttctctcttggttttcatggcatccttcttcccagatcccttcctggctgactgtgccgcctttgttatgtttctggcttagctttcttctgtgggtattcctcaagtctctattgttctcatgcctttgccctccttctcagttatacttatgccatggagagcttggttttcacttttctctgggctgtagatgactctactgtctgcatctacagctatgtcagaagtggagttttgggcttttaagcttgcaattctgctttaatagagaatacttcttaatgttgtgtttaaataatatatatgttttatatttatttaaaaaattcaaatatgtgtttgtattaaacttgctgtttagatggctaaataacgcctgactccttaatactttgagttttccaaaggtgttattctctcattacctttcctgtgttcactcaagcatgtttttgcatgtacagtgaaaacataatcataataatcatgtttggatactttaaaatcttcttaaaaagaggatattaaaatattttaattctattatattttaaaaagttaccagaagtgaaaaaaatcttataagacttcttgtagcagctaatcctctaaatttgtgagaaagatgtttttgaaaacttatgacattgtgattgtgtgtaaataatttagggattaatttagcaactaaatctgcctaaatgaaatgaggagggtggaggaaacaagcaacagtatcttgcagtcacatgtagattttctcccttgctattcaactctatggcatattctgatttcagctctttagctgtctctctgtttctttctcacacaattgattgtgctgtctctcgctctctcatgctctgtcactctctctcttgttctgttttttgttgcatttgtactttggtgaaatattttgataatgaagattctagaccgtccttttctagaagggttttggaatagccagctttctctttggatggctggaatcaaggaggactttattactaaagggctctgctgtttctctgtgtgtaattcacagacgcagatttttccctcttcatgttatttatgaagttattttgtttatgtgtattatcaatgttcatcttttctcaacttttaaggcagaaatatgtcttgaaaatatctaattaatattgctaatattttatttagaagtagatttaatttactttcctcttaaaaaaagattccttccttcactataatgtatttatttaaaaacatattgttagatttaaaatgtaattttatatgggtaagttttctgttatgatttgaacaaattacttgtgtagcttttattgtatttgattaattttttagatttttaaaaaagactagtcgagtgcagtagtgagaaggggggaaaaagtagaacaaggagttccatcagtaactgactgtaaacaatcaagaactcactaccttcggagcagccttttagatttttttcccccaaagttatacgtgcaaatgatcacataaaacttgtaatggaaaagagtaatacccacttttctcttttacccattttgctttaattcgttatggtggaatatgtagctttctgaaaaaggatgtgtgggagatattgtctgtctttattcttccttcactcttgattgattgtttggctggataacaaatacgtgtttataagaatgttacttcagaatttcgaaggcattggtgtaacattatgttgaagagtctgaggccattttgatacctttttctttgtggcttgttttactttctggaaatccatacaatgttggctttgttcccaatgttctgagactttgcagctttgtgtcttgattcacacattttcctggaccgttttaatttggaaatgcaagtctggtattttgatgaaatggcttcaatttttgttgttgatttcttccattgagttttcattgttcactctttctataacttgtattatctgggtgttaaatcccttgtactggttaattttttaaaattaatttctttcttattctttttttgagatagttccagtgtggcttactattacttctattgaacaattattttctgctgttatgtttttcttatcctatacttctcatatctaataccctcctcccttctttcttctttccctccctttcttctttcttggtatactttacatacaaataagtagcaaatagaatccaatgacatataaaaagaattatacatcaggacaaagtaagatttattccaggaatacaatgttggctaacatttgaaaattaatcaatgggatgggcacggtggttcatgcctgtaatcccagcactttgggaggctgaggcaggtggatcatgaggtcaggagttcgagaccagagtggccaacatagtgaaacctcgtctctactaaaaatacaaaaaattagccgagcatggtggccagtgcctgttattccagctactcgggagggtgaagcaggagaattgtttgaacttgggaggcagaggttgcagtgagccgaggtagcaccattgcattccagtcagggtgacagtgtgagactccatctcaaaaaaaaaaaagaaaattaatccatgtaatttactgtattagagtgaagaagaaaacctgtatgatcatctcaatagaagtagaagaaaactttgccaaatctcagtagccatttatgatttaaaaaagaaaagttttagcaaactaggaatagaaaaaaaattttctgaatatgataaaagttatctgctttaaaaatgtataccaagcatcatactcagtgttgatatattgaatgctttcctgctgagttcaggatgacttctgtcaccacttctatttattgtagttcctagccattacaataaggcaagaaaaaaaaataaaagacataaagattagaaagaaggatatgaaagtgtcgttattcatcgataacatgattgtgtacatagaaaatgcaatagaaccaacaaatagttagaattaatcagtgaatttagcagtgctgctgcatagaaggttctgtaaatcttttgtgaactgaatcccttcctgtgcatttttccagcatcacattctgccatccttaccctgtccccctcactagtcatcacaacaacattcccttgtgatagttgtactgaatttcttttatttcctcaaaagacccatcttcctgctttcaggtctgcttttgttatttcctcttctagaatacttatgtccttctaacccttcttgttccttatccactgtcagtagtgcatgctcccataggacttaatgttctttaattgttcatttgcctcttgtttgctacatttgcaggctgtttttatgtattcagtgtctcacagagtgctttatacaaggtattaataaatatttgttgaatgttgctggattgtataatactttgcaatttaagacgtggaagaaaaagtgaatcccctttctaaaggtatttctgtagaaagcctgtcccctaactaaaagtgagaaactgaaggatttggatgtcttcatatcccacagaagaccatcattgtatttaatgggcatttactcatgtcaacacagcttatgcatccctgcttcttcatggccactatcaataataattgattattttcttaatgaacctagatctgctttaggatttttttcaatacaatattccagaaagctatgactaattaattggtattatctcagataaaaactgttactaattatctttcaaatctgtccttccagaacttaattccaagtaataaatttttcttattcattactttaagtagccattttggcttttagtacctcacttttgtaataaaatgtatcagtatgtatattttaatatacaagtaaaaaagagactttcacttcctttaatatgtttttaatttgtttcttttttttctttttctttttttttttttttttgagatggagtttcactcttgttgcccaggctggagtgcaatggtgcaatctaggctcaccacaacctccatcttctgggtttaagcgattctcctgcctcagcctcccgagtagctgggattataggcatgtgccaccacacccgactagtttttgtaattttagtagagacagggtttctccatatttgtcaggctggtctcgaactcctgacctcaggtgatccacctgcctcggccttccaaagtgctgggattacaggtgtgagccactgcgcccagactgtttttaatttcttaaagtaaggaccatgtaattctaaccactgaaaatattgattattaaaaaaatcaagtaatactcaaatgtgggaaatgaaaatttatgtgagtctgtgttagcaaaggtaaatctgactgcttcttccttttcatccttcctcagatattgagcattgtaccaaaggcccatattaacagcatatatttctagtttttttccccttaactattcacacatgcataacactaacttatattattatgtcccaggactgattcagtttgtttatatgtattacatgtattggctgaagggtgtgtgtgtgtgtgtgtgtgtgtgtgtgtgtaagtgtaatatttttcataacgatttatagtgaacattgttttatttcagaacttaggtatttattttattattgctaaaaattatgtaacattgtattgtatgggtatttatattgttttttcccagttggttatgttgttatatacttccgtatatgtacatttaaaaaagtatacaaggaatttttttttaagggtaactcctaatggggaattgctcacatgtgtatttcatttttttttttctttttttgagacagagtctcactctgtcgcccaggctggagtgcagtggcgcgatcttggctcactgcaagctccgtctgctaggttcatgccattctcctgcctcagcctcccgagtagctgagactacaggcgccctccaccatgcctggctaattttttgtatttttagtagagacggggtttcaccatgttagccaggatggtcttgatctcctgactgcgtgatccgcctgcctcggccttgtgtatttcaattttgatgcatgctgtaaaatttcctcttagagagagtctaccaacatttatacatgagaatcccatttctccttattctgtcctatactggttattatgaatcttttcaatctttgcctgtctggatggcagaaaatcctattcatatgtaacttgaaagtgtttatttttagagacagtctcactttgtggcccaggctgggatgcagtggtgtgatcctagctcactgaagcctcaaactcctaggctcaagcaatcttcccaccacagcctcctgaatacctaggactacaggcacacgtcagcatgcctggctaatttttaaattttttgtagagtgaggtcttgccatgttgcccaggctagtcttgaacccctggcctcaaacaattctcccatctcagcctcccagtgctgggattacagatgtgacccattgtacccatatgtaattttttgatccttgattactagggaagatagaaaatcctcatatttttgctatttatattcattaatatcacacttgtttatattctttctcattgatttgagccctttactaggttattattaatctttagtttcatactaagaaaatccttctgtattttattatgcctaactttaaatcatgacttttcttgaaagtttaattaaaattttattttgttgttatttgtctcttattttatttatttatttatttatttatttatttatttatttatttagagacggagtcttgctctgtcacccaggctggagtgcagtggctcgacctccactcactgcaagctctgcctcccgggttcccgccattctcctgcctcaacctcccgagtagctgggactacaggcgcctgccaccacgcccatctaattttttgtatttttagtagggacggggcttcaccatgttagccaggatggtctcgatcacctgacctcgtgatctgcctgcctcggcctcccaaagtgctgggattagaggcatgagccaccacgctctgccgcgtcttcttattttattacattttccatattgttgatggtcaggaagtagttcttccttgccagtctctgattttcatagattttggacaaaatttctgttttattatggaatttctgttactataatcttagctttttggaatgatgggaactgtgtttttctaatatttgcattctatgcagtgacttgcataataataatatgtaccatatgaggggtaccacataatgaatttattcaatattttgtagacaataatctagaatgctactttgtataaagtgttgtttataaattatcagtgatcaaatgatgtgttttattttatttattttattttgagacagggtctctctctctcttgcccatgctggagtgcagtggcacaatcatggctcactgcagccttgacctcctgggctcaagtgatcctcctgccttggcctcccaaagtgctgggattacagtgtgagccgccatacctgacttctttttttcttttttctttctctgggatagaattttgctctgtcacccaagctagagaacagtgacgcaatcatggctcattgcagtcttgacctcctgggcccaagtgatcccccttcctcaacctccaagtagctgagaccacaggcgtgtgccaccatacctggctaattacggagtcttgctctgtcacccaggctggagtgcaatggcgtggtcggagatggggtcccactgtgatgcacaggctggtcttgaaccactggcctcaggtgatcctcctgcctcggcttcccaaagtacaaggactacaggtgtaatcctccgtgcctggcctgatgttttttacattaatagagcttataactcataagaattatgttagtctggtgtatattctgtttccttcctgctcctggagaaagacaatcattttggccttgaataatttcttagaaatgcagatgtaaaatttaaaatacacacacacacacacacacacacacacacacacacacacacacacacacacacacacacagagtctgttcagccgaaacactagcaagcctctaaaagtaggccaactgacatttgttgatattcctcaccagtctattgcaaagatgaggaaacaggcttattgacattttaaatggctaaactatgagatttagggcttctctaatgttttccgctctaattactgctcagtttgccttgtgtatttttaaaaataacacctagtctttattattgaggtcttactacttgtgatcatttaggtttttgcaatattttgctaagcctgtgatgtgattcaggtaaattgtaacttgagaacatatgttgtattcatcttaaatttctttaatgatttgggtcagagaacagtgtttctaggggagaatgtctggtttagaggtgctgctttttcagtttgatgatttcatggttttaggtataggaaattgatttcagaggattctcagtttatacctagctgaaccctgttattagggcgtttttctataagaggtatagagagaaatgtactgaacacaaaagagaggtgaattaagtgaactatataatgcttgatactcttcagataacattttaggttgtttgtatacattattaccacttttccactattcttcagggtgagtaccattatcctaattcacaggtgaggagacttaatgctcaaagaaattgacggttggtaaatggtgaaactgaaacttgtaatatcaattattatttggttatatagcacataatataaaaaagaagtacttcaaaaccctgttccctgaagatactctctgttaatctcttgttttatatcatttaagcctctttatacacacactccatgtacatgatgtgttttaaaaattgggattactatgtaatgtattttgtagctttttattaatttaacattattagttgagcattttcctgatattagatattcttcttttcaatatgcttttcaatagctgcataaattttcatcatgtggatttatgattacttatttaagcaaccttaacatttgttttcatttttctcctgttttttcaatttttaattttaaaaattgatacaaatattttacatgttatgcggtacttgtgaatatttcttacgtgcatagaatgtgtaatgatcaggttagggtattttaggtatccatcacctgaagtatttatcatttctatgtgctggtaacatttcaagttctctcttgtagctactttgaaatatataatacattgttgctaactatagtcatcctactctgctattgaatattgaggcttacttgttctaacttagtggccccaacctttttgacatcagggacctgttttgtggaagccagtttttccatggatggggggcgtggtgggggattatttcaggatgaaactgttccacctcagatcatcaggcattagttagattctcataaggagtgcacaacttagatcccctacatgcagagttcataatggggttggtgctcctgtgagaatctaatgccaccacttacctaacaggaggtggagcacagacagtaatgcttgctctcctaatgctcacccacaggccatgaactggtaccagtctgcggcccaggagttggggacccctgttctaactgtgtgtttgtacccattaaccaacctctctttatccaccccccttccatccacacattcttcccaggctctggtatgtatcatcctattctctgtctccatgagatcagtttctttagcttccacatatgagtgagaacatgtgacatctgaatttctgtgcctggcttatttgacctaacataattagctccagttccatccctgtgctgcagtgacatgattttattatttttttatggccacataatatttcattctgtatatataccacattttctttatttattcatccatcaatgggcacttaggttgattccatatctttgctgctgtaaatagtgctgtgataaacatgtgagtgcaggttatacagatttcttctcctttggataaataccaagtaatgggattgctggatcatatggtagttctatttttaattttttgatgaacctccatattgttttccacagtggttatatcagtttacattcccaccaacagcatgtaagagttcccttcttggccaggcgcggtggctcatgtctgtaatcccagcggatcacgaggtcaagagatcaagaccatcctggccaacatggtgtaaccccgtttctactaaaaatacaaaaattagctgggcgtgttggcgcgtgcctgtagtcgcagctactcgggaggctgaggcagctgaatcccttgaacccaggaggtggtggttgcaatgagccgagatcgcaccactgcactccagcctagtgacagagtgagactctgtctcaagaaaaaaaaaaggagttcccttctaaatacaaaaattagccacttggggggctgaggcagggaattgcttgaacctaggaggcagaggttgcagtgagctgagatcgcaccactgcattccagcctgggcgacagagcaagactctgtctcaaaaaaataataataataaataaataaataaataaataaataaataaatgagtttctctgcatccttgccagcatgtatatgtgtgtgtgtgtgtgtgtgtgtgtgtgtgtgtgtgtgtgtgttttcttttaatgatagccattctaactggggtaagatgatatctcattgtggtttttttcttgtatttccatgatgcttagtaattttgagcatttttcctgtatacgtattggccattaatatgtcttcttttgataaatgtctatgttgttaccccacattttaatgggattttaaaaaattgttgaattttttgagttctttgtatactctggatattagtcccttattggatgaatagtttgcaaatattttctttcattaagcaagttgtctgttcactctgttaattgtttcctttgctgtatggaagccttttagtttaatatagtcctacatgtatatttttgttatagttgtctgtgcttttgaggtcttagtcatgaaggttttgcctagacctatgtcttgaagtgttttccatatatatatatttagtagtcttactgttttaggtcttaaatttatgtctttaatccatctcgagttgatttttgtatatggggagagataggggttcagtttcattttatgcatatggatattgaatttccccagcaccatttattgaaggtcttttcccttgtgtatattcttggagtctttatcaaaaatcagttggttataaatacatggatttatttctagactcctattctgttccattggtctatgtgtctgtttttataccaatatcatgctattctggttactatagccttgtaatatattttaaagtcagatagtttgatggcttcaccttttcttttgactcaaaattgctctatttgggctcttttttgattctatacacatttgagaattgttttttctaattatgtaaaaaatgacattggtattttgaggtttattgattttgtttatctttttgaagaaccaactttttgtttcattgatactttgtattgttttttgagtctctattttatttagtttgccctgttctttattttttcttttattctgctaattttgagtttggtttattcttggctcactgcagcctccgccttccggttcaaacagttcttctgcctcagcctcccgagtagctgggattacaggctcccaccaccactcctggctaatttttgtattttttggtagagacggagttttgtcatgttggccaggctggtctcaaactcctgacctcaggtaattcacctgccttggcttcccaaagtgctggggttacaggcatgagccaccgcacccggccgcttttctagtttcttgaggtgtgtcattaggttgcttatttgaaagttttctacttttttgatgtgtttattgctataaacttctcttttagcactgctttagctgtatcccatatggttttggtatgatgtgtttccattttaatttgtttcaagaaatattttgatttctctcataatttcttcattgacccagtggttgttcaggagtatcctatgtaatttccatgtatttgtatagtttacaaaattcattttgatgttgatacttagttttattccactgtagtctgagaagattttttttttttttttggacacagtctccctcttttgcctggagtgcagtggcacgatctcgactcactgcaacctctgcctcccgggttctatcgattctcctgccttagcctcctgagtagctgggactacaggcacatgccaccacacccagctaatttttgtatttttagtagagatggggttttgccatgttggccaggctggaagatttcagtttctaaaaattcgttgaaacttatttaatggccttatatagtctgtcatggagaatgttctatgtgttgataagaatgtataaccagcctggcaacatagcaagtccccatctctgtaaagaaaattcgcagagtgtatattctgtagttgttggatagaatgttctatacgtgcctgttaggtctgttgggtctgaagtccagtttaaatccaatgtttcattgttgattttctgtctgagtgatctgtttaatgctgagagtggggagttgaagccccctactgttactgtatttcagtttatctctccctttagatctactaatattcgctttatgaatctggatgatccagtgttggatgcatatgtatttagaattgttacattctcttgctggattgactcctttatcattacatagtgacttctttttttttttttttttactgtttttgttttgtttcattttgtttatttttacagataaggtctcactgtgtcacctgggctgaagtgcagaggtgtgattgtagctcactgccaccttgaactcctaagctgaagcagtccttccaccacagcctcctgagtagctgggagtacaggtgtgcaccaccatgcctggctaacttttaaaaaatactgtagagatgagggtttctctgtgttgcccaagctggtcttgaactcctgacttaaagtggttctcccaccttagcctcccaaaacactgggattacaggtgtggccaccatgccaagccaaaatctgttttatctgatatcagtatagctagtgttgctcacatttagtttctatttggatggagtatcttttttccatccctttactttgagcctatgtatgtctgtaggcaaagtgcatttcttgtagccatcatacttgtatcatgtttcttttatacattcagccagtccctctcttttaagcagataatttaatcaatttacatttaaggttattaatgatgtgtgagattttgttactgtcatataatttgttttctgtttgttttgcatattctttgttcctttctctcccttatttgtgtgtttggtttaccagtgagttttatatttttgtgcattttcatgatagggtatgtgttattcttttactttcatgtttaggactcctttgagcatctcttgtaggcctagtctagtggtgatgaattcccccagcttttgttatcttggaaagactttatttctccttcattcatgaaggataattttgctggatatagtatccttgggtgacaggtttttttgtttttttttttttaaattttagcacttgcaatatgtcattcaattctctccaggcctgtagctttctgctgagaaatccgctgttggcttgatgggagctcctttataggtgactaaatgctttcacttgctacaccttaatattttctcttttgcttggctatagtttgactataaagtgccgtggaggaagacctttttgcattatatttggggatttttggacctcttatttgtgaaagtctaggtctttctcttgctagacttgggaagttttcatctaacattttgttaaataggttttctaaccctttcattctatcttcatccttatggataccagcatttcaaatatttggtcactttttgttgtcccaaatgccacaaaggctttgctcattctttttcatccttttttctttatttttgcctgactggattatttcaaaagaactgtcttcaagttctgagattcttccttctgcttgatcttatctattgttgcttttgaatatattttgcattttattcatataattcttctgttctagaatttctgttttgttctttttaaaaatacttatctcttttgtaaatgtctcagttatatcctgaattgtttttctgatttttctgtattgtttttcagaactctcttgtatctcattgagcttctttaaaatcagtattttgaattatttctctgggattttatgaatttttttattattatactttaagttctagggtacatgtgcacaaagtgcaggtttgttgcatatgtatacatgtgccgtgttggtttgctgcacccattaactcgtcattgacattagatatttctcctaatgctctcccgcccccatgcccccactccacgacaggccccggtgtatgctgttccctgccctgtgtccaagtgttctcattgttccacctatgagtgagaatatgcagtgtttggttttctgtccttgcaatagtttgctcagaatgatggtttccagcttcatccatgtccctgcaaaggacatgaactcatcatttttatggctgcatactattccatggtgtatatgtgccacattttcttaatccagtctatcattgatggacatttgggttggttccatgtatttgcttttgtgagtagtgccgcaataaacatacgtgtgcatgtgtctttatagcagcatgatttataatcctttgggtatatacccagtaatgggattgctgggctaaatggtatttctagttctagatccttgaggaattgccacactgtcttccacaatggttgaactagtttatgcttccaccaacagtgtaaaagtgttcctatttctccacatcctctccagcacctgttgtttcctgactttttaatgattgccattctaattcgtgtgagatggtatctcattgtggttttgatttgcatttctctgatggccagtgatgatgagcattttttcacgtgtctgttggctgcataaatgtcttcttttgagaagggtctgttcatatcctttgcccgcttttggatggggttgtttgatttttttcttgtaaacttgtttaagttctttgtaggttctagatattagccctttgtcagattgcaaaagttttctcccattctgtaggttgcctgttcactctgatggtagtttcttttgctgtgcataagctctttagtttaattaggtcccattagtcaattttggcttttattgccattgcttttggtgttttagtcatgaagtcttttcccacgtctgtgtcctgaatggtaatgcctaggttttcttctagggtttttatggttttaggtctaacatttaagtctgtaatccatcttgaattaatttttgtgtaaagtgtaaggaagggatccagtttcagctttctacatatggctagccagttttcccaacaccatttattaaatagggaatcctttccccatttcttgtttttgtcaggtttgtcaaagatcagatggttgtagatgtgtgttgttattctgaggcctctgttctgttcctttggtctatatctctgttttggtaccagtactatgctgttttgattactgtagccatgtagtatagtttgaagtcaggtagcgtgatgcctccagctttgttctttttgcttaggattgtcttggcaatgcgggctcttttttgattccatatgaactttaaagtagttttttccaattctgtaaagaaagtcattggtagcttgatggggatggcattgaatctgtaaattaccttggtcggtatggccattttcacgatattgattcttcctatccatgagcatggaatgttcttccatttgtttgtatcctcttttattccgttgagcagtggtttgtagttcttcttgaagaggtccttcacgtcccttgttagttggattcctaggtattttattctctttgtagcagttgtgaatgggagttcactcatgatttggctgtttatgtgttactggtgtataagaatgcttgtgatttttgcacattgattttgtatcctgagactttgctgaagttgcttatcagcttaaggagattttgggctgagacgatggggttttctaaatatgcaatcatgtcatctgcaagcagggacaatttgacttcctcttttcctaattgaataccctttatttctttctcttgcctgattgccctggccagaacttccaacactatgttgaataggagtggtgagagagggcatccctgtcttgtgccagttttcaaagggaatgcttccagtttttgcccattcagtatgatactggctgtgggtttgtcttaaatggctcttattattttgagatacgttccatcattacctagtttattgagagtttttagcatgaagtgctgtcgaattttgtcgaaggccttttctgcatctattgagataatcatgtggtttttgtctttggttctgtttatgtgatggattatgtttactgatttgtgtatgttgaaccagccttgcatcccagggatgaagccaacttgatcttggtggataagctttttgatgtgctgctggattcagtttgccagtattttattgaggattttcgcatcgatgttcatcagggatattggtctaaaattctctttttttgttgtgtctctgccaggctttggtatcaggatgatgctggcctcataaaatgagttagggagggttccctctttttctatggattggaatagcttcagaaggaatggtaccagctcctctctgtacctctggtagaatttggctgtgaagccatctggtcctggactttttttggttggtaggctattaattattgcctcaatttcagagcctgttatcggtctattcagagattcaacttcttcttggtttagtgttgggagggtgtatgtgtccaggaatttatccattttttctagattttctagtttatttgcatagaggtgtttatagtattctctgatggtagtttgtatttctgtgggatcgctggtgagatcccctttatcattttttattgcgtctatttgattcttctctcttttcttctttattagtcttgctagtctatcaattttgttatcttttcaaaaaaccagatcctggattcattgatttttttttttgaacttttttgtgtctctatctccttcaattctgctctgatcttagttatttcttgccttctgctagcttttgaatgtgtttgctcttgcttctctagttcttttaattgtgatgttagggtgtcagttttagatctttcctcctttctcttgtgggcatttagtgctataaattttcctctacacactgctttaaatgtgtcccagagattcttgtatgttgtgtctttgttctcactagtttcaaagaacatctttatttctgccttcatttagttatttacccagtagtcattcaggagcaggttgttcagtttccatgtagttgtgcagttttgagtgagttttttaatcctgagttctaattggattgtactgtggtctgagagacagtttgttgtgatttctgttcttctatatttgctgaggagtgctttacttccaattatgtggtcagttttggaataagtgcgatgtggtgctgagaacaatgtacattctgttgatttggggtggagatttctgtagatgtctattaggtctgcttggtgcagagctgagttcaagtcctgcatatccttattaaccttctgtctcattgatctgtctaatattgacagcggggtgttaaagtctcccattattattgtgtgggagtctaagtctctttgtaggtctctaaggacttgctttatgaatctgagcactcctgtattgggtgcatatatatttagaatagttagctcttcttgttgaattgttccctttaccattaagtaatggccttgtctcttttgatttgttggtttaaagtctgttttatcagagcctaggattgcaacccctgcttttttttgctttccatttgcttggtagaacttcctccatcccgttattttgagcctatatgcgtctctgcatgtgagctgggtctcctgaatatagcacactgataggtcttgactctctatccactttgccagtctgtgtcttttcatgggggcatttagcccatttacatttaaggttaatattgttatgtgtgaatatgatcctgtcattatgatgttagctagttattttgcccattagttgatgccatttcttcctagcattggcagtctttacaatttggcatctttttgcagtggctggtaccggttgttcctttctatgtttagtgattccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaaaaatgttgaatattggcccccactctcttctggcttgtagagtttctgctgagagatcagctgttagtctgatgggcttccctttgtgggtaacttgacctttctctctggctgccctaaacattttttccttcatttcatccttggtgaatctgacaattatgtgtcttggggttgctcttcttgaggagtatctttgtggtgttctctgtatttcctgaatttgaatgttggcctgccttgctatgttgggggagttctcctggataatatcctgaagagtgttttccagcttggttccattctcctgtcgctttcagatacaccaatcaaacgtagatttggtcttttcacatagtcctatatttcttggaggctttgtttgtttcattttactcttttttctctaaacttctcacttcatttcattaatttgatcttcaatcactgatatcctttcttccattagatcgaatcggctactgaagcatgtgcatgtgtcacgtagttctcgtgccatggttttcagctccatcaggtcatttaaggtcttctttacactgtttattctagttagccatttgtctaatcttttttcaaggtttttagcttccttgcgatgggttcgaacatcctcctttagcttggagaagtttattattaccgactttctgaagcctacttatgtcagctcatcaaagtcattctctgtcctgctttgttacgttgctggcaaggagctgtgatcctttggtggagaagaagcgctctggtttttagaattttcagcttttctgctctggtttctccccatctttgtggttttatttacctttgatggtctttgatgatggtgacctacagatggggttttgatgtggatgtcctttttgttgatgttgatgctatttctttctgttggctagttttccttctaacagtcaggtccctcagctgcaggtctgttggagtttgctggaggtccactccagaccctctttgcctgggtaccaccagcagcagctgcagaacagcaaatattgctgcctgatcctttctctggaagctttgtctcagaggggcacccggctgtatgaggtgtcattcggcccctactgggaggtgtctccaagttaggctacacaggggtcagggacccacttgaggaggcagtctgtcttttctcagagctcaaacaccatgctgtgagaaccactgctctcttgagagctgtcgggcagggacgtttaagtctgcagaagtttctgctgccttttgttcagctatgctctgtccccacaggtggagtctacagaggcaggcgggccctgttgagctgcggtgggctccacccagtttgagcttcctggctgctttgtttacctactctagcctcagcaatggcggatgcccctcccccagccaggcttactgccttgcagtttgatctcggactgctgctctagcagtgagcaaggctccatgggcattggacccgcagagccaggcacgggatataacctcctggtgtgccgtttgctaagactgttggaaaagcgcagtgtttaggtggcagtgtcctgattttcccagtgcagtctgtcacagcttcacttggctaggaaaaatcccccgaccctttgcgcttccggggtgaggcaatgccccaccctgcttcggctcgccctccgtgggctgcacccactgtctgaccagtcccaaccagatgaaccaggtacctcagttggaaatgcagaaatcaccaatcttctgcgtcgatcatgctgggaactgcagactggacctgttcctatttggccatcttggaactcagaagtccttttttttttttttttttttttgagttggagtcttgctctgtcacccaggctggagtgcagtggcgtgatctcggctcactgcaacctctgcctcccgtgttcaagccattctcctgcctcagcctctcaggaagctgggactacaggcatacaccaccactcccggctaatttttttgtatttttattagaaatggggtttcaccatgctggccaggctggtgtcaaactcctcacctcaagtgatccaccctcttcagcctcccaaagtgctgggattacagatgtgagccactgtgcccagccatgaatctttttttattggactctgttgctggaaaattattgttttcctttggagctttcttatttccttgctttttcatgtgtccagtgtctttacattgatatctgtgcatctggttaaatggtcgagttgcttcttccaatttatttatttatttatttacattctttagagacggggtctcactctgttgcccaggctggagttcagtggcgtgatcatggctcactgcagctttgaccttttgggctcaagggatcctcctacctcagccttctgagtagctggaatgacaggcatgtgccacagtacctggctagttttaaatattttgtaggaacaggatctcactatgttgcccagcctggtctcaaattactggcctcaagcaatcctgtctcagccttccaaagtgctgagatgagaggtgtcagacaccgtgcccatcatctgtgggtagggtgctttgactttgattttaggtgcatatattagtgtgagcactgtatgatttctttggttgtaaacaatatgagtggtatctgtgatttccttggtagctgtgatggttaatactgagtgtcaacttgattggattgaaggatgtgaagtattgatcaaggatgtgtctgggagggtgttgccaaaggagattaacatttgagtcagtgggcttggaaaggcagacccacccttaatctggatggacaccatctaattagctgctagcatagctagaatataaagcaggcagaaatacgtgaaaaggctagactggcctaacctcccagcctacatcattttcccatgctggatgcttcctgctgtcgaacatcggactccaggttcttcagttttgggactcagactggctctcctttcttctcaccttgcagacagcctattgtgggaccttgtgatcctgtgagttaacacttagtaaactccccttttttatatatctatctatctcctattctgttcctctagagaaccctgactaatatggtagctttgagtgcagttattagtggaggctgtggtgaaattttgctgggcagtaggacaccaagtgggtcattctttgtgttccagtggtggcagtaataggctgattgtgcttgtctttctgctccaggatggcttgcactggcaccagtgtcagcgggcctaggtggtctgattcttgggcctccagatagcttgtttagcagtggtgggccaggcatgtgggcagcttctcaggcccctggacagctggtatgagtggcaatagcaggggtggagcaatgcactggaacccaagtgatttatgctggtgttggctgtgacaagttaggcaggtctgtcctttgacttgatggtggtacatagtggtgggtgccagctctggtggtattggcaggttgtgttggcccaactggagaccccaggaggagtggtcaggtgccagtggtgatgtactgatctgggtgatttccaagtccgtggatgacatgctcagttactgtggggactagactggctggatgagtagacttgtccttgggccccttggtagtgcattcaggtgatgtctgtgataggcaggggcaggatggtccctagcccactggtggaatgctcaggtgttggcagtggtgtctttgctgcagtcctgccactgaggagagtgaggccactcttagtgggagcagtgtagggaggtagctgtgggatgtgtggttttcttgtgctctggtcatacaacagcctgcagtagcggaggtgggctttgtctttgaagcacatggaagtgcctggcctcatttctctccttggcctggtgctggaggcagcattagacctaaccctagccccacctccagccccaggggagttcaaagacctttggaggctggctgtgggcctgccgtggggaagggggagggcccccctcagtaggagcagctaggcaggtggttgtggggaatgcagtttgcttgtgctgttggtccacagcagcctgcagcagtggcagtgggatttgtccttggcgtgtgtgaaggtgccctgcctcctgtctctctccttggcccagtggcctcagggaagaacatagtcctttgggtttttaattttttttaattttttttttattttttggagatggagtttcaccctttcgcccaggctggagtgcagtggtgtgatctccgctcactgcaacctccatctcccaggttcaagtgattctccccattcagcctcctgagtagctgggattacaggtgcccgccaccatgcccagctaatttttgtatttttagtagagacagggtttcaccatgttggccaggctggtctcgaactcctgacctcaggataagcccacctcggcctcccaaagtgctgggattataggtgtgagccaccattcccagtccaagtttggttcttagaatggtgccaagctgcagctgttcagggcttgaaagcctgtgggagttcaagttctctctctgcagcaatgcttctgtgcagtctgtagtcagttccgtatgttagtcttgaggcctgtatgggtcaaggggttctcgtgtaattaggatcatgaaacactgtggtgggcacgtggagccttggggatctgtctcaccctttttctctgtccatgagctttccccagttcatagtccatcccagcttctctctccttacttgttacttgcttttagtccttgccatcgcctctctcatcccagtgttccctctttttttttttttttttttttttttttttttttttttgagacagagtcttgccttgtcaccaggctggagtgcagtggcgtgatctcggctcactgcaacctccgactccctggttgaaacgattttcttgcctcagcctcccgagtagctgggattacaggcatctgccaccactcctagctaatttttgtatttttagtagagacaaggtttcactgtgttggccaggatggtctcgatctcctgacctcgtgatctgcctgcttcggcctcccaaagtgacaggcatgagccactgcacctggccccagtattctctcttagacggtctatttgaagtgtgaatatttacttgctattttggttcctctctgtggaggaggtgcatactatctgcagtagtcagcgatcttgaacctaaaactgaaatttgtttttttttttttttttttttttttttttttgagacagggtctcactctgtcacgcaggctggagggcagtggcacgatcttggctcactacaacctcagcctcccaagtagctgggattacaggtgtgtgccaccacgcctacctaatttttgtatctttagtagagacagggttttgccatggctgctcttgaactcctgacttcaggtgatctgcctgccttggcctcccaaagtgctggggttacagcggtaaaccaccacgcccagcccccaaactgaaatttgtatttgaaagctcaccttacttagatctcatggtctcccagtatatggtttttacattacaactgagaaacgcttttaccacatcacatgatgtaaaaagtagcttcgtttctatttttttttcatttttaaggtctaaaatagcttcaattatttcagtgtcattattatatttgggttgtctagactaagggtgaaatgcaatggaaattgccggtatggagaccaatacgtagaaaagccgttctcctacattactacattttaattttaagttgtcaggataaagtatgttgcaaagacagcaatagtctacttaaatttcctttaccttaaatcaaatcaaacttttaaaagaaacgttggttccctttcacaaaacttggaataaactattaaaagtgcatcaaaaggattagtgacgggtatcttttttttttaattatactttaaattctagggtatatgtgcacaacgtgcaggtttgttacatatgtatacatgtgccatgttggtgtgctgcacccattaactcgtcatttacattaggtatatctcctaatgctatccctcccctgtccccctatcccacgacaggccccagtgtgtgatggtcccccaccctgtgtccaagtgttctcattgttcagttcccaactatgagtgagaacatgcagtgtttggttttctgtccttgtgatgatagtttgctcagaatgatggtttccagcttcatccatgtccctacaaaggacatgagctcatccttttttatggctgcatagtattccatggtatatatgtgccacgttttcttaatccagtctatcattgatggacatttgggttggttccaagtctttgctcttgtgaatagtgccgcaataaacatacgtgtgcatgtgtctttatagcagcatgatttataatcctttgggtatatacccagtaatgggatggctgggtcaaatgctatttctagttctagatccttgaggaatcgccacactgtcttccacaatggttgaactagtttatgcttccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcacgtgtctgttggctgcataaatgtcttcttttgagaagggtctgttcatatcctttgcccactttttgatggggttgtttgattttttcttgaaaatttgtttaagttctttgtagattctggatattagccctttgtcagatgggtagattgcaaatattttctcccattctgtaggttgcctgttgactctgatggtagtttcttttgctttgcagaagccaattagatcccatttgagtgacggatatctttaaaaaggcttaacataggctgggcatggtggcttacacctgtaatcccagctctttgggaggctgaggttggtggatcactcgaggtcaggagttcgagaccagcctagccaacatggcaaaaccctgtctctagcaaaaatacaaaaattaactgggtgtggtggtgtgtgttccagctactcaggaggctgaggcaggagaatcgcttgaacctgggaggtggaagttgcagtgagctgagatcgcgccactgcactccagcctgggcaacagagtgagactcagtctcagaaaaaaaaaggggggcttaacgtgaagcaagtaagtttcatgtaagcttaatgattctgacccaaatttgaaaatgagtcttcaacttatttgggtaaatatcaaggagcatgcttttggcattgtatggtaaaagtatgtttagttttgtaagatactgcaaagctatcttccaaagtggctgtattgtttagtatttccaccagcaatgaacaagagttgtgtagcttgcatctttgccaccatttggtggtgtcagtgttctgaaatttgactattctaatagctgtgcattagtatcttgttgtttaaacttgcaattctctaatgacatatgatgtggaatatctttaaatatgcttatttgtcatgtattatctcctttattttgtattatctgactcttcaggtccttttttttttttttttttttttgggacagggtctcactctgtcaccagggctgaaatgcagaggtattatcatggctcgctgcagccttgacctcccaggctcgggcagtcctcccaactcagccttcccaagtagctgagactataggcaagcaccgccacatctggctgatttttgtattttttgtagagatggggttttgccgtgttgcccagggtggtcttaaactctcggactcaaaccatctgcctatctcagcctcacaaagtactgggattataggcatgagccaccacacccagccaactgttgaggtctttaacctattttttcatcaggtttttttcttattgttgagtttttttttatttattcttgagacagggtctcatcctgttgtccaggctggaaagcagtggcgtgatcatggctcacagttgcctctgcctcccagggtcacgtgatcctcctgcctcagtgtcccaagtagttgggaccacaggcgcacgccaccatgcctggctaatttttgtatttttttggagacaggttctcaccgtatttcccaggctggtctcgaacacctgcacttaagtgattggcctgccttggtctcccaaaatgttggatttacaggtgtgagccactttgcccggccttactgttatgttcgttgtgtgttttagataatagtcctttatcagataaggcttttggaaatatcttctacctatggcttgtcttcttattttctttacaatgccttttacaaaccgtattaaaatattttctttccttcctctgcatggattttagctcacttgatgtcgtttcacaactcactgatgctctgatcacttttgaagtctttccctcccctcttgttccagtagtttctattggtgcctcttcatgtttcttcatgttttttttctgcagtatctaatgttgttaacccatccagtgtatttttttctctcagacactgcatttttcacttacaatttgcgtgtacatgtgcatgtgtgtgtgcagagacagagatcttccatgtgcctggagacatgttcactttcctctccttgaataaatggaatatgtttatcataggaattttaatgtggttatctaatttgattctgttgattgatttttctccttattatgggttgtatctattcctgcttctttgcatgacttaaaatttttgtttggatgccacacattttgaattttgtgttgctcaggactattttgtattcctttaaatatttttggttttgtcctgggacacagttaaactacttggcaataattttattctttcaatactttctcttactctttgttaggtattcctagaatagccattagtctagagcaggggtctgtagacattttcttaagagagctagatagtattttaggcttgtgggccatctgtcctgactattccactattcatctctgccctattgggcaaaagcagccattgacaatactcaaatgaatgagtggtaagttggggcattcacagggctcacatcaattgtttcccttgtctcaaggatcactgtcctgggctgcgtgttgttggatgtctgaaactgttttttatatattttatctgtttcttaagttttcctggcaggagggtaaatctgatctgctgcagaggttcagcattttgccttagttccttgttttggatgacttaagagtgcttaggatagcgcttggcatgtagtaaaagtcctatgtgagtttttataaataaagaaaaaaataaatttcaaattgaatttcatttgtaagacagtttaaaaattttaatgtatctttggagaagttaagtttcaaacactttgaaagatgcaggcattatagagaaatttctggaggtatcatagcattaattgtggggttttttttctctcgggtgctagatgcagtagcaaaagaaagtgataaaaacaccaagggattcctttatttcttttgatctcatgaataggtaaaggagtcttaaactttccttctcctcttaactatcaacaagggactactatgattcttgcctttcagagtctggcatcatttttttctttccccatgatgcttttagtcttaacaacaagaagtgtgggcctccatgttatcatttaaactatctttttggcatctactgtttagtttaacctagttttcactgaatttttttctcttgttgttgttactgtactttgcagtttttatgtatatataggtttaccttgggaatatttcagaatttctttttttttttcatttgtagaacatggaaataatctaatttgaggccaagtgaatttatgtaaatttatagttagcagtaacaaccagacacactaataaaaaccttctaatattaaaagaaggaaaacaaaaaccgtgtgtgcaaaggaatgatccgcacaaattataggatactgactacctggcagtgggtagtagggtttgggatgtatgagtctatataagtaaatgaaagtttttggcagtgttttacttcttatggatgagggggtcataggtgtttattattaaagtataaagaagaggtccatgcattcattgagaagaaatgaaccaagaattatgaatggtctaattctttgtactcagtgctcaaagtggagaggagaaagatgcaaatgagagaaacagaacatgcagtctttattggattggaaataaaaaattagaattgtgaattagagattaaaagcaaagttttgagtgaagaatttaaagagagacttatttccctctgtatgggaaatacatacagtattttgccctgagaaattttctttgtataaagtcgtgcttcacagtttgttaatgttttaaattcatcataacagtattgactcagttttgtacttttaaagtaatctgtgtgtgtgtgtatagatgtatatgtatactctctaatcagaatgactccatatatagagctaatatcagctgttggtattttattcatatttttgaaaatgccagtataatatctcacattagttgtttaacctttatacattaatattagttttccaaatgtaactaatgtccttctttaacctatcttataacaatataagaacaaatggctgtgcgcggtggctcacgcctgtaatcccagcactttgggagaccgaggctggcggatcacaaggtcaggagttcgagactagcctgaccaacatagtgaaaacccatctctactaaaaatacaaaaattagccaggcatggtggcgtgcacctgtaatcccagctactcaggaggctgaggccggagaatcgcttgaacctgggagatggagattgcagtgagccgagatcgcaccactgtactccagcctgggtgatagagtgagactccgtctcaaaaaaaaaaaaaaaaaaaaggcatggttgctcacgcatgtaatcccaacactttgggaggctgaggtgggtggatcacttgaggtcaggagttacagattagcctgaccaacacagagaaaccccatctctactaaaaatacaaaattagctgggcgtggagttacatgcctgtaatcctagctactcgggaggcttaggcaggagaattgcttgaacccaggaggcggaggttgcggtgagctgagattgtgccactgcactccacgctgggcaacaagagtgagaactccatctcaaaaaaaaaaaaaaaacaaatgaagtaaagtatatacacatatatgtgtgtgtgcgtgtgtatatatgtgtatatatatatttcactgacgaaatggctaaaatcagcaagtatcaggaggcagctccgtgacttccatgctaccactggcagtagggaaaaaatggctgcagaactcttggtgtctttcccatcaccaccttattctcttcctctactactatacttaaaaaagctttgccactactgttatgagactatggccactaagttccttatgttctttactcttgtttacctcaatcaccacaacaaactcaaaacttggcccagcgtggtgcctcatgcctgtaatcccagcactttgggaggacaaggcagacaaatcacttgaggccaagagttggagaccagcctggccaacatggcaaaaccccacctctactaaaattacaaaaaatgggccgggtgtggtggtgggcgcctgtaatcccagctactcgggaggctgaggcatgaaaatcgcttgaatccaggaagtggagtttgtagtgagctgagatcatgccagtgcactccagcctgggtgacagagcgcgactctgtctccaaaaagaaaaggaaaaaaagaaacttaaaaactcacaggttatttctcattctcaccctctctccatgtggcattcacttttcaatctccatctctctcttcattcccccactctctgaaatacctactccaactccagaaactttctgacagggccccctcggaagtcattatccatcatctgcaaaatcccctatgtcctcatcctctttttggaatgttacttcctttctctttgttgctgcctttctttcttagttactacctttcagtttttggagattagatttttatctcatagttttctttagtaccactcctttcacaattcctaaaaatgaacatatttttatgtgttcatttgaaatccgtatgtcttctttggtgaaatgtcccttatgtcttttgctaattactgttgagtttagatagttctttacatactctggatacaagtcatttgttggatatatgattttcaagtattttcatttcatccatggcttatcctttcatcctttcagtttggatgaagtccaattatctttttttttttattttatcagttgtgcctttcatgtcatatctgagaacttagtaaatctgtaacactatggtctttagcgtctcttgtctagaatttgtgattttcctgtttatatctctctgcccttctcaaactcatttcatctcctctgaacagaatatatttttagttaattttataagagattattaaaataggttctattatatggaattcattcatatgcttgtttcaatttgtggtgcagcaaaattttaaattaataaaattattttctgtaattgaataaatccttattttcaaatgagaatagagataagactattccctcaggaatgatttgccacaaagtagtggaaatccatgcacacattattaactttgatggtctttttaaattctcatttgttagatattgtcattcctgggaaattggtgcttactgagcaagcagtttgtgttactcagcaagacttattttcctacagtctataaatctttaaaggaactagacagattcccaaaatttagaagtggatgtatttgatatctgagtggcataagtggctttaaatctctttataagatgatacatctaccatgtaaaaagatcagccctagtgtttgaccctgtagtagtattcttttggttgagtgttttattcatgtgtgttgggcatatgctataagtagcatatgattttgtgggatgataaaagtatagtttgtatacatattaacacatttttatagtaaaatttccttgtgtctgaagtattttttctaggcagatatttgaataaacatctaaacaatctttttttgcagtacactttgggttaatatggcattagtgttcttaatttgtcttaatgcagccttgcttctaaccacattgtattacaggttgagcattcctaatccgaaaatccaaaatccaaaatgctccaaaatctaaaatttggagcctgtttgagcttactctagctctggaggctgcctgctctccccacccccaaataaaacccccaaaacaaaattcagaactttttgagtgctgacatgatgccacaagtggaaaattccacacataaataacacaaactgtttcatgcacaaaattaacaaaaatactgtatcaaattaccttcaggctatatgtgtaaggtgcatatgaaacgtaagttattttctttcttttttttttttttttgaggcggagctttgcccttattgcccaggctggagtgcaatggcgtgatctcagttcactgcaacctccgcctcccaggttcaagcgattctcctgcctcagccttccaagtagctgggattacaggcatgtgccacaacgcctagctaattttgtatttttagtagagacagggcttctccatgttggtcaggctggtctcgaactcctgacctcaggtgatccacccgccttggcctcccaaagtactgggattacaggcgtgagccatcgcgcccggcagaatttcatgtttagacttggttcctatcaagatagcttattatgtatatgtaaatattccaaaagccaaagaagtctgaaacctgaaatgctcctgttcccaagcatgtcagataaggggtactcaacctataccattctctgagtttttctaaatcatgcaagaatggtatgattctgtttgagaaatattcttggtgctatttgatatatagacctttgaaaaacaggagataaggctctgatatgatcactggagcttggtgtctattgcaatatttttgggaaaatattcaaatatctaaaaaactttactatttttaatttttttttttttttgagatggagtctcgctctgttgcctaggctggagtgcagtggcgccatctcggctcactgcaagctccgcctcctggattcaagcgattcttctgcctcggctcccccgagtagctgggactacaggcacgtgccaccacacccagctaatttttgtatttttagtagagacaggtttcactatattggccaagctggtctcaaactcctgaccttgtgatctgcccacctcggcctgccaaagtgcttggattacaggcgtgagccaccatgccctgcctatttttttttttttttttaattttttgagacagtgtcaccctgttgcccagactggggtgcggtggagcgatctcgtgatcttgtcttactgcaaactccacctcctgggttcaagcgattctcctgcctcagcctccccagtagcttggattataggcacccgccaccatgcctggctaatttatctatttttaatagagacggggtttcactatgttggccaggctgatcttggactgctgacctcaagtgatccacctgccttagccccccaaagtgctgggattacaggcatgagccaccacacccaaccctaaaaagcttttttgtcatgttagtactttaggtaacttgtcgtacacagagatttattggtgtaaaagatagacctcttgatacgaatttttgataatttgtttggaaaatagttgtatctaagctgtgttgcagagcttcctattataaattatatcacagctttcttccttctaatttccaggctgaggtcctttttatccttctttgagttatggctaacatagccttacattttttgacatattttcctaagttaattgtagaatatctgtagatattttgttagatgtacatacagatatttaaattttgacgctttaaagtaatttgccaccatggttctgttttattttttgtcttttttgccatctttttttttgagatggagtctcactctgtcccccaggctggagtgcagtggcaccatctcggctcactgcagcctccaactactgggttcaagcgattcttgtgccccagcctctggagtaggttggggttacaggtgcgtgccaccatgcctggctaatttttgtatttttagtagagatggggtctcaccatgttggctaggctggtctcgaactcctgacctcaagtgatccccccgcctcagcctcccaaagtactgggattacaggtgtgagccgctacgcccagcttttttttccttttttttttgccatctttctcaaagaaagaattttccagctggccatggtggttcacacctgtaatcccagcacttacagaggacaaggtagaaggatcacttgagattaggagtttgagaccagcctggccaacgtggtgaaactgcatctctactaaaaatacaaaaattagccaggcatgttggtgcatgcctgtagtctctattactcgggaggctgaggcacgagaatctcttgaagtcaggaggcagaggtttcagtgagctatgattgtgccactgtactccagcctggatgacagagtgagaccttttctttcttctccttcttgtttttcttcttcatcctagactgccttatacttactcagatcacatttcttcttattgtttttgtcttatttccatgttttttcctctaccccttaaaacaaattttaaaagacatttttataaaaatgaattttacaattatgtgtatttctttacctatttttcataattccattttttcctacgttagttaataacagttgctatgtgcttctagacctatttctaggtgtgaatttcattttattctgctggagacttaccaagctttctggttctttcttttataattctggaaaattctctgtcatttatctctttgaatatcatgttttaaattcttcctgtcttctgtcattgtcctcaccatcctccacctagaaattcagcacaccagatgaacaactgagctagaaatcagattaactttcacaaaagcaaaagaaacctatacctgctacatagccattttaccttgaagactgaaaattaaggatgaccacatatgaggagtccagttattactgaggagatatgactttaaaaactacttttgtttatctgttgcattctttcaaatagcttgcagcacagtgtgagacctaataatggttgcttaataattgcctgctgtattgagtttataaagattttatgttattttaccaacttttaaacatcactttaagaattccttcattttatcttagtttatgataacagccactattttttgaggacttagtatgcttgaggtaggtagcatctccagtttgcagatgtggcagttgaccttcagaatgtagattacaaaccaattaattatgaaagccagtttggaaatccatgcctatctgatttaaaattccatgccctttctattttctatgttacttctgttcagatcaaatgttgtgaccagaaaacatgttagttggtctttataagttattattattattattattattattattattattattattttgagatggagtcttgctctgtcgccagactggagtgcagtggtgtgatcttggctcactgcagcctctgcctctcaggttctagcaattcacctgtctcagcctccagagtagctggggctacaggtacgcaccaccgcacacagctaatttttttttatttttagtagagatggggcttcaccatgttggccaggatggtcttgatctcttgacctcaggtgatctgcctggcttggcctcccaaagtgctgggaatacaggcatgagccaccgcacccagccagtctttagaaattctaaattaaggcttactctgtcatgccaattaaatttggggccccaaatgcatgcatacgtatatttacatatttgtgtacataaatataggtctttctagggactggaagggatgaatagccagagcacacaggatttttcgggcagtgaaaatatttgatatgctgatacatgtcattatatatttgttcaaacccacagaatgtatgcaactgcaagaatgaaccctaaactatggactttgggtgatgatgtgttaatgtaggttcatcagtttttcaatcaacagtttgtttgtttgtttatttatttacttatttttgagacagtcttgctcttttgcccaggttggagtgcagtggtgcaatcatagctcactgcagccttgaactccctggctcaagcgatcctcccacctcagtctgctgagtagctgggactacaggtgcacaccaccacatcaggttaatttttgtattttgtatagagatggggtttcgtcatgttgcccaggctggtctcaaactcctgggctcaggcagtctgcctgccttgggctcccaaactgctgggattataggcacgagccactgcgcctgacaatcaacaaatactgataatgtggtagactatgtctgtgtgtggcaggggctatgtgagagatctctgtactttcctctttattttgctgtgaacctaaaactgccctgatgaaaataaattctttaaaaacaaacaaacaaaaacatctattttaagcatcttaacatttttcataatacagtattcctcataatagctacataacagttttcccatcattaacttcttatttgcctttttttcctgggcatatttgttctaaatgaaatgtactccacctcacagttatatacagagtttccacattagtataaactatgagataatgctacaggtttgatttgagactctttttgtttgtttctcatgttgtaatattctctttgacttctctggagttctttatgggcagctgtagtgaacaatgagaattggccacataaagtttccttaaatatgggaaggtaaatgagatgtggctggccaaacatagaaatgaagtataatataaagcagcactccattgtagaactgctgccaggaaagtatctaaacatctggaatatggtcagaattctatattaaataatgcagtccaagcatgtactgtatctaagttaaaaaactcttatattgaagatgttaggcatcttatctaaaggagtgcagcatttatactttgggaatacgcaggaaagaaagggtctatatgtaaaattaccaaattgaaaaaaaaaaggtgaaaatacttagtgatgatggcgtgtgttctttctaaaaaaatgaaacaaatttttttttttttttttttttttgagacggagtctcactctgtcgcccaggagggcagtgacacaatctcggctcactggaagctccacctcccaggttcatgccattctcctgcctcagcctccctagtagctgggactacaggtgcccgccaccatgcccggataatttttttttttgtatttttagtagagacggggttttaccatgttagccaggatggtctcgatctcttgactttgtaatctgctcacctcagcctcccaaagtgctgggattacaggcgtgagccactgcgcccagccaacaaaaaatgtttttaaatgaggtggagtctcactgtgttgctcaggctggtcttgaactcctgggcttgcaatcctcccacctcattctttcaagtaactgggattacagatacatgctactgtgcctggttatgagaggaatgtttattttaaaagcgtttctggaaagtaactcagcaagcaatatttagtaaattaaatgtagctaggccaggcgcagtggctcacgcctgtaatcccagtactttgggaggctgacgtggatggagcacctgaggtgaggagtttgagaccagcctggccaacatggcaaaacccagtctctactaaaaatacaaaaagttagctgggcgtggtggcaggcgcctgtaatcccagctgcttgggaggccaaggcagaggcaattgcttgaacctggggaggcagaggtttcagtgagctgagatcgtgccattgcactccagcctgggcaacagagcgagactccgtctcaaaaaaaaagtatctagcaatcccaaacatgcccttttaacttaggagtttttactttttttcttagttttttattttttgagacagagtctcattgtcacccaggctggagtgcagtggtgcgatctcggctcactgaagcctccacctcccagggtcaagtgattcttgtgctccatcctcctgagtggctgggattacaggtgtgtgccaccatgcccagctaatttttgtaattttagtagaaatcgggtttcaccatgttggtcaggctggtctctaacccctggccttaagcaatccacctaccttggcctcccaaagtgctgggattacaggaatgagccactgcgcccagccagtagtttcccttttgaaagtctgtttcatatgaacagaagtactcgtacattaccagaatagagtatttttaccaggatgtttatagtcagacagcctgaatgtacatcagtaggaatggtcaaataaattgttacagccatattatgcaatattatgaagcgattaaatactgagttaggtgtatatttgttgacctgaaggaatttacatgaagtattgagtgagaataataagatacagagcaatgtgtacactgtgatcccattttgtaaaacagttatctaaaaaataaaaaatctctgctgtatttaacagcagtcagctctcagtatctgtagtttccacatctgtggattcaaccaactatggatcaaagatacttagagaaaaagttgtgtctgaactaagcatgtacagactttcccccttttcattattgcctatacaatacagtgtaataaccatttacatagcattcaccttgtattagatattataaataacctagagatgatttaaagtacacaggaggatgtgcataggttgtatacaagtatgatgcaattttatgccagagacttgagcatctgcagattttggtatctgagggaggtcctggaaccaatcccgcacagataccaagagacaactgtttatgttttattcaggattgaattaccacggataaaattatgtcagtaatttcagggtattaatattgtttacttggacatattggtagaatgtgagaatatatatagtatgagggagcccggatagttcagttggtagagcatcagacttaatcagagggtccagggttcaagtccctgtttgggtgtgtccttcggcttttagcacctaattctgattccacctttgaaaaagaaagaaagaaaaaaagtattgttttagctgggcatggtggtgcacatctgtagtcccagatactcaggaggctaaggtaggaggatcgcttgagcctgggaggttgaggctacagtgagccaagattgtgcctctgcactccagcctaagtgacagagcaagactctatctcaacattccccactgcctgcaaatgtgtatatatatatatatatatatataaaatgtgtcagtggaaatctgaagtataaaatctatgtatattactataaatatgtaaacattttagtatgcttattggcaagactcatgaacgttaattgactttggtatgggagcctgcatgattgtgcccatgtttgcagttcagcaattgaaatgaaaaagagatcagttgttccaagtgcttattctgaggttacttgtttttcagttaacatttctctggaaagaccagactacaaatggtaaaagctctatgttttattatcgacaatcccttttaaagttgaagtaattaacatttggagtgaattggattactttttattctaatgtgtgtgttttccaactttttattttcaaaaagttcaagccttcataaaggtagaaagcataggataataaacacctacatatccttcacctaaactgattattaatattttgttttattttggataaaaaggaacaaaagctcacctttttttctcactaccctaatcagccactgttaatgtcatgcaaacagtttatattatttgccactaaacatatttcttatttgcttaaattttttaaatgaaagcataatttatggtagataaatacacagaattatgtgttgtagtttgagttttgacaaatgtgtatacagttgtaatctatacccctgtaaagatagcatttctgtcacctcaggaagttctcacatgtactttcccagtcaccctcatctctaccagtagcttctactgctctgttttcttttgtttcagagagttttccctgcttttgatgttgttgcatacatcaatatatctttcctttttattgctaagtatatttcattatatgaatataacaagttatcagtttttctgctgatggaatttgggttggatattgctttgagttattatgagtaaagctgttatgaacattctcatgcaagtctttttgcatcatagagttaacatttgagtatgctgagcaaataagtaaatcaacagtatataatgtgcacaatatgaggttctgttaagtgctgtgaagaaacaaatcagggtaaggagatagagtaggagggaggatggtttccagaaacaacttcctgattaagagatactttagtaaagacccagaaaagtatacaagtggactatgcagatcactaggagaaactgtgtatttccaaccagagaggaggaagtgcagcattactgaggcaggggtgtgtttgacatactccagtatgggtgcagagtgagcagtgtggggaaatgttaaggagatattggcaccatggtaagaagagcaagacaggagtcaaggacatgaatagtacctttttttttttttaactagaaaagttaaaaaaaaagatgaatggtttcaccatagtagagttgccagaaacaacaaaatttatataaagtttgagttctcatatgttgcagcaccatgctcagtgctttgcgtatattatctttttacaacagtactatgtggcgtattggtacttatccccattttacagatgaaaggattaaaacactaagggattaaatgcagacgcctttatcaataattttgtttacaattttcagcagatgagttgatcattaattttttttgacagtagctttttcagtgagtaagggtaacagaaaagaattcttgtctagctttaaggttcatacatggcatttagtactacaagaatttggacaagttatttaacctctcaagatcactttactcctctataaaatggaagatttgtgtttggtgctttttaaggtctgatgagtctaatctgtgaaagagcacagggagctgattatcaaagtgaaatagaaggtaccattaaaggttaagggatacctcatatatttaaccttcaaaaaatactgtctttaatatagtttaataaactttttgaagtcactgtggaggctaaaatgtgcacacatattttagatatttgagggaaatggcaaagatgtctttggtgatcatatttagttgaaacaattcaaggtaatatgatttatgtcttgtttttccttttttgtgggtttgttgatggtgcctggagcctctctattttcctatttctccctctttatctcatcttccacttcatctctcttctctgtctcaaaaaattgctcacaagttcctgtttagataaatgagagtattattcaattcataatgattatttatagaaaatttggtaagaaaatagaattttgtagcgcacaacaaccttgacagaatctaaaaatttacatataaaatgtattggcaatagaataaaactttatggataaaatttagatttgcaaaatttgactataccttgaaagctcacattgagtgaatatataagttaatctcaacaaggacaaactaactgaatcaaatctatcttaaaaatgatttcagtaaaataaaaaatgaagcagaagacttggaaatggtttaaatgataaatttagttgttcaatggaatccttctagaaaatatttttctcagtgaaaattgattagtttcagcatacttttgcataaaatcttcacattgaagacataatccttaacatcaaaagagaagagttgagatatttcattatcagttggatttttatttgcctctgggtctatttttggacccaggcagaagctgtttctattttatgtcttgaaaaatccttaaggctgatttctgagcttaaatcctttggtttaaatgagtttacaatggtgtgtgtggtgggggatattatttaacattttctgacaaggaaacgcttttgaattttgttgcgtgggagaggagttggtgacttggtgggcaagcccattttcattactttaattgtgcgatttattaggattttaagctttttataaatgttttagtgttataggacagaattaaaaggatttagcataaaaggagtttaacaaaaggactttgcaacaggattgcaatagtttttatatttgatggatttggctagccgcttttcatttcaatcatcatggtacattctgttaaatgctgtagaacaggtgtgtgtaacgtcattctctctattgtacatgcaaataaacacacaattttatatataaaaagttaatccactgcaatttggaggattatgttatgggagggtgatgactccattaggcatcatgaagaatgaagagtacatgctatttatactgcaggaaaaaacaagttaatagctacaatgttcatgagatgtagaatttttatgtggacacttttattcaagatatccacaataaaattatttaaatgaaaattaagattttgttacattgttttctaaccttgaaatgagaatattttttttttctggatggtctgccttatataaagttggaagtttagttagtatttgtttattgtagattgtggtgttttctacttgcatggactttctagtaaatgtgttgggagttattgccattctcagtatagggcttttattttgtagtttaaaattttagcttctttgattatccataaactttataaatttttagtaagtattatgtgcctgatctagagagcaaagtttgctggactgatatacttcagtaggttagtgaaaactactggagttcttcaattcaggtttgagaaaaacaatcacaacattcttgccagtattatttgcattttaaaaacttgatgtttcattgatcaaaatatcaaattgatatgcataatacaggtacaaactgtaaagaccttggaaagaccaggaagtagaaggaaaatagccattgttaaaggtgaaggcaaaatatgtaggagtgaagaattggctctgtatagaggaagttcagttataattaatttggaacataaatattatggactgtgggcctgttaatttttaacttatgcttggatcaaaagtaatattgttaactgtgaaatctgatttgtttagcaggagtaatggcacaccatgtacagtaaattatgtttgaacaaacctattcttgatgctttctcactacattatcacagatttgtttaaaagatataggcactgattattatataattctaaaatatttaaataactatagttttattcataaacattagttgtgtttgtaggtttttttttttttttttttttgagatagagtcttgctctgttgtccaggttggagtgcagtggtgtgatctcagctcactgcagcctctgcctccccggtttaagcaattctcctacctcagcctcccaagtagccaggattacaggcgtgcaccaccacgcctggctaatttttgtatttttactagagatggtttcaccatgttggccaggctggtcttgaactcctgacctcaggtgatccacctgcctcgacctcccaaagtgctgggattacaggcatgagccactgcactcggccttagttttgtttttcttttagaggtgaagatcttgctatattgcccaggctggagtgcagtggctattcacaggtataatcatagagcactagagcctcaaactgctgggctcaaacctccggtgtagatactatagtctggtgtctaagaaatgatagaacttgtcttaacttaattttcagtcttaattattataatcacagttaaaaagtattagttaagtcacaatctcagtatattaccattaacctttccttctttggattagacctcattatttttggagggatcaattaacatggattgttaatgttacaaatgctttctactgaccaggtgtggtgactcacgtctgtatcccagctctttgggaggctgaaatgggataatcacttgaggccaggagtttaagactagcctgggcacagagagagacctctatctctacaaaatattaaagaattagctgggcatggcggcgcatgtctgtagtactagctgactgggaggctgatgaggaagtatcatttgagcctaggagttagtggctggagtgagctatgatgtccagcctaggtgacagagcaagaccccatctctgaaaaacagacacaagaaatgctttttatcacccagcctaagaaataaaacaaagagttttgaagtcccctggctacactttccaaatattttcttcttcctaaacccgtaagagttaaatccctatcctgaaattagtgtttatcttttttatgtatttatgtatccatggatatttgtcatgttgaaatatgatccctggctgggcgcagtggctcacgcttgtaatcccagcactttggggggctgaggcgggcagatcacgaggttaggagttcaagaccagcctggccaacacagtgaaaccccatctctactaaaaatacaaaaattagctgggcatggtgacaagcgcctgttatcccagctactcaggaggccgaggcaggagaattgcttgaacccgggaggtggaggttgcagtgagccgagatcgtgccactgtactccatcttgggcgacggagctagactccatctcaaaaacaaaaaacaaacaaacaaaaatccccgttgtggcaatgttggaaatgttgggaggtggtgatggcagtggtggccatggcagtggctgctcctgggctgcatgctccacggagccggtggaagccaggaacaggcagaagccccaccttctgagttggcagggcaggagcttcgtgcatgggcctcgtgctggcacctcgagctgcccgccctgccatagccagcatgcctggctgtcagcagtgggtgaaccccccgctcgcttgcttacacatgcctcaccactctgcttgcccttggcaggcatgggatccagcctggtagtgtgagcagagcacagcctgccaggctgagtgggcccagtgggccccgagggaaacttgggcagcagtgctactggccacagaggtttccggctggcgaagtgacacttcaaggattctgtaacagtggggcctggtgaaggtacttggatcatggggacagatccctcatgaatagattaatgccctccctagggagtgagtgagttctagtttccagaagatctggctgttaaaaagaacctccccagccgtttggcatgtgatcactgcaaatgctggctcacttctgctttgtgttatgagttgaagctgactgaagccctcatcagatgctcaatattgaactttccagccactagaagtgtgagccaagtaaaccccttttctttagactacccagtctcaggtatactgttatggcaacactaattggactaaaacaatgagtgtgactgctttatttttttatttttattttttcccctctgccaccctagtgtgactgtgttagatatctcatctcagtggaatcatgtaatatttatctttttatgattggtgtatttcacttataatgttctcaaggttcatccatgttgtagcatgtgacaggatttccttctttatttttatttttaaatttttaattaattaattatttttagatggagtctcactctgtcgcccaggctggagtgcagtggcacgatttctgctcactgcaacttctgcctcctgggttcaagcagttctctgcctcagcctcccgagtagctgggattacaggcacctgccaccatgccctgctaatttttttgtttttagtagagatggggtttcaccatcttggccaagctggtgttgaacttctgacctcttggtccacccgcctcagcctcccaaagtgctgggattacaggtgtgagccaccgtgcctggcctttatttttattttttatttttccataagttattgggggtacaggtggtatttggttacatgagtaagttctttggtggtgatttgtgagattttgatgcacccatcacctgagcagtatacactacaccatatttgcagtcttttatccatcgcccccatctcactttccccccaagtccccaaagtccactgcatcattcatatgactttgcgtcctcatagcctagctcccacatattagtgagaacatatgatggttggttttccattcctaagttacttcacttagaataaaagtctccaatctcatccaggtcactgcaaatgctgttagttcattcctttttatggctcaggaatattccatcatatatatatatatacacaccagagtttcttatccacttgttgattgatgggcatttgggttggctccatgattttgcaattgtgaactgtgctgctataaacatgtgtgtgtaagtatcttttttgaataatgacttcttttcctctgggtagatacccatagtgagatgctggatcaaatggtcgttctacttttagttctttaaggaatctccacactgttttccctagtggctgtactagtttacattcccaccagcagtgtagaagtgttccctgatcgccgcatccacaccaacatctactgttttttgattttttgattatggccattcttgctggagtaaggtgatactgctttgtggttttgacttgcatttccctgatcattagtggtattgagcattttttcatatgttttttggtcacttgtctatcttcttttgagaactgtctattcatgtccttagcctactttttgatgggattgtttttttcttactaattggtttgagttcgttgtagattctggatattagccctttgtcagatgtgtagatcgtgaaaattttctcccactctatggattgtctatttgcttttctgactgttccttttgctatgcgaaagctctttagtttaattatgtcctagctatttatctgtgtttttattgcatttgcttttgggttcttggtcatgatatcttgcctaaggcaatgtctagaagggtttttccaatgttatctcctagaatttttatagtttcaggtcttaggtttaagtccttagtccatcttgggttgatttttgcataaggtgagaggtgaggatccagtttcattctcctacaggtggctagccaattatcccagcaccatttgttgaaaagggtgtcctttccccactttatgtttttgtttgctttgttgaagatcagttgactgtaagtatttgggtttatttctgggttctctactctgttccattggtctatgtacctatttttataaagtaccacactgttttggtgactatggccttagaatatggtttgaaattaggtagtatgaggcctccagattggttctttttgcttagtcttgctttggctatatgggctcttttttggttccatatgaattttagaattgttttttctaattctgtgaagagtgatggtggtattttgatggggattgcattgaatttgtagattgcttttggtagtatggtcattttcacaatattgattctacccatctgcgagcgtgagcatgggatatgtctccatttgtttttgtcatctgtgatttctttcagcagtgttttgtagttttccttgtagaggtcttttgagtccttggttatgtatattcctaagtattttattttatttttatttttgcagctattataaaagggcttgagttcttgatttcattctcttcttggtcgctgttggtgtatagaagaactactgatttgtgtatattaattttatatccggaaactttgctgaattctttcatcagttctaggagctttctgtaggagtcattagggttttcaaggtaaatgatcatattgtcagcaaacagtgacagtttgattcctcttcactgatttggatgctctttatttttttctctcgtctgattgctctggctaggacttccagtactatgttgaagaggagtggtgaaagtgggcatccttatcttgttccagttctcagagggaatgctttcaacttttccccattcagtattatgttggctgtgggtttgttatggttggcttttattacattaaggcatgtcccttgtatgatgattttgccaagagttctaatcataaaggggtgctggattttgttgaatgctttttctgcatctattgagatgagcatgtgattttgtttgcttgtttgtttgtttgtttggcggagtctcgctgtgttgcccaggctggagtgcagtgctgtaatcttggctccctgtagcctccgcctcctgggttcaagagattcttgtgcctcagcctcctgagtagctgggattacaggcatgcgccaccacacctggctaatttttgtgtttttagtagagacagggtttcaccatgttggccaggctgctctcgaactcctgacctcaagtgatccacccacctcggcctcccaaagtgttgggattacaggtgtgagccaccactccctgccgtgatttttgtttttaatttggtctatgtggtgtgtcacttttattgactcacgtatgttaaaccatccctgcatccctgatatgaaacccacttgatcatggtgaaatatctttttgatatgttgttggattcggttagctagtattttgttaaggattttagcatctgtgttcatcaagggcatgggtctgtaattttcttgtttggttttatccttccctggttttggtattagggtaatgctggcttcatagaatgaattagggagggttcctcctttctctatcttgtggaatagtgtcagaatgattggtaccaattctttgaatgtctactggaattctgctgtgaatccgtctggtcctggacttttttttgttggtaatttataaaattaccatttcagtcttgctgcttgttattggcctgttgagggtgtctaattcttcttggtttaagctaggttgtatttttccaggaatttatccgtctcttctaggttttctagtttacgtgcataaaggtgttcatagtagtcttggatgatcatttgtattttgtgtcagttgtaatatctcctgtttcatttcctagtgaggttatttggattttctctcttcttttcttggttaatcttgctaatgatctatcaattttatttatcttttctaagaaccagctttttgtttatcttttgtatttttttccccaatttcatttatttctgctctgatctttgttatttcctttcttctgctgggtttgggtttggtttgttcttgtttctctagttccttgaggtgtgaccttagaatgtcagtttgtgctctttcaggctttttgatgtaggcatttagggctgtgaactttcctcttagcaccgcctttgctatatcccagaggttttgtttttgtttttattttacttttttgagacagagtcgcgctctgtttcccatgctggagtgctgtggcgtgatctcggctcactgcaacaggttcaagcgattctcctgcttcagcctcctgagtagctgggattacaggtgtgtgccaccatgcccagctaattctctgtatttttagtagagatggggtttcgccaccttggccaggctggtcttgaacttctggcctcaagtgatccacccaccttgacctcccagagtgctgggattacaagcataagccaccgtgcttggccgttttccttcttttttaagtctgcataatccgtttcaatataccacattttctttatccattcatctatcagtagacttttgggttgtttccatctgttggctatttggaataatgctgcagtgaacatagttgtgcaagagtttgctacatttatttttacttttatttatttatttatttatttatttttttgtggggtgggaaacaagatcttgccatgttgtccaggctggccttgagctcctgggcccaagcagttctcctgtccggcctcctgagtagctgggactacaggtgtgtagcaccacacctgactacatttatttatttatttatttacttttaatttattatactttaagttctgggatacatgtgcagaatgtgcatgtttgttacataggtatacacatgctatggtggtttgctgcacctgtcaacctgtcatctacattaggtatttctcctaatgctatccctctcctagccccccacctcccgacaggccctggtgtatgatgttcttctctctgtgtgcatgtgttctcactgttcaactcacacttatcagtgagaacacgtggtgttttaattagtaagctttatttcttattcacagaaaaattaagcagaaaatagagtttcccagcctgggcaacatggcgagaccccgtttctgcaaaaaaatacaaaaattagccaggcatggtgatgtgtgcctgtagtcccagctactcaggaggctaaggtgggaggatcatttgagctggaaggtggaagtttcagtgagttgagattgtgccactgcactccagcttgggcgatattgtgagaccctgtctcaaacaaacaaaaacacacagagtttctgtatacccctgaccctgcccaggcactacctcttcccacttcccactttttgtatcatagtggtacatttgttacaagtgatgatcctacactgacacattattattccccaaagtccctaattgacattaggattctcttggtctacattctagaaattttcataaatgtgtaatgatgcatttcacaaatgtatagtgaaacaataatccaccattttagcatcatacagaaaagtttcagttaaaacttaaaacttagaagtccttaaattcctctgtgctctgcttattcatgtcttcctcctaattcctgcaaccattgatctttttactgtccccatagttttatctttcccaaaatgtcatgtagttggtaacatatgatatatagcctttttatattggcttctttcaatgagcaatatgcatttaacattccttcgttttatggcttgatagctcatttctttttagtctgttgtttggatatattacagtttatttatccattcatctgctgaagaacatgttggtcgcatccaagttttggcaattataaataaagctgtcataaacattgtgtgcaggtttttgtgcggacaaacgtcttcagttcattttcgtaattaccaaggagtgtgatttcagcattgtacggtaagagtatgtttagttttgtaagaaactgccaaactcctccaatggggctgtgctctttggcattcccattagcagtatgtgaaaagtgtcacttgcgtcctcttcagtatttggtgttgtcagtgttctggaatttggtcgttctggtagctgtgcaatggtatctcattgttttagtctataattccataataacatataacttcgagcatattttcatatgcttgtttttatgtgtatcttcttgggtgagggtgacctcaggtcttttgcccatagtgttttcttattgttgaattttaagattcctttgtgttggctaacaatccttttatcagatgtgttttttgcaaatgttttctagtctgtagcttgtcttctcattctttttacttttactttttacatgtactttttaaaatagcaaaccaaaattatttaatattaaagaaaaccatttttaaagcaattctagcaagaagttttctctttattctgtcttccattaaaaaaatcttattttgaaacaattacagacttacaggaagttgcaaaaatactacagagcagtccagtgtatccttgtgtgtacataattccatgccattttatcacattcaccaccagcacaatcaagatacagcactgttccgtcaccacaaagatctcccttatgctacctccctgcaacatccccagcccttgagaacaatttttctccatccttattttgtcattcaagactgttacatagtagaattatacaatatgtaagttttttgagattagtgtttgtttttttttttttttttttttggagacagagtcgtactctgtcacccaggctggagtgcagtggcctgatcttggctccctgcagcctctgcctcctggagtcaagcaattcttgtgcctcagcctcctgagtagctggaattacaggtgcgcgccactacgcctggctaatttttttcttttctttttttttttttttttttttttttttagtagaactggggtttcaccatgttggccaggctggtcttgaattcctgacctcaaatgatctgcctgcctcggcctcccaaagtgctgggattataggcatgagccaatgagacaccgtgcctggctgagattagcttttttactagtacagtgctcttgaggtatatccaagttgtttagtctatcagtagttaattcctttttaatttcgattagtatttcctggtatggatgtaccattcatctgttgagggacatccaggggtgattttgactcttacatctaaacctgctgttaacatttgttcacaagtttttctgtgagcacaagtttttatttttctgggataaatgccaagtactgtgattgctgggatgttttgtttttttaatttttgtttggacaaaagtcttcagttcattttggtaattaccaaggagtgatgattgcggcattttatatttccgctgtggcattttatatttccactagcaatgtatgagacatctagtttctgctcatctttgtcagcatttactattgtcatgatcctttgtttgagctcctctagtaggtatgtagtgatgtctcactgtgctcttaatttacatttccctaatgacttttcctgtgctgatttgccatccatctcttctttccagtgaagtatctcttaatgtctttgcccattttctaattggattgttgttttactgttgagttgtgagattatatatttgagatttgagtcatttgtcagatatgttttttgcaagtattttttcaagtgtggatgtagcttgtgctttcattcttctatcatggtctttgatagagcaaaatttataattttaattaaatccaattaattgattttaaaaattatcttatggatcatactttttagtatcttgtgtgggacttcatcaaactctgtatcctgcagattttcttccatattttcttctgaaagttgtatagttttacatttaaatctgtgatcaattttgtgttaatttggggtaaatgtgagatttaatttttttttatggacatccagttgttccagggtcatttgttgactattcttcctccattgaattgcttttacacctttgtaaagaaaatcatttggccatatttgtgtggtctatttctgtgttttcttttttcctttaatctatgtgtctattcctctgctagtaccactaactcttatttactatagttatataactcctgaaatatgatagagtgatttcctctattttcttcttttgttaaacttgttttagctattctagctcccttacctttccataaaattttagaatactcatgtttataattgcaaaaaaatcttgctggatttttggtaggaattgcattaaactttatatcagttatgtatctccatgtatttaggttgtcttttgtttgttttatcagcagttagtagttttcagtacataagtcctgtacatgtttaatcaatttatagttcagtatttagatttcttttgaacaagtataagtgctactgtactttaaatctcaattttcatgtgtccatgatagtatatacttttgtatgctgatcttatagcctgtgacttgctggactaactgattctagtttttttttaattttttttgttgattcctctgtaatttttatgtaaccaatcatgttatctgtaaatagggagttttatttcttcctttctggtctatgacttttactttgtttgctgccttattatactagatagaacttccagtactctattgaaaaacagtagtgagagtggacactcttgctttatatctgacctcagaggaaaagcatttagtttgtgtgatgttcgctgaaagattttgtgttaagttatatcatctaatacctggagcaaccacttgaattcccgatcctataacaatctgtttcttctctggtagcttatagaagcttttctgtgttatcactgtcttgaaacaatgtactctgatattggtctgtttcatgtactgtgctagaacctgaagaagctgataaaatcgtagttttttgttctggggaaactttttgaattatttcatgggtgattttctcctgttttctctgttctctcttttggaacttctgtcatctatgtattgactgtttggactgtctgagcccatccttttcaatttcttgtgtgtaaaaatgctcttttcttctcttgtgtttttgttcttctctctgggaaattttcttaaatttgcctctgattcttgtgttgagtttaaaaacaatatatgcctgcctgtaatcccagcactttgtgaggccaaggcaagcagatcacctgaggtcaggagtttgagaccagcctctactaaaaatacaaaaattagccgggcatggtggcacgtgcctgtagtcccagctacttgggaggctgaggcaggagaattgcttgaatctgggaggcagaggttacagtgagccaaaatcacgccactgcactccagcctgtgcaacagagtgagactctgtctcaaaaaaaaaaaaatatatatatatatatatatatgcacacacatatatttatataaatacaaatacacacacatacatacatacatacatatatatatatatatatccccttgtttttatcattcttcaagagctctcttttattctccaagcgtctatctttttaattcttattttgttccatgtctgcagtatcttctcttacataatggaaatgattaatgacaatttttaatttctattgtgttcttcctgtgtagtattagatactttccagatgactattaatccttggctgtttgcacatgattgtcagtggcaaactgaaaagctaattgaaaacattgcatatctgcttgtcgactttgtttttttgagatggagtttcactcttgttgcccaggccggagtgcaatggtgccgtctgggctcactgcaaactctgcctcctgggttcaagcgattctcctgcctcagcctcccgagtggctggaattatagacacccggctaattttgtatttttagtagagatggggtttcaccacattggccaggctggtcttgaactcctgacctccgcctcggcctcctaaaatgctgagattacaggcgtgagccactgtgcccagtctatttgtcgacttttaactttattgtgaggtgctttggttgtgttgtttgtttgttggaaccctctgatggatagtatattttagtctttcctcttggacttgttaacatgtcccagaaaagacttacaagtgcccacctaaaggataaggttctggtgctagtgtcctggaagccccatgggaaagacgacatgaaggatgatgaagggatgtttcaatattaagtattaatgttgtcatttaatcttcttcacttttttgttttgcattcacctttacccagtgtccttctgtctgtctctagagagtaacctttcagccttgtgctgggaacggggaagatgagttgcctaacagggtaaaggtcttagcatcgatgtgtttttcagatagccgatatcaaatctagtcttctttattttagcttcatctcccatcaaatctagtacctggtattatcagttattgtgccttttaaagattctgcgatgtaaagtaatttgggcgtcaggttttttcccccatgcacaaccttgaacttttaagattgctaagtcagtcatcagtcatctatttccaaaatttcttggggttatatatttttaaagtacatttaatttaatattttttttcctagaattttctgaaggtataaaatgaaattcatgtcttcagtctaccatcttaactcagaagttgaaacaaccatttacttgtttcttctggcatttgccttcttatttaaaaacaaaggaaaaattttgggggaaatttatatattcacatggtttgaaaatgaaaaagcacaaagtatataatgaaaagtttcttctatccttcattttttttcattttccctctcataagtaactattacgattttttttttttttttttttttgagacggagtttcactcttgttgcccaggctggagtgcaatggcatgatctcggctcaccacaacctctgcttcccgggtttgagcgattctcctgcctcagcctcttgagtagctgggattacaggcatgcaccaccacgcccggctaattttttgtatttttagtagagacagggtttctccatgttggtcaagctggtctcgaactcctgacctcaggtgatctgcccgccacggcctcccaaagtgctgggattacaggagtgagccactgcgcccggccactattatgatttttatatgtcctcgtggagttcgtatatgtatgtatacatatatgcaggtctttttttctcttctttgtaaaaaaggtagtatattggctgggcgtggtggctcacacctgtaatcccagcactttgggaggctgaggcgggtggatcataaggtcaggagttcgagaccagcctggccaacatggtgaaaccccatctctactaaaaatacaaaaaatagctgggcatggtggcaggtgcctgtaatcccacctactcaggaggctgaggcaggagaatcgtttgaaccttggagacagaggttgcagtgtgccgagatcatgccattgcactccagccttggggagactccatctcaaaagaaaaacaagaacacacacacaaaaaacaaaaggtagtatattattctgtatcttcctatggttgtatgtattccttttttccactttatatcttctatctcattccatgtttttatagtgtaattcgttgtgttgttttgcagcggtaggaaatattctattgtaacttgattttttttcagtcttttgctattataaacaatactgttgtgaataatcttatatacaagttatttatctcatgtctgagtatatgtgtagggtgaacttggattaaggggtatttgtatttcaattttgattaatgtgagaaaatttaatcaaatttttggattttttaaggagctcttaaataagtgtcaatatatgtagttaaatttagttatatagtcctttttattttagcttcatctcctatcacatttagtacctgctattgtcaattattgtggcttttaaagatcctgtgatgtaaactaatttgagtgtcgggtttttttttttcccccaagcactaccttgcacttttacttctgactgctgcatcagtcatcagtctgacttagcatgcttaagtaaatacacacacacacacacactcacacaattttaaagatatatagttatcgttatataaataacatatttatatgtatataaatatatgtagttaaaaatttttaagtagaaaatgtctgacttatttaaaggtagtgtgaatagtgcgatgatccctaaggaacccaccagtcatcattttatgactattcttgtttcattagcatttatttccctccctctagattattttgaacccttcctagatatcatatcagtttattggttaacattccctcacttgtttctaaaagataaggtatcttaaaaatgtaaccacagtattgtaggggaggaaaacttctctgacctctcagggtctctgggtgggccaaaaaattaaactgacataagataaattaacaggagaaaagcatacaaatttttatttcataaaatttacatgtgcatgtgtgtccgaacagggaaatgaagacttaaggaagtggcggctgggcgcggtggctcacgcctgtaatcccagcactttgggaggccgaggcaggaggactgcttgaactcaggagttcaagatcagcctgggcaacacggtgaaaccccggctctactaaaatacaaaaaattagccggacatggtggcgggcacctgtaatcccagctacttggaaggctgaggcaggagaatagctcgaacctgggaggcggaggttgcagcgagcccagatctgccatggcactccagcctgggtgacagagtgagactccatctgtaaaaaaaaaagagaagtgactcagcctaagtttttttttttttttttttgagacggagccttgctctgtccctcaggatggagtgctggcgttggcatgatcttggctcactgtaacctctgcctcctgggttcaagctagtctgcctcagcctcccaagtagctgggattacagcgcctgcctccatgctcgcgctaatttttatatttttgtattttttttttttaaactagagatggggtttcaccatgttggccaggctggtctcgcatcctgacctcaggtgatccacccgcctcggcctcccaaagtgctgggattacaggcgtgagccactgtgcccggcttcggcctaaattattacatgctaggttgaacaaagaatgacatttatggaaaggtatctgggaagataagggctagtttaacaatgttcatttatacagatttctttcatccttgccttcacatctctggtgattaaaatgtttcttcttggtatgtaggaaggtcatctttcacttgggggcttcctttcaggaatcaaagagccggtcagcgtgtctttcttacatctgctgtttttcaaatgcttttagcccaaataatcaatatgccaaagaggcatattttggagtggtttgtcctgagctccttaatatcattatcaatatagttttaaggaatttctgtcatgtgtgaggttgagcattttttcttcttaatcttttttttttttttgagactgattcttgctctgtcatccaggctggaatgcagtggcacaattatagctcactgcagcccccaactctgggggctcagagggtcctcctacttcagcctcctgagtagctagggctacaggagtgtgccaccatacccaactaattttttgtttttattgtttgtagatacagagttttgccctgtctcaagtgatcctcctgcctccgcctcccaaagtgttgagagtacaggcgtgagcaggcacagagcaccttttcatatgattcagaaccatttatatttcctgactttactttttttgcttcttgttcatattatattggttttgtatcctgtaatattgttgagttcacttactattattatgtggacttaggacttgatgggagcagcaactctggatattcttgtattattattgctgttaataggaatactctgaaccattacctgtgacatttgctgtagatcttttgtagatgatcattattaggttaaaaaagatatttttgttatttttttttgttcatatgattaggtatagagtctaattgaatgctttttctgcatctgctgaaatattaatatcattaattacattaatagattttatactgccaaactattactgttgcttaggtaaatctaattcagttatgagagtttatttttttcatatatgttgctatttaatttgctgatattttgtttaggatttttgcaactatgtatatcaatgggaatgacctatagttttataattttcttgtcttgaactacctttatttagtttcgacatcaatattattactagttttaggtaattagttggtggggtatgggatggttttctgatctcatggggaaggtgtataagattgaaattggtgccaattgaaacttaaaaaaaatgccagttcaggctggccattgtggctctcgcctgtaatcccagcactttgggaggttgaggcgggtggatcacttgaggtcaggagtgtgagaccaggctgaccaacatggcgaaaccctgtctctactaaaaatacaaaaattagccgggcatggtggtacgtgcctgtagtcccagctactcagaaggctgaggcaggagaattgtttgaacccgggaggcagaggttgcagtgagctgcgatcgtgccactgcactccagcctgggtgacagagcgagactctgtctcaaaaaaaaaaaaaaaatgctggttcagtttttaaaatgattacatatatataatatatgatgattttatatagtagcttttcttctttttattcaattgtataaattatgtcaacttataatgaatacttctccttttcaagtattttgaaagcatgaaaatagtgggaattatacaataatattcctcaaagcttacaatttattttatccttcctgtcaggtgctcaaaaatgtgataactttgctgaaaaaagacccctccttggtgtttgtaagagcattggatcttctgggtaaggaaattttaaaaattctttgtatcacctattacaaatttatattattccagagggagaactttgatgttataaaacctttgtaaccataagactaagctctcataagagagaagaagaagaaagtaaaacatatttagggtttccaacagtaaatgacatttattgatgctatagcatgtgcctgacactgttctaaaggtgttgtgtgaattttcttttttatttattaccacaatactgtgaacaaatacaaatatctttccagttagtgcattccctcaaattgaacttctggctgcaaggaaagctaggaatgattatggttttgttagtaaggaaaattatcaaaatggatattaggttggctactagcagtcttggcctcatgctttcagtaaatagtgtgcacttcagatcatgtggcattggagaaaggaagaacatgttaataatataacatggttaggtcatggagtcttgattattgtttcctaatggtactgtttgacttcataggctacaagacaaatttcttcaagtgtaaatttttcgattgaagaagacataaagcctttgagaatttactgtatactcagcactttgccgggtgtaggataaggatacaaaatcatgaaagcctaatttctttccccagagacttatgaatgtggctgaaaagaaaaagtacaacacatgcaaaataattatgaaataatgatgtatgacaggaatgcagagaagggagagatcagtgtgcatgaattaatgagaaaaagcctcatggagaaggagcagcataggttagatcttaaggaatgggaaatattgcagcagatgagaaggactgccagggtaggttataatatagtagtggaagagaaactgaaataaatacatttaagaatggtaagagtttgtgggccaggcatggtgactcacgcctgtaatcccagcactttgggaggctgaggcaggcagatcacttgaggtcaggagattgagaccagccttgccaacaaggtgaaaccctgtctctactaaaaatacaaaaattagcccagtgtggtggcatgtgcctataaccccaactacccggaaggctgaggcacgagaattgcttgaacctgggaggcagaggttgcagtgcaccactgtactccagcctgggcaacagtgagactctgtctcaaaaaaaaaaaaaaaaagagagagtttgtgacttagatttaatgccatctgcaaaacagatgaaaacaactattgcagtactctgaaactcaaccaaaagcatataataatctgaaaagtgtttaagcttgagaaactgctaatctttgcacaataacagtgggaatctgtggcattcatgcctgcagctgctcctgtcccactccacactttccctcttccagggttggttggttggttggttggttatagagtgtcttccagggtgagaaaggttttgaggactagtaccttacctgctgtgcttggaaaattttcgctcatctctgagtggcaggtattgcatatgcctgccagcattatctgcagaaattactgtcttgatgacatgtgtgctttgagagccattggctctttcagcctaagataatggttagctgaggcttcatgcatatgcagaggagccatgaaaaagggtccagggggaagaaaaatctgaatagatgtgcagatcctttggcaaaggaaaacaacttttgttgacctggggtatttgagtgaatcctctgttgagtagttggctgcccactaagatacatagatgcatggccagaccctgaaagtcaggctttaaagtaatgcaagaataaaagaaataataaaactgaacagagaaatcagcaactgcaaattgtggaagaagacagatttcatagaatccagagtaatgttatactgtattatataaaatgtctatttttaaatataaaattatgacacatgccaagaaacaggaagttgtggcagtgagaaaaaggcagacaatagaaatcatacctgactggtcttcagaaaagcctgagtcctgtcctctcactctccccactggacagcatgagcttcaccacttgctccacgttctccaccaaactaccagtctctgggctctgtgcaggtgcccagctatggcacccagccagtcagcagtgtggccagtgtctgtgcaggcaccaggggctctggttcccggatctccgtgtcccactccaccaacttctggggtggcatggggtccaggggcctggttgtggggatggcggggggtctggcaggactgagaggcatccagaatgagaaagagaccatgcaaagcctggacgattgcctggcctcctgcctggacagagcaaggagcgtggagaccggaaaccagaagctggagagcaaaacccaggagcacctggagaagaagggaccccaggtcagagactggagccattacttcaagaccatcgaggacctgagggctcagatcttcccaaatactgtggacagtgcctgcatcgttctgcaaatcaacagtgcctgtgttgctgctgatgactttagagtcaagtatgagacagagctggccatgccctagtctgtggagagggacatccatgggctctgcaaggtcactgatgacaccaatgtcactcagcttcagctggagacagagatcaaggctctcaaggaggagctgctcttcctgaagaaaaacctcgaagaggaagtaaaagtcctacaagcccagactgccagctctgggttgaccatggaggtagatgcccccaaatctcaggatctcaccaagatcatggcagacatctgggcccaatatgacgaactggctcagaagaaccaagaggagctggacaagtactagtctcagcagattgaagagagcaccacagtggtcaccatgcagtctgccgaggttggagctgctgcgttgattctcatggagctgagacgtacagtccagttcttggatattgacctggactgcatgagaaatctgaaggccagcttgcagaacagcctgagggaggtggaggcccactacaccctgcagatggggcagatcctgtagactggatcctgctgcacctagagtcagagctggcacagaccctgcagagggacagcgccaggcccaggagtaggaggccctgctgaacatcaaggtcaagctggagactgagatcaccacctactgtcacctgctggaagatggtgaggacttcagtcttggtgataccccagacagcagcaactccaggcaaaccatccagaagaccacctctcccaggatagtggatggcaaagtggtgtctgagaccagcgacatcaaagttctgagacattaagccagcagaagcagtgtaccctttggggagccaggaggccaatgaaaagttcagaggtaaaaaaaaaaaagaaaaaagaaatcttatgtggttgtctccagatgttaaattttacaaagattttaaagcagctattataaatgtgttctaagaactaaatgaactatgtataaagaattaaaggaaagggttatagcaataactcaacaaatagataatctcaacaaggagttagaatttatataaaactcaaatggaacttctgctgttgaaaggatataaaagatatagaaagtgaaataggcctggatgcagtggctcatgcctataatcccagcactttgggaggccaaggccagcggatcgcttgagctcagaagttcaagagcagcctgggcaacatggtgaaaccctgtctctaccaaaaaaaatacaaaaaaattagctgggcatgatggcacacgcctgtggtcccagctacttgggaggctgaggtgggaggattgcttgagcctgggaggcagaggttgcagtgagcccagatctcaccactgcactccagcctgggtgacagagtgagacccagtctcaaaaaaaaaaaaaaagttcataagttgttttcataagttgttttatggatgtagacctaatatgtcttgttgttaagtttttgtctaaatgtttgtagtaggtgagcatatggtgatgttgaatagagtagactctttagtagctactgttggggaggaatacttttctctcttaaattctttggggagagggctgcaatttaaactgacgaaaggcagattagcaagaggacaaaaaatcagatttaattacatatgtacatataggagtttgcaaaaaaatgtgacttaaggtggcttatatatcatctcagtaggagatggggatggagagggacacaatttgtagaagggcacattttgtagaacaaatgacttcttagaatgggagcagaaggaagggcacttgtgactttttggaaaattaaggtggtccttaggagaaaagacaggagatgtgatagttttgtaacaatatctgtttgggagtggtcctagaagagattaagttgctccaggggaggagatttatgacaaatgaagttttttggagggctctgctctgcttttaggtagataaagtatactaggaacttgagtgctatcaacaatccatgagtcaatacatacatacatacatacatatatacatatgtacagttgagtttatgacaattaagtttgtgtgttcatttatttattttagagacagagtctccctcggtcacccaggcccaggtgcagtggtccaatcatagctcactataatctggaactcctgggctcaagagatcctcccatctcagcctcctgagtagctgggactataagttatgccactgttgggctaattaaaaaaaatttctttttttaagagataagttcccacgatgttacccaggctggtcttgaactcctggcttcaagcaatcctcctatcccagcctgccaaaatgttgcaattacaagtatgagccaccacatctggtccaatcatattattcttattttatgcatgcagaagctaatagaggttcagtcacacagttagtcatggacccaggcttttgcttgaccctcaagctatgttctttccagtaaccatactgtttgtcattatggagggcattcctctatacatacacaggcatattccgtctatagactgtattaagagtgccctaacctcagatttatatatttacaattttctgaccagttattttcagaggtaacaaagatttcttaaaaaaaaaaaaaggaggttatgttaggagcaattaagcaatttgtttatccctgccagagtacctaggactacaggtgtatgccaccttgcctggctaatctttgtatgtcttcttttgagaagtgtctgttaatgtcttttgcccactttttaatggcattgttttttgcttgttgaattgtttaaattcgttatagattctggatattagatatttgttgggtgcatagttagtgaatatttgtgaatctataaatattcacaaaaaatattcactacagatattcacaaactgtgcatccaacaaaggtctgtagattgtttgctctgttgatagtctcttttgctgtgcagaagctctttaattagttcccaattgtcgattttgtttttgttgcaattgcttttgaggactttgccaaggccagtgtccagaatggtatttcctaggttttcttctaggatttttatagtttagggagtcctttccccattgcttgtcattgtcgactttgttgaagattagatggttgtagatatatgcagctttatttctgggttctcttttctgttccattggtctctgtatctgtttttgtgctggcaccatgctgttttggttactgtagccttatagtatagtttgaagtcaggtaatataatgtctcagctttgttctttttgcctgggattgctttggcttttcaggctcttttttgttctatatgaattttagagtagttgtttttctaattttgagaaaagtgacattggtagtttgataggaatagtattaaatctatagattgctttgggtagtttgaccattttaacaatatttattcttccaatccatgagcatagaatgtttttccatttgtttgtatcatctctgctttctttcagcattgtcttgtagttctccttatatctttaaccttgttcattagatgtatttcttggtattttgtgtgtgtgtgtgtgtgtgtgtgtgtgtgtgtgtgtgcgcgcgtgcccattgcaaatgggattgcattcttgatttagctctcagtttggacgttatttgtatatagaaatgttactgattttactacctttatttttttttatcctgaaacttactgaaattttttattagttctagaagccttttggtggagtctttcgggtcttctaggtatataatcatattgccagtgaagagagataatttggcttttttcttttttcctatttgaatgccttttatttctttctcttgcctgattgctctggcaaacagtagcttcttaagagagtctttgtgttaggcgtatattttgatgcagtgtttctgcataagcaaaagatacttttgttattttagtacgtttgacgtataccatttagttacttagaatttttcagtgtggaaaaggacttctccaattttattttagtatttttttcttcatttaaacacattgtttaatgaattcaaaggaagtctcctttacatgatagcaataatataagaaggacatggctattagaaaattgtggtcactaatttcaggaacactattatttaaaagtcctgtgccttctagattcctcaaggatctagaactagaaataccatttgatccagccatcccattactggatatatacccaaaggattataaatcatgctgctataaagacacatgcacgtttattgcagcactatttacaatagcaaatacttggaactaacccaaatgtccatcaatgatagactggattaagaaaatgtggcacatatacaccatggaatactatgcagccataaaaaaggatgagttcatgtcctttgtagggacatggatgaagctggaaaccatcattctcagcaaactgttgcaaggacaaaaaaccaaacactgcatgttctcactcataggtgggaattgaacaatgagaacacttggacacaggaaggggaacatcacacaccggggcctgtcatggggttgggggaggggagaggaatagcattaggagatatacctaatataaatgacgagttaatgggtgcagcacactaacatggcgcgtgtatacgtatgtaacaagcctgcacgttgtgcacatgtaccctagaacttaaagtgtaataataaaaaaaaaggaaaaaaaaaagtccagtgccaacttatgtccaatacaaagtaatttcaagaatgggcagattccttcacctgcttccagttttttaaataaagtaacaaaaaacagcaggcaactgatgatgtagaacagaagatgtaatgcttccaaaataatttaagttaatgagactcagtttataggcataaatataggtgatacgaggaaccattcagggagccaatgaagtctgaaataatggaaagagtaggagaatacatagttacaagacagcaaatagaatagtgactgcatcaaatggagatggagaaagccacacataatcatgaagtgtctgcttagagacattcttcagtttcacatgtaccttgagaatgttttctttatcttgcccatctttatttctttcttggtattaagcgcagtgccctatatctaggagaccctcgaatatatatatattttgcctaagtgaattttaggaagcttcctatacgagtagttatactcatcctttattttttagtatcacttttttatgactgagaatatctcttaatctaaggaatcatatgtactgtacctgggtatttacattttcgtagccagttgggtacaaaaccttaggacatccctccatttggagaggagtgggatgtccaggttgctctccagctccctggcacatactttattgaacacccatgtagtttagactttgtcaagttgcttatattcacaactaatactgcctattaaattattcttgggaaaattcactaagattttcttttgatgtataacttttctttctttttcttttcttttttttttttttgagacggagtcttgctctgtcgccagactggagtgcagtggcgtgatctcagctcacggcaacctccacctcccgggttcaagcgattctcctgcctcagcctccctagtagctgggactacaggtgtgcaccaccacgcccagctaatttttgtatttttagtagagatggggtttcaccattttggccaggatggtcccgatctcctgacctcgtgatccgcccgcctcggccccccaaaatgctgggattacaggcgtgcactaccgcggctggccagcttttcatttttataaattcatagtgccttttctaagaagaggggaattgctatggaaagtgtcagtcaaagtcaaaataaaaatacagagatgaatctctatgcaaaacattttatttgagaatgtacataaaacagaattgcaatttggggccacatacacagtttggggtggttttgttatgtctgaagaacaaagaaaagcttgggaaattagagaaatgcaacatattgttttagaagaaagctcattggcgctagagtgacaatggtggagttatgccggttcgtttcagcagttactagttataactgatcttagggttatagcaggcagtttcagcagctgggctttacggctaatttttggagcaggtgctatgtgccccaagtgctttcccccactggcccctcaactctgatttagttgggtaagacaaaaatgacccaatttgcataattagctctcaccaaataatcccagttgttcatattttatcctttagtaataaatacattgccccagcccaaaatttaacatactctctcttactgcattgatgacagtcattaaaatgccatttatttaggtattctagtgttttgtttcgttgtgttttgagagatcataccataataattccagataagtcatttaagctcttggaaagggataatgtttattgtgccactgatccagaaactaaggcagtgtcttgtgtaataatgtgagagagggaggaaaccaaagtttattgtgtgttatatgctaaacagttcccagaatgtagctatttatggttaggatcttgttggctactatgagtaatagcaaatgagtaacattattcaagagctgactgcagaccttgaagaatgtttaatccaatatattatgatcacattacacacattacgtgaaaatatgacctttatgtagagagaatcatagactattggaagtggaaagaaccttgtagattatgtcatttaactgccttgtgttgtagatgaagaaaagaggttaaatgtttgtccagaggctcccatcacgcatcactgtggtgggaaaaaattcttgtaagagtgagtgaaaatttcttcatctcagttggttaggaatcccttatcgctcgttatataggctttctatggccattgtttccaagactggattttaagaatcagaaaaattagtcttttgccaagcaagaacatatgaaaaaattataattgactatcagttaatactttaaatttactttgagaaaagcaaaataatttttttttttttttttgaggcagagtctcactctgtcacccaggctggagtgcagtggcgtgatcttggctcactgcaacctccacgtcctgggttcaagaaattctcctgccacagcctcccaggtagctagttctacagacatgcgccaccatgccctgctaatttttgtaattttagtagagatagggtttccccatgttggccaggctggtcttgaactcctgggctcaagtgatccatccgccttggcctcccaaggtgctgggattacagatgtgagccattgcacccagctgagaaaagcaaaataatcttaatagctaaataggaggaatgacttaatttcaaaattgactgtttattaaatagaatacagttaattcacaatattaatattttcctctcattattacaaactggcaaaagcatcatcttggattggcagaagttcatggagtggtatgtggaaaccagtttcctaaagctgcagttattaggtggaggtgaagcgcagtgtcaccatcctgaagtggtactgcagtgactttatttcaacgtttgtctaatgtaaataagggttatgttattaaataattagaagtagaagcatattgcttgggatagtcggtatgtgactcttctttttgtcatgaaaaatcccagagcccttatatatgatacctgatgctttcaattttgactgatttttgtcagttgtgtttgcgagttctgaccgatattatctccataggcagcaaagtagatttatgccgttttcccagtctttgctgcttgtagacatggactcttccagcagttccttggcaccaaatccagacaccaagtctttcatttgcccatctctctggcatttttcaggctttctgtgggtacctgggttttcttctagctctctgccatggctctgtggctgtctttactgctcaaagaaagagctttacatcttaggtataccgtttatgctgacagctgccgcactggcatagagacgtttttaatgggatgggttagcataccaggtgatccaataacgtagatgatctatggggctctgggctttagtattaacttagaaccacgaagacctcagtgcatgctagatatgatctctgtttatctgattatggatgtaggaaatcttagggaaataagatgactttactgttacttctatttaattactctttctcatgtggcttagggatgttttttataatatgtcttaaaatgttaacattgtctttgataaacaggagtcactagtataaatgctaattgtgtacatttttcatgaccccagttcacttaattacttaaagcaaatttttagtttttgtttggtgataaggcaaagggcccggaacattacacacctgactgacacttaatacaattttaaaacacatgctgaacaaatctcagtgggaggttaagagtagtctgtcagtgtcaaggaatacacatattacattgtaaaattgtaaccatgggctagttgtttatatatttattttaaactataatatttaaactatggacacatctaaagactgtgtgagattatatttcagactttgtatattttcttgtgatattgaaattggtacagatctcaaatggtttaccaaaatggttatttgcaggtgaccaaaccaaaggaatgctggtttaatttcttacagaattgctttacttgctgtttgatatgtgtattcctgaaaatctgtgctgttagggcccttgctggaaacagatagcatactcaaattgggtgattcaaagagagtttaaataaaataacacatgtgggagctgagactcattatccttcctcccttcccctccccttctcttccctcctaccctccccctctccttcctttcttcctcactctctttctgagacaggatcttactctgtaacccagactgaaggcaatggcttgatcctagctcactgtagcctcaaactcatggaatcaaacagtcctcacacctcagcctccttaatagctaggactacaggcgtgagccaccatgcctggtttattatcatttctaagcaagaggagataacccttagtaaagcctgcagagaaagcgatatgaagagggttagcaacaggaactgtggcctctggtggatggatttagcctatcttcagtaacctgacagtgggacatctttttttctttttttttttttctgaggcagagtctcgttctgttgcccaggctggagtgcagtcgcacgatcttggctcactgcaagctctgcctcccgggttcatgccattctgcctcagcctcccgagtagctgggactacaggcacccgccaccacgcccggctaattttttgtatttttagtagccaggatggtcttgatctcctgaccttgtgatctgcccgccttggcctcccaaagtgctgggattacaggcgtgagccaccgtgcccagccgacggtggggcatcttatttctccagaggcttcctatggggtcatcccagtcagaaactaggggctggattctgaaggtccagagagcccactgatgcaattcataggatatggctcagtctcccaaggcaaggaacaagatatagagaatgcagtgtgtatttggaggggcagtacacttcattctacaaaatttcacactaaaatggatagaaataggcttggtgaaaatgtatgcaacattgttttcagaacaataatttgaatacaaaattagaacatttaaaagttgttttaatgctaattaaaaaaatttaaaaagtaaaagattttacctaaaaaaagacaaagatgccctgatggaatgggggtataagaaagagttgagactgttacgttatggagaaaagaacaaaatggacaaagaccagggagtaacactctttaagcactttcaaaccagaggacatggttaaactgagccatgaaaaacatgatttctcctggttttctacattcagttgatctaatgtactttgtattcagttgctgttaaattatagtacaaaaaagtaaaatggtatgaattttatttattaataaaactaactttttttttgagacggagttttgctcttgtcgcccaggctggagggcagtggcacaatctcggctcactgcaacctccgcctcccgggttcaagtgattctcctgcctcagcctcccaagtagctgggattacaggtgcttgccatcatgcctggctaatatttgtatttttagtagagatggggtttcaccatgttggccaggatggtcttgaactcctgacctcaggtgatccacctgcctcagccttctaaagcgctgggattacaggcatgcgccacctcacctggccataatacaacttctttgatgtactgacattatttctcattgagaatcataattgtagcaggaaagactgcagtgtgtgaggtcatacatacatacatacatacatttaattattgtataattgaaattcaatgaactatacatatttaaagtgtataatattatgtgtttgatgtgtatatacctttgaaactctttctacaaacaagacaatgaacatcttattccccaaagtttcctcatgtctctttgtaattcttcctttggcccctcccagctcttttcttcaagataaccaatgttctactttctgttactatagattagtttgcgttttctaaagttttatataagtggaatcatatagtatgtactctttttttgtctagctttggttactcagcgtatttattttgagattcagccatgatattacatgtatcaatagttttttttttgtgacagagactccttctgtcacccaggctggagtactgtggtgcaatctcggctcactgcaacctctgcctcctgggcccaaacgatcctcccactggggagctgggactataggtgagccctactgtgcctcactaatttttgtgttttttgtagaaacagggttttactatgttgcccaggctggtcttaaactcctgagctcatgtaatccacctgctttggcctgccaaagtagtacattcatttttattgtgaaatattattatattggattagtttactagagtatgattatgctctcatctgttgatggatattttggttgtttttaggttttggcctttacaaataatgctgctatgaacattgtattcaagtccgtatagacatacatatttccttttctcttgaccagatacctacaagtagaatggttagatcacatgttagatgcatgcttttcaaagtggttgtacaattttacatctacaagtggtgtatgaaatttccagtttttctgccacttgagaaacacttgacattgtcagtctattttattaagtcttttttattttagctattttaataaatatgcagtggtgtgtcattatggcattaatttggatttttacaagttgttcttcattttcaatccttaattcagttacctcttcattcatatctccctgttatttggccattttgagtttgtgaatttctcgtttataatattgtttacctgcaattgctacagacttacctcacgtaagctcttgaaaagctatacctatgctactttacatacactttttttctggcataacagtttttgcacaaaacacagttttcaataaatataagttaagaagtaatatttctatgtataatttcaggcagagacactattgccagtttagtcaaaacaacagtctctagtcaaagaatattgtatcaaactactttgaaatgtacagtttccaattactgcagaagtcccttttaaggaattgcacttccaggtcagacctatcagtgttcttgcggtgtcccctctcacttgaatctgagcttctttgtgagacttgctttaaccaataacatgtcagtagacataccagaaatgcaagcttgataaatgtttttatattgggatttactctgtgaaaccaccatagtcattatcatatgtgggtgaaataccacatggagaaagagacccaaccatccttactctctcaacttgcagccaactcagaagtagaaaatagctatatgaatgagcccaggagagaaaatagcagaagaacaacccatctaattcacaaaatctgagaaataaagtgattattcacttgagccagtatggtttctagtggtttctcatacagcaatagatacatgaaccatagtaaccatatttgtattaaaacaaaaagttttgctttgtttatatatgcctagttagtgggtagatgtggtagtactgtcacaactctttaatctgtagtttgccatgtttccctgtgttttggagcacccttgattttagtttttatttagtcctaagttgttgtttgattttacagcaagggaatcgtgagtcccagaaaggttgaaaaaagggtgaggggaatggtgcagatacaagggaagcaaaggggaaaaaactttaatcatttttcaaaagatggctttatagagaggattgagggctggcaaagtggctcatgcctgtaatcccaagattttgggaggctgaggtaggaatatcacttgagcccaggagttcaaggctgcggtgagttgtgattgtaccaccgcgatctagcctgggtaacagagtgagactctgtctcttacaaacaaaacaaaacgaaatggagagagaaagggagaaaattgaaaatggatgtagaataagagaagttaattctctttagagttaggtcagtcactgaactggttttttgttctaggaagtttcgtcatctccaaaaatagtcacggtgtttgagaaatgtaaattgtatgtaatacactacatggagaatgaaagccaatggtgcattaatattgtcaaactgtgagagaaggcagtcttccatcttgtgctttttttcacacagagatttttcttttatgactatgccaggtttttgtttgttttaattttagtaccatagtgttgaggaaaagaaaattctcattaagcatgtctgattctgatattgaatgtccccctggaagtggatcacctgactactaccttccaaaatatgactccctggcactctttcttatcaacagccccttacaattaagtcacttctcactttgactactataataaactttcattatgtgttagtattcaattcatttttctttctcttgagtaaatatgagtttgtatataattcattacagtttttcccgttaaaagtaatggaaatgattttccatttaatgccttttcttttagtggcagagttttcaggaagaaattacagtcactaagtaggcatacatgtatttataattatgttgagctgttgtgttttagttttctgttttgtgggatttcgggaagatatttttattatcttttatgatgatgattttctgatgagacccttaccttcagctcctttcttctttcttgcttttatcacaacattcccaagggacacatctcatttctgatgctttccttctctgattctttccctttggctggtatctcttgtccagcacatgttctcgtctccttccttgtgattccctagtagcccaggctttgatccaacaggtcttaagcctgttttcagcatttccctgctcagggtgagactccctgcttctcagagtgaatcctacatgacttttttctgtgttctgtcaccaatagatccattccattcttctgttttgcaagtaattcttgctcagctctggtgccagctcaggagccatcttggccaattttgaatatttataatccccctacataattgttatttaaagttagtggtgtttctgttttctagttatgctgtgttgtgatttaggggtgatttcatttgtttcccttgccgatgtgttgttttctggaagatatttggagttaggtggtcatatacacatgcacaaacacatttgtaaaaatacatgggttgggctgggcgcagtggctcttgcccataatcccaatactttgggagaccaaggcaggaggatcgcttgagcccaggagttcgaaaccatcctaggcaacatggtgaaaccctgtctctacaaaaaatacaaaaatgagctgggtgtggtggcatgcatctatagtcctagctacgtgggaggctgaggtgggaggattgctggagcccaggaggtagaggttgcagtgagctgagatcacgccactgcactgcagcctggatgacagactgagaacctgtctcaaaaaaaaaaaaaaaaattaggttgtgttgcacttatgtgcaccttgcttgcttttctcttttaatgtattatagtgtggttttatttaatgatgaatattcatcctaccttatgcacattatttcattatatacatatcttagtaatatacattttgaaaatatagataataggttaaaagagcttaaagcttaacataggccaccttgtgctttcaccacatctccgaatctcatgtgtggctttataagattttgtgtcagagtatgctggtgtcctagtttgttccttgcactgtaacaaaataccacaaacttggtaatttataaataataattatttataataatttataaatattataataatttataaataattatttataataatttataaataattattatttataataatttataaataacagttctggatgctggaaagtctgtgatcaaggcagtggcaggtttggtgtctggtgaagaaggctcagtctttgcttccaaggttgcaccttgaactccatgtcctcacatggtggaagggcaaaaaagggcctagggtgttctctgcaacctcttttgtaaggttgctaatcccattcatgagattgggaaagctctgccctcatgacttaatcacctcctaaaggccccacttcttaatactatctctggggattcagttttttttttttttttttgagacgaagtctcgcaccgtcacccaggctggagtgcagtggtgtgacctcagctcactgtaacctccgcctcccaggttcaagcaattctcctgcctcagcctcccaagtagctgggattacaggagcccgccaccatgcctggctaatttttttttgtatttttagtagaaacagggtttcattttgttggccaggctggtctcaaacttctgacctcgtgatcctccttccttggcctcccaaaatgttgagattacaggcatgagccacctcgtctggctagttttatttttgattgattaattaattaattaattaattttgagacagagtgtcgctctgttgcccaggctggagcgcagcggtgtaatctcgtcttactgcggccttcacctcccggtttcaagcaattctcaagcctcagcctcctgagtagctggggttacatgagtgcaccaccatgtgcagctaattttttgtatttttagtagggatggggttttgccatgttgcctcaaattcctgggctcaagtgattctctcgtgtcggcctctcaaagtgctgggattacaggcgtgagccaccactatagctggtccaattcaaaaatttagcatatgaattttgggggacacattcagaccattgcagctggtaaggtaaaaaagaagaaaatatttgtgaaaggtttgcttctatactgtctgattctaaacttaagaataaaaattggccacatatttattaaaatggggttctctccctaaccattttactaccatatatttcatgtagcaatgttgcaaagaggtatgttttccatgagctacatctaattcttgtctttcttctcatctctcctgagctatttgcctggaaatttaacaggagtacttagaaatgggacataaagaaagatcaccagaagatagtagtctataatgtatatctgaagaaagaagcccacaaaacaaatactggcataatgataacgtggatgatattaggccttcagtggcagcttttgcaatttaacaggaactctgcttgtagtgatatttctgtttaatggatacaaatatgattttgtatttgataatttttttcatatgtaggtttaacgtaaggtttatactccataatatttattgatattcctgaatccatggatgaaaatatagaataatggaactaacaagggttttggagtcacatagacctagctgtgagttactagctgtgtaaactaaattactcaacagttcttaggctcactttccttatttgtaaagcagtgcttatataaaactgctgtgattggttcttgtgtgaattcaatgaggcactgttttcaagtattgattacatcctgatacatgttaggtgtgcctcatactatttgggtcaggaaggtattaaggatagttagatatcactcttcaccaggaatttcttttcatttatatttatatactttctttgagtgggagttttgcctctatgactgttcgagaaatagggctgtacccagcttatctggtgcttgtgctacagattggccagtcttcattgcctaaccgagtactgcatctagaggtctttactttcattggaaaatggtaatgtgttcatattcccagtagaagctcatatagtataaagctacatgtgtgtgtatttttgtgtgtgtctttattgaggtatatggaaatatgatgaacggcatatatttaaagtgtacagtttgataaattttgacatctgtatatgtccatgaagccatcacattccaatcaagataatgagcatatccatcacccacaatagttttctcatgtttctttgtaatgcacccttcctgttcctccccctgtagaagaagcgtgtttctatgtaataagtcttcccgagtagcagtgccatcttcactttgtaatgaggtttttttgggaaatactttgctgtcacatagttcaaagtgactttagtatacagttaaaaatataaaggtaaaggtattgagttcaaagttgttttttcttctgctctacaacttaaccaaaaagtaaagctttccatctagaaccagttcataaaacaactaaaaggcttgcagtttctctgtgtaatcatttcaaaacaatagttttttttcagccaccaagaaggatgcagtcttgacatataaatagaaaacagattgagtttttggctgatattgctatactggtttaaatgttggtccagtcaacttcaggcttagattacaagatttgcaaattagaggaaaaccaaaagggaaagaacatctgcatagattctgactttgtggaattccatacaggcatgcttactctacttctggtggaacaggccatgtgcatagtgaataagcctgaaaagagatcactgttgtgttgtgattatgttaaagacaaaagttgaagtagataattaggcaattcattatggagaaccatgacagtttctacgtcaagtatttttaaccatttttttgggggggaaatcttttgttgatacagtgatatgttactttgccagaataaaaccttgctaaatatcactaattatgttacttgattttctggtatcaaagtattgggatttgaaaaaggtaatttgctgtaactaaggattttaaattggttataatcaaagactatatggatataatttattctataaatgacaacacagtctcagtgagatgtaaggaatccttgtctgctactgggctaatcatacattgtgtatatgattttaagatgttttctaaagatcacctctcctgccatttagatatgaattttaagaactgctttatttgattttttttctcttttattctgagaaggggcttccttatgttctttcaagacatgtttatgggtatctattatgtgtcagctactgttaaataatccaggacatcgtttcttaactgagggaaaaaaggtagagatgattttgatccccaagggatatttggcagtgtctgggggacattttttggttgccacatcatggagtagaaggtgctgttggtatctagcgtgtagagtcaaagaacctgctatactgtgcatcctataatttgcagatcagcccttaacagcaaagaattatctagctcataatatcgatagggtcaagtttgagaaaccctgatccaagaagataaaaatctgtatgtctagaactgacattgctagacatttcttgctagagctgacattctagcaaggagagtgaaacagtaaaaaaataagtaaaatatatagtatgatgatgtaatgtataacaatagtagagggtcgggtgtggtggctcacacctgtaatcccagcactttgggaggctgaggtgggtggatcatgaggtcaggagttcaagaccagcctggccaacatggtgaaaccctctctctactaaaaatacaaaaaattagctgggcatggtggtttgcgcctgtaatcccagctactcgggaggctgaggcaggagaatcacttgaacccaggaggcagaggttacagtgagctgagatcacgccactgcactccagcgtggacaatagagcaagactgtgtctcaaaaaaaaaaaaaaagtagagaaggtagttagataaagttggacaggacagtggtgtttgttgttggtggatatttggattgtttgccattgagggtttgatgaatagtgtggatatgaacatttctatattgcttttggtgtacatttctgtttggtatatgtaactaggagtggacttgctgggtcataagttgttctcactatcttcttctatcttattatcttcttatatcttgttagatatttccaagcagtttttattgttccatgaacctttatttattgccaatatatgaaatgatataattagaacaatgtagtaaatgtgtgtcatttcctgtgttgatgatatcaggagtcttatgagattgccttaaataattgggatttgaaattctggatgtgctttttctccactggtagctattgtaaatataattttgtctcttaatttctcttcctagtattcaaatgttgagcactttttaaaaatttgtatttatttatttattttgagatggagtctcactctgtcacccaagctggagtgcagtggcgcgatcttagctcaccgcaacctctgcctcctgggttcaagcgattctcctgcctcagctgcctgaataactgggattacaggtgaataccaccacgcccggctaattttgtatttttagtagagatggggtttcaccatgttagccaggctggtgttaaactcctgacctcatgatctgcccacctcagcctcccaaagtcctgggattataggcgtgagccactgcgcccagcctgaacacttttaaatagtgtttctttatgtttgagaactgtaaaactaactgtaacagtataaaacgtgatggttgcacaagtatagttggaaaacttacctggaaaatggcagaaatccttgatgtcatctagatcatgaaggggaaaaatgggacaaacatgaagtcctgaatagttaactttataggaaaggtcatgctaagtgaaatggtacaggaaaatttttaaaatgctgtatgaccctcaggtgtgttttgttcaggattgtacaagggctatactttttttctttatttctttgtgtaaagctgttgatcataccttaggatactgaggaccaaatatttgaagagaatttggaaagatttagaaaaactccttttacacaaaaggagtttaaattataaagctggctgaaaaacttgaaaaaattacaaactttgaagttttgttttatgtccatgaatagattattattatcttaaaaataaattttctggctcaataaggtatttatcacaactactataatattctagagccaagatttaatttttgggtttttttttttttttaaataaacatccttttgtttttttaagacaaggtcttactctgtgatccatgctggagtgcagtggtacagtcttggctcactgcaacatttgaccctcgggctcaaacagttctcccacttcagcctccctagtagctgggactacaggtgtgtcccaccagactcggctagacggggttttgtggtattgcctaggctggtctcgaactcctgaactcaagtgatcctcctgccttggcctccctaagtgctgtgattacaggcatgagccactgcatctggccaataaatgtcttttgattgagttatatgttatgtcttttttttgagacccagcctcattctgtcaaccaggctggagtgtagtggcacggtctcggcttactgcaacctctgcctcccaggctcaagtgattcttctgcctcagcctcctgagtagctgggactacaggcgcgtgccaccacgcctagctaatttttgtatttttagtagagacaggatttcaccatgttggccaggctggtctcgaactcctgacctcaggtgatcctcccgcctcagcctcccaaagtgctgagattacaggcatgagccactgcaccgacctatgttatgtcttccttatgttaactgattttatcctttgttagaaaacaattgttgtgacaagtggttttcttttcatttatataattttattaacatcttgtttaccaaacacagtatacaacgaaggttaaaacagttattgtgagatgactggcatgttaattagagcctccctacgtgtgtgtgggtgtgggtggatgtgcttttggagagactaatgcagagcaagggacagtattttgagtgcctctttggcggtgggtttttttttttaaatgacaagccctcaaatatgtggtatgtttaagtcttatcagttatttagatgtagtcacatttatctctgtggaaaatataaaatacaataatttgtatattgtaaagtaatgtcatttttaattttttgattagtctttttcactttcttgaaaaattcagaagaaaacattctgaatgcatctgtttgtcagttttgtccgtgcacctttctcagacaaaaaaataaaatgtacgtttatgatgatgaaaacagctgcagtgcatacttctgagagtcatttgtcaaacgaagcagcaatagaggaaaaatgataatacaccactgcactattaagtataaaactgctgcaattggtgccgttttaaattattaaacactgtaaatgccataaagttaattagaagaggaacaaactctacaaagataaatgtgttttcagtatgattgttaggggagggtacagtagaaaccagtgaatagagaggaaatttatttctggcaggactctacacatggaactgtggctgaactttttaccctaattacctcctgctaatgcctgcagcgggctggaatcaaagtggtgcttcaggccctggaaattctctgatgtggcaaacgtttgttgtgtgaggagggtttcttaagaaaaagcagaatattgtgacaggatttaaaaaaaatttctcagttaccacccacctcacttgttgcctacaaaaatagagtaattgtttgcatctgtgtgtgcttttttatcccctaagaaataactgttataaatcaatgtgacatagatccagtgaactgaggcttgcctgaggtaggatttttttttgttttttaaagtttctcctttaattgaaaatttagattccaaatgtaaagaggttattttttataattgagaagaaacattctatgcatttttaaggagaatttggatcttaaagtgtgcttttcaaaatgaattctaaaaacttttgtagtatcaaactgataactattaaattgcttaatcctggaaaaagtgggaatttccagtttccattattagttctccatctgagactagaacctaaaagacatttctctaatctttgtgaaagttaatatcattccacttatgtgtcacaaaaggtttggccatgtatgcatttttgaaataaaaagaattagttctctaaaagcacctgcttttcaacttctgcctttaaaggcagtgtttctatacaatgtaaaatacaagtaccatgacaagtcattttatataatctatttttaaaaaatagagataggggtctcactgtattgcccaggctggtctcaaactcctgagctcaagcgatcctcccacctcagactgccaaacagctgggattacaggtgcgagccactgtacctggcccattttatatattctaaaagaatccaattttcaaatagtctgcccttgtgcatctgtgctgtcttgtgtctccagctccagcccttatctaatcttcttgaaataccttttagataattcttgaaaagcactaatagcactttttttataatgcaaataaaatcatgtttttatgttggcaaaaatttattttggcagtcttttagttggatgtcctaaagaaatagttttaatttttaaaagcagaatgctgtgagttttcttgatcctaggcaataagaattgtagtgaaatcccaaatttctttcaagattgtgtcagaaactcacagttgctgtggttacagattgcttcattataaccttagtattttgcattttgcacacttatacttttgcattgcatctgtgaccattcattcatatagtagttttgtgaattgtgaatgagggctatttgtttgaactaccaagtttcaaaattatgttacaaacaatttatttttatttcgttcggtacatatgtttacaaaaactttaatcagtggtaaggcacttatatattttcacttcacgtattctttcaaaactgtaattatccacatttgatataatagatatattttgcaacatttggctttgtcatttgacgccccttcattttccgctcaattccaactgcctttacaagaaaagccaaataagaaaacattttacttctctgtctactatgaaaagtaatctgtcaaaacgtgaaactactttttaaagctgtatttatatctgtaggtatttggtgcaatttaagttatatttcactataaaataactgcatattatcattagaaggatttaaatcatcatgtgatatttttctgattctaataacaggaaagagaaattatactaatgtggctttatcacaaattatgtaatataataacatttatgtaaaatgaatgtaaatattcttactagttttcaaacaaaacattttatggtacaagaggaataattttgttgtacttcaataatatgtcagatttcttagaagtattaatttagaacaggatattttattgtcttcttaataaagataagcaaaagcttagatttttctgctatcattttaagaattgacaaggaaaataattgactataaatttttacacatatccttctctaaaatgtttcctgttctgtcttgatataacaggttgttccttgattttgagaattagactttaagcataatctattaattttggctttacttcatttctcagcatgtctcaaatgctgtgatgaactttggttactttgaaatgtttagtgaagtggtttctattgatttcatatgtgtactcaaactaatctacattggtagattatcaagttttaagatgatactagagtaataaaactgggcatactctttcacagtatagtagtatatttggcctcactgtgcttgcttggcagaagatggtataattaacatctttttatgagttgagctagactttagtatcctcatttcaagtaccccatgtttttttgttagctatggttgtgtgtatctgttaatatgaaaaatgactctgtatttttttgtttatcataactgataaggagttttaagttatattgcttttagggaaataaatcccggcaacatcttgctttttgtggttgttagtgcttctactataaccaacttataaattttccctagtatattcttttagttttcaaaagttccttataatagtatgactcaaaactaactgtacatgatttttagggaactttatgatgtatttctttatcattaactaaaattttaatgtttaatttttaactggtctgttttgcctctctattcttctgtattcctctgccagcagtttctgcacttttgttatctatcagaagaaagcgataaaataggaaagtacaatagaatcttctaatggacattaaattcatatatcttccaaaattaaaaaataatgaacaatttattaatatttttgctattaaagctataaatatatttttcttttacatgtggatttacaatatgagatttttagtatcctgaattactactttcaaacagtacactgtaacagttatgctattattatggctgattatattatctactacatgaataccgaaggcagatttgttagttttttctttggttatttggaaacctgatgttactgaagtcaaggttgaaacttcagtcttcttttacttctcttcttcatctataaatagatttcctaatcaaccagtaaatgagtatcagcaacttaaatattacatgttttagcaaccaaaatctttgctattgttagaaacatttccactggtagtttattgctgaatattaaagattaaagtgttccttttttaaaatttgaagattgaatcaaatgtttaaagaaaagcttttcttatcaggccatggttgctgcaataaaagaaagaaagagaggctttcctgtataaagttttacctacatcatagggttattggaaaggttaaatgaaatagtacttgtaaagcctttataacaatgggtggtatttatcaaatgtacaatattcatattctcgtgatgaaattatagatattatacagcagtaacagatattagccttattagaaaagcaagattcacaaaaggtagaatgtcaaacattttaggatgtttgtttcagaaatggaattttcccaagtatgtctcctgaatttctcatttagtcattaattgtttagacttttaaatgaattttaaaaaatggattctctaaaaaaattttatcctctcagcttttttgggagatttttagaggagttttagggtcacagcaaaattgagtggaagatacagaaagttcccacatatctcctgcccgcatacatttatagcctctgccattatcaacagtccccactagagtggtacatttgttatagttgatgaacctacattgacacattgacacatcattatcacccagattccatagttcacattaaggctcactcttggtgttatacattctgtggggttggataattgtatcagacagagtgattaaatcttttaacagatagttaacattaattctcttaattcttttcttaatttttaattaattcttttaacaagtagtactaatgctcaacatacaacagtgagcgagacttaatctctgccctccggaagcttatacggtagttctttttagcgaaagaacttgtaagtccgaaaaatgtacagatggcattaactagagtgtttagttctgttgtttgcgttccttctttaataatgttttaatatctccacatagttaaaaaaaagaaaaaatggaaaatatcctggaaggtttagtaagcaattattttctttattagaacaaactgttgtttggtttgaactctattgtcattggccttggaaatgttggaatttttcattaatatggattattaatattatttacagatatctcacatgtatattgaattatgagttgtcatatggtacttttagatggagtcatttcctttgaggcaagcagaaaaagtgaaatgtttcccatgttagtgttttagttataataacctaaacatagttttatactacttcatgttagatcaagttatgtagaaaagtaattagaatatgtttcacttgcacctcagtagattaaaaccagtttagaagttttaaaatgtgctaattctttttgacatttgttgatttgtctgtttggtgaaggcagatcctggatttcagtttagggaagatgatacttaaaagactgacaaacttgtactttgtgttatcaggaaatgggacctgattatttcttggaggcttggaagattttgctgcattgtcaaatgattgcactttaaccttatatctagtagaaattttactttccttaggtgagatcagagtagttgaactgtagatttgtatgtcaaaactcatagtagtaggtgtatattcaataaatagatgtaacaaaagatggcaaactagctgtcctaaacatccacaaccttgtttaagcctttttatattcagcagattatcatacctcctaattcactagaactttatttatttggaatttcctgattctttcagttaagccaaaaactgattatttggtaacatcagtaaaattgataaccctttaatgagactaactaagagaaacaggagacacaaagtactgatatcaggaatgaaagaaggggcatcactacagatcttatgatcaataaaagataataaggtaatattatacaacttttatgccaataaatttgttaacttacatgaaatggaaaacctaactaattggaaagtttttggtaagtgaagaacaatcagtagaataattttcctgggagcagtttaaaattgtaagcaaatatttcacaatacttttttttttttttttttgagatggagtttcactcttgttgcccaagctggagtgcagtagcacaatcttggctcactgcaacctctatctcctgggttcaggtgattctcctgccttggcctcccaagtagctgggaacaggtgcgtgccaccatgcttggctaatgtttgtatttttagtagaggaggggtttcaccatgttggccaggctggtttcaaactcctgacctcaggtgatccaccccgttggcctcccaaagtgctgggattacaggtgtgagccaccgtgcctggccacacaatactttttaaaaattcaattttaaattaaaatttaacatttaaattaaaaaattttaaagcttatttttcccatgaaggaaggccataaaacagtgatacaagaactcagggaagacatggcgagataaaccccacaaattgatcacagaattgatgaattgtaaggcatggaagggagaatagatagaaaatggaattaaatgagagactgaacaaaatgggaagaaaatcacaacatgtgcatagttcccgaataagaacagcaaagcattgtgattgaggaaatatttaaggtaaaaattaagaaaactttatggaaataaaatgacttcatttgatgtaatgaaatagcacagcgtgtaccaaggatagttgactcagaatggtcaattccaatatatatcattgtaaagtttctgaatttcaggagctttaataactcggaggtggtgaggtgggtgtggggagtgaagagggagtagtggggattaggctgatctcatatttccccacaacaactagagcaaatactataagacccccgagaaagatagtgaaaagcagcccaaattcacttgaaatagaaaggtataggttagaggtcagcaaactttctcctgcaagaaatattttaggttcattggatgatatgttcactgtggcaactaaactatagacaataaagaaatgaataggttcggctgtgtttcaataaaacattatttacaaaaatagcagtggggcaggattttgggcatagtttgttgacttctatataccgccattttggaaatgtttttctagacaaaatctaaaaaaatattaatcatgctgtacttatgcatggtttttgttgtttttattacagacagggtttcattatgttgctcaggctgaagtgcagtggctattcacaggcatgattcatggcacactgcagcctcaaactcctggcttgaaatgggctcaagtggtcctcctgcctctggagtagctggcactacaggcatatgccactgtgcctgtcttatgcatggtttttagtggaggaagactgtgtgggcgtagtagaaaatagtattgtataagtagataatgtatgtatttatattatatgtatattacatgtatatatgtaaataaactggcagcccatatctgtttcttgtaacatttctttcataatttgaattttcattgtatttgtttaccattgtggaacattaaacatatttctttgtattataacttaatttccagtccttaaaagaaaactcagctaattattttgaaacctccttaaagatagtctttctaacacatctttgtgtttaatcacaaataaaggaaacttactttctttttttcaacataatgtattatgtctttgcgtcttatgttgtctgttagatctttcttgaagaagaatgtctgattccaaccccaattgtaatattacctcctgtttttgtgtggagatgtcacttacccctttgtgcctggttacctctctataagttgtgcgagtgtcggaaggtttcataacccagtgtttattgagaactctgcagaagaaaaatgcagaataaagttattaactaggctcatcacaggtttagcttttaatatggttacgtttccattttcttttctttttctttttaattacttaattaaaaacaagaccaactggcttttgttctttaggagccaaatgagaatacaaataatgtaatactatcaaaaattttcctcttaaatttaaagcattagattcagtaacacatgttgaaggttgtgcagctttttcccatttaaaaataagtgtttccatgcttcttgcaatttgtggtagattttaaatgtctttgctattttgtgtttcacttatacatgcacattcttggaaaatgtcactttctcaaatactttgttccgcttttcctaattttgtttcaatctgttaaatatcatgaatgaaaataataaaagtctttgtaaaggaaaatggtattaatgtttagaattttgaaatcataaaagccatatttcacattgctttaaagtgatgttcattgtattgcattaaaaaaaaaaccctctattttgaaaacattgtccaggttaagaatggctatgattctaagaaaatacccaaatgtaaagaaaaaacatactgttacaaataattaaaaaatagatgagagacaaaatttaaatatttttgttagggatttatgaaacttgagttttggaattgaatttaatattgtattatttgtaattcttgtttttcatcaagcataaaagatccttttgcatctgtctactataccattttcaggaggtatttaaattttaaagatgcagaaggtacagtgtgaggctaccatctttcatgcattataatttttaaaaagctgaagtattcaacatcaaacttagtctttgcaaaaagctcaaggcacttagctcatttttcattctatagatgcaaaaaacctagtttgtgacaaagaaaatgaattgttgatcctatgatataaagatataattacacaagaatacttagttgtacatagctaaaagtcttatttaattcctgttttttgacctcttcatgttttggctcctttagtggttcatttgactaggcctcactgcattcttgacttttgtcttacgtagaaaccgttggatctgaaacagattgtcagaaggtttccccgtgtttacaacatgtttggtagtatttatatataaaaagattcctaagttatgggttgagaattctcatgattacttaaccaagtgatgtggttatgtacatttggtcaaatcttttgacaggttaacctcaattaattaagaacaaattactgatatgacttgtgaaaattaaaataacttttgattaaaattgcttaatgctttgtaggcttctctgttttatcatttcaaaaactctccctattgtctcaataaaagtgagttagaattccagaaatgttagtgtgttacagaacttgaacaatggaggctcatttggttaaatttgtttcagaatagattatattgttaaaattttaaaaattatttaaataaatgaaaattgtgtaataatttttcatatactactttaagtaaggaacttaatttagtagatttaaatgtagcatatataaatgaagtcataattttacttatactgctgaaatttaatcaatgtcattttgaagtagtataatggcagaaggactgaaactttattatgtatctattaaaaaacccttctgcgtctttgaggtcacactaaatctaaagatcattttgttgcaaaagagagactggatgggttatctactggtatataatgtattagaacatatttagcatattagaacaacatttatcttctcatactttttttttttttttttgagaccgagtctcgctctgtcactcaggctggagtgcagtggcacaatctcggcttactgcaagctctgcctcctgggttcacgccattctcctgcctcagcctcccgagtagctgggactacaggtgcccgccaccacacctggctaatttttttttttttttttttgtatttttagtagagacagggtttcactgtggtctcgatctcctgacctcgtgatccgcccgcctcggcctcccaaagtgctgggattacaggcatgagccattgcgcatggcctatcttctcatagtttctatgggttaggagtccaggcacaatttaactggttcattaccttaggtcttacaggctggagtaaaggtctcatctgagggcttgactaggggagattccacttctagccttcctaagggcagttcttaagggctgtctgcagttccttggcatagggcttccccacatggctgcttacataatcaggctcccaaaaagagtctctagtgatggtgtttggggagactggggaccagcaaatggaagatggcatgaggtagcctttcgaggtgctggaaatgtatttttctgtctgtgtggagttataagggatatatggactttatgaaaatttaccaaggtgtacactttagatttatatactcgtttttaggtatgttatacttctgtatatctttatttaaaagtaattgtaaaacatactttaataaataactgctagttacttttagattttttgatatccttttctgctttggaactaattttttagttaatatgactcaacaaaagtaaatgataggtatatcctaccactgctttaaccagatcattggataataaccttttaaaataggagatctttgattgcaatggaatttcagctttatgtttttttggtagtggacaaccttatacatttggtgaattaggatacttataatcattaaaaatctaaggttactactacataacgtatcaaaaaatagtggcatgaactccttatactcaggttaacttctggcaccaagataccacctgcctatgtggtgattaaaaaaagaaagtatactagaacaattttttttttcaattttctatttagaaccctgactttagctagttccatgtccttttcttttgccaatattctgcatactctacgggacatgatcttctgtgattctacattgtgggttatagttcctttctccacttatttatattctcatctaagtaagcagtgctcacatttgcttactcctgagtgtgctatcttttctttctctactctaacgttaagtttctaagctctttcttctatctccttggattccaccattgtactgaaaatgaattcctccatatttacaggctggctttcatttgaaagataattatttcctaataatactgactttgttgggttttgcattctcttagcttttttttttttatatttttatttttatagacagggtcttgctctgttgcccagactagagtgcagtggcccaattatagctcattgcagtcttgaattcctgggctcaacgtatcctctctcctcagcctcctaagcagctaggaatgtaggtgtacaacaccacacccagctaatttttaacatttttttatagagagagggtcttgctacgctactaaggctgatttttattttttatttttttgttacttattttatatagtattagtatatatttttaaaaattggctaaaaaacttatacgtgcccttttcatagtgtctctattaatattttgttgttgttgtttgttaatttttttttttttttgagacagaggcttgctctgtcacccaggctggagtgcagtggcacgatctcggctccctgcaacctctgcttcccgtgttcaagcgattcttctgcctcagcctcccgagtagctgggattacaggcacacaccaccacgcctgagctaattttggcaatttttagtagagacaaggtttcaccatattggtcaggctgatctcgaactcctgatctcaggtgatccacccgactcggcctcccaaagtgctggaattacaggcattgagccactgcacccggccatactatttgttgaagttaagaatatatcccatctccatatttttggcaagatgtgccctcttgttcctctccctacactcagtcatactgccatttatctaccttgtgaccagtatgacagattgcattctttttacatacaggcttatattagctatttaaagaaacaaggactcccaggtcatttctaattcttactttctaatcttaacatggctgtatggacagtgttgcatatccttttatcatctgcactgatcccttttcccgactctatgtttttctttatgcatattacttattaatctctaacatttgatttattttactcatttatgtgtttattttgtgttcagtaggtgtctttacctactagaatatgttcaacagtgggaaggattttgccctgttttgcgctcatagtgcctggcacaaagtatacaactaatatacttttgtgttttttgagacggagtttctctcttgttgcccagtctggaatgcaatggcgtgatctcggctcaccgcaacctctgcctcctgggttcaagggattctcctgcctcagcctcccgagtagctgggattataggcatgcgccaccacacccagctaattttgttttttttagtagagatggggtttcttcatgttgctcaggctggtctcgaactcctgacctcagctgatctgcccgtctcggcctcccaaaatgctgggattacaggcctgagccagcacacctggccacaactaatataaatttatcgaatgaataaattaatgagaatataaaaggcaatagttccctctaccattctgagattgaggcctaattttgacttaagattcattgttacttccatattgctcaaaataatttcattggtgtttactaacccattttagatgaggtgttaggatataccaacatcacatacaattccctgtcttcccagtatagttgtataaaaaaacttcagtttttctgttttgttttttttaaaggtgctgtggtctgtctctgtagaagtagagtttttcacttcatgccaacctgtaaattttgcttgcccttggttcagatacctttgttggtctaactaagggggagggcccttgtatcaagcatgaccatctaagactactggcttatcatgggatgctgagtaggacagttctctttatgtcagttgtggctggcagatcttttaattgacctgatggatatcataagattgcaaaggaagaagcaggcatctcaagctgggaggatatcattgtagtcagtgagtagacgtgaggatggaatagagccaagtagatagaataccatgagtaaaaaagttaataaaggtttaaaggctgcagtacaagttgtctgaaaggggagaatgtaaactaatggtttaaaaatgctccaacaaggctgggcacggtggcttatgcctataatctcagcactataggaggccgaggcaggtggatcacctgaggtcaggagttccagaccagactgaccaacatgttgaaaccccttctctactaaaaatacaaaaattagatgggcccggtggcgcatgcctgtaatctcagctctcaggagcctgaggcaggagaatcgcttgaacccaggaggcagaggttgcagtgagccaagattgcgccattgcactccagcccaggcaacaagagggagactccgtctctaaataaataaatagataaccccaacaaacaaacaaaaacctgagtccatctcgtgaaggtctttatttgcttagataaaagtttgaacttcatggcagtggtgtgtcattgaaagctttagaaacaggaatcaaatgattagagagaattgtttagggagattactgtgacaaggtggatttttaagttgtaatgtttgagtgtgatataataaaacagaccacaagggataaattcccattgcttatgatccttaacagtggccactgctcattacactctgtttccaaacatcttgttttcccttcagttctcctggtttctgcttcattctaaaacatttattgacggtaaactatgtctaagcacatgcctgggcatgcaaaatgaataatatactattattggcttaaagaagatcacaatctgatggagacttaaaaataaagtataaaaaattttgaaaatgctatcgttcctagaggttccaccctgtgttctattctcttggttacatactccctttctacttctttctttctcttttctttttcctttttttttttttctctctctctctctttcacaaagtctcactttgtcatagctcactgcaaccttgaactcctgggctcaagtgattctcccacctcagcattctgagaagctgggcccacaggtatgtaccactgtacctggctaatttttttttttttgagacttagtctcactctgtcactcaggctggagtgcagtggtgacatcttggctcactgcagccccaaccttccaggctcaagcaatcctcccacctcagtctcctgagtagctgggaccgtagacatgtaccaccatgcccaattaatttttaaatttttttgtagaaagggggtcttgctttgttgcacagactggtctcaaactcctgggctcaagtgatcctcctgccttgatctcccaaagtgttgggattacaggcatgagccaccacacccagccccattctacttctttatcagttttttcagtcaggatcaggtatattacttatgtcaaaagtccttttttattagtatggttgcatatgtatacacagggatccccactgacttcctgttttgtttaatagcatcaccaagttctcattcagattggctcaaaacctcaatgttgaaataatctgtactctgctgttactgggtattatataaatgtcaagttcctgttagctgatggcgtttgtgagttgttctatatggtttttttgtctagtctttctatcagttgttgagagaagtatgttgaagtctttcctattataattgtggatttgtctatttttcctttcagctctacccatttttacttcagataacttccagctctgttgttcaatatatatacatttagggttgctttgtcttcttgatgtattgacccttctatctttattttcctctctgtctctgcttattttcttagctccaaggtctactttatctgatatgaatcttgacagcctccctgcctccctcccttcattccttctttccttcttccctccctccctctctttctctctttctgttgaggtgactttacataatataaaagttaccattttaaagtatacaattcagcagcatttagcacatttacaatgttgtatcaccacaaccactagttacagaacattttattcacatcgaaagaaagccccatacccgttaaacagtccctccccgtttcctccttcctccagccactggcaaccaacaatctgccttctgtctctgtggattgacctgttctgggtatttcatataactggattcacacaatatgtgaccttttgtttctgacttctctcacttagcataatgtttgggaggttcatccatgctgtagtgtgtgtcagtacttcatccctttttatggccgaataatattacattgtatattttgtatacattgtacactacaatttgtttatccattcatctgttgagagacatatgggtgtttctactttgtggttatgatgaaaatgctactatgaacattcatgtagacgtttttgtgtgaacatatgcttgcttcctcttgggtatatacctaggagtagaattgctgggtcgtatgataattctatgtttaactttttgaggtactgccaagctgttttccacaggagatgtaccattttatattcctaccagcagtggaccagagttccaatttcttcatattcttaccaatacttgttattttctgattttaatttttaaattatgaccaacctagtggctgtaaagttatatttcattgtgaatttgatttgcattatcctaatgactaatgatgttgagcatcctttgtgcacatgttgaccatttgtatatcttctttggaaaaatgtctattcaattcctttgcccactttttttttctcattggaatgtttggcttcttgttgaattacaaaaattaacaatatattcagaatattagacccttatttgatatattatttacaaatgttttctcacattttgtggttttctttttactttcttaataatgtcctttgttccacagaaattttaaaatattgatgtaatctgatttatctgttcattcatttgttgcttatacttttggtatcatatctgagaatcaattgccaaattcaaggtcaggaagatttacctatttgtttgctcctaagagttttatatttgggttagaactattttgagttgggggctagggtttcccttcattcttttgcagagaaatatctacttgtcccaacataatttactgaagagactgtcctttcccccattgaatagacttggcagctttttcaaaagttaattcatcattaatttatttctggactctgaattctatttcatttttggaatgtctaatgctaggccagtttcacagtattttgataaccctagttttgttgtaagtttaaaaatgtgagtcctccaaatttgttcttttccaactttgttttggctgtttggtgcaccttgtacttattacatttgtgtttaggattggatttctcatttctgcaaaaaaggccactggaatttcgaaagatattgtattgctgttatgaatggaactgttttcttcatttgtcttttggattgttcattgctagattttgcgtgttgatcctgcaactttgttgaatttatcagttctggtacttttatagattatctggaattttcgacatataagaatatattatctgtgaatagataccttttatttctttttattgcctaattgctttgcgtagatctttcagtacagtgttgaataatagtgggcatccttgtcttgttcctgatgttaggggaaaaactttcagtttttctttattgaatatggagttagctgtgggtttttcatgagccatttatcatgttttcaagtttccttctttattttttttttaagtcagggtcttgctctgtcacccaggctggagtgcagtggcatgatcatagctcattgcagccttgacctgcagggctcaagcagtcctctggcttcagccccctgaagtagctgggactacaaaaaaaaaaaaaaagtactcttgtattagcagattggctttaaaccaggacagtccttgaatgtgtagtaatgccatctacaactctgccttagtcttcacttcccgcttgagatgagccagaggctcagccagagatgcaaaacgagagtccttgctgtttttctttgagcaaatgtttggccctgtgtatgagtgttttagtttttattccccagtatattagtcagtgtatataaacacagatagacacatagatacacacaaaaccgttttaaggaattggtttgtgtaatttgggggtacagcaagtaagaactaggccaggctagcaagctgagaggctaaaaactgtcagagaaggattgatgctgcagtcttgagacagaatttttttgaaataacatgtaatttcacaaactgaatctctgtgttcagttcttttttttttttttaatctgctgtcttttaaatctctttattcatttccttttaattctggaaaatgtactgtacttcacaaattcagttttctgcatgaactagtctatttatagctccatgtacactttctgtttttactacttttttgtggaggggtagtgtgcagaggagagtaatggacttggttgggtgtttattatttgcttgaggatggtatgttttctgtattcttatgaagaaaataagacttattttttctcccacaattaaaaaaagtttataaagagattttctctcaaggaaagctattattataacttgtagctcaggttcaacagcaagtggtgcctagtactggtttttaacaaatatcaggccgggcacagtggctcatgcttgtaatcccagcactttcagaggtgcatagaagaattgagtgaaaagtacagtggtcttctttcttcttccttttcctcctcctgttccttctttcttcttgacaggctctcactctgtcactggagtacagtggcacaatcatagcacattgtatgtagtcttgaactcctgggctgaagtgatccttctgcctcaacctcccaagtagctgggactacaggcgtgctaccgtgcctcgctgattttttattttttgtagagatagggtcttgctacattgcccaggatggtcttgaacttctgggctcaagcaatcatctcaccttggcctccaaaagtgctgggattagagacggaacccactgcacttggtgcctggactcccctattctttgatacatccactttctcccatcattaacacattaaattagtgtggctagtacatttgtttcagtcagtgtgctgatactgatacaactaatatccatagtttatattaagtttcaccccttgagttgtacattgtgtggcatttgagaaatgtatgatgctctgtacccactattacagtatcataaagatagttcctctgtcctgagaattccctgtactctgcttattactccttttttccctccccctaactcctggcaccactgtttttttttttttttttttttttttttttgagatggagtttttgctcttgttgcccaggttggagtgcaatggcgtgatctcggctctctgcaacctctgcctcctcagttcaaatgattcttctgtctcagcctcctgagaagctgggattacaggcacccgccaccacacccagctaatttttgtatttttagtagagatggggtttcatcatattggtcaggctggtctcgaactcctgacctcaggtaatctgcctgcctcggcttctgaaagtgctgggattagaggcgtgagccactgcgcccggccaattttagaccttttctgacaagcttcttttacttagcaatatgcattcagggttccctcatttctttttctggcttgatggctcatttctttttgttgctgaataatacttttattagcaacaaagaatgaaatacttaagtgtaaaacaagcaaaagatctatatgagtaaaacaacaaaatactgatacatgaaataaaaaaatataaatgtcatctcttcctaagttgatctatgcattcagtgcaattcctataaaaatacaagcaagttattttgtggatatgtactaagtaattctaaagtttgtatggaaaggcaatgctcctagaagataacatagaaaatctaggtgaccttgagttttggcgatgacctcttaagtacaacaccgaaagcgcaatcataaatgaaaaaatcagtaagttgggctttattaaaattaaaaacttttgctccgtgaaagattattttaagagagtgagaagatgggctgcagatggtgaggaaatattggtgaaagacacgtctgactaaagaactaaaaaactcttaaacctgaacagtaagaaaatgaacaatcctattaaaaaatgagcaaaagggtctcagcagctcgggctgcaggaggagtggcagcagccaggcagcccagcttcgcaaaggctctcggcatgctgcggcccgcaggcacctggcacacgtcctccccgccaccaggatgcccgagaggaaggtcagctccaccgaaggggccgccaaggaagaggccaagaggagatcgccgcggttgtcagctaaacttgctcctgcaaaaatggaagcgaagccgaaaaaggcagcagcaaagcattgaaaccaccatctgtaaagctctacatgttcttcacggggtgaataatttctacccaaaacttgggttaaagcttgaaacgaggaagtacaaataaaagggcaaaggggagcaaagggaaaacaggctgaaagaaactaaagaagatttacctgcagaaaagggggaaatgaaaactgaggggagtccagcctctgatgaagcaggagagaaagaagccaagtctgattaataccatataccatgtcttatcagtggtccctgtctcccttcttgtacaatccagaggaatatttttatcaactattttgtaaatgcaagttttttagtagctctagaaacatttttaagaagggaatctcacctcatcccattttttaagtgtaaatgcttttttttaagaggtgaaatcatttgctggttgtttattttttggtacaaccagaaaatagtgtgggatattgaattatgggaagctttgactgtcttgggtgtcagcttaacatttcatagatgggggatagttttcatatcctataatacaaagcatattaaatggcaatatggagtcagtcctgcatttaatgtcttgaacattttaaattacttctattcccgtggtttttttttttattatactttaagttttagggtatgtgtgcacaatgtgcaggttagttacatatgtatacatgtgccatgttggtgtgctgcacccatgttgttttttagtagaattgtttcctaaagaaaaccactctttgattatggctctccctgtcagaattgtgtccactctgtaacatcgttggttgtggttgtcctgttttcctaataactttgttactgtgctgtgaaagattaaaaaattgaatatgtagtatacatgctattcagttgtgaattggtgggatgtgtgtaacagcttatcaaattgtgaagatactggtacttgatgtcctcttaaggaaaatttgcttccaaatttaagctggaaagtcactggaataactttaaaaaagaattaggatacatggctttttagatatttgttatgtatgttaagaattgtgtacaaattgaaatgtctgtactgatcctcaaccaataaaatctcaattatgaaagaaaaaaagagcaaaaacctgaccaaagaagatacacatggcaaataagcatatgaaagatgctcaataatgtatgtgattggggaattgcaaattaaaaataacaattggataccacagttttaaagggctaaaagctctaacattgacaataccaaatgctgagaagaggtggaataacaggaatgctcatttattgctagtgggactgcaaaattgtacagctactttcaaatacaatttggcagtttcttacaaaacttaacatactcataccataagattaaccaattgccctccttggtgtttactcgaatgagttgaaacttacgtcctcccaaaaacctgcacaaagatgcgtatagcaactttattcataatggccagaacttgaatacaaccaagatgtcctccaccatgcaaatgggtaaacattggtacatcctgtgagtggaatgtcattcagtgctaaaaagaaatgaggtatcaagccatgaaaagacatggaggaatgaatgcatattactccgtaaaagaagtcaatctgataattgtactgtatgattctaactatataatgaaactgtggagacattaagttgaaatttttttttaacttctcatctcttttttgattagttctccttttattcacatttgtttgtagaggaaaacattttagtcatagtattaattcactcagaaaaattatgtgaaatgagttataaatttagtggtgaactgtacatggaagcttctttcaaaatatatgtttgaattcaaatgctagtgtttaaaagtctatttagtaactggtaatttgactgaattgaaccatgtcattattatttattgactgccattcaaaataaccttttttatttttacacatttactagagaaaaataggaaacttagacaaacattctttcagcttgagataatcacgagatagtcactagtaacatttttatatctagccttccaaatagatatgtagtcagatatatgcatttcctctaaaatgtaagttccatgaggccataagtggtcaattgaatggatgaatgcatatttaacagacttaaataaaaatctacacacaattttaaacatactgttttcttataaaatgttttttattaagtatatgtctatcacatacttttttttcatccatgttgtagcatgtataaacacctcattcctttttattgctgaataatactccattgaatggatatatcacttttttgtttgtaagttgtttttttttatactttaagttctagggtacatgtgcacaatgtgcaggtttgttacatacgtatacacacgccatgttggtgtgctgcacccattgactcgtcttttacattaggtttatctcctaatgctatccttcccccctcccccaaccccacgacaggccccggtgtgtgttgttccccttcctgtgtccaagtgttctcattgttcaattcccacctgagtgagaacatgcggtgtttggttttctgtccttgtgatagtttgctgagaatgatggtttccagcttcatccatgtccccacaaaggacatgaactcatccttttttatggctgcatagtattccatggtgtatatgtgccacattttctcaatccagtctatcattgatgcacatttgggttggttccaagtctttgctgttgtgaatagtgccgcaatgaacatacgtgtgcatgtgtctttatagcagtatgatttataatcctttgggtatatacccagtaatgggatggctgggtcaaatggtatttctagttctagatccttgaggaatgggcacactgtcttccacagtggttgaactacaagaaaaaaacaaccccatcaaaaagtgggcgaaggatatgaacagacacttctcaaaagaagacatttatgcagccaacagacccatgaaaaaatgctcattatcactggccatcagagaaatgcaaatcaaaaccacaatgagatactatctcacaccagttagaatggcgatcattaaaaagtcaggaaacaacaggtgctggagaggatgtggagaaataggaacacttttacactgttggtgggacggtaaactagttcagccattgtgattaagttgaaaatttatgtccacacagcctgcacatgaatgttcatggcagctttatttataattgccaaaacctggcagcaagttgcccttcagtagatgaatggattaacaaactgtggtatattcataaaatggattattattcttatttttcttatttattttcagtgaggtttttttttttttttttttttgtagagtcttgctctgttgcccaggctggagtgcagtggtgcgatctcagctcactgcaacctctgcctcccaggttcaagcgattctcctgcctcagcctcctgagtagctgggattacagatgcatgccaccacgcctggctaatttttgtatttttagtagagacagggtttcaccatgttggtcaggttggtctcgaactcctgacctcgtgatctacccaccttggcctcccaaaatgctgggatttcaggtgtgagccaccgtgcccagagagttttttgttttgttgttgttttttttttttagtctacctaccttcttactctggtggttcgtgtgctagttgcatgtgtagttttataagaaactgctagactgttgtccaggcgactgttccattttatattcccaccagcaatgtgtgagtgatcccatttgtctttatcttttccagcatttgttgtcactatttttaaattttttttttttttttttttgaggcagagtcttgctctgtcgcccaggctggagtgcagtggtgagatctcggctcactgcaagctccacctcccaggttcacgccattctcctgcctcagcctcctgaatagctgggactacaggtgtgtgccaccacgcccggccactatttttaaatttttatcagttctgatagatgggtagtggtatctcatagtgattttgtattttctttctttttttcctttgagacagggtctcactttgtcacccagcctggagtgcagtggcacaatcactgcccactgcagcctcaacccccagcctcaagtgatcctcccacctcaacccccaaagtagctgggaccacaggtgcatgccactatgcctacctactttttgtattttttgtaaacagggtttcaccatgttgtcaaggctggtctcgaactcctgagctcaagtgatcccgcctgccttggccttgcacagtgctgggattacaggtgtgagccgccgcgcctgggctgttttgtattttctttgtggctattcatgcatctatataatctctttcatgaagtatttctgcttatttactttgttaaaagaaggccatcaagaaggccatgtccgaggtcagctgaacgtatttctgattctcctgggatagtaatttaatgatgctatttgcaaaaactaccatcttttccattgccttttaaagcaaatgcctatgactcaatatttgatgatttaagttataatgaagactcaacctcctagttttttattaatggaagaaggagtaagaaattttgtggagaataggttgataggttttcagaattagagcctgaatttcagacatatattatatgaaaatccaaaaaagttgtagctaagtataattattttggtttgtccagtgcattccaaaattatagatggaggctgggtgtggtggctcatgcctgtattcccagcactttcgggggccaaggcaggtggattacatgaggccagtagttcgagactagcctggccaacattgtgaaaccctgtctctactgaaaatacaaaaaaattagccaggtgtggtggtgtgcatctgtggttccagctacacaggaggttgaggcatgagaatcgcttgaacctgggaggcagaggtagcagtgagccaagatccagctaccgcactccagcctgggcgatacagccagactgtctccaaaaaaataaaaaaaaaattatagattcatttagatgaaaatgtttagtgacttcttgttgatttttgtcttctatatttataatatttttccttttaagaaatctggtttaaatattttgttttatagttcataattacttaatttaaccttttaattttcaataaaagaagcattttttgaaatttgttctttaaatacttttaattaaccctcttcactgtaatgaattcactgtgtaaattccatacctttggctgttgtaatatataaaaatgaggaccttttcctccctaataaaatcttaataacttcctttatgggtatgggtcaaatgtacagtaggtaacagattgttctgataaaatttcaacacacatgctcagtaattcactataaaacaagttacttacataaagaaaaggtcagttaaagagaatttgcattcatttctatttacatttatcatgaatagtgtaaaatgcctttactatgcatttttatatgtatatatgggatcctgggcacaaattacagatttttaaagaagcatttattaataaaaattgcatccttcctgcctttcctacagcctctgatatttgcttacagtagattcagttacattctaaacttggctctaaaaacttcttctaggaacttccccccactttatgctattaggtttacctttaaggtcatagccccatgtttaaatgtcaaacacaatcctttaaaaataatccattagagctctgtagaagtcacatgaagactgtattctgtgtaaaactttcttgtggcactgttttctacaccatttttggcttgtatgatagaaaataaaagcttgtttcatgtctgtctattttagtataacaccttatggggcatgcatactgattattttatggaaagcactctcatcagcctgcccatgaggaaaattaagattgtcttgctatgttccatggaaatggtcaaggcttttcaaaagagaaaacagagaacaaaagaatatgtcgggcgtgcacccaactgtgttattggcaggaaacgtgctgactcctttgtgaatgtgtgaatttgtgaagacccttattttaaagaattatcttttcctattagttgttgaatgagaggtttttctcatatataaatagtttatggttctgacaaattttgttcagttatctataaactgagctttcgtaacatttgttttgtctgtttctaatgaaggcttgttgcatgaagattctcagttgtgacattgtatggatgatgccagtgaagtgatcggagttccagtatctagtgtgttgtagccatcatgagctcctaattgaaggcgacaggctgcttttttcccctcctagttggtcaggcaaaatgttagatttcattcattattaactcattccttatcagcagaggactggattaatttgtagggaacataaataatttttgctttgtgtcaattttagagattgaagttcaggcttatacaagattctctcccacctccagttgttccaattgtatgcatttgtgtaactaccatcataaaaatgatacactaacatttctgtcacaccaaaagtttctcgtgccactttgtgctccataccttcctcctttccctctctcttgcaacactgatttgcttcctattattatagttgtggctgttgtttttttttttaacttttcatagaagggactcatacagtgtgtagacttttatgtatagcttccctactcccacagtcatggtattgagattcacttttgttgttttatagataatttgttctttttaaatgctgagtacttttcattgcattaatatgtaactgtccattcacctattgatggacatttaattgtttctaggctttttattatggctaataaaatacctagttgtgacatatggaaaatgtatgtttaatttttttacaaactggtaaactatttttcagagtgactgtaccattttgcgtctccagcagtaatgtgtgagggcttcaattagtttgcattcttgccataactttgtactactagtttttaaaattttagtcattctattgggtgtagtggtatccattagtggtttcaacttgcatttccctgataattaaatatgttgaacatcttttcatgtgcttacttgctatctgtatatcttctttaatcaagtatctttaaacatattagggccattaaaaaactgtattcttctttttgcttctacaacagttatcatagaattatcgtcattttatttattatgaacacctttattttttatttttcatgcatgaaatcatttattttagagctaatgtaagcttagcccacattataatgttataacattaattttaatgctgacattaaaattaaacattaaaacaacattgatacagaaaataaacatatgacttaatatgtacaagagagttagcaagaaaaacttgataaataattttttttccaacttttattttaggttctgggggtacgtgttcaggtttgttacatcagtaaattgtatgtcactggagtttggtgtacagattattttgtcacccaggtagtgagcatagtacccgataggtagttttttgatcctcactctacttccaccctcctccctcaagtaggccccggtgtctgttgtccccttccttgtgtccatgtgaattcattgtttagctcccacttagaagtgagagcattctgtattaggttttctgttcttgcattaattcgcttaggataatggcctccagctgcatttatgttgctgcaaaggacacgattttgttcttttttatgctgtgtagtattctgtggtgaatatgtaccacatttttttttttttgagatggagtctcgctcctgtcgcacagactggagtgcagtggtgtgatctcagctcactgcaacctccacctcccaggttcaagcgattctccttcctcagcctcctaagtagctgggattacaggtgtgcacgaccacgcccagctaatttttgtatttttagtagagatggggtttcaccatgttggccaagctggtctcaaactcctgacctcaggtgatccacctgccttggcctcccaaagtgctagaattacaagcatgagccaccacgcccggcctatgtacgacatttttaaaatccagtcctctgttgatgggcatctaggttgattccatgaatttgatattgtgactagtgctgcaaagaacataggagtgcatgtgtctttatggtagaatgattgatattcctttggatatatatccaataatgggattgtcctgtgttgaatggtaattctaagttctttgagaaatctccaaactgctatccacggtggctgaactaatttacattcccaccagcagtgtataagcattcccttttctccacaacctcgctagcatctattattttttggctttttagtaatagccattctgactggtgtgagaaggcatctgattgtgattttgatttgcacctctctaatgattagtgatgttgagcatatttttcatatgcttgttggccatgtgtatgtcttctattgagaagtgtctgttcacgtactttgcccattttttaaatggggttatttcttgcttgttgacttatagattctgtatattagacctttgtcagatgcatagttcacaaatatttttctgtccttctgcaggttgtttgctgttgacagtttcttgtgctgtgctgaagctctttaattaagtaccacttgtcaatttttgttgcaattgttgggattgcttttggagtcttccttataaaatctttgccagggcatgtgtccagaatggtatttgctaggtttttgtttctagactttttatagcattatgttttacatttcagtctttaatccaccttgagttgatttttgtatacagtggaaagattttcatatatagagcccagtttcaatctcctgcatatggtttgccagtagtcccaccaccatttattgaatagggagttttttccctattgtttgttatcatcaactttgtcaaagattagatggttgtaggtgtgtggctttatttctaggttctccaacctgttccattggtctatgtgtcagtttttgtatcagtaccatgctattttggttactgtagccttgtagtatagttgaagtcaagtagtgtaatgcctccagctttattcttttcgcctaggattgcttttactattcaggctcttttttggtctcatatgaattttagaatacttttttttctaattctgtgaaaaatgcctttggtagtttgataggaagagcattgaaactgtaagttgctttgggtagtatggacattttaacgatattgagtcttcctatccatgagcatggaatgtttttccatttgcttgtgtcatctctgacttttttcagcagcattttgtaattctcattttagaggtcttttacctttctggttagcagtattcctagggattgtattccttttacggctattgtgaatgagattactttcttgatttggctctcagctgggatattatcgatgtatagacatgctgttgattttcatacattgattttatatcctgaaaccttgctggagttgtttaacaaatccaagagcctttggacagagactaagagttttctaggtattgaatcatatcatctgggactagagatagtgtaacttcctgtcttactatttggatgccttttatttctttctctttcctgattgctctggctgggacttccagaactgtgttgaataggattggtgagagtaggcgtctttgtcttgttctggttctcagggggaatgtttccagtttttgcctgttcggtatcgtgttggctgtgggtttgtcatagatggctcttattattttgaggtatgttccttcaatatctagtttgttgaaggtttttaacatgaatattgaattttattgaaagtcttttctgcatcccttgagatgatcatttgtttttttgtttttagttgtgtttgtatgatgaatcacatttattgttttgaatatgttgaaccaaacttgcatcccaggaataaagcttacttgatcatggtggattagcttttctgtgtgctgctggatttgatttgctggtattttgttgaggagctttgcatctgtgttcatcagggatattggcctgaaattttccttatttgttaatgtctctgccaggttttggtatcagaatgaagctggcttcggccgggcgtggtggctcatgcctgaaatcccagcacttcgggaggccgaggagggcggatcatgaggtcaggagattgagaccgtcctggctaacatggtgaaacctcgtctctactaaaaatacaaaaaattagccgggcatggtggcaagcgcctgtagtcccagctattcgagaggctgaggcaggagaatggcgtgaacccaggaggtggagcttgcagtgagcctagattgcaccactgcactccagcctgggagacagggagactctgtctcaaaacaaacaaacaaacaaaaaacagaatgaggctggcttcatagaatgagttagggggaatctctcatgctcgactttttataataatttcagtaggattggtagcagcttttctttatacatctagtagaatttggctgtgaattcatttggtccagggctttttctcattggtaggttttaaaaaatgacagatacaattttggaattcattattgttctgttcagggttttaatttcttcctgattcaattttgggaggttgttgtgtttctagaaatttatccatctctcctatgttttctagtttctgtgcatagaggtggtaaaaaatgtgttgcatgcatcatcactgttgagtcataagattttcttttcttttctttttgagacagggtgtcactctgttgcccacactggagtgtagtggtatgatcagaactcactgcatcctcaaattgctcctgcctcagccttcctagtagctgagactacaggtgcatgcagaatttaaaaaatattttggacacaaacctttgtcagatatatatttttgcatttattttttcataacatggcacttgccttttcatttttaatttttgtctgttaaacagttaaagtttcacattttgataaattgtgttttgtcagttatatctattttcatgcatttctttttctgtttaagaaataggttacaaagatttttctcaagaaataggttacaaagatttttctcctgtagtttgtccttgacacatagtttttgctattatatttttagacttatgatccattttgagtttgtttttggagcaatttaatttttttcatatagaaatctgattcttttggcaccatttgttccaaaaatgatcttttcatcatttagttatattgtacctttgatgaaaatgagttggccatacaaatgtgagtttatttctcgactcactattctgtttccttgaaatatttgtgtatgcctataccagtaccatactatcctgactattgcagctttatatgtcttatacatgtatatcatttgtatacatccatatctcagagatattatatagtgtaggttcagttcaagatgaccccaataaggcaaattccataataaagcaagtcccgttaattttttggtttcccagtgcatataaaagttatgtttggctaggctcggtggctcattcctgtaattccagcactttggggaggtaaggtggggggcttgcttgaagccaggagtttaagaccatcttgggcaacaaagcaaggcactgtctaaaaaaataaaataaaataaaaaaattagctgaatatggtggtgcgcacctgtagccccagctactcaggatgctgtgactagaggattgcttgagatcaggaattagaggctacagtgaattccatttcaggtgacagagtgaggccctgtatctaaaacaaaaacaaaaccaaaaaaggtatgtttacactatactatagtctcttaagtgtataatggcattatgtcaaaaaaaaatcaatgtgcataccttaattaaaaaatactttattgctaaaaaatactgatgttctgatacttcagtgaatcataatctttttgctgatggagagtcctggttaccccttacggggctctttcctgttcagcgtcatgaaaccaacacatcaaactgaaaatgagtatcaggcagtgcagctttattcagtagccttggaattggagaagtgggaacttagcttaacttctcagctcctgagaaacctggaagttacagatatagggcatctttaatgaagggtttgggcattaagagccaggagaggaatatgtttttcttggaaagggatggagattttcctggaatcaaggagccacctcttttctatgctttcctggtctcttctggtctttgtcattgtgattgtcaactgtcatggtgctgatgggagtgtcacttagcatggaaattggattataatgaagctagaggttcttcagaggtcgattaaactgccattgtggatttcatcagctttagctgggttagacctaagaaggaacttctgaccacagacatcctgtttcctaaaaataaatggagttaaagctgactaggaatttagccatatcacataggcattgcattggccaacaaaaatggggtagggatccagctaagtcatttaggcactacaatgggtagtattaggaccttgctctggattaggctttggcttaagggaatgttgtgtttagtttagtcttctatctaaaccactaaaactttctccatatcggcaataagcctgtttcactttcttctcattcatgtgttcactggagtagcacttttaatttcttcaagaactttttctttgtgttcatgacttggtgatgtggtgtaagaggtctggttttctgcctgtatcagctttcagtacgtcttccttgctaagcttaatcattcctagcctttgatttgaaatgagagatatgcaactctttatttcaaatgaacacttagaggctattgtaggattattaattggtctactttcaatattgctgtgtctcagtgatgaaggaggcctgaggagagggagagagacaggagaatagctggtaggtggagctttcagaacacactcatttattgattaaatttaccgtcttctatgggtccagtatgtggtgccccaaaacaattacaataataacgtcaaagatcactgatcacagatcattctaacagatataataataaatgaaagagtttgaagtattatgagaattaccaaaatgtgatggagagacactagttgagcacgtagtgttgtaaaaatggcttcagtcaacttgcttgacacaggtttcccacaaaccttcaatttgttaaaaaaaaaaaatgcaatatctgtaaagcacagtaaagtgaggtgcagtaaattaggtatgctcgtatgtaagaatcatgttaatttgcataaagattttaaagttagcttgtcatcgtctttaaaaaggcctggtaggattttgattgtgattattaaatacatagatcagtttggggagacttgccatcttaagaaaattataactcccaatccaagaacatggtatttactattatttatttaggtctttgatttattttatctgcatgttatagtttttagtatacaaatcttgcatgtattttgttagacttacatagaattatttcatattttcatgctattgcaaatactttcagtttcaaattgttcatttctatacaaacatgattgtgtatgtagaccatgaattctgcaaccttggtaaagttctagtagctttttaaagagattctttgggattttttatgtagataatgttatctataaatagatcatgttatctgtgatggttttatttctaccttgacaatctggatgctttaaatttatttatctgtaattattgcgctgggtaagacttcttatacaatgttgagtagaagtgataaaagcagacaattttgcctcgttcttgaccttatggggaaggtgtttattcttatatctgtagatttttttataggtgcactttataaggtagaagaaattctaattatggtttgttgagtgtttttctcttgaaaagggtgttgcatttttattcctaaaaatgccatatctgcatctttctaatgtgataatcatggtagtttccccccttttttctgtgaatatggtgaattacattaatagatattttgtagtaaagcagccttgcattcctgcaataaagttcacctggttttgtattgctggattttatttgctaattttttttttttttttgagacagagtttcactgttgttgcctaggctggagtgcagtgatgcaatctcggctcaagattgaaatcagtttcaagcgattctcctgtctcagcctcctgagtagctgggattacagacatgcttgcaccaccacccctggctaatttttgtatttttagtagagacggggtttctccatgttggtcaggctggtcttgaactcccaacctcaggtgatccacctgcctcggcctcccaaagtgctgagattacaggcatgagccactgcccccagctatttgctaatattttcttaatgagttttgggtgtatatttatgagacatatagatatacaagcatatattttattttcttgcaatatatttatttagtttttggatatgtgctactgacattataaaatatgttggaaagtgactcttctaccttacgaaagagttcatgtatgataggtataattttttgttttgaggattttctttgcaagaagttatgaattgaatttctttttagatcgtgagctattcaaattatctttatgtgtagattggttttggcactctgtacattttaaggcatttgtctgtgtcatcagaatatttcctgtttccttcattatttgtttgttccttctttattacttttttgaacactttgaccagagttattgattctattatctttaaaaataacaaagtttttgttttattgattccccctttgcttactcattttattttaagaaattcttgttcttaaaatatgttctgtccctctgtctagaacacagttttttctttattgtacctttacaataagtcttattatgtggaatgcatttccatatacattctagaatgagatctcatgtctggtatatttttgatgaggttttaaactatcaatttagaggtcttttaggccatgttattttcttttaggtaggtttttttgtttttgttttttttttttgaggcagtttcactctgtcgtccaggctggagtgcagtagcacaatcttggctcactgcaactccgcctcccaggttcaagcaattttcctgcttcagcctctcaagtagttgggattacaggtgcttgacaccatgcccggataatttttgtatttttaatagagatggggtgtcgctgtgttggccaggctgatctgaaactcctgacctcaagtgatctgcctgtcttggcctcctaaagtgctggggttacagacgtgagccaccacgcctggcctacgtaggtttttaaaaaaccattttattcttcttgtgtagatatattatgaatctttccttagatttgttccaagatagtcaatagttttgatatttaatgtcattttatatgatttttaaaaaaattttactaattgtttctcaatttataaaaatatacctgatgtttgtatattaaacttttatctagagaccttggtaaatccatatattctaacagttggtctttattatgaatttgcctctgtgtgtgtgtgcacagatgatctatatttctatgcacagattggtattttttgcttttatacaatcaagtttttagcaaataatgacagctttagtttctccttatagtaattacttttcttggcttatgcacaagaccttccatactgtgttgaatagaagttatgataataagcattttttcctacatcctgattttagggtcagaccttttcatattttatgggtgtttgctagtttttgttcgttagttttaaggttggtaccctttatcgtattaaggaaatgtttcttatcatgaataggctttgaagtttattagattcttttatgtatctattggtgtaatcatataatttttcttttctttcatgttttttttttttttgagacggattcttgctctgtcacccaggctggagtgtagtggtgtgatcttggctcaccgcaccctccgcctcctaggttcaagcgattctcctgcctcagcctcccagagaagctgggactacaggcacatgccaccatgcctgcctaatttttgtatttttttagtgggggcagggtttcaccatgttggccaggctggtctcaaactcctgacctcgtgatccacctgcctcggcctcccaaagtgctgggattacaggtgtgagtaactgcaccagcctaatcatatcatttttcttctgtgtagtactaatttggtgagtgatatttttttctttgccaaattttgcattcctaacttgttgacttaaaataagggatgtattatgatcatttttgggataagttttgaatcaatttactaatatcttgttaatcagaggtttgaatattatgttaatgagaaagtatagagattattggtctttcttttttaaaaaaatgacatttttctttcttttttcttttttagcacaagcccaccgtactgttgtgtggatctgtattcacttcgtactggggagatggtcaagtccattcaatttaagacacctatttatgatctccattgcaataaacggtaaggattttttcatgggtttcttgtgtaaaataagaaacatgctctcctgggcatggagaactctaccagtttcaatgactaacttagatttatttttaaaaatctcaaggaaacaccttctgaattctgttcagtggaataactctaagatttcttgatgaatatattcagacttctagtcttgatccattagggaattgtgaattcagtttagtgggatataacaagcatttgtaaaacaaaatggaaatgaatagaaagtatctgagcaaacttaaaaaggttaagtatggttttgagaaatattttaatgtagctttttatatgtattttgtgtatgctgatttatgatgtgaaatgtagttttgctgtgagaaaccaccaaaatttttgaaaagcatgttcctgaactataaaaaaatgctttaaaatatttttattccttcacacttcacagtggagctaaaatagggactagactaatttgtatcctttaaaatttatttcatttaattgctgggaaaatattcagatctatcttgaacttctatgtgacctctactgctaatgacaaattaatcacagaacattagaggagaaaggaaccttaggaatcttctatcactcagcactttccttttccgtttaagcaaactgaagccctgggatggtaaatatcttgatcattagctcttacatgcctcgtataaatcttccatgccattaaaaagcaaaacacctgaaatatagaaaataaattgttttctgccatttcagtaaatttaagtgaagcaaaagactcacaggttagagtttaaagagatgttttgaaacgtgactcagtaaggttgaatgtagaagggagggcaaagacatacttaaaaaatacaaataaaaggaaggtgggttttgatactaataagagaaatatttgaattcaagtatagaaagatgaaaattataggatgtaggaaaaatacccaatatattattgctagaataatatgattgtcctatgacacatcaagttgatcagaagggtatagaagtgttaaacaacgttattgaatgggtagatcctgcagacatatttaaccctgaactgtcctttgtgctgtcacaaacttgattacatattatttggtcaaaaaataatgtgaacacatactaaaaagtacagagaagatttttagaccacagcttccttgtatttcaattacataaatatactagaagtcaaaaaacaacaacacaaaactctttctcttatttactttcctctttaatttaaaatgtttgctccattttaaagaggaaatcaaaactgtaattgtatatcatctgaaaattaatcgcaaaatatggttgctcagttgcttaggtactttatttaaaggtttcaggtcccccacagataaatgtagtcatctatatctgaattgctcctcattctccagaaaccgtacgtatcaataaatggcacatataaaatcacctgtagcccatgcttaattcataactgcacaagagtgaatactacaactagaaattttaaatttgaggaaggtagagcttattcgggagccctagcaagaggtgatatgacaagagtgtatgatatggcagaaaggagactatggtgggaatttattggtgcagaagggacataagtaaactatggttcactcccagaagcataggctctgttggagacctagtagtttaaagcactaagggatcaaaagggtctcgggaagtgtgcaggaacagatgtatccttgaaaattccttctggcagtatggcaggcaatgttaagggtaataagtcttcaaataaataaatgtaataaagagaagatatgatgtaaaccttactgaaacaaggtagcaacactgactcagaacacttatcgctcctccattgtaaccccccaataaaacagtaatttataaagtctgatgctaatgaaaatatagataagtgtaccaatgcaacaaagtagaatctcagattagacacacacaacctctatagacatgtgacttataaaggttccgctgcaggtaagttttttcaataaatattgctccagcactcagatattgatacagaaaaaactcaagtcttgactcctacaacaaaaaacgatgccatgtgaattctaactctaaccatgaaagataataccatttatttgtaggaacattttcaattacaaattcaatttattttatatttacaagtctattaagactttaaagttctttctagcacaagttttgataatttgccttgataatttgtcatttattagttttgataatttatcaatagttttgacaatggtcttcccagtcatttgtccattaagtcttctaatttattggaatttagttgtttgtaatattcctacgttgctaatttaatgactgtaggttatctggtgatgtaggtaatttatgaattctatttccttttcttttttgggagttgggaggactggatctcactctgtcacccagactggagtgcagtggcaccatcacggctcactgcatccttaaactcccaagctgaagcaatcctcttgactcagcctccctgtagctggaactgcaggcatgtgccaccacgcctggctaattttttttaacattttttttgtagagacaaggtcccactgtgttgtccaggctggtctagaactcctggttcaagtggtcctcctgccttgggctgggattagaggcatgagccactgtgcccaatctctctattttcttgatcagtctacctagagatttggttttatttccagctgtaggtttatttatagggaagtagcgtggggtatgtgttgattatcaagttcagcagtttattttctagtttgccagggttttttttggtttgtttttgttttttttttttttgcataaccaggcattgtatttagtgaagtcaatatgaggacgatcatgtttttccttttcaatttgttaaattggatgatttcccagtgttaaaccattcttacaccctgggtttcaccctaggggtaattatctataatcctttttatatattcctggatttaatttttgcagctatgttcatgagggagattcatgtatattttctttttcttattatgccttgtctgtttttttgtttcattcattagacccttaggaaggtatttctttttttggaattttctatgataatttgtgtaggattgttattctatttttcttaaatcttttgagtttctgtcattgggttaacatacatttatggttattatgaccctttatgaaccatcctttgttaatagtgatattcttgttcttaatgtttatctgataataatatatccatttcagctcttttgttactatacgtatggtatgtatttttccatttttcagttttaagctagttgtgtgtttgaatttgttggtgtagacataatatggtatcattatccagtctgacagtttctagttttaaatattctatgtttataaaataaattatgagaaggaatgagaatattatatgcgtgtatgtgtatatagtgtgtgtatataatatgtgcatgtgtatgtgtgtatatgtacttatatgtatatctgtatgtatatgcacacatacacacaccccatatatatctgaatgtatatatctgtatgtatatacacacatacacacacataccccatatatatctgtatgtatatatctgtatgtatatatacacatacacacacaccccatatatatctgtatgtatatatctgtatgtatatatacacacatacacaccccatatatatctgtatgtgtatatctgtatgtatatacacacacccccatatatatctgtatgtatatacacacatggacacacaccccatatctatttttatgtatatacacacatacacacacaccccgatatctatctgtatgtatatacacacatacacacacatacaccatatatatctatgtatgtatatacacatatacacacacatacctcatatatatctgtatgtatatacacacatacacacacacaccccatatatatctgtatgtgtatatctgtatgtatatatctgtatgtatatacacacatacacacacacacaccccataagtactttctctttggttccattgactcttaataatggtgcatttttgtggctgtgtgtgtgtttcattatttgatattttctgtcaaacgctgtgtgtagaggaatagtacagacattggtaattagatatggaaatgccttttcttctatcagggcattaaaagggtattaagttgatataacatgtaggcaaggtggtctgaggctttagtatagtaacagaacagaaatggaatttacaattgagtaattctaaaatttgatattatcacctttataaggatattatctctacctttttgtgtattcagagtacacatacacatatatagcaaattatcacttattagtaagaagcaacccagtaaaatatatagagaaaagtttttaacaggcccagctagaaaaaaaaattgcaaggatctaacagtagtcactcattagaattattctgcatcagtaaatgaaattgttgtttttaaagatgaacaaaattaataaagcatgcatatgaaataatacattttcctttttttatactcatattagcatctgttgctcagatttaccagcttccaattttgaaaaataagctattagtttgttaaatatttagtaacaattataatctctatttgattttttgaagtaaatattaagcttggctatttatattaatatgctgcaaggatagcacaatataaagtggtggctttggatgtattttaggaattttgctttaaaaaagtgtttataactaaattattttctaattatctgtaaatcttgggcattgagaaaaatactgcttttacagattgttagtgaattttactatattgagtcaatcagaaatgacttatatttatgagtagcagttgggaaattcatccgccatttaaacttaaagtgatgggttacataaatccattttatctttaatgccatgactaaaacatcactggaaaaacactttagtagatagccaacaatttattatcttctccattctttttttttcatttccttttgagacaggatctcactatgttgcctaggctggtctcaatctcctgggctcaagtgattctcctgcctcagcctcttgagtagctgggattacgggtgtgcaacactgtgctgggcttgatcttatccatctttactgtagacttattcgattcaaaaataaatgaaaacaaaactttactttgtgtattcatatttttagagacaagatcttgctgttgcccaggctggcgtgcagtggtgtgatcgtagctccctgcagtcttgacctcctgggctcaagtgatcctcctgcctcagcctcctgagtaactaggactacaggctcacaccaccacacctggctagtttatttgtattatttcttatagagacagggtcttcctttgttgcccaggctggtctcaacctcctgggctcaagtgatccttctgccttggcctccaggaatgttgggattgtaggcatgagccaccatgcctggctgaaacaaaactattaaaagacaaacattttttgaggtggtagttttttcttccatcacttttcttctagtcatctctatcttatttatatataggattttgtggtttatatttttacacattttaagaggcagaagtttctagcctaaatattataggaaatgtttaattttaaaattgtattagtaggcacttgttttcatctagatgatataatgcatttctgattccacttacagaatttcacattcactttttttctttctgttttttttctctctctaattttaggatccttgtcgtagtcttgcaggagaaaattgctgcctttgatagctgtactttcacgaagaaattctttgttacaagtatgtaccaattttttttcccttcttatgcctttgggtttatactacttacttgacacaatcagcaaactaactgtaattttctcaacagtacttaatgttttcaattttgatgattttcttgtgattctgtggctattctcattgagtaatattcttgtatgatatatattttcaactttccaacacattttctttatattactaagcaagctttgttgtgggttacctcactttctccttacatactatccttgagtttgtgatttagtttcatatagctgtttcatactttcaaagcagttgttaaattgcttaacataccgtacttttatacattatacctttacatatgagcaaaatttgtttctactaacattagtatctgtcatttaaccaaaaggtgaaaaaaatatatttttcgaataaggacttatattttaaaagagtgttcaaaaatcttcaatactgttaaataaacttatgtacttataaagctgtaagcacaatttcctttaaaacttttgtttgtttttgtaaattgataatatttgcagcttttctgtgggagtatttggcagcttgagattttctaataggagaatttgtggtaagtcctcatttgggtcaacttacagattttctgtatgatggaaaaaaatgtaaacacataaagccttggaaaatatattggcagaatcagtatagaagttggcacattttcaaagaaagcaatttagcagtttcgtattaccaattttactataatttctcaatttaaaccatatatgacagagaaaagagtgaaaaaaccttttacttagaagagagaatagtgtatgtattcttagtttttattgctatttgaaattgaaagttcttgcagaaaaaatgtgtttttagtcatcttaaaatggttaaatgtatcttaaatatacaaatgtcttcaattttcaataatttggcctattatgtaaacatgtaataatatagtgctgtggcaaaaatattgtatcttaattaaatttctagtgccacagacatgccatttcttttcctgtaaaggccataaacaataactttttattttgggaaatatatacatatatataattagagtagtagtatgatgaacacccacgcatttattatctagtttcaacaactatcaaataatggacagtctttttcatttataccccttccccaattattttgaagcatattgcagacattatagaatttaatttgtacatatttattatctacgtctgaaagataagaactttgaaaaattaccaagtgattatataattatcatccaaactgcagtcttttgatttgcacagttgccatactggacttaactctgatcaatatatgtaaacttgtaaagtcctgagcgaacacagatatatagttatcttgtccatttactaccaatgaaactcccaaggtttttgatacaccaaaaccttctttatgaaagtttagtgtccttgctaaatcttttctacaacttaattttcatgcttcttatgtcccatttaatttgaacctctcattattctcattctgttggaggtacatttttcctttgtcttcgtgaccagaatggccttttcactaataccccttctctttatgatgttttaatcctatatatctttctgggcccagtgtagatagtaattcttatatgaaatctttcttgacccctttagcttacagaaacttctccttctaaatcccttaaagataacatttcccactgtctgtttgtagaacattagattttcaacatactttgcaaatcaggatgccctggtcaaatatgcttaggaaatgctgccttctgttgagactagcaatgatgattagtattttgtctgtttaaatttatttgatacatttcttaatttcccatatttatttgataacagacctcatttgttaaccaacaccgttttggaatgcttttgtagtatgtcatctctgcctctcttgaggcacttacattctatcttgtatacattttctatctgtttgccgctagacagtattctcattgagagaaaagttactcagtttgttttggattgaggaaataaagttttaccatggaaggcataatgtgtctatcatgtccttgccaacataaaaatattaatgattttttttgttctcttaataataaaacccagttcactaaagatgaatacatttatcaaaattatgttcggtttcaaagcacaagtggttctttttcagaatgtttagttaatgaaaatgtttgtgataacagtatgtctgaaaatgtagtgcttctctgtcaacagttatcagatgaagaaaattatttatataggatcagtacagatctttataggtctgagttggaaattaaaagtaagtggtgaatattttaagaaatgatatatatatatatatatacacacacatatatacatatatatgcatagatgaatgaaatttctatcttacaagtcacattggggtaaatccagaaattttggaaaggatgagtttgttagaaaattatgtcttcataggcgtcacctcttgagtatctctctcgtatctgcagtatctctcctgtctatctctaaaggatttcccctttgaaaatgggatcttctgttctgcagacttttagtaagcacaaaacataagtcaaatttgataaaagtgaacaggagactgagttgttagcactctttcttaatgcctttcatgctttcctttttctttaatgtctttttgggacatctttgccatgtattcctgaatacttccacctgaattgctggaccactgaatagatgaaacaagttttgttaaagcattagtctcttttgtattctgtgaattcttcactacaggaagaagagatctagagggatcaacagtgtttgtggtactgtagaaggtactttaaaagtgaaatgcagcttttagttaagtcctggtcaagtggctggaggtccacagtgatgaatttttagtaattcctgacccacaaagattatcacttattctctcagagtaatgtttgcatactggctgtcatgggttgggcattccttaaaatctatttagtgtggatttcataaaatctgaaatgtatgttacttaaatggttaaaatattgaaaaaagtagtaaataaaagtacattctgtcatttctgggaataaatgttggaaataagtgtaattaactatgtatataagcccagtaatgtctttttttttcttttttttttttttgagatggagtctcactcttttgcccaggctggagtgcagtggcatgttcttggctcactgcagcctccacctcttgggctcaagcagttctcctgcctcagcttcccaagtagctgggactacaggcaggcaccaccacgcccggctaatttttgtatttttagtagagatggggttttaccatgttgtccaggctggtctcgaactcctgagctcaggtgatctgcccgccttggccttctaaagttctggaattacaggcatgagcctccatgcccggccagtaatgtctttgaggaaagatgttcttaattttaatatagttgtcagaaggtaggatggtgcatgtcttgggaagaatagggactgaaagggagtgtaagaatgtgctttggggaatctataatgtcctttttttgtctggttgttatttatgtgttcaatatgtgtacactttgttgatttgggtaatgctgcatgtatattatatttcaacatgcacttaatatgaaaaagttcagaaagcaacagtaacatatgtttgtgatttctttcttcatactctggatacagtttgatgtagcatttcaccacaggtcccccttacctgttcatctacaaatacccttaccaatagtggtaatgtattttatttcatatttctgtgaggaagtatgtcattcttagttacaaattatttttcttgaaaaccctaggggtcaaatttatgcatatgacatatgattttaggttggtaagattgatgatattctgtaaatatttgaatgaaggaatttggccgattttctttgaaattacagcttcctctaaagtgatttatatcaatatttagaacaaaatttaccatgaccagatttttaaaattaaggaacaaagggtgccacttcataagtagaaagaatcttattttcctccagtttctccccttctccctgttcctttatacagactgaaacttttgtcaggtgaatcccatgcctgtaagctggttttgcctgttagactgaaaggtataggatatagagactggaggataggatactgggatgtagggagcaggtgggacagggcatactgagatagcatttgtggtagttcatttgcctgtagcacatagtttttctacatttattggtacctagttcttaaggtaggaccatagcccatgttgaatgacaagatctccacttaatgaggttgttgttttgatcatgcaagcagttatcttctaaaatagtttgaaaaggttttgtataatacctttttagtgcattggttatatgtgaatacaatgaagggactgtaaaataagtagagacagctgtgtccatcagagcaagcatcatgggaatttgtgccaaagggtggaaggaacaggtaaagagagctgatagaggactgttaatggaacgcatccaatatgatgagaaaggagacacctttgtatttggatataaagaaaaagtcgccttgagcagctgtctgatgtggaaatccaaaacccgtgtatgattaggaaaacaaaagacaaagaccgatagatgtcattagcagtcattttcagtgttcttaaattgaaaggtagatatgaagtctccagagagatcaaaggagtgtacagtaagcaatcttgttccattggcctctgtttttacttggaggagaaaacttatttcttataatcttagtgttatttcttggttttaatgtgttcttcatttatgttaatgattaataacaaatagaacaaatggaaatgcaaagtttactttaaaatgcaaaattatctttaagttttgaaagaggagctctgcttttatgtgaagaaacaagtttgtaatatttatgagaattcattgataggttagtgtgagttctaagttcagcttacattaaaagttaaacctatctttgtttttctgagttctccataagatggaaaaggttactatgatgtttttagggcatgtgctggtgctggaatcatagtggacactcagtgaatatatatgcagtgaactaacttgtgactttttcattctctgcacacaattctcacccattgagtcttagaatggcagtactcatgaaattcattttaaactaaaaactcataaaaccttatgagagtccttaatcagctgtatgatggttaaacacatctgtgaaatggtatttaatgttttatatgcttatgtgtttttctggggaggatgttcacttttttttttttattgttgttgttgtttgtgtttttttgagatggagtctcgctctgtcgccaggctggagtgctgtggcacagtctcggctcactgcagcctccatctcccggcttcaagtgattctcctgcctcagcctctcaagtagctgggattacaggcgcatgccaccacacccagctaatttttatattttttagtagagacagggtttcaccatgtgggccaggatggtcttgatctcttgacctcatgatccgtcctccttggcctccgaaagtcctgggattacaggcgtgagccaccgcgcctagccatatgccacattttatctgatcgttagttgacagatatttagtttgtttctacttttgggctgttgtagataatgcttgtatggacactagtgcacaagtttttcagtggacatatgttctcttgggtatgaacatttagctacaagtttttgtaattttgaaatttgaatttccctgatggctaatgacactgaccatttttaatgtgcttatttgccatttgtatatctctgtccatttttaaattatttgtcttttcaatactgagtggtaatattttatattctagatatgtcacttatcagatatatctttttgcaaaaaatgttccctcattctttagattgtcttttcactttcttcttttttttgttttgttttgttttgtttgtttgtttgtttttgagacggagtctcgctctgtcacccaggctggagtgcagtggtgcgatctcagctcactgcaagctccgcctcctgggttcacgccattctcctgcctcagcttcccgagtagctgggactacaggcgcccgccaccacaccctgctaattttttgtatttttagtagagatgggatttcactgtgttagccaggatggtctcgatctcctgaccttgtgatccgcccacctcggcctcccaaagtgctgggattacaggcgtgagccaccgcacctggcctggtcttttcactttctttatggtgtcttttaaagcatgttaaatttgcatttgttttgatgaagtccaatttatgtatttttcttttgtcctatataagaaaccattgcccaatccaaggtcatgaaaatttacagtatttcattctaagaatttaattgtttaacttttttttttttattatactttaagttttagggtacatgtgcacattgtgcaggttagttacatatgtatacatgtgccatgctggtgcgctgcacccactaactcgtcatctagcattaggtatatctcgcagtgctatccctcccccctccccccaccccaccacagtccccagagtgtgatattccccttcctgtgtccatgtgatctcattgttcaattcccacctatgagtgagaatatgcggtgtttggttttttggtcttgcgatagtttactgagaatgatgatttccaatttcatctatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtgctttgggtatatacccagtaatgggatggctgggtaaaatggtatttctagttctagatccctgaggaatcgccacactgacttccacaatggatgaactagtttacagtcccaccaacagtgtaaaagtgttcctatttctccacatcctctccagcacctgttgtttcctgactttttaatgattgccattctaactggtgtgagatggtatctcattgtggttttaatttgcatttctctgatggccaatgatgatgagcatttttccatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggtggcctgttcactctgacggtagtttcttttgctgtgcagaagctctttagtttaattagatcccatttgtcaattttgtcttttgttgccattgcttttggtgttttggacatgaagtccttgcccatgcctatgtcctgaatggtcatgcctaggttctcttctagggtttttatggttttaggtctaatgtttaaatctttaatctatcttgaattgatttttgtataaggtgtaaggaagggatccagtttcagcttcctacatatggctagccagttttcccagcaccatttattaaatagggaatcctttccccattgcttgtttttgtcaggtttgtcaaagatcagatagttgtaggtatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatgaaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaatgcttgtgattttggtacattgattttgtatcctgagactttgctgaagttgcttatcagcttaaggagattttgggctgagacaatggggttttctagatatacaatcatgtcgtctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgacgctggcctcataaaatgagttagggaggattccctctttttctattgattggaatagtttcagaaggaatggtaccagttcttccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttcattgtgatgttagggtgtctattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagtaggttgttcagtttccatgtagttgagtggctttgagtgagattcttaatcctgagttctagtttgattgcactgtggtctgagagatagtttgttataatttctgttcttttacatttgctgaggagagctttacttccaactatgtggtcaattgtggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaatccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagaatttagtccatttacatttaaagttaatattgttatgtgtgaatttgatcctgtcattatgacgttagctggtgattttgctcgttagttgatgcagtttcttcctagtctcgatggtctttacattttggcatgattttgcagcagctggtactggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggccccctctctcttctggcttgtagggtttctgccgagagatctgctgttagtctgatgggcttccctttgagggtaacccgacctttctctctggctgcccttaacattttttccttcatttcaattttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcgtttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaattcgatcgtctgaagccttcttctctcagcttgtcaaagtcattctccatccacctttgttccgttgctggtgaggaactgcgttcctttggaggaggagagaccctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataacctgccgtgtgaggtgtcagtgtgctcctgctggggggtgcctcccagttaggctgctcgggggtcaggagtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccctgcccccagaggtggagcctacagtggcaggcaggcctccttgagctgtggtgggctccacccagttggagcttcccggctgctttgtttacctaagcaagcctgggcaatggcgggcgcccctcccccagcctcgctgccgccttgcagtttgatctcagactgctgtgctggcaatcagcgagactccgtgggcgtaggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcacggtgcgtgcacccactgacctgcgcccactgtctggcactccctagtgagatgaacccggtacctcagatggaaatgcagaaatcacccgtcttctgcgttgctcacgctgggagctgtagactggagctgttcgtattcggccatcttggctcctcaattgtttaacttttatatttaagcctttgatccatttttgtatgtggtatgagataggggtccacgttcattccagtccaaatgcttttgcatttggatatccagtagtcccagcaccgtttgttgaaaagacttctttcaccattgacttgtcttggtattcttgttgaaaatcagtggacttataaatgtaaataactgttttctttaaaaaaagggctcagactttttatttgtccttgccaggagaaataaggcaaagtatcacagagagcagttcagtttttttgttttttgaaatgaattcaggtcacctctccattaggaccactttctgggaggatgccatctaaaattgcatcatgcttgtgtaccttcttaattacttttttagtaatggacaaatatagtgtgcttctaaaaattttttaccttcatttaaattgggaaatgaattcttttaacatccagttctctttgtccaataaaattgtaaacatgttagaattaggcctagtattatagagattcatgtccccccaaccccttcacttgttttcagactttacctggaggcaaagattaatctttaaaagagtcatgcttataaggttgggatggtgctgagtggcttatgttctgctgattccagctataaagcattcttttggcaagcaggaaaacagttgttttcattacaatatactgtaattcttgaggtccactgaactctaaaaatacggactcaaaaaatgaaatgaagaattgtaaactgtgtttttccttaggacccttttgtatttgtgaggttaaagtggttatcagaatttattgagagttagattatttagttttaaagctaattcaggagattctctgtgtctaatgtaacaccactgttcacaagtacttggttctatttttcatgacgaattttaaaaggggaaaaactttcttatagatcatatttatcctcatttctccagctctgaaattgtcagcggaatacatgtatacatactcatataaaattatatttttaatgaataagattaatctattcaatggtctaatctattgtgtaaatactacacaatttatattacagtatgttgtctttttataatttttagtgtgtttttgtcctatatatgtttccataatatgcatttaatagataatagtaatattacagttaacctgaagtcagttttccggaaaccctaagtattgcaaacatactccttcaaacagtagcatgaatgaacagttttttaaaaagggagcaataaaatgagaaagcttttattttgtttatgtggactttcttttagggtctgtctcttctctataagtttattattttcttttcaagacgaaaattcaaaatagatggcagtttagggagctaggctaaaaatggctgtgtactggaagtgacagtaaggtgtgcttctttagtgcttttgagcatagcaataggaacatagtcagaatgactagggagtggcagcagggaagagtcagcggcgaagaaaaccgattcttcaatttacacatccctgtaatcaagttggaggaagatagaaaataaacagtaaatatatgtcatagaacaattaactgttgttattggctagaactgcaagcaagaagaatgatattgagtgaaatgtaaatacaaaggattatgcagttccctaacatctttctgtggaggcagactttcagagttacttgtcttcattggcctcagtgaggtcaaatacttgttctttttctctcctcattgtagtatcatgtctgatagtctcatttatcttttgcctttaaattcctgaacccatcatatcatttctctctcctctcccaaaattcttccttgatttatgaatgttagacttaaaatggccctgttaacttcattctcatgtttaggaataactgtataaaatgcccagtgtttgctgaaagtgatgaccagttctttccagatttgtttcttattgggacagagttaagccaaaaggaaactaaatagagggggaaaaatgcaccttacttagctaacaaaataatgactagtgttacaggaattttatgtgagacttgaaaaaatataagcatttgatttttctgtttttctggcatcgatatatgatgcaccaacagaaaagttattaagaaatttctcaatagtgccatttgaaatttttcaggctgctatccatgtccagggccaaacatgaatcctattgctcttgggagccgctggcttgcttatgcagaaaacaaggtaagacgtggcctgtgtttggattatttgtaatggagcaagtgttgaaggattttccataaaaaatacctgtgctccatagttgattaccaataataaatgttttacttactagttcatttgctttggtttggttttaattgtgcaactaataattgaactcgtttaagaatttataaatgtttggcagttgtcattaagtccagactctgtagaaccttaattgttttagcttggttttatatagagaacttcattctattaatttgcagcattgagatgaccacagtagtggtattaaggaaagtagtttttgactttttagaaatcaggaggcaggagtaacttctgtcttcattggtagattagaaacctgggcatagaataatttaattgacaaggctaggcgtgatggctcacgcctgtaatcccagcactttgggaggctgaggcaggtggatcatttgaggtcaggagttcgagaccagcctggccaacatggtgaaaccccgtctctactaaaaatacaaaaattagccgggcgtggtggcatgcgcctgtaatcccagctactcaggaggctgaggcaggagaattgcttgagcctgggaagtggaggttgtggtgagctgagatcgcaccactgcactccgtctgggcaacagagtgagaccctgtctcaaaaaaggaaaaaaaaaaagaataatttaatttacattaactatatgctaacaactatatctaaataagggttcagccatttgttttaatagttaaatcacacatgttcacattttgttgacttcttcggttatttatcaatttatttattaaggtcatcataataagtgaagatactatatgcactaggaattttacttatgtctgatttaaggaaaaaggtaaatttgaatcttcaaaaagaaagataaaattcttttaattccatttagtaccctgcatgtgaatatagaatgaaatcttctaaaagaatattactatttttggtttcgtttttgctagttgcatagttattgtatcttgagattaatatgaattaatatgaaatagttcttgacaaaattaggatgtggtaagtaaagtagttatttggtaaagccaaatctactaaatttctagcctctggaatgtacaaaaatcaagaaactactgaagaaaattatttttctgcataaattctttgagatcttatccataaatctgtctaactactagatatgttacatcttcctgaattctgtatttatattccattttgttttttctcttgattttccagtatatcttgtaaaaatagctctttcaaattattcttttcaaacaaaacaaggcatacaagtaagtgtagtgacacaatggtatcttctaatgtttctatctgtaaagcatttcccttgagtgctggaaacattcaagacaaagatgtataaattgtcccttggttcttgtggatgtattctcacatatggggaactgcccatttggaagtggaggtaatatgtaagtagttacatattgcctttgaggggaaagaactcccttcatagatgcatagcctgaatatgcaccagttgttttccctcttcaggaatacatgttaatatctggtgtcatgtacagagaccagacaacgtagtggccttcacaaggagtttgtgagtcaaatgtcgtgctttcatctcaaaatatttctagataaatgtccttacatagtattttcataagagctagcatttattagtttctaattgttttagctttggggctgagtatagaattgtaaaattgaattaaattttggggtaccagtctctttcagtgaaaatgctctttgactataaaatcttaagaagccgtatatctttgtttagttttgagattcacagggtacacgtgcatgtttgttacacaggtatattgtgtaagggtggggattcagcttctagtgtatccatcatccagatattgaacattgtaccccataagtgatttttcaaccctcagctgcctcttccctcccccttttggagtccccactgcctatttccattttcatcatcatgtgtacccattgtttagctcccatttataagtgagaacatgctatttttgattttctgtttctgagttagttcacttaaggtaatggcctccagctccaagcatgttgctgcaaaggacatgatttcattctttctgtggttgcaaagtattccatggtgtgtataaccatattttctttattcaaataatcagctgctgatagacacctagtttggttccatgactttgctattgtgactagtactgcgatgaaaatacaagtgcctgtcctttttaaattaatgatttcttttcctttggatatatacccagtggtgggattgctgggtcgaatggtagttctatttttagttctttgagaaatctccatactcttttccatttacattcccaccaacagtgtataagcatccccttttctccatattcctgtcaacatctgttgtttttgacttatttttttttttttttttgagacagagttttgcttttgttgcccaggctagagtgcaatggcatgatctcggctcaccgcaacctctgcctcctggattcaagtgattctgtctcagcctcccaagtagctgggagtacagacatgcgccaccatgcctggctaattttgtatttttagtagagatggggtttctccatgttgatcaggctggtcttgaactcccaatttcaggtcatctgcccgcctcggcctcccagagtgctgggattataggcatgagccccagcgtccggccgtttttggctttttaagaatagccgttttcggcccggcatggtggctcatgcctataatcccagcactttgagaggccgaggtgggtggatcacgtgaggccaggagttcgagaccagcctggccaacatagtgaaaccctgtctctactaaaaatacaaaaaattagctgggtgtggtggtgggcgcctgtagtcccagctactcgggaggctgaggcaggagaatcacttgaacccgggaggtggaggttgcggtgagccgagatcatgccatcgcactctagcctggccaacaagaatgaaactctgtctcaaaaataaaaataaaaataaaaagtcgttttcactggcataagatggtatcttggtgtggttttaagttgcatttctctgaatattagtgatgttgaacatttttttttcatttgtttgttggccatttacattctttttgagaaatgtctgtttatgtcctttggggtttttattggagtttgtttttttcttgttcagttgtttgagtttcttgtagattcttagttggatgcataatttacaaatattttctcccattgtgtagtttatctgtttactctatcgattatttcttttgctgtgcaggaactttttagtttaattaagtgtcatttgtctatttttgttgcatttgtttttggggtctttgtcataaattccttgcctaggacaatgtctagaagagtttttccctaggttttcttctaggatttctatagtttcaggtcttacatttaggtctttattccatctgagttaatttttgtatatggtgagagataggggtctggtttcattcttctgcatatgactagccaattttcccagctccgtttattgaatagggtgtcccttctccattgtgtatttttgtcaactttgttaacaaaatatcagttggttataagtatctgatgttattcagttctctgttcagttatcttgacctatgatcttttttttttttttttttttttttgcacgacagagtgtagctctgttgccaagggtggagtgcagtggcgtaatctctgcttgttgcaacctccgcctcctgggttcaagtgattctttcacctcagactcctgagtagccgggactataggcacatgctaccacacctggctaatttttgtatttttagtagaaatggagttttatcatgttggccaggctggtcttgaactcctgacctcaaatgatccacccaccttggcctcccaaagtgctgggattgcaggcatgagccaccatgcccagcctatgtgtctacttttgtaccagtaccatgctgttttagttactgcagccttgtagtatagtttgaaatcaggcagtgtgatgcttcctgatttgttatttttgcttaggaccgctttggccatttgctgccccaccccattttattttattttattttattttttgcttccctatgaactttaggatagctttttccaattctgtggaaaaaacattaataatttgataagaattgtgctgaatctatagatttctctggccagtatggtcatttaaatcatattgattctttcagttcatgagcttgggatgtttttccatttgttggtgtttacaatttctttcatcagtgttttgtagttttttcttgtagagatctttcatctccttggttaaatttcttcttatatatatattttcgtaactattgtaaatgtgattgcctctttgctagatcattattggtgtatagaaatgctattgaattttgtatgttaattttatatcctgcaactttactgaatccgtttaccaaatctaagattttgtgcgtgtgtgtgaaatcattaggtttttctagatacaagatcatgtcatcagcaaagaggggcaatgtgacttctacttttccaatttggatgccttttctttctttctattgccttgttgctttggctgggacttcagtactgtgtcgaatacgagtggtgaagttggcatccttgtcttgtagtaaatcttagaggaaaggcttttaaattttccccattcagcctgatgttagctgtggttttgtcatatatggtctttattattttgagataatttccttctatgcctagtttgttaagagtttttatcatgaagggatgttgaattttattaaatgctttttcttgtatctattgagatgatcatatggtttttgtccttcattctgttgatgtgattatcacttattgatttagatatgttgaaccatccctatgtctctggaataaatcccccttgattgtggtctattatatttttgatgtgctgttggttttgattttctagcattttcttgaagattttggtgtctgtgttcatcagggatcttggcctatagttttcttttttgtggcatccttgtctggttttggtatcagatgatgttggcttcatagaatgagttagggagagtttcttcctcttttatttttttggaatagtttcaggaaaattggtgatctcttttgtacatttggtaggattcagctgtgaacctgtctagtcctgggcttgctttctgggagactttattacctactcactctcactactcattattggtctgctcagatttctgttttttcctgattcaatcttgttacgttaggttgtatgtttccaggaatttatcaatttcctctaggtttttcagattttcagtgtatagctttttataatagtttgctgatctattgtatttctgtggtatcagttgtaatgttctctttttcatttctcattttgtttatctgggtctttcctttcttggttaatctagctagtgtttatcaattttgtttatctttttgaagaaccaattttttattcattgatcttttgtattgtttcattagtctattttgcttagttctactctgtttattatttcatttcttctgctaattatgggtttggtttattcttttttagctcctttgggtgcattgttagattgttaatttgtaatctttgtacttttttgatgtaggcgtttattgttgtaaacttccgtcagcacaccttttgctgtattccacagttttggtatgttgtgtttcaagatcatcatttgtttcaagattttaaagaattgactcagtagtgttcaggggcatgttatttgatttccatatgtaaagtttccagagtcccttttggtatttatttctagttttagtccattgtggtctgagaagatacttgatatgattcagtctttaaaagtgtattgagacttgtggcctaacatatggtctatcatggagaatgttctatgggctaagaatgtatattctgcagttgttggatagaatgctctataagagtctattaggtccattgggtctaaagtccagtttaaggccaggcacggttgcacatgcctgtaatcccagcactttgggaggccaaggcgggccaatgacttgaggtcaggagttcaagaccagcctggccaacatggcaaaatgctgtctctactaaaaatacaaaaatagccaggcatggtggcgtgtgcctgtaatcccagccacttgggaggctaaggcaagagaaccatttggacccaggaggtggaggttgtggtgagctgagatcactgcactccagcctaggtgacaaagcaagactcagtctcaataaataaataaataaagtccagtttaaatccaatgtttctttgttgattttctggctagatgatctgtttaatgctgagaggagttttgaagtcccccactattactgtatttcagtttatctctctctttagatatagtatatactaatatttgctttaggaatctgtgtgctccagtgttgagtgcatatatatttagaactgttatatcctcttgctgaattgatccctttatcattatataatgaccttctttgtcttttttttttccagctgtttttgactttagagtctgttttatctaatataagtataactacccctgttcacttttggtttccatttgtgtggaatatctctttttttttcccctttacttttagtctacatatgtctttatggtaaggtaagtttcttgtaaggagcatatagttgggtcatttaaaaaaatccatttagttattctgtctcttttaagtggattatttattttatttacattcaaagtcattattaatatgtgagactttgttcttatattgttgattgttttctggttatttcgtatatttttggtttcattctttttctcttattgtttgatgttatggtttggtggatttctgcagtggtactctttgagttctttctctttctcctttgtgtctttgctttaccagtgagtttcatagtttggtgtgtttttgtgatactaaatgttgtcctttcacttccaggtttagggctactttgagcatgtcttgtagggtcaatatagtgataatgaattttctcagaatttgcttgttggaaaaaatgtcatttctccttcatttatgaagggtaattttgctggatacagtattcttgactgacatacttttttctttcaaccctttgaatctataattccattgtcttctggcttgtgaggtttctgctaagaaatctacagttaatgtgatgaggtttcctttatatgtgactagacacgattttttcttgctgcttttaggattcactctttatctttgattttagacaatgactataatgtgccttagagaagacctttttccattgtatctgcctggggattgctaagcctgttgtatctgaatgtccaaacttttgttagacttgggaagttttcatctattattccattaaatgtgctttcaaattttttctttctctcttcaatgtcaggaatacttataattgtaatattttgacactttatgtttccccagatgtcataatgtcttcgcttatttttaaaattcttttttctttatttttatctgactggattgtttcaaaagatctgtcttcaagttctgagattctcccttttgcctgatgtagtcagttttattttacttatttatttatttatttagagacaggatctcactgatcttactctgtcatccaggctgaagttcactggtgcaatcacagctcactgcagcctagacctccagggctcaggtgatcctcttgcctaagcttcctgagtagctgggtctacagatgtgtgccaccacaccaggctaatttttttaatttttattttatttttatttttttttttggtagagatagggtcctgccatgttgcccaaactggtcttgaacttctgggctcaagcaatcttcctgccttgacctccctaagtgttgggattacaggcatgagccactgtacctggccagaatttctctttgacccttttaaaaattatctgtctctttggtaaatttctcatttatattctgaattgtttttctgatttttctgtattgtttttcacagttctcttgaatctcacaaggttgttttaaattattattttgagtcctataaatgggctctcataaatttctttttgattagaatctggctggagagttattgtgtttctttggaggcatcatattttatttttcatgtttcctgtgtctttacattgatatttgcacatcaggtgcaacagttacttcttcatatttttacatttactttcgtagaggactttttttattaatgaagatatatctatagtactggttggataggacactttggtcttgattctgggtgtgtgcggtaatgtagtctgattttttttttctgtatacatcattaggggtatttattatttacttaatgaattagggtgtgattattagtggtggctgtggtgaagttttgctggagactgggatgccaggttgactggtcatcagtatgcagtggtggcagcattgggctgagtgtgcctatccttgtgccccagagtagtgtacactggcacctatattggtggttacaagtgggctgattgttggtcttccaggtagcttgcttggatgctggtagtggcaatggtgaacagtatgggtgggctggttcctgagcccctgggcagccagtgtaacatgggtgataacggtagcagtggcaagataattatttttgttcctagtggcgtgtgttgatgttggtggtggctgcagtggtctgggggttcgggaggtagtctccaggcctgtggttggagcttgcaggtaggtgccagcttttgaggcagtggcagggagataaggcccaacctcagaccccctggaggagtgcttatgtacccaaagaagtggattggtttgggcagtcccaaggaccctgggttatgagttctgtctttgggggttgaaggcagaactaggctgggtgggcttgttctcaggctccccaatgatgagagcagataccagccatggtgggtggggacagggtaatcctaggatcagtttttgggtgaggggccctgaggctgcttatggagagggtaggtctggcctcagtggccacagctaggctggtaggtggggaaaatgtgtctctttcacaccccagtcccagtggggctcaccccccagtcccggtggcaatggcatatacctgtctcacccccatccctggctgcaggagcctctgcccagctcgcaaccaagtcttagtggcaactcatgcctgctcatgtctcagtctctggcctggcagcacttgcttccctgcattggtagctgctacagccaatgctttactcgattctcagcccctagtgcgggaatgagcccagatcacaccctagtcccagcagtgacagcctgagattttttttttcctgagatggagtctcgctctgttgcccaggctggagtgcagtggcgcaatcttggctcactgaaacctccacttcctgggttcaagcagttctcctgcctcagcctcctgagtagctaggattataggcatgcaccaccatgcctggctaatttttgtatttttcatagagacagggtttcaccatgttgaccaagctggtctctaactcctgaccttgtgatctgcccacctcagcctcccaaaatgctgaggttacaggtgtgagccaccactccaggcccctgatttttttttttttaacacctcagtcccagtgctgctaggccccagagcagcatgccatctgccaaaaaccaggtttgaaaatgatgtcttgctgggcatggtggcttgtgcctgtagttccagctacttgggaggcagaggtaggaagattgcttgagttcaggagctctgggctgtagtgcactatgccaatcaggtgtctgcactaagttcagcatcaatatggtgacctcataggagtaggggaccaccaggttgcctaaggaggggtgaaccagcccaggttggaaatagagcaggtcaaaattcccatgctgatcagtagtgggattgcacctatgaatattgcactccagcctgtgcaacatagtgagacgctgtctcttaaaaaaaaaaaaaaagaaagaaagaaaagaaaaagaaaatattgtcttgctatagccacttaggtatcagaaagtgtataggacccagtacaagctccctccctggagcagttctgttggagagtctcctggcagctccctatgttaagtttcagggcctgggagggtagagggtctctttcctggctaagattgcatggttccatggttggggatgtgggccgctggaattctcttacttacccttgccttgtgttgggaagccactcccagctcccagcctatcctagccaagcaggctacttgtcttccttctcctacccacttttggtgtttcctgttagttctctgttgaattccagtgttttaccttggacagtgtatttgaagtgtgattctctatgcactattttggttcttctaagtggaagaggtgagcatgaaatggtgtttgaccaaagtctatatccctttcattcacaaatgataacgtatatatgctctttggcaaactgcttttttttttcttttgcttaacaatatttcctggaaattagttcatttgatagaattttgcactatttctatagtgcaaaattctgactcatctttgattttgttgaaccaagatacaaatgtaattttctgatgattctaaatttagaccaaaatttctgacttagttacttttgtgtagaactgctgactcagttgtagttgaatttgaaaggtaagaatagggctgggcgtggtggctcactcctgtaatcctggcactttgggaggctaagactggtgcatcacttgaggccaggagtttgagaccagcctggccaacatggggaaacctcgtctctactaaaaataaacaaaaaaaatccaggcgtggtggcatgtgcctgtaatcccagctacttgggaggccgaggcgggagaattacctgaacccaagaggcagaggtttcagtgagctgaaatcataccactgcactccagcctgggtgacggagtgagactctgtctcttaaaaaaaaaaaaaagaaaggtaagagtgttgttgttgttgttgttgttttttacatatttgtccttgagtattttaattaccagaagcagggaataagtaatagcctttcttttcttgcttatgcagcaggaggcagcagaggaataattttcataattatttgaatgtgtatttgtggatgaatgagtgagcaagagagagattctttttatttgctaaaatgatcacttttcaaattctttattgtactctatgtgaaaccacatttgatgatcacctgacatttggaaaattcctcacttctctctttcaaatctatttaagcagtcattcagtgtgatgtaacagagattgcttaaaaaaatcttgactttgcatatcatacttttaagggtgttccattctattataatatattactattgctttcagggatgtttaaaataacaatgtcagtgatgaagaaaattttgaattaagaataaaaggattacatatcagtcttcatcagaggacctggttttaaacaatgtaaagcatttttaatttttactttttgtgagatatagattcttcgtgaattccagaggttctaaaaaactcataatgtggtgcagttctaatactctacccttgtcattttgttttttaaaaatgttaaacatacaaatctggctaatgacattttttgctaaatataggaagtagaggaccagtggagaatttaatcctggtttattgcgtagcatgtgaaataatcatgcatatcaaagtagtgattcattttgaaaattggcagtttgctttatttatgtcagtcacaaataaggatatgtctttttcattcctaatggtaaaagtttaagctctctgaagtggacagctaatatacttgtcatagttgatttatgcgtaatttgtaatgcttttccactgacacaattgaaaatataaatatggcaaaatcttttgtctactttttatgttttcttttataatctttgtggaggagttaacaggataaaacatctaatttgttagcatgtcagatatttaagttaggaagtcatgtgtaagtcctttgattacgtttttaaaatttatttgtggaaaggccaccagaccccaatcctaccatttcagagtttatggattcttaaagaccattcttcttgtaatgaaaaccgtagttgagcatgaaactgcctgagtggcaccagtagattataaaaaggggtagaagtgtctcggcaaagcttttagctgtttgtctgaaatacactcatgcaaacattcccacccatcaccatcactgttcacggaaaataagctctatcctgatagcctgtagagttaaacagattaatagaaatgacgttctgcttctctctctctctttttctcagttgattcgatgtcatcagtcccgtggtggagcctgtggagacaacattcagtcttatactgccacagtcattagtgctgctaaagtgagtacctccgaaatcttggagagttgtggttatgtgtagtaattgttcagatttctctcctgaattatattttctattgtaatgattgtagtgcttgtacttatccaattttaaagattttaagtctgttaactagcttcaagactgttacctaattaataccacatttggaagaagctttccatgttttaaacagtgacttctggattctctgtgatttgcatcgttctgcctacactgacatccctttgcatctttgaacatttcagagtcttcttctcatgaaaagaatattattccctatgaaaacttgagtcagtccctcgtcacattcaaagattcttttatatcaaggggctgccccttcatgtttgtcaagtgagctctttttttcatgtgtgtgagggttaattttgatgatgtctggtaaactttatgctgattataaggtattcttgtaaccactatcctttagaattgtgaagtatacaacaaaacaattctaataataggaatgacagagtgaatctaaaagacaacatataatagaaagcacaaccattcagaaaagaacaacagtttaaagcaaaccacagagtgggaatcaaaggtcacactgttttatgtaaaacaaatacaaaaatacttcatatttgatcacagacgcttacatgatgcgcttcagaatgtgttccttggtttgatgagagaagcattacatatttttcacccaaaagggaattaaccattaggtctttatgcctatagcactatgagtttttagatttcagaaatcttttttcttttcttaagacagggtctcgctctgttgctcaggcaggagtgaacacccacctcagccttccaagtagctgggactacgggcgcatgccgccacgcctggtttgtagagacagggttttgccatgttacgcaggctggtcttgaacttctgagcttaagcaatccacccacctcagcctcccaaagtgctggggttacaggtgtgcatcaccgcacccagcaattgcagaaatcttaataaagattgcttacttttctccattgtgtatagaaaaattatgatggttatttcaatgaagagctgagagagagtatttagaaaacatcttcagtattagtctactcatttatccacaaaatacaacgagatctttttctcaagtattagactccttttagacttgtctatctcatacacatgggtcacgatagtttagcttatgatcattttcagtaatttttagttatggaatggaggataacttttcagctcctgtttgctattcttatgtgtttatgtgcttatataaaaagaaagtgatcttcattccatgttttgctgtggacatgctggagtgaggctggacttaagatgttttaaaaataagtgcagggctgggcgctgtggctcatgcctgtaatcccagcactttgggaggctgaggtgggcggatcatgaggtcaggagttcaagatcagcctggccaacatagtgaaaccccgtctctactaaaaatacaaatattagctgggcatggtggcgggtgcctgtagtcccagctactcaggaggctgaggcaggagaattgcttgaacccaggaggcggaggtttcagtgagctgagatcacgccactgtactccagcctgggcgacacagcgagactctgtctcaaaacaaacaaacaaacaaacaaacaaaacaacaaaaaaaatgcaaactccccattttctcatacctcaatattgggaactgtgaggcatatactcatgtcttccacatttaagactatgaaattatgtttaatataacactttagggctggatgctgtgcctcgtgcctgtaataccagcattctgggaggctgaggtgggaggatcacatgagctcaggaatttgagaccagctgaggcaatatagtgagaccctgtctctacaaaaaaatttaaaaattatctgagtgtgatggtacatgcctgttgtcccagctactccagaggctaaggtgggaagattgcttgagcattggaggccgaggctacagtgagccatgattgcgtcactgcaatctgtttacttttctttttgggagaatataagggttatttttaaaaaactcacaaagatgtctccagacctagaaaacttctctagagaattctttttaatatttaagaataaacaatggcaatattacaaagactcttccagtgaataagcaaagtcagattatgcctaatctggtttgatgaagccagatcaccttaatactaaaactttagaagagcattataatacaagaacactacagtccaaatcaatgaacatagatgtgaaaaatcctaaataaaatatttgcagaaaaacagcattatataggataccatatatattgtgtcacagtccatttggaataagaatatatggacataattatagtataatatataggacacaatatatgctgtgtcacaatccacttgggataagaatatataggacacaattcttcagtatataggacgctatatattgtgtcacaatccatttgagataatccacaatataagctggtttatcactcaagatcaatgagcataatttgcacatttaacaggagaaaattatatgcttatcacaatagatgaacaaaaagtatttgataaaattgaaaatatattcattgataaaatcttaataaatacagatagtttctggttctcttggtttttaaatttttctcaaattatcaaacttgtttaaacacagtaaacctggtcatactgaagtctgtttctgataactctaatgtctggttcccttttgggtccatttctcttgtgtgttgtttctgctcgttctcatttattatgacttgagtccttgtgaagcggtgtcatttgtctggggtaatacccgaagtttgttgtctcatgccaaggaaattgaagacgcggacacacaaggaatgggtttaagagtggaagtttcatagatgaagaaagaagagagcttcctcctgcagagagagggggcctgagcgggtttcaggattggggcgagatgtgattggttttatagatgagcttgaggaggtcatgtttgatttacatagggtgtagtgggttggttggaccaggtgtgtcatttgcatagcatgtgtagaggctggctatcccaccataatcttttattatgcaaatggagtctctacctggctggtgccatgttgcctgcacatgtggttacaaagaaaaggtaagagggaacctctcggttgaatatacctgacttccagatatcccttttctattggcacagctgctggcattcacctatgcaagcttccagcttgcttatctatgcttgcagcttgatctttcaggctgctttttgttagaaaagaaattatttgggggctgatttttatttaaaggaaaaccttgctgaggactctcttactctcactaactgcctaaataatttctttttaactcctgttatcacttgtttgccagaatttatttcaaaactttttagaaaatagttttgagtttgggatgacagtggagttctgggacagtatcagtcttgaataataatccaatttcagggattgagattatttgagtgaagttcacctgcaatagctgtggtcaccttattgctgtaggtggactcttctattgtatatttctttatgttcaaacccaagcttggagggaatgtcaccaagtagacccatttggcagggctttgactctcatagatgattttctagttccatctatcaaaaacaccacttagtttcttagcaccctacctcctgcttcctagaatcaccagatacctctaggcctaaatgcctagctgaaatgtctggatttccttattctttcggattctgactttgtaactcagtaccttcaagcagcattttacaaaaatattctcttcgattttcctagttgttctcattagtggaaatcagattgatctgatttccccaacctgtcattattgaaaatagaaaacatattttcttatttattttttaaccatttctaggtgatatattttttgagatacaacatggagagcacgttaaaaagccatgtagtatgtgctccttaagaaaaatacttaagtaattttacagttactttattaagtcactttctctgaaagtgtaatcattactcttttactctttccgatgacagcttcccttgtggcttaatagaggttattaaccactttgttatatagaaggatgaattattaatttttttgtcttaaattttttgtctcactgcaattgtgaggataaatatattcattgcatatgtacttggagctccttagaggaaataatcttttttacattttctgcatttccaaatacaacttgcataatatttatgctattaatgttttttcctttgattttccaagtaatttgacttttctcataaagaatatgagagtcatgaattttttatggtagtgataaaaaatattgaaattgttcaaatgagattatttgacacatttataaaatcttggtccatattttctagttccctcattaccgtcttattttcatgtgtgttaccagtgtggtcaattgatttaataaaaatgcccctgttttctcttgttatctgataacttcctaatgacaactaacagcttttgtgagagcagcaccattagcactaatggatagggaggccaactgatatggcatgggaaaggttaaagatgactagtgacccttcggcaaatctgcttgcagcagaacagaataagtaccatgctcatttgaattataggtcataacggattttctcacactttcgttatagtctgtcatgttcagctgtcttacagctacagtttagttctgtgagtacttgtgtgaagattcatcagtgatttaatgaacatttttatgtagatacctcagattgtgaggacacttagtctaatttttcatctccttttggccaggttatacttctctattcctaatttttgctgaggctttataatttttcatatatatttgagaaaatagtcagatatatacatactctgtctactaaaattaattggagagacaaattactgtgaggtgatttagatttccgttaaataacattatcagttaacttctggacactagtgctcatagatgtgcttgatgctaacatggaaacaaatttaccctaaaagcaagggtctttacaaatgcagaaaacttccagcacttttctctaacacccctgactccctgcatagttaatgggttatgataaatagtagtatcttgtaacttgctatacaaattgcatatttgatgacttaaattttgagtttagatttttgtccactactaagacaactccatcaatagtcatgttttttttttccctaggaaatatcaaacactcttcatgtaatatgagctgttgactatgaaatctactgctgtcttctctctgtggatctttttcctggttctcttatgttaacttttactgttgtggtttgctttggtacacattactttccactttttatgtgctccagttcttttagttttattccttttcattggtataagagcatgaaataataggctcaggggcaaatggggaggatatacaaccaaagactttaaaactaaaaggcattcctttgataaagggatagctgtgtttaagtgggagcatctccattagcattaatggagtgagtacatcagttaaggcatctcagaggttaatcaggcttcctggcctgctcttgacatcaatacactgtggcgcctgaatctgttggtccttcagaggcttacttgacaacactccaacagactttgtgtaagtcatttcttgtgaattattgaaagaaatgtttggctgctaattgaggaacgttgatgtgttttataatcgcgggagtttgagtttttagcactaaacaaaacagttacaattgatttgtggctttctcttggttttagtctgctgttaaattatatctttttatttgaattcagcatatggctttgctggtcatttttatttaagtatttattagtatattattatggattttaatttttcctgttttccacctttcagacatctgtgttttgtattcattaactgtgagatcacaagtagtaacagaaatagattacaaggcagtacaggatagtgtaaaaatcaggccctggagacagatggtcccagttttgaattctgactttgtcattgggtaactgtttgagcttccattttacttaacttccctagcctcgattttctctttcataaaattgaagtatctgaggaaatctatcaacatagtttatgttaagtgcctttaccagtccctagtccatagaaaagccaccgtggaaacatagctaccataaaataatgcatctattattagtgctagttttatggtattttaatagaacacttctttggaaaatacttctcccattttcagttttaatctaattattgcttacatcacatttagacctctatacacaactgtctttgtgtactatttatgaattaaaatttgaaataccatgtatataatagtttatattttcaaatttagccatagcatgtgccagaattaggtaaggatttttttttcataattgttttagaaaagatagtcacctcattgaagattaatttgaaatattttaatgaaactttttttcttacaacatgagaattggaaaaatgtacctatattatttaaaatgtaatttttgatgtgtctaagtattctagggtgcctgtttttgttctaatgatgatacccttcttcagcaatgtgtgactcacaagtatttgtctttattttagctttcttcctttcatttctttttctgtagactcagaaacttgaagctttcttcctttcagatgaaaaaacttgttatttagaaaaatgtttctattaatgcatatgaagataatcagaggatattcacatagaagaaaaaatatttcacgagttagttttacttatatgttttgaatgaaatggagctaaaatgtaattataaacatcttaagttatctttaattgaaataatatagtaggagcaccacatttaattgttttctgttaccagatagaaaataactctcttaactaatttagtatgatacttcattcatccagtgattaatatcttggacagagattgtgttttccatatgccaaatcttggtatacagtattatataacagcatattcatagatttgctttggaagcacattcttttccacataggtattctaccagtgtctcagtctttttcatactagaaataggtatacaattagagttataatatttcaaagaattgaccatttcatagtttctacttcttcctatgtcattgattttaagatgtatacattaagaggagggaatgaaagaaatatcttctataaaaatataattgtacccttatgtaaaacagagctctttaatttttttaactatggctttatgcctgccatggtgactttagagactttactgatgccattccctcaaactaatactgatattctaattaaaattcaagatcattaaaagtcagactgaatgtctgtgacagtttactgctataaaagattgtaagagaataaataacataatgattaggaaaattaataaaatgcgtatttctatgtagaatccaaatactgatgtgaagtcatacattttacctttcattgtacagacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtaagaagaacttttggtgcgtaccatgtgtgttacttgcaaagatggggctaagatcaagattagtcaaaatgtatttggcctaggagattatcaatttggaattttaggaattcagattatttcaaatgaggtttttctttaaaaatgattagtaacatgttagaacctgctgttttgaacattattaatgcatcaaacctgaaggtaaagtcgaggttctaagagattctcttatctgtgaggacatttgtttcataaataaataattatataacatttaatactgttctgttcataatattcttttttttcttaacttgctaccctagagactcagttattgtttcttttttgtgtgtaatgacatttgtcataacctaaattgtaagattaataaatttttttctttttttctttctttttttttttttttttgagatggagcatcactctgttgcccaggttggagtgcagtggagtgatctcagctcactgcaatctctgcctcctggattcagcggattctcctgcctcagcctcccgagtagctgggattataggcatgtgccaccacacccagctaatttttgtatttttattatttatttattgagacagagtcttgctctgtcgcccaagctagagtgcagtggcacgatcttggctcactgaaacctccacctcctgggttcaagcaattctcctgcctcagccttccaggtagctgggatgtaggtgcgtgcctccatgcccagctgacttttgtattttttagtagagttgagtttctccgtgttggccaggctggtctcggactcctgacctcaagtgatctgtccgccttggcctcccaaagtgctgggattacaggcatgagccaccgcgcccagccttaatttttgtatttttggtagagacgcggtttcgccgtgttggcctggctggtcttgaacccctggcctcaggtgatatgcccgtctcggcctcccaaaatgctaggattacaggcatgagccactgcgcccagccacgtaaattttgttttaaaggcaggaccatacctatttggaggaatttataaacaaattaattaatagttgcaacttacacaatttactgagtagtatcaaaatttataacagatgttttcttatcaatataaaaatatgtgaaatcttaaagtagcatataagaatacatacatggcagtagcttattataaaatcttgtatcttcagatacagtgttctgtaattttaaaaatctagcttcagaaacatttacaatgagtgattataagtacagaaatacatgttacatttgcttataaatcttgctggtaaggtatcatttgggctgtttttcccccatgcactcataaactctattttcttttgtgtcatagtcttcattttaaatatacgtttcttaaaggaaggtaatttttttattctgatagtgtgtgatcattgatataaaaatacaatctagaatcaattcctagaatgagataggagtagggcagtattggtgaaataaaatttcttttagtttttatatagaatatatatttaattccatattcagagcactatgcttagaaactatgtgagctgttaaggtattagccttaaatattgcatatgttttgagaaaatctgtttccagtatatatgggttggtgttgtgatgaaaaattacatttggcagctacttatatgctagttcctatagtaagattaacagcgtttcaagaaagtttttctgcaattacaacaaaaaaactttgaaattctggattattaaatttggctcttgtattttacttgaaatctgagtaataattctctgcctctcctgtcttaactttgtggttagccaaatgtgttacagattcgtatttttttaatgaagtgctagaagacttttcagttgactttaatgactttgtgttaattagttgatgtggataaacacaaatgttctcttttttaattgaaatgaaatgtataaacttttagtgttgtgagtgttagagtaaaatattccttttgttctttgattttttgatttttaattaattcacctacaaggccacccacatttattgggtagtaacaactctcctcaacattgtctaggaccatacatctgttaaagatctagcatttgttgatggagagatttgggattatttcaaaatagaaaatgttatctcagtaattttgatgaaatagaagtgtaattcacgtatttattttgttaaatggaagtatggggacatataattatattaaaacatgacatttaggccttatgttttaaaatgtggtttaatttttttctttaagttcattaactttttatgaccttgaaaaaggaagtcttaattttggagtatggaaatggactatagattggagagttgcaaaagttcatttgtctgtgataaatgcattgataacacttgaaacaaatatgtttattaagaagaatcatagaaatgttaacttttaaaagttaagaatcttaaatgttgttcaacatggaacattctaccttttctgttactggttagtagccccaatcttccacttatgacatattctgaaattttaacttgattaaaaaattctgttagaggacaggaaagaaattgattttcaataaaaggtgagttagtgtgtacattttaaaaaatatatataatttgtaaagcaacaagatctgtgcagtataattctgtcttttaattaacatgaatctgttttttgtcaataaaatgtttttgtctctgataagtagttcagttggagtacaggctgtttttagattatgctggattgtattaaaactgcagtggttaatgtcttagatttatcgcttttagccccttccgctgatgtttagcctaaactgtaatgtttttccttttccaaatacaactcagattgtatacgaaaagctgataatacattgacttttgctgtttaaatcccttgagcctttgataatgattttttttgtgttaacaattgtagtatataaaatcggattcaccatccttctgatgccatattgattagtttgattttatggtgatgggatcattgtgtgttaactgtattaagaagaaatggatttgattgactttgcatccatttttatctgtgttactttcatgttttatttaaaagcatttctggaccagaataagttaagtggtataatttgctttttacacgtttatataattgaagttagcaatgtggcaaaatctctaatggaaataaaatgcttcagaatgatgacataaatctgagctatttcttgcctggagaacaagtgttattcataataatttaatagcttctgaggtgttttgttcatgtgatgaaggcttatccaccttgtatcaattcatgggctctgctttgtttaatgtagtcaggttgttaatacagacttaagagttcatcctactgtgataagtggtgagtgaagattacatgtcttaggaaaattatactggaatatctctgacattaatggtttaatgttttaggctaggtgatgatgcaatggagaagattcttccaaaagtatctggttgtttatatttgtgaagtccataaagagaacattcaaagaatcttacgtagtggtaagattaatgtgcctttttgctggatggcttctgtctttattattgccatcaaattgaatactcaatgccagttgtattggaaggaaacatacagggtgtagggttataatatatgaaaggaaagggaatcttgtagataaagtttaaagtagaaaaatgggcaaaagatagaaataaatatttcacagagaaaataaaatatggttgaccattgaacaacatgggtttgaactgcacaggtctacttatatgtggattttctctgtcactaccagcccttagacagcaagaccaaccccttttcttcctccctgtcctcctcctccttagcctacctgtagtgaagacaatgaaactgaagacctttataattgattcacttccacttaatgaacagtaaatatattttctcttactttattataagaatataatctgtaatacataacatacgaaatatgtgttaattgacaatttttgtcatcagttaggcttccagtcaatagtaggctattagtagttaagtattggaggagggaaagtcatatgcagattttcagctgtgcagggggtcagcacttgtaaacatgagttgttcagaggtcaactatacatgtaaatgatataaaatatacccataacttcacttgttattaatgagaaagctgcaaattaaaactgagataccatgttttacttatcagaaactgagccgctcaaaagcttgcaatatattctatatttttattaattttgaagtaattatagactcacagtgagttgcacatgcctttcatcttacttcctccagcttaacctgaatgatgatgtattttgtagctatagtatagtaccaaaacaagaaaattttctgagtgatgtgggttaacaaaaaaaacctcagaaaatggacaatgatacactctgttaactaggctacaggtcttaatcagttttctctatttgtttaacctgcattcattggtgtgtttatgtgggcatgtatagggctgtgaaattttatcccatgtatacattcatgtaacccccaccacagttaagatacaggactgttctaaactgtttcatcaacgcatacttctttgtatttcatgagcatccctcatcccaccccatccctttttcctgataaccactaatctgttttccatctctatagttttatgactctgacaacgttatgcaaattgaataatacattatgtaatattttaagatggactttttacactaaatatattgtctttgaagtccattcaggttgcagcatgtagttcgtactttttttcttttctttttttttttttgagacagagtctcactctgtcgcccaggctggagtgcagtggcgcgatcttggctcactgcaagctctgcctcctgggttcatgccattctcctgtctcagcctcctgagtagctgggactacaggtgcccgccaccacacctagctaattttatgtattttttagtagagacggggtttcgccatgttagccaggatggtctcaatctcctgacctcgtgatctgcccacctcagcctcccaaagggctggaattacaggtgtgagccaccgcgcccagctgtagtttgtacttttcaatcactctgttgtattccattgtatgaatgtgtcagtttgttcaattattcaccccttgaaggacatttgcactgtttctagcatttttctattatgaataaagctgtcgtgatcatttgtgtaaaggtttttaatgtggatatgttttcatttctctgtaaatgcccaagagtattgctgagttgtataagtgcacttttagaaaggaaatgtgcaactattttccaaagtgcctgtgctattttatattcccaccagcactgtatgatagacagcagatttcccaactgaatccatggaagctgaagaaagtggtacaatatctttaaagtactgaaataaatgaactggtagccccaaattccatttgtagtgaaaatatacttcagaaatgaaagggaaataaaggcattcttagaaaaaggaaaactaagagaacctatcactcgcagatcaactcttaaaaatggcaaaaagttttccaaggaaatgacaataaaagaaggcttagaacttcaaaaatgaaagaacaacaatggggtgggtaaaaataaaggtatatgtgagatatcctttttaatgaatttataagattatatttgatgattgcgttagaaattgtaacatcatctgatgtgtgttgaccgatgtgtgtgtaagaaatacttaatatttttatattttaaaaaatggggacataaattgaactttataaaaatcaaaatttatgctacagtggacacaatcaagaaaatgaaaagacaactcacagaaggggagaaaatatttgtaaatcatatttttgataaggtaccagtattcacaatatgtgaagaactcttataactcaaaaataaaaagactacctaattttcaatgagcaatggatttgaataaacatttctttgaaaaagatatacctgtggctgataagcagaaattgggacccttctaacctgctagtcagaattgtgcattcactttgtaaaagagtttcaaagttcttcccaaaatgttaaacagagttatatgactaatatatatctacgataaaactctgaatatttgcagcattgtttgcaatagccaaaaagtagaaaaaaatctaaatattcatcaactgatgaatgggtggataaataaaatgtggtatatgcaaacaatataatattatttaacaatataaaatgtacattttagtggcattaagtacatttgtagtgttatataattatcagtacaggcactatccctttccaaaactttttcaccatctgaaactgaaagtctctgcccattaaacaataacttcccagtactctgtttcccaggccctggtaaccagcattctactttctgtgtttgaatttgcctgtttctaggtatatcacatagtgcaatcctacagtattcatccttttgtgtctggtttatttcacttagcataatattttcaaggttcatacctgtcgtaacatatatcagaatttcatactttttaaaggctccataatattccactgaatgtgtatactacattttgtttatccatttacttattgatggacatttggcttacttctaccttttgccaatttttttttttttattgaaatggagtcttgctctgttaccaaggctggagtgcagtggcacaatgttggcccactgcaactgctgcctcttgggttcaagcgattctcttgcctcagcctcccaagtagctggattacaggcatctgccaccatgtctggctaattcttgtattttttgtagagacaaggtttcgctatgttggctaggctggtctcaaactcctgacctcaagtgatctgcctgccttggtgtcccaaagtgctgggattacaagcatgagctaccgtgccccgccacctttcgccaattttgaataatgcttgtgtgaacattggtgtacacatttctaattgagtctctacttgtaatacttttggttatgtacctaaaagtcaaattgctggatcatatggtaattctatatttaattttttgaggaattaccaagctatttttcacagtggctggaccattttaaattcccaccagtgaacgtccaatgatggataagggtctcaatttctcgtatatccttaccccaacactagttatttttctttttaaaaataatggccatcctaatgatgtaaatggccatcctaatgagtgcaaagtagtatctcatcatggttttaatttgcatttacctaaggaatagtgatgttaagcctcttctcatttgcttattggccatttggttatctttaaaaaattgatacataatatttgtacaaatttttggggtacatgtgatattttgttatatgcatagaacgtctaatcatcaaatcagggtatttaggatatatatcaccatgagcacttagcatttctatgtgtagagaacattttaagtcttcactactagctgtttttaaatgtaccaggtattgttgttaactattgtcactctactatggaatgttagaacttattcctttgatctgagtgtacatttgtacccaacctgtctttcttcattctttttttctttttctttttcttttgtctgactgggttagtttgaaaggcctgtctgtcaaactgaaatctctttcttctgtttcatctagtctattgttgaagcttctcaatttttttttttttttttttgagatggagtcttgctctgtcacccacgctggagtgcagtggcgcgatcttggctcactgcaagctccgcatcccgggtttacggtattctcctgcctcagcctcctgagtagctgggactacaggcacccgccacaatgcccaactaattttgtgtattttttagtagagacggagtttcaccatgttagccaggatggtcccgatctcctgacctcgtgatccacccgcctcagcctcccaaagtgctgggattacaggcgtgagccactgcacctggactcacttgtatttttatgtcattcattgagttattcagtttatggatttctgtttggttctttcttatgagatctatctctttggtgaatttctttttcatatcctgaattgtttttcttatttctttgtaatgttgtctgtgtctgcttgtatctcactgggcttctttaatatcattatttttcaattctttttcaggcattttatacattttttgggggggttaaaacctattgttggaagattgtgtttctttggaggtgtcatatttccttgctttttcatatttcttgtgtcctttcattgatgtctgtgcatcaggtataacacttctaattttttttttcttgagacgaagtctcggtctgttgccaggttggagtggtgcagtggtgcgatctcagttcactgcaacctctgcctcccaggtttaagtgattcttctgctcagcctcccgagcatctgggactacaggtgtgtgccaccacgcccagctaatttttgtgtttttagtagagacgaggtttcaccatgttggccaggatggtctcgatctcttgagctcgtgatctacccgccttggcctcccaaagtgctgggattataggcgtgagccaccatgcccggcccacttctaatttttaaaattggctttcataggggaaggctttttcctgtgtgtttttttttttaaaataatgacaaggtatttttaaattggtaatacataggaagataataactcaaaggagtaggtagcagatgccagtatattcaatcaatgagctgtattttactggaatttaatcaatattaacctgaaatagatgataagttaatatgcatattgtaatccctccaactaccgctaagaaattactcagaaaaagtaacagaggacttaaaatattaatgctaaaaatattttctaaacacaaaagaagataggaggaacaacaaacacctaagacatataaatatacatagtaaaatggcaaacttaaaatccagttataccaacaatatattaatggcaaatgtatcagacccaaattgcttcagattcaaagaccacttgtttgaaaataaaaagatggtaaaaaatatatcacatgctttaaaaattttaatgtaagacctcaaactaaaaatcatagatgaaaacctaggaaataccctttttgacatctgctttggtaaagaatttttggctgagtccccaaaagcgattgcaaccaaaaacaaatattgacaaatgatacctgattaaactaaagagcttctgcacagcaaaataaactatcaacagagcaaacagacaactacttaatgggagaaaatgtttgcaaatggtttatctgataaaggtctaatatccagcatctgtaaggaacttaaatcaacaagaacaaataaccccattaaaaatgggcaaaggacacacatacacttcttaaaagaagacatacgtatgggccaacaaacatatggaaaaatgctcatcatctctcatcatcagggaaatgctaatcaaagccacatgagatgccaccttaacaccagtcagaatggctgttattaaaaagtcaaaaactggctgggcctggtggctcatgcctgtaatcccagcactttgggaggccgaggcaggcagatcacgaggtcgggagatcaagaccatcctggctaacacagtgaaatcccgtctctactaaaaacacaaaaaattagctgggcgtggtggcgggtgcccatagtcccagctactcgggaggctgaggcaggagaatcgcttgaacccaggaggcagaggttgcagtgaaccgagatcatgccactgcactccagcctgggcgacagagcaagactccatcgcaaacaacaacaacaacaacaacaacaacaacaacaacaacaacaacaacaacagatactggtggggctgtggagaaaagggaacacgtatacactgctggtgggcatctgaattagttcagccactgtggaaagcagtttggagacttctcaacttaaacaaagctaccacttgacccagcaatcccactaatgggtatatacccataggaaaataaatggctctaccaaaaagagacatgtatattaatcaccatgctattaacaatagcaaagacatggaatcagcctaagtgcccgccagcagtggattcaataaaggaaatgtgctattcatcaccatggaatactacacagccataaagagaatgaaatcatgtcatttacagcagcatgtgtggagctggaggccaaaaccttaagcaaatcaatggagaaatgaaaaaccaaatactccatattctcacttataagtgggagctaaacattgaccacaccacgttgggaggccgaggcgggcggatcacaaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaacattgaccacacatggacataaacatgggaactattaatagacactgcagactactagagtggggagggaggaaggaggagtatgggttcctattgggtactatgctcactacctgggtgcaatatatccatgtaacaaacctgcacatgcaccccttgtatctaaaagttgaaattaaaaaaaaaacatgtaaacaataaccataatagaattagagtggccatagtaatattaaagactttacgtcaagaagtattactggagtaaaagagagacatttcattcacgataaaagggtcaatataataaaacaattgttaacacataatacagataaaacatttttttctttttttttctcagtaatacttgttctggaaaaccactattaatatgtataattaataaaacaattattagtatataaatacctaacaacacagccactaaaaacattgaacaaaatctgacaaaattgaaagaagaaattttagctcttttttttttgagacagagtcttgctctgttgcccaggctggagtgcaatggcacgatctcagctcactgcaacctccgcctcctgggttcaagcaattctcctgcctcagcctcctgagtagctgggattacaggcacgcgccaccatgtccggctaatttttgtagttttagtagagacagggtttcactatattggtcaggctggtctcgaactcctgacctcgtgatccccctgcctcggcctcccaaagtgctgggattacaggcatgagccaccgcgcctggcccaattttagctctttattacagctcaagatttacataatttattctcattaattgataggaataagcactctgtaattttccacatgcatgttagtaaacatgtacgactatttctctattaaaaaataattgatagaacaactagatagaaaattagaaaagacttagaagacatgattaacactattttctaacttgaccacccaaaactgcagaatgcacattattttcaaaaacatctgagacattcattgtacatgatagaacagatgcttggccatgaaacagatcttaataactttaaaaggattaaagtcatgcggagtatttctctaaggacaatggaaatcaataacaaaattcgatttggggaatctccaaatatttggaaataaaacgcacttgtaaataactcatgggtcaaagaaagaagcttagggacattagcaaatattttgaattgaatgaaaatgaaaacagaacatataaaaatttatggagtataactatagtgttatatggaagaaaatttacagctttaaatgcttatattaggacaagaaaatggcctgaaattaataatctaagtgtttcccttaaaagattataaaaaggagcaaattataaccaatgcaagactaatgaagcaaataataaagatctggatagaagctgatggaacagtaaacagtgaaatattggaaaagtctaaaattggttatttgaaaagatcaatataatcaatgtatttgtagctagattgaattggaggttctagctagatcaataaggcataaagatctgacaggataatgtttcagacatttttatgatggcttgttgtttatgatattgtatagcatgattgacctgcacagttaaaacgggtagcttttgtggtgtgcaagttgtatctttgtaaagctttcactcacaaatactatctcagtgcttaagtacattgtttttttgggctgtatttgcatatatgttgtaactgataaaataactgttctggtcatttgctctgtatctttcagggcaggaataacatttggtttatattctgagctctaagcagagtattttacacatagtaagacttgactcttaacatgcatttttgagagaaaaaaatagcgttgccagtgtaggacaacttccaaggctacttaaaatcaaatttctctgtgtctaaatattatgatccaaaattggtgtaataggttttctttctgaaacattagataagtaaaacaatttttaaaaagttgttgaacttatgatgggaaattatatggaatgtaaattatatttcagtgtagccttaaaaattaagaggagtgaataaaagaaactccatttgagatacagaggtacctattctaatgtacctctgcttttatgatttcatagtcatttcaaagaagttctatttctctctagaaactgagagttgaagaacacgactttcatactataatatgaaaatgttattggatgatttctctatacacctgtttatttatgtttaacaaattatgttgtttcccccccattcttatatttcaataaggggcaaaaaattgtgatttcccagcagatcgcataacacagtaagacctgtatttcctgtccttggataaagcgctaagtgattacattttgtaaagaattgaaaatagttgattgtatcattttttttcctctgaacctatacttgaagaagtaattgtttctgtcatctacagtcaagtcagctgactctttttagagtttatatgactgatgtgcgtgggggcatgttatatctcttcctcaattctaaagtggaattctctccttatattggcaagaataatctgctagagtggaaacatgttatttggtcagtggtttgtgatgtgccttcttataggcttcaagctcggttatcagtgagaaaatatttacctccatttgtctttatttctttgtgaaggtgcttgtgagtgaggattctgacagtgatggcattgtggcccacttccctgcccatgagaagccagtgtgctgcatggcttttaatacaagtggtaagttcgctctctgtcttttttttttttttttttgtagaccatttatataatgggttttccagccaaatatggaatatggaatctgacttttcttcatgtatcagtatatatcagaaaagttattaagtcattatattgaataaaggaatttataataaaaatttagtacccctctaaaatccctctaaaattggttttgttctcgataaagtagctattaaatagcagccatttaaacaatgctgttgagttacatgaatttctgtttataattactccaagaacttcagtattccaaactagaatattaatggatatgagcagtattttttttttgtaacttgaagttttgtgtaactaacttacaacactttgtaagctaatttaattttctcggttttttttttagtggtgctctttttctttttcttcttaaggtttactccttacattttgttatatctttttagttccttttaatatagcatacaatttgtactcttaattttcttttcacaatatccagagtagttgtcttatttaaattctgcatttgtaagatttttaaatttttattttactatttttttaaaaaaagataaagacagagtctcactatgctgcccaggctggtcctgaactcctggcctcaagtaattctcctgccttagcctcccaaagtattgccacgatgcttggccagatttttttcattatgataatgtttttgtatttctccattccctggatatctatctgtttaactggaagttaagtctagaggtataaatccattcaggctaaggagtttttgtttgtttgtttctaaacttcgtaagtattgcgtctacatcatttcatcccaataggagacacattattttaggttgtctccctatttgtggtgctatatttgatcacatgagtaaagtaatgactatcaagtatctacattattggaaataggtttttcttatggagattaacaagtactctacagtatgtcattttgacattatttctgaagcaactttttaattaataattttgttacattgaaggttgtagaatggtgggttgttttcttaattctgtcctggtctctgcatttattgactgttattcttctatagaaaacgttttctctcatcagccaggagtaaacagcctttctcctgtatatcaaaagtggtataaatgcctaattctctctctctctttttcttttaaatgaccaattttcacagtaaggagttggtgtaatacttccagtggtaggaaacaagttacaggttgagtactttatgtctgaaatgcttgggactagaagtctttctgattttagattttttttttttgattttggaatatttgcatatataatgagttatcttggcggtgggacccaagtctaaatacaaaatttatttgtttcatgtataccctatacacatagcctgaaggtgattttgtacaatattttaagtgattttgtgcatgaaacatagttttgactccgttttaactgagactttgtacatgaggtcaggtgtggattctccagttgtggcatcatgtcagtgctccagttctggagcatttcagagcattttggtttgcattataagaagaacataaatttctgtgaggattttggtttttcagattaggaatgctcaatctgtattttaaaaatactttgtaaataaaactgctcttttgttttcagagctggtatagtcatcataaacttgcagtcttttcagatcttacccatttggttgatgtatctaaggagcatgctacttttaatcttagttttcagaaatgattatatcacttaaaattgatgggaaaagccaatccttttccccttcttttcatcttttcaaataaagaatgatagtaagggattatcattatatagagatattattttataaagcactttaaataatctaccctctaatatcttaataagtcatctttgattaagggaacaggatttttatagtgattggtaatcagtaggattgatttaattaataaaggcaagatttattgaaattctgtgagtgttgtgggaattaagttaaatgtgaaaaaacagcctggaagttatgtcacttgtagcactccacttggaatgaccggtatgactcatattgatattccatctgttatgtcagatctcctttgtgttagtgtatatttcatataaccctacagtgcttctgacactggcagctgtatttttttcctgtgactttgcattataagaagaacatattatataatataaagagtgttgtagtcgtcataaaatggtttcataattttgatctacatttgccatttgatttctttgtcctctcacatttgtgtttatacgataaggttaaaaatagcaatatttatacctatttttctgtgttgctgggacactaggtttataactatgatgtaatttattttgtgacaatcatttgtttaaatatttgtttcccttgctaacttatctgttcctcctacaaagagatcagatgtcattaatctttgtatctctagtgcttggcatggtgtctcagagtaataggaaacttagtgaattattttgaactattccccactgtagatgtatggcactgtattaggcatggtagtctctattttgacaatgaaagtgataggtcagttcagtatttttaaattcttttatttatttttttctttctttctttctttttttgttttttgtttgttttttttttgagacagggtctcgctcttttgccaggctggagtgcagtggcacgatctcagctcactgcaacctccgcctcccaggttcaagcgatccttgtgcctcagcctgccaagtagctgggactacaggcgtgtaccacgcccagctaatttttttttgtatttttagtagagacggggtttcaccatgttggctagtgtggtctcgatctgttgacctcgtgatccacttgcctcggtctcccaaagtgctgggattacaggcatgagccaccacccctggtcctttccttatttttctatagaaattttgatgagattctactaaagttcttctggaatttattcactttgaaatggttcatggtgtatagagtttccttgttctggtattacataattgtttcatatagcaatctatgaagcctgttaatatcattggaaataatcctatatggagatgctaattagttaactgtacctgtaaacttgtgagtgatgaaaataatggttatttttatatcatttcacatttatatataattctctaaatattgcttatgcttcaaaattatgatagagcctataatttaatatattaacaaaaaagcccttatactacttatattttaattttttaaaatcttaagtattatattttgtgttttaatttcattctgggaaagtggttcttggcttgctaaaaggatccacactacagaaatgttttagaaccctttatcaaaaaggttgaagcttgctgatgtgattttacccgtttcagctagcacattggaagatacctctttcactagtgactctattcaccttgtctggctaagtcttgttaattcacttaataagagatagtccctatgcatagagtctgcttgctggttagttgcaaatgcacaaacagggtcttaaggaaggaaaaccctttgtggaggaaggacagcatgctaggggataaatattagcctggttttggagatagttcttcaaaaggaaatcaattccaagctgggacctaaaagattagaaaataatgattcagtgcctggcaccataaatattatttgaatgaaagaggcaagaaaaatatggtacatttgaaatagattgtgaaccatagtctgtatagtggactcattagtttgttgtgcacagatatgtttttcaatgtgttctcatttctgcaacattttataaatccttcatgcctgtttagatatctgtattcagtggagggtttataactcagcaaccactcatacagttggtttgcacaatgctttatagtagctggtaagcaattacttacaattcttcttaattatttactttcagctttgagtatttttgctgttctgaatattgacttattacttgattatgagcaaggatgcagaaagtgctcaattctcaatgatgtggaagtctggattttttccttctttttttaattagcaagtgctagtcagcagctacccagctttgtacaaaaagtaattggggttagccatggcttctaaccattaatcagcttgtatcattaggtgacattttattttgctttgctagtttctggttcatatttactcttctaacccttctgattggtgtacatacatatacacacacatacatagaggacatgttttagtgaggaaactgcattgctatttgtaaatgcatagatacctcagtagctgggttttttcccttaaattattatttgtcttacagttttaaaaatgtttttgtgagataaaatgatgtattttctagcactcttcatttaagtccttcccactagtaaatcataagtttactaatgtgattaagaaatgcgacattataaaatgaggtaggagccgggcacattgcttataatcccagtgacccaggaggctgagatggggggaccaacacttgaggccaggagtttgagaccagcctggccaacataccaagatcctgtatctaaaaaaaattttaaaaaattacctgggcgtggtggcacgtgcctgtagtcccagctacttaattgggaggctgagatggaagacttgcttgaaccaagaagttaaggctgcagtgagctctgatcccaccattgcactctagcctgggttacagagtaagagcctgtctggaaaaaaaattaaaaaattaagtaaaatgaggtagttctctgcacactggctgaattatatttgttagcttctgaacttttattaattgacgttttataaaaagatatgtaatttcttttttattttaatttttaatttgtttattttattattattatacattaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctgtgagtgagaacatgcggtgtttggttttttgtccttgcaatagtttactgagaatgatgatttccaatttcatctatgtccctacaaaggacatgaactcatcattttttatggctgcatagtattccatggtgtatatgtgccacattttcttaatccagtctatcattgttggacatttgggttggttccaagtctgtgctattgtgaatagtgctgcaatagacatatgtgtgcatgtgtctttaaagatatgtaatttcaataggccttaacacagtagttacaatttttaatttaaattggctttttccaaaatataactaatagatcctccaatgacatactccagtccttctttacccatacatgtaaccatatatgttttaaaatttatattaggaagttttaaccctctaataattatctaatttggttaaaggtattttcatggggtatgtaatatggctaataaaaacagtattgcttgttagaatactttttactagtttagggaagtttatgtaaaacaaacaaaacatgccaaaaagttgattgcatgatttttgtttttaaagctgatcttactcaaaccagtttacctgtgtttgtcactgttacacttaagaatataaataaattccttttagtcttcattcattcattcattttttgagacggagtcttgctctgttgcccaggctggagtgcagtagtgtgatctcggctcaccacaatctccgcctccaggttcaagcaattctcctgccccagccttctgagtagctgggattacaggtgtgcgccactgcacccagctaatttttgtatttttttagtagagacggggttttgccatgttggctaggctggtcttgaactcctgacctcaggtaatccgcctgcctcagcctcccaaagtgttgggattacagacgtgagccactgcgtccagcccttttagtctttttaaaagaaagacatatttttagacaacagtattataaacatgtcctggacaacaaaatccaagaacaaaccaggcccatagccacttcctgggaaacgttaaaaatactataaaatgtacatgatggaataacactgcaaaacgaatttaggagaccatgtaggttggttgactgggtggcatacatttctgtcttgtatgggacctattcagaaaagacatgaagtgatgctattaaatagatctgtgaaacttctagttcagcagctgcattcatttttttttcaattttttaattcccattcttatttattagctgtgactttgaggccagaattaaaacaaatattttagtggcagcatttatgatttgtttagaagtaccagattgatccccatggttagatctgggcagattcaatatgggcagtgtaaatttgttgctctcagggacaaagtgaataacattttcaaggaactttaaaaaaaattaataaactttattttttatttttatttttttgagatggaacctcgctctgttgcctaggctggagtgcagtggcacaatttcagctcactgcaacctccacctcccgggttcaagcgattttcctgcctcaggctcctgagtagctgagattacaggcacgtgccaccacaccttgctaattttttgtatttttagtagcgatggcatttcaccatgttgcacgggctggtctcaaactcctgagctcaggcaatctgcccaccttggcttcccaaagtactaggattacaggtgtgagctaccacacccggccggaatcttcttttgcctggctaactcttacactgattcctatcttaaatatcatttaagaagtcttccctgagtctacataaaatgtcatgttccccttcctccttcaccttgtcacctaattgggcaagctagttaatctgcttgtcacactcaatgcttcagtttcctcatcaataaaatgggggctagtaatgatatctaaaataatacctggccaggtgcactggctcacacctttaatctcaatactttgggaggccaaggcaggtggatagcttgagctcaggagctagagaccagcctaggcaacatggtgaaactctgtctctacaaaaaatacaaaaattagctgggtgtagtggtgcactcctgtaggtctagctacttgggaggctgaggcagggggattgcttaagcctgggaggcagaaattgcagtgagctgagatcgcgccactgtgctccagcctgggtgacagagcaagaccctgtctaaaaaaaaataaaaaataaaataatatctaacaaatagagtaacctcaatagatattagttgtttctgttttcattattatcaatcaccttcatcctagtttttaaattatttacatccatcagagtatcttttcaatgtgttcgctgttagaggtaagcttttgttaatattttgtccccaagtattagcccagtagctttcacatacttgatactgagtaagtgtacattgaataattacaataattaattacattggattgcttcataattgtaatcatggaaaaaatatagcagggcaaaattaagacatttattcaatgttgttattcatttgttgaataaaatcaacttatgtctaaattgtggtttgaataagaattgtctggccgggcacggtggctcacgcctgtaatcccagcactttgggaggccgaggcgggtggatcacaaggtcaggagatcgagaccatcctggctaacatggtgaaaccccgtctctactaaaaaatacaaaaaattagccaggcgtggtggcgggcacctgtagtctcagctgcttgggagactgaggcagaagaatggcatgaacttgggaggcggagcttgcagtgagccaagatggtgccactgcactccagcctgggcgacagagcgagactcttgtctcaaaaaaaaaaaaaaaaaaaaaaaaagaatcgtctccatctctatatattgggagtgatacatgatggcaaattataatacatgcagatacatatcacagataactaaaactgaaatatgtaatagatagtaatttaaaataccccatggaggctggaagcggtggctcatcccagtaatcccaacactttgggaggccgaggagggcggattacttgaggttgggagttcgagaccagcctggccaacatggcgaaacctcatctctactaaaaatacaaaaattagctgggtgtagtggcacacgcctgtaatcccagctactggggaggctgaggcaggagactcgcttgagccaggaggcagaggttgctgagatggtgccactgtactccagcttgagtgacagagtgagactccgtctcaaaaagaaaaaaaaaaggaccccatggaaatgacatttttatgtaataagaacaatagattagtatactattatgtttttggacaacaaactatttcttatttatcaaactatcgttagaaacataaggaagaaatcctcaattctgtgcaataagcctgacatgaacctttaattcagtaaataattgatttgcttttcagaggcattacttctgccagctgagcaactgagaaatgtaaagtacaacacatctacattttaaataattacccctccttggcagggaaattgcttttccatccattaataagaggaaaatgagtgttgaatctctagcaaaacagagtaaatatgtacccctttagatgcttggctgcatctttagcagacttgaaattcttctggttacttaaatgatacatattaaaaggtgattgtggtcttgggttaattgttaaagaagtttaggtttttctttttggacataaaggttttcccattgtctagcaagtggttagagaaataccatgtcttgatttatttttaacatctataatgcatcacagatctacagcataacatagcttgagatttttaatctgacagcttctggtttatcactaccagacacctatattatttcattcacaatgcaaaggcaacttgaagaatttatttccttttttcattagaagaggatgtttccatagtaggtttgtacttactctcttgtttcatcatcttgtaaagtggtgtcctttactcatgtaatggatttactctctgaagaattagttctgtttgctctctgttcattgtggcactgtagttgtgtaagagagggatctttgtaggggtgacttacgattaggtagtaggtacagtgtctagggaccacaatacttttagaacctcgctataattttctgatttctttaaaagcagaaaaaaaaacatggttttaagttaatagaatggagtaaaaaaatataactttaagtattttttcctgaaggagagtgcccatgaagacaaaaatgcccaggtcccacctaaagtcctaatgtagccctgggttccatcagtaagtgaagagccttttccattcttcatcactattgccacagcactaccacttaattgaataaaggtgctcagttgatagtgaatgaactcatggaatatgtgaatgcatacattgggatactatgtaaaaatgtgaaatcaacatatatacctgtaaaaatagacctgtctacaacaaatataacataaatacttacaataatataaacatagtatttaattttgcaaaaggtaaagaaggatctgtatagtcaggtacatacatgcaaagcagctgttgatttcaacttttcatttatcagtatacccttactagttgttaaacactgaagtacttgaatacttcttgcctgtcccagtagcctctgagcctccctccctggtgggggatggtgggcaccttgtttcactattcttattcagattggcctgtatcttgccatacattaaatattttttgaacattgctctaaaaacagcctaaatatttcccaaagatatatattcatttcaaagagatttattatatatagtaaggtgggtacctgtggtcgggagcagtgagaaatgaagagtgggtgcaggaacggagaagcaaagagaaaatgtaaaaacagtaagaggctgggtgcagtgactcatacctgtaatcctagcactttgggaagccaaggtgggcgaatcacttgggttcaggagcttcagaccagccttccaacatggtgaaaccccatctctactaacaatacaaaaatcagccgggtgtggtggctcatgcccgtagctgtaatcccagctacttgggaggctgaggcgtgagaattgtttgaacccaggaggtagaggaatacaatgcaatgcaatgcaatgcacatagcaagagaaggtttatgtatggacttattaacatagacgaaatgaaaaatctgattaattcttccatgcatctgaagtctaaaaaggatatctagaatgctaagaaagtggaagtaatgtttatcaattagaattgagaattaataaatgtgatgttaatatagttttaagagtacaacaatgtaaaataatactatcaaatacaattatagttaattaaataatttatactataattgatatagtaattaaaaatgaactgattttataattttctctttgttcctttgattgtttctaagaagacattgaataagtaaatatataatttggttgtgcacagaatgcctgcctacccagtcatcttttttatggatcagccatttttcttatatatacttgttctgtaacatagtcacagagtcatgctttgatactgctcctgtaggtaatcaaacctaatttccagagacacttggtcatttggtaatattttcaacatatgctcatatacccaaaatgtgttaactgatgtacaatttgatacagcatgcttgatgactatctttgaaactttatctttcatctaatcattatcatttgttacttagttacttactttctgaacatttggaccagaaccctgattcatgtctgttatattttcatttaagtactatgatacatggttctttgagcacccatttagccaagctgagactcactgaccttttttttttttatactttaagttttagggtacatgtgcacaacatgcaggttatttacatatgtatacatgtgccatgttggtgtgctgcacccagtaactcgtcatttaacattaagtatatctccaaatgctatccctccccccttccccccaccccacaacaggccctggtgtgtgatgttccccttcctgtgtccatgtgttctcattgttcaattcctacctatgagtgagaacatgcagtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaatagtgccataataaacatacatgtgcatgtgtctttatagcagcatgatttataatcctttgggtatatacctagtaatgggattgcagggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttagtgatcgtcattctaactggtgtgagatggtatctcatagtggttttgatttgcatttctctgatggccagtgatgatgagcattttttcatgtgtcttttggctgcataaatgtcttcttttgagaagtgtctgttcatatccttcacccactttttgatggggttgtttgtttttttcttttaaatttgtttgagtttattgtagattctcgatattagccctttgtcagatgagtagattgcaaaaattttctcccattctgtaggttgcctgttcactctgatggtagtttcttttgctgtgcagacgctctttagtttaattagatcccatttgtcagttttggcttttgttgccattgcttttggtgttttagacatgaagtctttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaattgtttccccatttcttgtttttgtcaggtttgtcaaagatcagatggttgtagatatgcgacattatttctgagggtcactgacctcttttttttacccctcaccatatatctgttttttttttatatatccttctctgaatggtgcgttttgagtttttctctctcttttttttttcttccatgggggtggggtggctgctcaagtgttttaactttctaactggtctgttaaacatcttgcattttccctttctccattcactccatataaagccaacaagtttatcttgtcctcacatttatttttgtttttgtctgtcttcatttttattgaattgtaacttacgtaatataagttgcaccaattttaagtatacggcttgttgaattttatttatgtatgtacctctctaagcaacatccatagtgtttgaaagatctgtttcacacatctctgaaatacacagaatgcccttcctacatttagaaattcctacatttccatatttacctttccaattattttgtagtcctaacacataaagaatctgcttgatacagattgttctccatgaaatcctcttctttatctctgcttcctgtcttatgctgttcataattatttcactttactatcccttctgtctaccaaattcctactaacctccattcaaggtgtactttattatgcacttccagcaattattgtctatgacatgaatttagcattagttgactgtatctgtatctgtaatttttccttgaggctggttacagtctgatactaccatgtagatatgtatagatcttgagtactaaactttgtgttgggacataatatacaccagaaactaacactcatttatccttagacttttccaattatatttctcactcttttttttttgagacggagctggagtgcagtggcaagatctcggctcactgccatctccgtagagacgggatttcaccatgttggccaggatggtctcaatctcctgacctcgtgatccgccagccttggcctcccaaagtgctggagttacaggcgtgagccactgcacccggccaaaatttgtatggaatttcaaaggacctaaaatagccaaatcaatcttgaaaaagatgagtaaattttaaagacttaaactacctaaatttctgaattaatctaaagctcaccaagaaagggtttttagggagtaagtatagacatagatgagtgaatggaataatgtccagaacagtcatttgatttttgacaaaagtggcaggtaattaaataggtgaagtatagttttttcaacaaatggtgctagaacaactgcggtatcttttggtggaaaaataaatctttactaacatcatacataaaattaactctaaatggataataggcttagcataaacactaaaactatgaaactttaaaaagaaaacgtaaggttatatccttaaacttgggatagaaaaagatttcttagataaacacccaaaccacaaaatcttcatcaaaattggaaatcttttgggaaaatgttaaatagtgaaaagccatgccacagactgggagaaaatttctgatagaagatagatagatagatagatagatagatagatagatagatagatagatattgaaaacatacaatttaaaatgaggaaaagattttaaacaatcatgtcacaaaagaaaatatttaaaagccagtaagcacacaaaaaactgatcaacatcactgataaccaaggaatactggcaaattaaaactgtgagaataccaattgaaattattaaaaagactgacagtatcaaatgttggtgaagttatggagcttgtgagaatgtaaaattatacaaccacattggaaaatagtttggcagtttcttataaatatttaatatatgaccctgcaatttctctcctaaatattcacccaaggaaaagaaaaacatgtccacatggagactagtatttgaatgttcatagctgtttgagttacaatattaaaaaactagaaacaggccaggtgcggtggctcacacctataattccagcactttgggaggccgaggtgggtagatcacttgaggccaggagtttgagaccagcctcgtcaacatggtgaaaccctgtctctactaaaaatacaaaaaatttagccaggtgtggtgacaaacccctgcaatcccagctactcaggaggctgagacaggagaatcacttgaacctggagacagaggttgcagtgagctgagatggtgccactgcactccagcctggttgacagatcaagactccatctcaaaaaaaagaaaaaacaaaaaactagaaacagctacggaatggatatataaattgtggtatgtatttaaaatggaacactagtcagcaatataaatcaatgaatgacatactgctacttgtagcaaatagactgagaaaatattgtgtgattatatttcattaaattctaaaacaggcagtattcatcccgcataatagaaagctgatgagtggttgcttggggccaggtggttggggagaggatggtttgcaagtgaacacaagggaactttttttgaatgctctttctcttgactatggtagtagttacacaggtatatgtatttgtcagattcatcatactgtacatctaaaatgaatctattgtatataaattatgtattcataaaggttaaagttttaaaaaacattctggcaatggacaaatattctcaacaacctgaaaaaatgagaacacatgtacgtaggcatacaccactttcttaaatatctatttggtaaggaaatctgttaaaaataatgaacattagaatgcttaatatgaaaactcactggaaatgaccagagatgtcttcataagcctgaaaattgtacaattcaaagagaaagaaaataattaaatatttaaataatgatgttaatacacttcgaactgctaaaaatgcaggaggacgaatataacaaattaaaaaataaagtgagctagaaaatcagttgttcactttatatagatttttccacatgaaacaaataagggcaatatcactgatttctaatttatgttggttatggatatatgcaacttttgtaagggatcagctaaatcatctgctttggtagtgtttacttcagtgcctttaacagagtgttatgtagcaaatttgataacgatatactatattttaggctactaaagtggaagaatacattgatgagtttgattattagtgtttgtaagtagcttaaaaaatatgctgctgtaagctagtttatgctgcccatatggagactttgggacctttgttttccagtattcatatccagcttgaaagttttattaatctgactttaataagctatgatattatgatttgtgtaagctgaggaggttaacgctttctttcagtactgggattctgtttctttgcttttgtgtttacaaatttggctattaacttttctaaataattaagtaatttgtaagtttgtatctatacaggtgttaattgaaaagtattacatgaacaagcattaatgccaaagtataaaattcttttatgaatgatataatctgaattcctgtaaacatttctatttgattcagcataatcatgtttatgtctctttttggaaaagagtgtgagtagctggtagtttgtcttctagttcacatgtgtgtatatgataaagaaccatacaattaggtaggtgttataaataggatatggcaaaaaaggcaaacctactcatgtttccaagattttatagcatatgcctggtgaaattttgctattctttaattttgctttttgggttaaccagctgacgcccagttgaaaagacttatgttcgtgtgaggccacaaaagccttaatgttcagtctccagctacctcagattttggagaacgctgtgtaccatcagcagcttgaatccccaccctctaacgctaatgctcatctatcaaacttgaggctaagagtgagggagaggaagcttccagataaacatacagaagtgcctaaacagctaatcactctaggcttccgcttccaggccctataattagaagtccttctttttccttgtattcccagatgacgcaaatgctttttgtggcttggcacctcatttggggcgtgggtttagtttatggccaggccagagtctggtttagtcttctgatgcagcataaatagttctcaagccacagtctactctgcacaagtttttccttttatgtatatgtgcattttaacttgttttctagaagaaaaaaaagcttgctatttccctggcagaatgtgtgcaaaagaggaaattctaaatgaaaagaaagcacgtgactatgtagtcctatactagctatttctttttctcctttctgctctttaaattttttatattatttttaaaattttgtgaaaaaagtaaacttactggtggattgtagaagccacatttgcatggaggggtggaaaaaagtgtttgagataggatacagagaagataataggcataattttttagtggacattttcctgaaaatttgaatttgttttacataatcataactaaacagagatgaatgccagtttgaaaagctaggaacatatgggaacgtgttcatttgtgattttcattcatatgtaaaacaataatagtcttgatttggcaaatgaggacctttatttgaatgctcattctacataaaatggtatgatttaaaacgaaatttaatgaagtttatagtaggtgaggaatatatgttacaaatgcaaattcatcttatttcctgtcagaatgatgtttctattgaattgtttgtcaagtgcagaaaatttgttacagagaggtggagtcagaagatagtagtggatttatgatcattcaaacttagtataactcagcaaaaaagtaggagtggcaaaacactgtctacaaatggacaacaaagcattcatgcctaaacttaggaattcattgtttgaggccgggtgcggtggctcacacctgtaacaccagcactttgggaggctgaggtgggcagattgcctgagctcgggagtcagagaccagcctgggcaacatggttgaaaccccctctctatcaaaatacaaaaaattagctgggcgtggcggcgggcgcctgtggtcccagctactcgggaggctgtggcaggagaattgcttgaacccgggaggcggaggttgcagtgagccaagattgtgccactgcactccagcctgggtgacagagcaagactcccatctccaaacaaaaacaaaacaaaacaaaacaaaacaaatttattgtttgaataacagtaagtaaagaatataaactatgtcaataacctcatgatcatagctagacatataatgagaggtaaggttatatatattgttgtaggtttaataatttattaaattatttataataaatggtacctttcattttctaaaatgtattctcttggaaatagccaggacagtggcatctagtaggatattttaatatagtgactagagctgtaccttatgtttgccaaagaaatagcaaactcaaatttacttcatcttttcactgaaatgactatcttgtcttcccacagatgcttaatattctttcatgcctttttgttcaacaaaacattagtttaaatgcttatactaatgtgattctgcttctgggaatagcaaggtaaacgtagaaaccatccttcccatagaaaacatttatgaaacctggacaaaatacaactgaacaggcacataaagttagatatgtgtattataatctctggaacaaccagtaaaattttaatataaagagatatagctcaaaagtccatagataaattatttatttttaacattcaacaataaatattgttaaaaataagtagtctcaaaacagcaagaaaccatgagaagagaaataaaactgaataaaatgttgaaattagcatttcataaaaattgaatattccaaataaatagtcccataacagcaagaaaacatgaaaagagaaataaaaaacagaaacaagacaagcaaaaataataataaattggtagacctaagtccagccctaccagtaagtactaaatatgaataaactacaaataccaattaaaggcagtgatttgattgaaagagagtgagcgagtgtgagagcacccaactgttatctaaaagaagcctatattgatagatatagagtagaagaatggaaaatatataccatgcaagtaccaatcaaaacaaagttggagtggtaaagttaatatcagaaaaaactagacctcagagcaaggaaaataaccacggttaaatcatgttaaaagggttaattgaccaagacttcatacaatcctaaatgtgtatgaaccttgctctaaaatttaggaagctgatataacttaggaaaactacacatgtccacaattatccttggagactgtaactcctactcagtaatggaacagaaagcagtcagtcagtaaggaaattgaagatgcaaacatcactaccaattacatacctttctagaatatattctaggtgttcaagtgtatatggaacaaggatcatatttcaagccataaaacaaactttaacaaatgtaaaagaagtaacttcttgtcataatgaaattatactggcaataatatctgaaagatatctggaaaatatccaaatatttggtaacaaaacaatatacctttaaataacccacgagcaaaagacaaagcaactaggaaacatttaaaactgaatataaatgaaattgcagcatatcaaaatctgttacatttagctaagcaggcttagagggacattaatacctatatgtgcttactccagaaaagaagaaagttcctgaaacaataatctaagctgctcccataagaaactcgaaaaaaggaagagcaaatgaacccaaaacaaggagaataaaggaaataataaatatagtaacagaaatcagtgaaattgaaaagagaaaaacagaaagttatgaaaccaaataggttaaccttaaaaagaccttaccagactggtgaagaaaaaaaacagagaagacacagattaccaatatcgtgaatgaaaaagtggatatcattaatgtctctacagatattaaaaggatgaattccttgaattacagaaagtaattcatcaaagaagaaattttaaattaaaaaattaacaaaatatttaatggtagttaaaaatcttcaaaaataggcccaaatatttttacttgaaaattcccttaaacatttaacgaagaaataatagcaatcctacatcttttttttccccagaaattaacagagtaaggagcattcccatttgattatttgaggcctggattatcctaaatatcaaaatcatccaaacacattattagaaaagaaaaccacaaatcagtatttctcagggacacagataagaaaatattcaagaaaatattagaaaattgaatctagctgcttataataaaggattttgaccaaacgaggcttatcccaagaatgcaaggcatattcaacatttgacaatcagttattgttagaattcgctatattaatagatttaaaaagagaagccacataatcatttcaatagctgcagaaaagcacttgaaaaattcaattttctttcattataaaaactctcaacatattttacgaaggacttttacaaaaaacctatacataatgttatacttaaagattgaatgctttcctcctacaacacagaaatctctccttcctatttctgcttgcctcagcaaatgcagtaagtcgagaaaattgaagaaaaggcatgtaggtcagaagggaagaaatgaaactgtgattgttcctaaactacgtaattgtcatcaaagaaaattcttgtactgtataaaaaaacccctagaacttgcaggaaacatacattgtcaagataaaaaatcatcaattttatctctatgcactagcaagcaaaaattgatcattttaaaaaatattaccatttataataactctaaaagacaatattttcagaatctgtgtgtcaaacaaaaagaagtcaaaatagatctaaatcaagaaatatgctgtgttaatagatcagaaggcacaatattaggataacagttgtccccaaattaatttattacactcaatacagttccctcaaaatcctaaacaagaatggctaaaataatgttgaaaaaggcaggaaaaggctcattttacctgatttcaagattttctgtgaagttacagtaaccaagaatgtggtattagtgaatgtatagacacagaaattgaattaatagaatagaacttcaaaaataggccttggcctggcatggtagttcacgcctgtaatcccagcactttgggaggctgaggtaggcggatctcttgagaccaggagtttgagaccagcctggccaacatgtcaaaactccatctctactaaaaatacaaaaattagccaggcatggtggcgcacacctgtagtcccagctacttgggagattgaggcatgagaatctgttgaacccaggaagtggaggttgcagtgagccaagaatgcactactgcactccaggctgggtgacagagcgagactgtctcaaataataataataataacaataaataaaaaataaaaaaatgccaggcatggtgactcatgcctgtaatcccagcactttgggaggctgagtccggcggatcatgaggtcaggagatcgagaccatcctggctaacatggtgaaaccccgtctctactaaaagtacaaaaaattagccgggcatggtggcgggcgcctgtagtcccagctacttgggaggctgaggcagaagaatggcgtgaacctgggaggcggagcttgcagtgggcgtagatcgcgccactgcactccagcctgggagacagcgagactccatctcaaaaagatataggcctacacaaatagccaattgatccttggcaagttgacaatgttacttcaatggagaaaaaacagtgtcttcaagaagtctttctggaacaattggacatcttatgcaaataagttaaccttgtccatgttttgtataggatcctcaccttataacctgttgtataaggtcctcacaccttatacaaatattaaaatgatgataggcctaaatgtaaaacataaaattatgaaacttttacaaggaaagagaagatctttgtgaccttgggttaggcaaagaattcttagctatgacatctcatcaaaattaagaactttctctgtaatagactctattggcattttcaataaatatcatggtgaattaagtacaggaagtagtagttggatcagtagataaattggagcgtagaattaaagcttgaagaaattgcaaaagagggagtttcatggggggtatgtcattttcacattctttgttttgaaaaatgattgtggctgggcacggtggctcatgcctgtaatctcagagctttgagaggccacaacagaaggattgcttgaggcccagagtttgagaccagcctgggcaacatggtgagaccctgtctctacaaaaataaaagaaaattagccaagcatggtggcatgtgcttgtagtcccagctacttgggaggctgaggcaggaggatctcttgagcccaggaatttgcggctgcagtgagctgtgatcaggcacctgcaccccagcctgggcaaccgagtgaggttctgcttcaggaaaaaaataaaataaaattatgaattctgtaaattcaggaatatcaaacttctctctgctagttttacaggaatgccataatacttgcacatctagtgtttataccttgctgatatactgatgtgtcattaagcttggtattcacatgaaaaagatattttatttttttcttttgtaaagtttcttatagccttggtaatttttttcccattggtaatattttaaatattgtgaatagctttttagaatatttcatccacatacataatcatttttatttttaccctttgttttttgtcttccaggaatgcttctagtcacaacagacacccttggccatgactttcatgtcttccaaattctgactcatccttggtcctcatcacaatgtgctgtccaccatctgtatactcttcacaggggagaaactgaagccaaagtaagctgtataatttttcagaaggcgatttcttggtgtaatatgacatctactctagctggtcatttatattacattgcagcttaatgttgatgtttgtgagaaaatattgctgtctgtgatagaatgggttagataaatagggaaaaattccgttttgacccagtaaatacataagcactagatgaacatttttttgtttaaaaattcaatgaattttgataaaacagtagggctgtttatcctgcttttcccaacctgagaccatttcttgccccagggaaaactcctgtcattcatttgctgtctctccagaccttttactaggcatttggattctgtgtacataaatatgtatgtgcatacatacacacacatatacatataaacatggacatattcatatatacaaaaatagtttcatgatgaatatggatatatgaatacagtggaggctagtgagaaccagttgcgcacatccctccttggcacggtatttagtgatattattttgattgcgtgaaatcacccatgttgggactatttgatcatgaaaatttgcaaacactacaaatcagggctatttttttcctcagagagctagattttaaacatttaccagcagataatcacgtacacgtgcatgggtacacatatgttcatatgcatgatttactgagcgcttgtatcaggtgccacgctaagtgcttcacatatatttaatattcttatttaatttttaatttttatttatttttattattttttttgagttggagtctcgctctgttgcccaggctagagtgcagtggcgctgcgatctttggctcactgcaacctctgcctcccgggttcgagcaattttcctgcctcagcctcccaaccagctgagattacaggcacccaccaccatgcctggctaatttttgcatttttagtagagacggtgtttcaccatattggccaggctgatctcttgaccaagctggtctcaaactcctggcctcgtgatccacccacttcagcctcccaaagtgctgggattataggcatgagccaccgcgcctggcccacatatatttaatattcttaatatcacatggtagatattgtgtattgtcttaatcgcttaaaatctcaaacaccttttgtttcataccttatatgcacttgccaatataacactgtatatatgttattctacaagatagccatttgaccctactctatttattgactagcctatcattttccaacagtctaaagtgatgtttctcttgaattcccaccaaaataaatgactataatggattgaaatgtcttaaatttagagaacttaaacgctaatagtttataagaatatgtttgaaaaagtattaggcattactctaggttgcttatttactaactcactctgaaaactgataaaccaaaaatatacagtgtttaccccacttttcttgttatcaatttaataagacaatcaagtagttgatgagggaaagttttttcattgaaatattctttttttttttttccctcaagatgaagtcttgctctgttgcccagactggagtgcagtggtatgatctcggctcactgcaacctccacctcctgggttcaagcaattctcctacctcagcatcctgagtagctgggattacaggcatgtgccaccacgcctggctaatttttgtatgtttagcagagaaagggtttcaccatgttggccaggctggtcttgaactcctgacctcatgatccacctgccttggcctgccaaagtgctgggattatagacgtgagccaccgcgcccagcctcacggaaatattctaacataaaactggcttaagtaaaattttaaaaattatttctaaggtttcttatacaattattattattagtagtagtagtattttgaggacagggtcttgctctgttgtccaggctggagtgcagtggcaggatcatagctgagtacagccttgacctcctgggctcaagtgatcctcctgtctcagcctcccaagtagctgggactacaggtgcatgccaccacacctggcaattttttcagtttattttctttttttgtagagatgacactatgttgtctcactgtgttgcccaggccagtctcaacctcctgagctcaagtgatcctcctgcctcagcctcccaacgtgctggaattgcaggtgtgagtcaccaccctggcctattcttaatttttatgggtacataatagttgtacctatttgtggggtacatgtgatattttgatacaggcatacaatgcgtaatgatctcgtcagactaattgggatatccattgtttctttgtgttgggaacattctaaatccaatcctctaattattttgaaatatacaataaattattgttaactatagttacttttgcactaaactaacaaatcagcttctagatatagtctcactttggagaaaatacagaaatagagggataagttaaacaacaccatgaaaatgcaactagccaactctaaaatatgggaagttctacattacaaatatgacttgatttctttaacaaataattgtaattggaaaataaaagttgatgtgtggtgggggaaaggtgaattgttaaaattcaaggagactttggagagtatcatctaagtacaaagcgtggaccttatttaaatcctctttcacacaaaccaaatataaaaagacatttttcagacaagttgtgagatttttacatttgacttactagatattatttattattattagatattatatagataatattaggtattcaggaatttaaagtccttattttttagtgatgcaaaagtatttacagatgtctggaatttgctttgaaatgatctagcagtaggggaggggagggttggttagataataggacaaataagtgacagaagacaatagagggatggttatgttgattataagagacttaaaatacacattgagtaaatgcattgtgaaaactttgtttggaccctgatctaaataaagtataaagagacatttttgagacagttggagaaaattgaccatgaatgaggtgttatttgacatttatcaactataactaatttgctgggtatgtaattgtgtatttgttttgtagagacagagtctcgctgtgttgcccaggctagtcttgaactcctgggttaccacctgggtcttccacagtgttgacataagccactgcatattgccttgtaactaattttttaaaagtcattatttattaggcatatattctgaattatttacaggtgaacagagatgatatctctaatgtgctttaaaatattctagcaaaacaaacaatgagatatagtcaacagatctgcagagcgttaattgttgaagttgaatgatgtccatgtaggtgggtcatgttaacattctctatatttttgtgtatgtttggaaatttctcttaataggaagcaaaaacaacacccttcaccaacttttttacttactttagctttatgacttgatttattgttcgttttcaaaagctttcccagctgttgtgttttagagtgaccttcttgcgttgcatagtgaatcccgtggagatttttatttaaattgcattgaaattacattttaatacagttagaactgacatctttatgttgtagaagttttgcaactaggaattttaacattttaaaatttgtcattgctgtggtatggcaaagctattgataattttgtattgaatttgtgtatgcctgctttgctagattctcttgtaagattaagtagtttttcagtaaattttcttggaatttctaagtggaatacattttctgaaaattattatcttttttgtttttatttttctcttattatattgtctaggaattctaaaatattatgcaactgtagtagtgatagctatactctttgctttttgaataatatcttttattttgacttcattgttttgccctatttcttgcatgtttttcatgatataagtaatacataataacattttggaggtaaattttagacaatcttgaactacatggaacaaaaacatcaaagttacctgacccattaacctctgcacccagagctgctttgcttgtcaatttgttgtgcattcttaagatccccaaacatgtttattgtagatgaaattgttcttaacagtgcagtggtattatatctttttcaattattatcctagcactggagatctgaggattaaaaaaatgattttacttaaccttactaatttgagttctgacatttaaagatcaatagttcttaaaagctatgtatgtttatttctaattaatatctaggggaaaatccaatttactgattgatagggtcttggcattttcttttctttcttttttttttttttttttttttctttggagacggagtctctatcgctcaggctggagtgcaatggcacaatcgcggctcactgcagcctctgtcctcccgggttcaaacagttctcctgcctcagcacccctgagtagctgggactataggcacccgccaccacacctagctaatttttgtatttttagtagagacagggtttcaccatgttggccaggctggtcttgaattcctgacctcaggtgatgcacccgcctcagcctcccaaagtgttgggattacaggcatgagccactgcacttggctgggtcttggcattttcatagtccaagttctatttgaattaattcatgagctttaattaaaatgtaaaaatcttgaatttttatcccttactgtatattttttcctgctttttgtgttcttgttgctacagtttagaaaagactaaagacaggaaatgggtttgcacatttttctttatctctgttattttattctcaggctaaactgggaagtcttatcttttaaattttttaaaaattatttttaaacttttttttttttcttttgagacagagtcttgctctgttgcccaggctggagtgcagtgtctcgatcttggctcactgcaacctctgcctcctgggttcgagtgattctcctgtctcagcctcccgagtagctggggttacaggcgcccaacagcatgcccagctaatttttgtgtttttagtagagacggggtttcactatgttggtcaggctggcctcaaactcctgacctcaggtgatccacccatcttggcctcccaaagtgctgggattacaggtgtgagccaccgtgcctggcctaaacttttattttaagttcaggggtacatatgcaggtttattatgtaggtatattcatgtcatgggggattgttgtacagattattttgccattcaggtactaggcctagtactcagtagttatttttttctgatcctctccctccttccatcttccaccctcaaggaggccccagtgtctgttccctctatgtgtccatgtgttctcatcatttagcttctacttataagtgagaacatgcagtatttggttttctattcctgtattagtttgctaaggataatgccctccagctccatccacgttcctgcaaagacatgatcgcattcttttttatgactgcataatattccatggtgtctatgtaccatgttttctttatctagtctgccattgataggcgtttaggttgattccatgtctttgctattaggaattgcactgcagtgaacatgtgcatgcatgtgtctttatggtagaatgtttgatatcctgttgtatatttactcaggaatgggattgtgctgggttgaatggcaattccgtttttagctctttgaggaattgccacacggctttccccagtgatggaactaacttacactctaacagtgtataagcgttcccttttctccacaacctaaggagcatctgttattttttgactttttaataatagccattctggctggtgtgagatggtttatcctggttttgatttgcatttctctaatgacattcttttgaaaagtgtctgttcatgtcctttgcccactatttaatggggttttttgtttttttttcttgtaagtttgtttaaagttcttatagatggtggatactagacttttgtgagatgcatagtttgcagatattttatctcattctatagattgtctgtttactatgttgattgtttcttttgctgtgcagaagctctttagtttgattggagcccatttgtcaatttttgcttttgttgtgattgcttttggtgtctttgtcatgaaacctttgccagttcctgtgtccagaatggtattgcctaggttgtcttccagagtttttatagttttgagttttatatttgagtctttaattcatcttgagttgatttttttttttttttgagatgaagtctcgtttttgtcacccaggctggagtgcaatggcgtgatctctgctcactgcaacctctgcctcccgagttcaggcgattctcctgcctcagcctcccgagtagctgggcttagaggcacctgccaccacatccagctaatttttgtatttttagtatagatggggtttcactatattggccaggctggtctcgaattcctgaccttaggcaatctacctgcctcggtctcccaaagtgctgggattacaggcgtgagccactggagttgattttttatatgatgtaaggaaggggttcagtttcaaccttctgcacatggctagccagttacccgagaaccatttattgaatagggagtcctttccccattgcttgtttttgtcagctttgttgaagatcagatggttgtaggtatgtgtccttatttctggggctctctagtctgttccattggtttgtgtgtctgtttttgtattagtaccatactgttttgcttaccacagtcctgtagtatagtttgaagtcaggtaacatgatgcctccagctttgttctttttgcttaggattacgttggttatttgggctcttttttggtttcatatgaattttaaaatagtttgggaatcttattttagaaaattgtggtgaaatgcaaaaaaaaaattccaccatttttaccattttaaagcatacagttcaatggtattaattcacactgttgtgcatccatcaccatcatctaggtaatcttagcctttagcattgaatgacttttctaagctatcaccatttaacattttacccatactagtagttccttgattagagaaaaactagaaaatggaattttagtcattaacacagtgtcttttcttctaatgttcccatcaggcaaattattatttatgtgcaaattttaactcattcatgagtaaatatgggaatatttaacatctcatacatataatgcccaatttctttcttctggattaaatacttaaaatatttttaccttcttgagggtaataaggattattatatctgttttattcttcaccaaaaatacatacaatgcatacttttaaagttcctactgagtttaatgaaattgatttttctattaagatttcattttagaagtatattcattggatcatgatttatatttttcattcatgcaatattcatgttaaaaattaccttatttcttctcttccttatctaggtggaatcaattcttctcttccttgtgttactcattttacgccccattatagtacttattattttgtattttgactggttgtctacttgtttgtctccactaatactgggatttcttttaaaaataaattgtacctcattgatttttatatgcataggccttccactaaggcagatacatttttttccttggaccatttgaaagtagattgccaacatgacatgatgccctattaccctcaatgcttgaatgtgtattttctacaaatgagaacattcttctgtgtaaccataaaaaagtcaaatcaataaattttcaccatctaattttgaaagtccattttggtttcactgattgtcccagtaactagctaaaggatctagttcagggaaactgaatttttttttttttttttttgagacagagtcttgctctgtctccaggctgcagtgcagtggcgctatctcagctcactgcaacctcccgactgcctggttcaagcgattctcctgcctcagcctctgggattacaggcagacgccaccaagcccagctaatttttttttgtaattttagtagagatggggtttcaccatgttggtggccaggatggtctggatatcctgaccttgtgatccgccctccttggcctcccacagtgccaggattacaggcatgagccaccgtgcccggctggagactgaatttttatatctctttaatctccttcattctggaacaggtcattattatttctttgccttttatgctctcggcacatttaaatattacaagtaatttatttttgtcaaaagtgcctcaattttttatctgatgtttcattatgattagatttagcttactcatccttgacaggaatgtcacagagtaggtgctggttcttattgcatcctatcaggttgttactgattttgattttgatttgttattgatgatgatcagtttaatcacatgactgagatgatgtctgctggtcttcctcactgtgcagttactcttttgtacttataaaaatttacaaggtttttggggcagtaatttaaaactatgtaaatatgccattctgcattgaactttcaattcattcctttatttacctatcattttggtctcatagattcctattttattcaatggattatatttgttcaataattacttattatagtgcacaaaatgtcccacatttggccagtgggagcccaataacttggtgtctgtgtccttttgacatatcttcaccactttctgagcttgtccttactttctggcacaactaacttgcttacccttaagtttaattattatttgtttttgtctcttttgtatggaagttttaaatttgatgagcattttatctagagttaatatttcactgtgctgctgggcacattttatttcttacctctttttcaaatcccatcccatctgttctagtcactgagatgctctacctcatctctgaccttttagaatttggatattttaagcacttaacacctatttttgatacctctttgtattaaagttatttgccatttaatttatctataagttcaatatggaaatagaaattttgcttaagcttcttggcatctctcatgcatagaatggagccttgcatattgtagtgcaaatgtttgctaatgccagtgatgttcctacttaacaggtaggaaagtcaaatagaaattatttaaatgattatgctctagaacacactctgtatgggagactgggaatttctaaaccccaaataccaggacctcagtgaccacaaaattaattttataaggttctacagaaaattattttgaactgatatataaaatttaacaccagtcgtgaaatctatatgtcacatgatctgtttggccctctttgagtactacaaaagcatgtttttctggattcttccaagaactctgacggtactttaatcaggcaaggaaaaaaattcagtatgtgtatctaattatactgaattaagttgttttgtggtctatgacttgggatatcctttgcatctgacagtaattttcctcgtaaagcacatatgcagtaagaaaaatagtccttgttttcaacagtaagtataaaccttacacatattttgttaacatactttctcaaacagactcaagtcatttttgtacttagcatgctaattttggcaaatggcaaacttgcttttgaaacaaaatcagaaaagtgttaattttaccattctagaataatactgtgaaataatatagttagtatcttcaattgtcaaggggaaaatcatctagttattcagtgttattaactgataactatttgatggtcattttagataaatgcaaatatttgtttttagtgtgaacatgttccaaatatttcctagttatggttttactaatattcaagtttaactgggctttctgtatttatttttgtgaatctagcaaccctgtgcatgaccctatctatagtcatgtaattcttcagtttttctgcaaaaacgtcatttttattgagatataatttacatactataaaattcatttttagaagtgcaattcagtggtttttgttatgtttttacagtttgcatatcatcactagtatctaatttcaggacatttttgtaatccttaaaccacttatccattagcagtcactcctcattcctgttttccctgctcccctatatacttggatgctgattagtaattatataactaaggacaggctaaataccttctctaatcttcaagttactcttctgtaaaatggggccaataccgatttcagagtttattgaggaaataacagaaatactatatgtaaaatgcttagcaaagcactggcacagtaaatgccaaatacagagtcaatattaggacctctacttttggccaatatagcgttaagagctggattaaccctcctacctgaaacaactaaacaatgaacagtagttttctatttactgtacattagtcattgaaagatggcaatccctgatagatgaagaacaaatgagaggatgcctatggttgccccagtttattgctttgaaagagtttccagtcatggtgcaggaagggggaaccctagtggagcctagcagtctccctgaattgatgaggtattgctaagagtcctgggaggccaagatcatagattctcaatacactggaccagagacatgggagctgcagagagagaatcccagagatctgcagaggagacatgcgaacaaagaaagaactaccgtcagatcagaaaggcaagagtaaaactatcttttattcaaaaatgacatgattgtctatgttgaaaaactaaaggattttattttatttttaaaaaactaataaatgattttaacaaggttacaggatattagatcaatatacaaaaatcagttgcatttctatatactaacaacaatgaattgatcatttaaaaaatccagaagtgtatactactgacattcaataagcaagacttgtactctgaaagctagaaaatattgctcagagtaaagacctaaataaatggagaattaaaccattttcttgtgctagaatacttaccatcattaaaatgtcagttcttcccagatttatccatagactcgatgtaatctgcatcaacatcccagcagggttttcttttggttaaacattaacaagataattctaaaattcacatgaaaatgcacaacacttatgagcaaaataattttgaaaaagaaaaagttggagaaatgtcactacctatatcaagacttactaaaactacaataatcagtagggatcctgtgaccattcccacacatgtggagacaacttatttttgacaaaggtgcaaagatacaaagtggagaaagattagtcttttccacaaattaacaaattaactcaaattagatcatagacttaaatgtagaacctacaactatgaagttattagagcaccaaaagaaaccttcgtgacttgggttagggacagacttttaaaatgtgacaccaaggttggacacagttataattccagtactttgggaggctaaggtgggaggatcggttgaccccaggagttcaagaccagactggggaacatagaaagactctgtctctacaaaagcaaaaaaaaagttagccaggcctggtggtgcatgtctgtagtcccacctccttgggaagctgaggtggaaggatcgcttgagcctgggaggtcaagactgcagtgagtcatgatcacaccactgcactccagcctgggaaacagagcaaacccctgtctcaaaaaaaaaattttttttttggttttgtttttgctttgcaaaattttctattccaaagcccattaaagaaaaattgataaactggatttcatcaaaatgaaacacatctgctttttgaacaaaaccattaagagaatgaaaagacacaagttgtatgtcttatgtccacaatacctttaaagaactaactccccacagtcagtgaatagaggaactaaatttctcatatttcatacattgctgttggtacagcttctctgggaaataattttgcatttacttaaaatattaatatgtacttaccatagaacccagcaatttcagtcctggggcagattgttcatattataaaattcatgttgttcaggatgatgtccagatttactcaatggtttttttcctgtggttactacaacaaattgccatgaacttgggagcctaaaatatcaaaaattattctcctacagttttggagggcaaaaatctaaaatcaaaatgtaagcaaggctgcacttcctttggaaattctgaggaagaatttgttctttgccctttctagcctttgatggcctttagcattctttgagttatagccacatcactcagtctctgtctctctgattgtattacatcctcctcatttctgagtcagctcctcttctgtatttcttgtaaagatacatgtgattgttttaagtaccaacctggataacccagggataagccccttctcttaggatttataacctaatcacttattttgccaaagagtaactctttgatcctttgagggatgtggacatgtcttttgggggctataattcacttctctgtattctatcctctgcctcccagaattcatgttcatgccatatgctaagtattacctcttttccctaccaacatccccaaaagtcacaacccattcattacagcatcaactctaagtctaaattttttttaaaaatattatcggctcaaaggtccaatcttatcatctcaatcatctgactctggtatggttgagactctggaatttatcctagggcaaaattcctgtgcttctgtggacctgtgaaactacaataaaagttacctcctgccaaaatacagtagtaggatatgcgtaggatagacatttcaaaaggaagaaatggaaaagaataaaagagtcactggtttcaaacatgtttaaaatctagcagggcaaattccattgtgtttcaaggccagagtttcccatctggcttgaggcactgccctcctggactgcggcttcattttctgggcctgtggctctgcccattcctgcctttgtacacacagcttaggcctttaagtgcacatctctgcccttggagtcattcatacattttattgaagggtagcacaggtttgcacctaggtagctctatcagcctgtttcctgcttgtggaattttgcaagtccagtagctgccttcttcttctttttctttttttttttttaatcatgcctttgtgcctttcagtccaagatggcggtgtttctgcagatactacattctcaaaaaccttgtgtatctcctgtgtatgtcatggggatccatgccatcagacaagaggacactccacagatctttcttgcatttgtctctctattcctggcttctgctgattgagtggatccatgaaacacatgcctgatgtcttcagcagaatgttgtcaagctatactcctggccttcagagcacattttcccaaccatgaaactcctcatagtaacatctttttctccttggtaggatattcaaataccagaagatccaaaggaagtattattgaatggtaaaataagaagcactctgaatggcagtaagggagacatttgaggtcagggagaaattttgaaaaacttatatcataaattttgtcatttagctatgatggaatgataggaactggattaaacctctgtatccgttaaggttctaccagagaaacagaatcagtagggcattacagaggtttatcagcatacatgattctggcggctggctaggctagtctgaaatcagtagggctggccagaaggaatgtccaggtggaaactgtcatgcaggagctgctgcttcaatctataggatcacaatagtcacattagcagaatgaacctcgagattacccagatgtagtaaattataaaaattattttatttttaaaataaattttcaattttggaatcattttagagttacagaaaagttgcaaagatagtatagaaagtttctataccatatcaaatttctccttttttatacttaaaaaaatatacatataaaatttactatctttaccatttttaagtgtacagttcagtggtaataaatacatttctattccttttcttccccttcattcaccctgccccacacttcctggcctctgataactgccattctactctctatcttcatgaggcccactgctttttttttttcacatcagatggataatgtgctgacattgtaacgaggcttgaggaaggcacatctcacacagcagtgtgaaaacccactcatcatgcttatgaactacaaaaggatcaaagatccacttttgtagttcccacctaggagtgagatcatgcaacatttcactgtgcctggtttgtttctcttaacataatggcctccagtttcagctatgttgctgcaaatgacaggatttcattcttttttttaaagctgaatatttcattgctatatataccatatatgctttatttattcatctgttgatgaactcttagagtgattccatattttggctattgtgaacagtgctgcaataaacatggaagtacagatatcccctagatgcattgattttctttcttttggctatatacctggtagcagaattgctggatcatatggtaattctgtttttagttttctgaggaacctccatactgtgctccatagtggctgcactaatttacatttccaccagcagtgtgcaagggtctcttctccacattctcaccagcatcttttattgattgtccttttgatacaagccatttttactagggtgagatgatatcttgttgtggttttgatttgtgtttctctgatgactagtgatgttgagcattttttttcatatacctattggccatttgcatgtcttcttttgagaaatgtgtgttcaggtcttttgcccatttttaaattttcttattttttcttttgtttctaatggggttggattttgcccattttaaaattggattatttgggggtttttgctattgagttacttgagctctttatatattatagttataaattctttgtcagatggatagtttgcaaatattttcttccattctgtgggttgtttcttcactttgttgattatttcttttgctgtgtagaagcttcttagcttcaggtaatcccatttgtctattttgctttggttgtctaggttttgaggtcttacacaaaaaggctttgcccagaccaatgtcctggactgtttctccaaagttttcttttagtggtttcatagtttgaggtcttagatttacgtctttaatcgattttgatttgatttttgttatggtgagagatagaggtctagtttcattcttctgcatagctatccagttatcccaccaccacttattgaaaagactgttcttttaccttcttatgttcttggcgtctttgtcaaagacgaattgactgtaaatgcatggatgtatgtttggtttctctagtacgttccgttggtctgtgtatctatttttatgccggcaccatgctgttttggttattatatacctgtagtaaattttgaagtcagaaagtgtgatgccttcagttcctttggctcaggattgctttggctatttgtggtcttttgtggctccatataaatgttaagattttttttttcctatttctgtaagaatgttgttggaattttgatagggattgcattgaatctgtaaactactttggatagtattgtcgttttaacagtattctttgatccataagcatggaatatctttccatttttttgtgtcttcttcaatttctttcatatttcatagttttctttttatagatctttcacttctttagttagattgagacctaggaattttatatttttgtagctattacaaatgggattgctttcttgatttctttttcagattgttccctgttgatgtatataaatgctatcgattttttttttttttttttgagatggagttttgctctgtcgcccaggctggagtgcagtggcgcaatctcagctcactgcaagctccgcctcccaggttcatgccattctcctgcctcagcctcccgagtagctgggaccacaggcgcctgccaccatgcccagctaattttttgtatttttagtagagacaggctttcactgtgttagccaggatggtctcgatctcctgacctcatgatccacccgcctcggcctcccaaagtgctgggattacaggcgtgagccaccacacccggccaaatgctactggtttttgtatgttcattttataacttgcaactttactgaatttgctgatcagctgtaacaattttttggtgagttctgtagccttttctggatataagatcatgttgtctgcaaacaaggctgatttgaattcttcctttccaatttggttgctctttatttctttctcttgcctaattgctctggccaggactggcagtattatgttgagtaaccgtagtgagagtggacatactcgtcttgttccagtctttagaggaaaggccttcattttttccctgttccgtatgatggtagctgtggatttgtcatatatggtctttattattttgaagtatgttgtttctatacccattttgattaggggtttttttatatcataaaggatgttgaattttataaaatactttttcagtatctattgaaatatgtggtttttgtttttgattctgttaatatgatatatcatgtttattgagttgcttatgttgaaccatccttgcatccctggaatgaatcccatttgatattataaatgatctttttagtgtgttgttgaattctgtttgctagtattttgttgaggattttcacatatatgttcatcacggatattggcctgtagttttcttttcttgttgtcgtgtccttatctgattttactgtcaaggtaatgctggccttatagaatgagtttggaagtatgtcctcctcttcaatttttttgaagagtttgagtacaattggtattaattcttctttaaatgtttggtagaattcagcagtgaagttgtgaagtcctgggattttcttgctttttatggaggctttttattacagcttcagttttgttacttgttattggtttgttgaggttttctgtttcttcatgattcaatcttggaggttgtatgtttccagaaatttatccatttcttctaggttttccagtttgttggtatataattgttcatagtagtctctaatgattttttgtgtttctgaggtctcagttgttatgtgtcctttctttgtttctgattttatttatttaggtcttctctcttttttcttagtctagctcaagacttgttgattttgtttacatttttgaaaaccaatgttttgttctattgatctgtatttctttttagcttcgatttcattagttcctgctctgatctttattatttctgtctttactatttttgactttggtttgttcttgcttctagttccttgaggtatatcattaggttgttcatttgaagcctttcatttttctgatataggcatttattgctacaaacttgcctgttagtactgcttttgctatatcccataggttttggtatattgaattttttttttttttttttttgagatggagtctcactccaggctggagtgcagtggcgcaatcttggctcactgcaacctctgcctcctgagttcaagtgattctcctgcctcagcctccagagtaactgggattataggcgcccgccaccacacctggctaatttttgtatttttagtagagatggagtttcaccatgttggccaggctggtcttgaacttctgacctcaagtgatctgccccctcggcttaccaaagtgctgggattacaggcatgagccaccacgcccggcctatatattgcatttccatttttccattttcacttgtttcaagacattttaaaatttctttcttaattaatttcttcattgacctattggtcactcaggagcatgttttttaatttctatgtgtttatatattttccccagttcttcttattaagttctagttttagtccattgtggccagaaaagatatttgatatgatttttattttaaaagttttgttcagatttgttttatgacctaagatatggtctcttctggagaatgtcccatgtgctagtaaagaaaatgtatgctgcagcagttggataaaatgttctctaaacgtagttaggcttgttggatctggtgtgtagtttaactctgctgtttcattgttgattttatgtctgaatgatttgtccattactggagtggggtctccttcttttattgtattgcagtctatctctgttttagatctattaatattttctttatagacttgagatgtccagtgttggttgaatatttataattgttacatatgtttacttaattgacccctttatcattgtatagtgtccttctctgtctctctttataatcttagattggttgtctattttttcatgtaagtatagctattcctgctctgttttggtttccagatacgtggagtatcttttctcaccccttcactttcagtctatgtgtgtctttataggtgaagtggatttcttgaaggcagcatgtaacttggtcttgtttctttatccattcagccactccgtgccttttagttggataatcgagaccatttacattcagccttattattgataagtaagaagatactactgccattcttttgctagttttctggttgtttctttcttagtgccttcctttgtgggtaagttattttctctggtattatgctgttaatttgttgcatttctttttagtgagtctgttacaggattttgtgttacaagtttttgtgttgtggttaccaggaggcttatagagacatcttataatagatataacaagttattttaaagagactacaacttatcttagatcacaaatagaagagtagaaacaaaggcaggcataaagaacatgtaaaaaaaatttatacttttactctatcacccaacttttttttttttttttttttgagacaaagtcttactctgttacccagtggcacgttcttggctcattgcaacctccgtctcctgggttcaagtgattcttctgcctcagcctcctgagtagctgggattacagacatgtgccaccatgtccagctaatttttttgtgtttttagtagagacagggtttcactgcattggctaggctggtcttgatctcctgacctcaaatgatctgccctctaaaagtgctgggattacagatgtgagttaccatgcctggcacccccagcatcttgacttttggttatatcagtttatattttttgtattacctatgttttaacaggttgctaatagcgattattatttttgatagatttatcttttgggtttcatactagagttatgagtggattgtacaccaccatttcagttatagagtattttgtgtttcaccatgtactttttaccagtgggttttataccttgaaaagctttcttttagcacatcagagttttcttggttcagattgaattattctcgttagcatttcttgttaggtgggtcaggtggtggcaaattatttgtttttgtttgtctcagaaatactttatttccccttcatatttcaagtataattttgctgaatgcaatattcttggatggcaatgttttctccttgagcactttgaaaatgttgttatactccctcctggcttatatgatttacactgggaagtctgttgccagacaaattggagatacagtgtttgcttcttttctcgtgctgtttttaggatcttctctttgtccttgacctttgagagtttcattattatacgtgttagagtacttttatttgggttgagtgttgttctcagtccttcctataactggatatttatatctttcttaagttttagaaagttttccattattatttctttggctgcattttctaccctttagtcttatctccctcttgaataccaataattcttagatttggtcttttgaggtaattgtctgcatcctgttggtggtattcattcctttttgttctttgtccttctcccaccaccccccacacccccaattgtattttcaaatagccagtattttaggtcactgattctttccttcacttggtccattccactgttgagagtctctgatgacttcttcagttcagcaaatatgtttctcagttccaagatttctatattttttcccaatctctttgttaaatttctctgataaatttctgaattgcttttctgtgtgtttgttgttgttgttgttgttgttgttgttttggagatcactgagttttcttaaaactgctattttgaattcttggtcagagggctcacagatcactctttcattagggtctgtcactggagttttgctttgtccattggagaggtcataattccctacttgctgttgtttttttcgtgtgtatatctgtatctttgcattgatactttatttcagttttatctgtctaccttgttttgattttattgggtatattttgcttagtgcattttttttaatccttttagagtcagggctcattttgttgcccaggctggagtacagtggtgcagtcattgctcactgtaatcttgaactcttgggctggagcaatcctctaacctcagcctcctgagtagctaggactacaggcacgtgacaccatacctggctaactttaaaaagaattttttttgttgttgttgttagagacagactctcattgtgttgccctgcctgtcacaaactcctggcctgaagtgatcctctcacctgccttggcctttcaaggcactggaattacaagcatgaggcagcgtgtctggcctgttagtgaatctttacagctaagttgttgccttttttttttggatataggtggtacctaaagcccaggttcaccttggctctgctaaatgattgtagtactgcctatcctgatttgggagcatcccaaagtggttatccccacagtgtgtcaagtctggctaggggtttgtgcccagggacctttgtaatgtattgcctactacatggtgctgctgaacagccactctaatttggtgtctcctttggccaagtaatggaacaaagtttccagggctagggatggtagtctagcctccccactttgtcttggcctgtcctcagggttgtttctcccatcaggcagccacgatacttcctgccagttaaggcaaggatagttttcctgccagagcacccaagatggtgggaaagctggtttaccacctcagtctcactttttccagtatagtcaccatgagttggggggggagattttctgtgctcttgatgccaggcagaatcgggggaggggcattacagatctggaagtctgaatctcttaccattcactctgaggttttctttttcacttctctgtggcctcaggaattgtctcatcctcatatttgagttctgagtgtttctggttaaaatctcggtactatatatttgtttttggttttctgcaggggtagtgaagccagctagcttctataccaccgttttggaactggaagtctccatcttctagtagaaattattttaaagcatctattattactatgctcagtgatatgaaggaaaatatgcttcttttaaataaaagggtaggaaatgtcagcagagaaagagaaaatataggaaattacctagtgaaaagtctacaacttaaaaatacaatatcaaaaataaaaatgaaatggatgtgttaatagcagaatttgagtgagtaaatgaatttgcagatagatcactagaaatttccaaaccaaatgagtgaaaaaatagaaaataagtagagccttagcaacttgtgggacaatatcagagccaacatacatgtagttattgcagaaggtgaggagagtaagggaggaaaaaaaatctaaaagtgggaaactttccacttttgttgaaagacatacatttacaacttcaaaaagataagcaaacaacacataagattaagtacaacaaaaaccatgtcaaaggacatcatagtcatttttctgaaaaccaaagtaaggaggaaatcttgaaagtaggcagacaaaagtaatgcattgcacacacagaaagtacattttaacacactattgacttctcactggaaaccatggaagtcagaagacagtggaataacatgtctgaaggactcaaagaataaaatattggccacctgaagttttccatcaaacaacaatatctctcaaggatgaaggagcagtaaaggcgagacatccacactgtaaattatgctaatggcacataataccagaagcaaacttgcagctttaggaaatagtgaagaatatggtcatttcttgttgaatagaaaggatgatttttcccttttaaaaatttgtgtctaatatatgggaatgattgaattattttgttggtattgtattatatgtacatgtaatacatatgacaactatagcacaaagatggagggtgctagggtggaggcaggtatatggagctgtactattgcaaggttcaacattgctatacataaaaaatcaatgcttcaatgaaaatggcatactaaaaaatgttcagttaatacaaaagacaggaaaggaaaggcagaagcacaagaaaaagagggataaacagaaaacagatattaaatggtatatcaaaattcaaccatatagaaattaaatattaatgtactccaatataaaggaagaaattgcctataaggtagtgttgaatatagagacattaatatgatagtaaatgtatattaaaagatacatcatccaaataagaaacataagaatattggaaattcaactatattagtatcaactaaaatagaatttaagacaaagcctattaccagagatattttgtactgttcaaaagtcaaattatcaggaaaatttaaatgtatgcacgtagactcagttttaaatgcacataatttaaatgcatcttgacattttgggctgtatgataaaaaataaaataaatgtatgcatctaaaactgagttttaaaatacattaaataaaatcagaattaataggatgaataattctacaatcagcattgttgattttaataccactttcttgatgttgatagaatagagaaaaaagacataaattattagagtaacactactagctacattggcctattagataaccaaacccaacaactgcagaatacatattattttcaattatgacatcatgcctagtttgaatggatatgaaacagtggataatagatgatacttaagtcagaggcaaaacatttattatggatggatttggatggcaatcacagtgcagtgcagggtactgtaggcttgataagcagcttgattccagtcatttccatcagtgaatagaaccttaccttggctgtgagtgatccagattgttcaattagcaactatgatttgtttgcagaactcatggccccaaagaggtgcatctgtagtctgcgagtgtttagtcttccttgtggcagatgagaccactggccaggccattgccaactgaggaaaagtcagtaaaaatgaaacttctagagggttttcagaattaggaggcggcgaactttttctttaaaggaccagataataagtatctttgactctgcattccatattgtctctatactcagttctcctgctgtcatacaaaagcttccataggcagtacataaatgaatgggcacagttggcccaccgacatagtttttacctaaccctgaattaaagctggggtgatggctttgcattattctatcatgctggttgctccttatttcaatcagccttccagagttgttggggttatacagctatcaaggcccagtgggcatcatcaggtttcatcttagctgagccatcagtcaatcaggcccaggtatttaaaggaagctctgtgaatccagtgcctcttgagccagtggcatgcttctgacagtggaataaaagataaagtggctgtaatacccaaggttctgctcaaccagactggctgtactctggaatataccatttccatttgaatagcggtccctgttggttgggctcttcccaccttgttcattttcaaattttagttgacccatccccaagtaggtctagaaagtcacaaggcctccatgggtcagttgttcaattacaattagaactttgtagctggttaatagcagccttctaaaaaagggagtgtacttggtggctgcatcaggcaggtggcgatgttgtactgagataacacctctgagtacttcagcagccattaagtctttacctaaacattttactcttggaatcctacgttgtttctggcatataatatgggaaggaactggaagtctagtaggtggtctgttgtgcagttgtcccactatcaccttggtgtacatgttcgatgatatcctctggcacaagcatttaagtacagtcatgtaagccattaataccagttatatattcaccaacataagtcaaaatgatagtacattgaatcggactaaagggtcccaccattttatatcccattccagtgtatttttcctccatgaaaagcatggactagcgtttttaatgtgcacatgccagttgctccagtgacaattgcccttcagtaatgttatcccctgtgcatggcaggggaagctaccctttgcataaggtgggacagctaggatgttgggcttttatctcacttggccttttttttttttttttttttttgagacagggtcttgctctgtcacgtaggctagagtgtagtagtgcaatcattgctcactgcagccttgaactcctgggctcaagagatcctccacctcagcctcccaagtagctgggactacatacagttgcataccaccatgcccagctaatttttataaaaattttttagagaggctgttgctatgttgcccaggctggtcttgaatccatggcctcaagagatcctcccactttggcctcccaaagctctgagattgcaggcatgggtcactgtgtccagcccgaaagtgcacgtgtttttatcagttctgaaggataaaaaatgttgaagtacatggctgggaatgtttctagaacttgtattttaattcccttttttatatttctatatgttttcattaaacataacctcatcaaatggcttggactttggcaaggtagttattgctatatgcagttatctttatgataactctcttcgtcttgagactttttatccgagcattgctcttgggttttctttcttttccagtagggttagaaagggcgttgttattggaatcattaggcatacttttggccatagaaagaaaaccacatttaacaatggttttttaaaatcagtgtttattttttatcacgttataaaatgtttgctgctggtcttggctgaatgatgtctatgtgactttttttgctctttccctcatgattcctttataaatgtcacttccctgggcatcatttcagacttcaaggcaataagaaggggagaaagggcaccatcagtgatgttaatttcctttatcaggaaagcagatactgttccagaatcctgcaatagccacctgcctttgagtgatcataactatgtcaccacttgttgtaaaagaggctaggcaatcacagattaagtatctgtggtggcatccagtgaaggagtgaatgttggagatggatgttggatttgcctctcagtagttaaatctatataatcatcaccacaatcaagatatagaatagttttcttatctcagaaacaactttcctcctgccctttttcgtcagtgctctctgccctgctgctgccctagacattgctattaccttattattaatatatatatatatatatatatgtatgaaggagtcttgctctgtcccccaggctggaggtcagtggtgtaatctcagctcactgcaacctccacctcccaggttcaagcgattctcctgcctcagcctcctgagtggctgggattacaggcgcatgcaccacacccggctaatttttgtgtttttggtagatacagggtctcaccatgttggccaggctggtcttgaacccctgacctcaagtgatccacctgcctcggcctcccatagtgctaggattataggcgtgagccaccacaccctgcctaaaaatattttttctgtaatttctaaggtttgatatggggttggagggaatgctgttgctggtcactttattttctaacttggtattgctgatcagtaccagagttattatttaagtattctaaaaatgcatatttcttggtcatcccccctcctacccaaataactgctgaatcataattctgaagatgtgaccacaggatctgcattttgtacagatcatctaagtgcttcttatcacactaaagtttaacaatctctgcttcaggtttttttaggatgttaaataatcccaaaatgttatcattcttattaattgaggttgttattgagtttttggtggtgaattcacagccttataagatgctgatttctacatcttagatgctgaaatgtagtaacatttaattctagtacccaatcctcttgtttcatatgtactttgacttcaacccattttgtgaattaatttttttaagttttgataaaatgttgaacatagatgaaaacactctttagaaattttatgttccatgtgagtatatctactatattagatattggtttccccaaatattacagttttgaattctcaaatcgatgaaatatttaaaaatgaataactcagattacataaagtatttgtataaatcggaattactggactatgactacagtacgttttaaagaacaaatatcttagcattttagaggcctaattggtttctgattagccaaattttatatcattataatgagaaatgtgagatattataaatatgctaaataatacaggaaacatttaatgaatggtaaattacataacctaacataaatttgcaaaacatttaattaaacactgtaatactgtatttgtatctcattagttgagaactctgacatttgtatacttaaaaactctaaattggtaataatgagtgccctaatgaggattcccagattaagttaagtgctgtttgcttgagtttttcttcttatggcacacttttatgctgaatggaaggaaacttaataagaacatctggttataccttttacccatattatattcaagccatttgttttttttgttttttttgcttttttgtttttttttttttgagacggagtctcgctctgtcgcccaggccggactgcggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcaagccatttgtttaacccaaccccagatgtgaaatgagccacgataggcacagataaaaatgctcgtttaggcttctcagcagctgcttatcttcctttgtgcataggacagcaaaggcatctctaagaactaagggggctattaaaagaaaccacaaactataaaaagaggctatagaacttcactttcaggaaactggctagttagtgttcctttcatttttttatgacagatttgttgaggtataattcacatacataaagttcaccattttataatgtacaattcagtagttttttagtatattcagttatccattgatcactaccattcaattcaagaacattttcagcaccccaaaatgaaccttgtacctatccaagtcactctccatccccctctccctgctcctctgcaattactaatttattttctgtatctgtggatttgcttattttatacatttcatataaaatggaatcatacaatatgtggccttttatgtcttgtttctttcactttgcataatgcttcaaagttcatccattttcaaatatgcatcagaaacttcattcctattcatggatgagtaaatactatttcattatatggatatatgacattttgtttattcatttatcaattgatagacatttaagttgtttccacatttgggcttaggaatccagctgcaaacatttgtatatagatttttgcttttttttttttttttttttctttttgagatggagtcttgctctgtcgcccaggctggagtgcagtggctcactgcaagtgcaagctctgcctcccgggttcacaccattctcctgcctcagcctcctgagtaactgggactacaggcacctgccaccacactcggctaattttttgtattttttagtagagatcgggtttcaccgtgttagccaggatggtctcaatctcctgacctcgtgatccacccgcctcggcctgccaaagtgctgggattacaggcttgagccaccacagcttgtatataggtttttgtatgaacgtatgtttttagttctcttgaatatctatctaggagtgaaaatgctgggtcatatggtaactttatgttaaacttttggaaacaatatatatatatatattttttttttagtatttattgatcattcttgggtgtttctcggagagggggatttggcagggtcataggacaatagtggagggaaggtcagcagatgaacatgtgaacaaaggtctctggtttttctaggcagagggccctgccgccttccacagtgtttgtgtccctgggtatttgagattagggagtggtgatgactcttaaggagtatgctgccttcaagcatctgtttaacagagcacatcttgcactgcccttaatccatttaaccctgagtggacacagcacatgtttcagagagcacggggttgggggtaaggttatagattaacagcatcccaaggcagaagaatttttcttagtacacaacacaatggagtctcctatgtctacttctttctacacagacacagtaacaatctgatctctctttcttttccccacatttcccccttttctattcgacaaaaccgccatcgtcatcatggcccgttctcaatgagctgttggatacacctcccagacggggtggtggccggacagaggggctcctcacttcccagacggggcggccgggcagaggcgccccccaacctcccagacggggtggcggccgggcgggggctgccctgcacctcccggacggggtggctggccgggcgggggctgccccccacctcccggacagggcggctggccaggcgggggctgccccccacgaaacaatattttttaagcttttattttttagagatggagtctctaaaaatatgcattgcacaggctggagtgccgtggctcaatcatagctcactgcagcctcaaattcttgggcaccagcgatcctcccacctcagcctcccaagtgattgggactataggcacatgccaccacacctggctatttttcttttttctttttgtagacacaaggtttcactgtgttgtccaggcttatctctctggcttcaggtgaaccttccacttcagcctcccaaagtactgaggttacaggcatgagccattgcatttggcggaagcactttctttttattattattattattattattattatactttaagttttagggtacatgtgcacaatgtgcaggttagttacatatgtatacatgtgccatgctggtgccctgcacccactaactcgtcatctagcattaggtatatctcccaatgctatcccaccccgctccccccaccccacaatagtccccagagtgtgatgttccccttcctgtgtccacctgttctcattgttcaattcccacctatgattgagaatatgcgtgtttggctttttgttcttgccatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgcctcaataaaaatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgaggtcattgtagattctggatattagccctttgtgagatgagtaggttgcgaaaattttctcccattttgtaggttgcctgttcactctaatggtagtttcttttgctgtgcagaagctctttagtttaattagatcccatttgtcaattttgtcttttgttgccattgcttttggtgttttagacatgaagtccttgcccatgcctatgtcctgaatggtaaagcctaggttttcttctagggtttttatggttttaggtctaatgtttaagtctttaatccatcctgaattgatttttgtataaggtgcaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatgaaatgttcttccatttgtttgtatcctcttttatttcctcgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattttgggctgagacaatggggttttctagatatacaatcatgtcgtctgcaaacagggacaatttgacttcctcttgaatacacctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaacttattgagagtttttagcatgaagggttgttgaattttgtcagaggccttttctgcatctattgagataatcacgtggtttttgtctttggttctgtttatgtgatggattatgtttactgatttgcgtatgttgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtatttgcccggctttggtatcaggatgatgctggcctcataaaatgagttagggaggattccctctttttctattgattggaatagtttcagagggaatggtaccagttcctccttgtacctctggtagaattcggctgtgaatccatctggtcctggactctttttggttggtaagctattgattattgccacaatttcagatcctgttattggtctattcagagattaaacttctgggcggaagcactttctaagtggctacaccatttatatttcccctatggaaatttgagtgtttcagtttctacacatcctcaccaaaacttatcatctttttttattttagccattcttttcggtatgaagtggtatctcattgtggtttttatttgcatgtccttaatgactaatgatgttgagagtcttttcatatgctattggccatttgtttatcttctttggagaaatatttgtcccagtcctttatttatcagatgtattatttgcaaatactttccctcattcattttatggcttttttaactttcttaatggtattcttttttttttttttttttgaaacagggtctcactctgtctcccagggtaaaatgcagtgctgcaatcacagctcacaccaatcttgacctccctgggctcaagcaatactcccacctcggcctcctgagtagctgggactacaggcgcacaccagtatgcccagctaatttttctattttttttgcagagacagggtttcaccatgttgcccagtctagtcttgaacttgtggggtcaagtgatctgcccagctcaggctcccaaagtgttgggattatagacaggagccactgtacctgacctttatttatttatttatttattttggaggcaggttttcacactgctggcatgcagtggcaccagtatggctcactgcagcttcaagctcctgggctgaagcgattctcccaccctagcctcttaagtagctggaactacaggcatgtgccaccatgccaggctaatgtgtttttattttttgtagagacaggtccttgctatgttgcacaggctggccttgaactcctggcctccagcagtcctcccacttccccctcccaaagtgctgggattataggcatgagctaccatgcccagccaatgtattctttgtacatgcaaagtttttaatgttgaagaagtatgatttgtctactttgacttgggttgcttataggtgatctcgattaagagtccaagtaagagactaatatagtaaccttgtagatgatagtgttttaagtgtattttttttttttcttgagacagggtctcgctctgtcacccaggctggagtgcagtggcatgatcttggctcactgcagcctctgcctcctcccaggttcaagcaattctcctgcctcagcctccctagtagctgggattacaggcatgtgccaccacacccagctaatttttgtatttttagtagagacagggtttcaccatgttggccaggctggtctggaaccccttacctcaagtgatctgcctgccttggctttccaaagtgctaggattacctacgtgagccactgtgcccagccacaagagtgatagcagtatgttgatagcagtgaaaacagacatttggacagagttgcaatgtatttttatgaggacaataataataatagcaaacatctttgtatagtgcttattaagtgctaggcactgttctaagtgctgtatgcagtaactcatacccaacaaccctatgaaattggcataattattcctgttttgcaaatgaagaatctcaaggcacagagctggtaattaactttcatatggccatatagcttgtaagtagtagatatatttactgtgatatattgcctctaggtaaagcttatatatggctttatatttatagtactgtttccatgtattttcataatcttctataatattaaactttgtagattgtttcatttcaaattggtattttaaatctaatctgaaaagaaattatatgtgtatgcacaaatgtgtatatgtagttatgtaatatatataaatggatagatatactgtatatttgcattaagagttgcctgaaagaaggatgtgttccaagataatgagaaatagttgtgggatttatgtgtgtgtgatttttttaaaataccaaagttattttctgtatttatgttcattattttattatatatagctatattctaccttgaaaacaaaataaacaaaatatctgcttgctattgaatgtcatttttcttcttttaagcagataatccatattttttaaattaattaatttattttacagattgggggtctcactctgttgcccaagctagagtacagtggcacagtcataactcactgcagcctcataactcctgggcttaagcgatccttctaccttagcctcctgagtagctggagctacaagtgcatcattgcgcctcgcttgctattgaattctttaaagtaccttaaaaataaagtatcttaatttcattggtctcatgttcttaactcatgtcttgtatggatttttcttaagggaagactttctttagtttttcctctctctactgtggagaatctaataacactaactttgaatttcaactgagcaaaagattattcccataaaaagaatgtctttcttctcattgtagatctatattacaaaaaactatattgaattattatattttgaattgcatcaacaaaaattttgtcaaaatttggtttttctcttgttataaacaacaactacatggtacctttgattttgctttcttgtcttcaaggcctaaaatttattatctggtcctttacagaaaaagtttactgaacccagttctaaaaaaaacctccacttctctcatgtccacaaacattttctgtgtcagttctataggattctgaaatgtggccaaccaggagcacatatactttatctcttgctattcacatctgcttagttcctgagtttaaaatattgactagtgagtgtcttaaagaaaaaaatatataaatatgtttgtgtcctaaatttgagagcaggggtttgaatagtgagtggtacctgtacttgtttattatttgttaccacggttgcctaatctgtacatggtaaatgttatttgtcatgatattcatgatatttagtgctgtagaattaaatcagtaatgcgactcgactcctatctagctcttctttttgtgatgagaatatgttaattacaaataacattccataattgaggtccaaaaatcatgcagataatgtcatcaccttattactagttttccatttttacaggtttttttcatttttaataatgtctgaaaaaccgtccagctagttaactaatagcaacagttatattattttacatcttgtggataggcaacttgttatcctctgtaatgttatttaaaggattaaactttccctacttattttgacagctagtatctttagcagtccttctctgctcatttatatatgctgatatgtcttcaaggtcatagagcagaatcacttctctattagcagttttctaaaaaagcattaggtggaattctgtcttcctgccttgatactgttactaacaccacctctatatcctgagtagtctaaaaatgaaagaaagaaactcctttttattgacagaccaggaagtggtcttgattataagtgttttggaaaaagatgttagataacatagttcaatttcactgtggctggaacataaattgctcaatgataaatctaaggatgcctttctttatatagttgactctgtcatgtgaaaatgcatttcatattatgatattaatttcttccggtactatatttcttttctcttacttcttctgtttacacctttgttcgtcctgcttttcccttcctcttgcttttctacgactttcatcctttcttttaataggacccctgatctattcagaaaagtcagttaagctgaacataatcgtaggcaagctacagaggttaaacacttctggaataactatttatctgaaatgctggaattgttgggagttaaatttctcagcttttaggacagtctttaattatatcattaatgtgtcatttggatgtgtcacaatagtcgagattggcaggcatgtggttgaattttgagtttgttcatgtactgatgatgtttgtgtagcagttttctagcaatgaagtatcttgtcttgatacataagactaaaatttcttttttatttaaaagattccaggctctattagaaacttgtactttgatggctacctagagcttttgtttgtggtgcgtttctgaaatatgtagtcttatttgaagacctaatacactgaaaagtgtttctctgaccacttggggacttttacctaattcatgttattataatgaagctaatatgcctcatgcacatagatatgtatatatacagcttttttttaatttttaatttttgtgggtacatagtagttatgtatatttatggagtacttgaaatattttgatacaggcatatagtacataataatcacatcagggtaattggggtatccatcacctcaagcatgtatcctctgtgttacaaacagtccaattacactcttttaattatttaaaaaaattttttgtgggtacatagtaggtagttatatatatttgtagagtacatgaaatgttttgttttatccaggcacagtggctcacgcctgtaatcccagcattttgggaggccaaagtgggcagatcacctgaggtcaggagtttgagaccagcctggccaagatggtgaaaccccatctctactacaaatacaaaaattagatgggcgtggtggtgcatgcctgtaatcccagctatttgggaggctgaggcaggagaatcacttgaacccaggagacagaggttgcagtgagccgagattgcaccactgcactctagcctgggtgacagagtgagactccatctcaaaaaaaaaaaaaaaaaaaaaagttttgttttaatacgggcatacaatgtcaaataagtgcatagtgaagaatggggtacccatctcctcaagcatttatccatttgagttataaacgattcaactgtattctttttttttttttttttttttgagacagagtttcactcttgctgcccaggtgggagtgcagtggcatgatctcagttcactgcaacttctgcctccagggttcaagtgattctcctgcctcagcctccccagtagctggaagtacaggcatgcgccactatgcctggctaattttttgtatttttagtagagacagggtttcaccatattggccaggctggtctcaaactcctgatctcaggtgatccacccgtcttggccttccaaagttctgggattatgggtgtgagctgtcacacctggtcccaattatattctttaagttatttaaaaatatatgattaagttattattgactatagtcaccttattgtgctatcaaatagtaggtcttatttattctatttaaaaatgtagaattaaattattattgactacagtcaccctgttgtgctatcaaataccagatattatccattctttctatttttcgtacccattagccatccctactcccccctcctccctccactaccctttccagcctctcgtaaacatccttctactctctatctccatgagtttattattttgttttattgattgattgattgagatggagtttcgctctgtcgcccagcctggagttcagtggcacgatctcagctcactgcaacctccacctcctgggttcaagagtttcttccacctcagtctcccaagtagctggaattacaggcgcacgccaacacaccaggctaatttttgtatttttagtagaaacagggtttcaccatgttgaccaggctggtcttgaactcctgacctcaagtgatctgcctgccttggcctcccaaactgctgggattacaggcctaagctaccatgcctggccaagttccttgttttacgttttagatcccacaaataagtgagaacatgcaaagtttgtctttctgtaagtggcttatttcacttaacataataacctccagttctgtccatgttgttgcaaatgacaggatattattctttctttttatggctaaatagtactccattgcgtatatataccatattttctttatccattcatctgttgatgggtccttaggttgcttccacatcttggctattgtgaataatgctgcaataaacatgggagtgcagatatctctttgatatactgatttcctttctttcgagtatatacctagcaggggaattgctggatcatacggtagctctagttgtagttttttcaggaacctccaaattgttctccatagtggttgtattaatttacattcccaccaatagtgtatgagggttcccttttctccacatccttgccatcgtttgctattacctgtcttttggataaaagcctttttttaaacttgagggagatgatatctcattgtagttttgattttcatttctgtaatgattattgatgttgagcacatttttgtatacttgtttgccatttgtatgtcttttgagaaaatctattcatatcttttgcccattttaaaataggattgttagattttttcctgttgagttgtttgggctcttttctagttgttaatcccttgtcagatggacagtttataaatattttctcccaatcttcgggttatcactttgtcgattgtttcctttgctgttcaaaatcttttttaacttgacatgatcccatttgtctatttttgctttggctgtctgtgcttgtagggtaatactcaagaaatctttgcccagtttcaatgttcaggagtttcccaaaatgttttcttgcagtagtttcatagttggagatcttagatttaagtttttaatccattttgattttatttatgtgtatggcgagagataggggtctatttttattcttctgcatatgtatatccagttttcccagcactaattattgaagagactatgtttccccaatatatgttattgacgtctttgttgaaaatgagttcactgtaggtatgtagatttgtttcttggttctctgttctgttccattggtgtatgtgtctgtttttatgccagtaccatgctgtttcagttactatacctctgtagtataatttgaagtcaggtaatgtgattcctccaggtttttttttttttttctttttgctcaggatagctttggttattctgggtcttttgtggctctatatacattttaggatttttttttctatttctgtaaagaatgtcataggtattttgatagggattgcattcaatctgtagattgcttagggtagtatagacattttaacaatattgattctaccaatccataaacatggaatatctttctattttcttgtgtcctcttcagtttctttttatcagtgttttgtagtttgcattgtagagatctttcactttttttgttaatcgctagttatttatttgtagctattgtaagtgggattactttgtaaatttctttttcagattgttcacatttggcatgtagaaatgctactgattgttgtatgttgattttgtatcctgcaaccttactgaatttgtttatcagttctgttagttttttggtggagtctttaggtttttctgaatataagatcatatgatctgcaaacgaggctcatttgactttttcttttcgaatttggatgccttttatttcctgtctgattgctctggctaggacttccggtactttgttgaataacagtgattaaagtaggcatccttgtcttgttccatatcttggcagaaaggctttctgtttttccctgttcagtaagatactagctgtgggtccattgtacatggcttttcttctatggaggtattttccttctatactcagttttttaagagtttttattatgaagtaatgttgaatttttatcatatgtatttccagcatcagttgaaatgattatatggtttttatccattattctcttgatagaacatgtcacattgatttgtgtatgttatactgtccttgcatacctgggataaattccacttggttgtgatttttttttttgatgtgttgttgaatttggtttactagtattttgttgaggatttttacatcaatgttcacctggaatattggcctctagtctagtctagtctagtcttgtctggtcttgtcttttcttttctttccttttcttttctttttcttttttttttttttttttttttatgtatgtgtttggttttggtttcagagtaataaaagcattgtggaatgaggttagaagtattccttcctcctctattcttctcaatagttggagtaggattggtattagttcttctttagatatttggtaaaacatctaaaattaagcagtgaagccattggtcctggatttttctttgctgggagacttattacatcttcagtcgcattacttgttactggtttattcaggttttggatattttcatgattcaatcttgttaggttgtacgtgtctgggaatttatccatttcttctagattttccaacatattggcatataattgctcatagtagcctctaatgatcctttgaatttctgtagtatcagtcataatgtctcctttttcatctctgattttatttgagtcttctctctttttttcttagttcagctaatgatttgtcaattttgtttatctttttaaaaaaccaacttttcattttgttaatcttttgtattcttcatttcagttttatttatttctgctttgatctttattatttatcttctactaattttgggattgggttcctcttgcttttctatttctttaagatgcattgttagattgtttatttgaagttttcctttttttttatttaggtgcttataactataaacttccctcttagtactgcttttactgtatccatatatatattttcatgttaagtttcattcacaaatatctttattctactgtgctttttctcttgtctggattttttaaaacactatttgacaattgttttaggtggtggaaaattaatttagtcagtgtagaaaacttaagtatctgtgagctgccttccttttagaggctatgcttaaaaatgcttataacagtatcaaattttccttagctttctttaatttttttctgaaataagtaagtggagatatttttgctcaagttgtcaccagttgactgatattgagataaaggtagtaaattcaatttgctaattcagaaatactggagattctttattcactgtatgataagtgtcatacaaattaactttccctggctcaggtctgtggctcaccacttgttttttgtaaataaagttgtttttttttttttttaacataactgcactcatttacatatgttctatgactgctttgacagtccaagagtagagctgagtaactgcaacagacagtggagcttttacatcctacaaggccatatggcctcttacagaaaaagcttgcagatacatgagccactgcagatacatgaattattgttgttatcagttatgtgtgtgtgttggggggcaaagggcattgagtgttttaagatcttctttctttgcatttcacctctcttcaggatcctgtatccctgactattgaagtaacattctacctaatggagttttgatcaacagtcattgtgaaatgcatctgtagagtaaatttttatttattacctgatcttaggtacatttggtaatgaggcaatcatttatattcatatttggtgatgtgtgatactcttagaaaaatccaagtagtttgagacatttttgtatcttttcttatctcatttctaggtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatggtaattttctctgtctccactgttatcttgaatcttccttccctttgtccttatttttacagatctgggataaaactaaacttgttatagtctgttcatgtaaaaagaagatcttaggcttatatgaaattcttaattattaaataatttaataaattggagccagtatagtaatggtgatctttaccatgctattttaactccctgtttcaatatataagggatatttggtatcatatttatggaatataaaacttggaactatttttataacttcagagaactgaacatcctttttacttatctcttccagaacattctatgttcaatgggacactatagtttattaagaaatattcattgttggaaagaaatagtcatgggtaatgtgtattttagatagagcagcatttgcttttttttttttttgagacggagtcttgcactgtagcctgggctggcatgcaatggcgtgatctcggctgactgcaacctctacctcccaggttcaagcaattctcctgcctcagcctcccgagcagctgggattacaggcatccgccaccacgcctggctgattttcagtatttttagtagagatggggtttcactatgttggccaggcttgtcttgaactcctgaccttgtgatccacctgccttggcctcccaaaatgctgggattacagacatgagccaccgcacccagcctgcattttattttaaaatgggattggcgggatttctgctgtgtatctcagtaatttatcttagagcaagtagctgtgtaaccatcatcccaatcaataaatggaacattattggaatctctcttttgcataccttctccataacattaaaccacaattctcatttttatggtaaccacttctttactttttagaatatttctactcctaagcaagtgtccttaaacactattgtttccattttatgtaaatggaattgtagagtatgtatattttgatatctttggcttctttaacattatatttgtgagattcagttatgttgttgcaggtaggtttagttcatttatttacagctctcatttattccattgtacttctgtttatttatcctttctactactgctgatgtacattgcatggtttcaggtttggggataatatgtatactaatttttgagtggaaattcttgatcataacgtagttgaatcttaaccttgataaataacactggagtggttgtaccgtttcattctcactagaacgacagaaaacgttgacattagatcaccttttctggagcattgcagatttcccttgatgggtgaccattttaggttttcaagattggggaatcttatatagagagattgtggttaccacagaaagtcattgttattttattaattgacctgaaattcacataacgtaatattcaccatgtaaatgtgacagtacattcatgatgttgtgccaccacaacctgtttacaaaacattttcctcactccaaaaggaaaccacatattctttaagcacttactcctcattcttctttctcctaatcccctagcaaacaccactctctgctttgtagactgttacttgtcctgtatattttatataaatataattatagaatatatgaccttttgtttctgccttctttcatttagtataatgtttttgaagttcatccacattgtagtatatattaacacttcactcctttttatgggtaaattatattccattgtaggaatgtaacgcaattgatctgttcattcactgaggtacatttgggttgtttctaccttttggttattgtgaatagtgctattatgaatatgtgtgtacgtgtatttgagtacttctatgtaattcttttgagtatgtacctatcctaatttgtttcagcttctgtactgaccacattacacattctttcgtagtatccgatgacttacacacacacacacacacacacacacacacacacacacacactctgtaggaagcttaaagatagactgaaaaaatataggtaaatgttttcctcgggacttttgtaactcaaaaaaatgggacctctttttactcctgagatcatactttatgctttggttctattatttttaatgagaatgattgttattcatgtgtatttaatttaactagtgacccatgatatttaaggttgaaagtttttagaatcagctctagatgcaaaaggtcattgggagctaaacattgagtatacatggacataaagatgggaatagtagacactggggactcctggagggaggacagtgggagggggtgagggttgaaaaactacctgttgggtactacgctcactacgtgtgacaggatcatttgtacaccaaacctcagggacatgcagtttacccatgtaacaaacttgcacatgtgcccccgaacataaaataaaaattgaaaaacaatgcttatatttcaaaaaagtatatagaatttttataaaataaaatttagaaagctatgagatattgatattttcagctatttgctagacattttatttcagacttagttacattttttggtgttagtgttaaaattgtgttttctatgtagatgtgtagtataggttctttgggggcttttctttttgtgtcaaatgtttttcataacataaaattttagcaaaatcttttggcaaagagattcactgtacacatggagcagctaggtcaataagagaaaccacagatgtattagtaaattaagaaggctttgtgatccctacatttatatgtctttggaagatatttccttgagcttcttttttgttcttattcttgcttctttatacagcaaaccacataagaggtttttgtgttaagattcaagcataatgtgcacaaaagattgtgggcattcctaccctcatagatcttgtattccacgggaaaagacagatattaaatgactgtgaacaaatacctttcaatatacttttgttgaaggttgcaaagtgccagtcaatgaaggatttcatcatttgtgaaaggacagtagttaaagagcaatactactagatttccaagtcaaaatatattgttttctctcagctttattgctttcatgtctctctgcatgtttttttcagaaatctcaaagaggagaatccacactgttcgactatgctgctgtacttaagattttcttttgaaagcaaggaatttcaggcagcctattcctcctgatagataacacgtgttaaaattttatttccagaatttccgtctattactctgtgtagtttttctcatttttgaagcatggactttagagtgatggtcatttttcttcatgtttttttgtatcttacatgtcataacaaaatgggcattgttggttagttctaaaaatgatgtatttacagtttgtgtgggtaaacagtctgatgctggtcaaaaacaatgtaaaccattgaacagggagggattcatcttgaaaatgaatcatgttttggcggtattaccgttgtttgtctgtgctctttttagccaagtaaaggaaactgttaaataacagttgatataggggtatttcctttttactctttggacccaatccagtttaggttaggattattttatctatttgccaatttttttaactttccagaggatgtttatttatttgaaatatattctttataaatatctcttccatttcctatcttgttgcctgaacatccacttagtctacttgaggacttcttgtgatccatgaacaggataggaaaaaaatttacatctttatattcactatcctttaaccaaaagtaagcatttcctttttgttatgaacatggaaaatacatgacaaaaacattaacagtgcttgtgacactgttaccaatagaaaatgcagaattactcatatcactttatatatgaaatatatatcttgaagtatcttgcattattgaatatattttaaaatattgtttttactcatcactactttgaaattatgattatataatattttagtattaattgattatatacattactataacactttatttttaatatattgataactgtacttcagtatagttcattttctttgtaattatatgtctttttcccatggcttgtaagtattattctgggaaacattcctcaggcttccccagactgtccaaatagtctgtgatacaaaaatggttaagaatccctgatcatcattttttccctcatctatatcagtaatttctaacaattttttactatcacaagcacttccttgtggaatgttagctataaatatgatctgccaattttctgcttaagatctttgtgtctcaccatattcctagaaggttagaaaatgtcctatcttatttccagcttcttgtctaaccatacctagatttctgtacccttccctgaatatgccacatgtatttattttttgataactttcctatttgcaacttttctttatttgacattattattgcctctttgaatgcctactaagcaagctaaaatattactgcctctcttaagccttcttttgatttttatcatctttttcaaccttggtattggtatgctctgcatacttttatcatattataatatgcaggttattcattgacatgtctgggcttcctattagattgacttctgtgagcacaaagtctttttggtgtttctatttgtatcttggcagttgacatagattctaaggccttttttatttttttgagacggggtctcgctctgtcacccaggctggagtgcagtggcgccatctcggctcactgcaagctccgcctcctgggttcaagcgattctcctgcttcagcctcctgagtagctgggattacaggtgcgtgccaccatgcccagctaattctattctattcttttcttttcttttagacggagtcttgctctgtctcccaggctagagtgcagtggtgcaatcttggcttgctgcaacctccacctcccgggttcaagtgattcttctgcttcagcctcccaagtagctgggattacaggtgcccgccaccatgcctggctaatttttgtatatttagtggagacaaggtttcactctgttggccaggctggtcttgaactcctgacctcaccgtgagtgagtgatctgcccaccgtggcctcccaaagtgctgggattacagacatgagccaccgcgcccagccgaatttttgtattttaagtagagactgggtttcacaatgttggccaggctggtctcaaactcctgacctcaagtgatccacctgcctcagcctcccaaggtgctgggattacaagcgtgaaccaccgcgcccgaccagtttctaaggctttaaaccagagttttaaaacatctttagaagttgttctaagaaaaacaatttagatttaaataattacttgttagaatgaagagctttttattcatagtaacaacttaaaaaaacatctccaaggtgtagtcatttgatcaacaacattaattagtgtttattgtgtccaggcactgttctgagtttaggaatttagcagtgaacaaaagagaaacatgtctgtgttcccatggagccacagagaaaaatgagggaaggggaatagggaatgcctagggaggattgcaatttgaaattagtatgcttcccataggccttgctgagatgatgacatctgagcaaagatctggtggaagtaagagagaaattcatatagaacagcctgtgtaaaatcctgaggtgggagtgtgcctggcatgttcaaggaatgataaagagaccagtgtggctgaagcacatggtgtaaggtgtataataggtgatgagatcggagaggtaatgagggcagatgattgttagcctttcactcagcatgagatggaggggggctctggagggcattgagaataagagtgacatgataatactgtgttttggcaggactagaatggagatctgtattgagaacacagtctgtacgtggacatgggtggaaacttagttgagaccagttaggagagtattgcaaaaaatcaggcaagaaaagatgaggtttggagtaagttgtttatagtgaagactgtgagaagtcattggattcttgatatattttttatggtatggcgatcagaatttctggtacattttatgtcaagtatgaaagaagagatgagtcaagatgactagtaagacttttaacctaaacatctagaaggatagggttggtgtcaattgaaatgaagaatgttgtggataaagcaggttttgggatggggacaggatcaggaattttggacatgttaagtttaatatgatgtctttttgacctcctactgatggtaagtaggtagttggttacatgagtctggagttcagtggaaagcagtcatttatgtagggataaatgtttgcaatgcatagatggtagctgaaacaaaaatgagatgagatcaccttgtaggtaagtgagtataaaaaagagatgtcccaggactgagccctggggccctctgacattaagtagccagtgacatacaaagcaaaactatatatgagaaatcctagaggccaagtgaattaattcttttagagagaagggaatgattaatgtgttaaattctactgacagatcaatgaagaactgagaaaaataagactattaaaattagtaatgtagaagtgtgatccccaacctttttggcaccaaggaccggttttgtggaagacagtttttccatgggccagtgtggggaggggtgggaggttttgggattaaacggttccatctgagatcaccgggcatgaattagattctcataaggagtgtgcaacctagatctttgcatgtgtagttcacaacagggtctgtgctctgatgagaatctaatgctgctgctgatctgacaggaggtgagctcaggtggtaatgccagcttgacagccacttacctcctgctctgcagcctggtttcgtacaggccacagaccggtaccagtccaccacctgggagttgggaaccccttgtgtaaaagacatatgtctttgataagaatacttttggtggcatggtaagttcctggtcccagtggattttagtaagaataggaaaagacagtgtcgacaagtctttcagggaggattgatgtaaggggaagcaggaacatttagaggagacagaggatgttgcttcttttatcataaggaaatgggtagtgaggatgggtgcaggtattggagctttgaggagaaaggcaaaggtaagaaatagtcctctaggagaataggcattcctttcaccagttagtaaatttttgttgaatgaataaagcatatcttccaccgttatttgtgccctaagtaaatttaattacatatctttgctttccagcttcaataccatgtttctacacctaagttactttctccctacttcttcaggtacacattcaaccccatctttaaaggccagcttgtgatgtactttctctctctaaaaatagtgttgaatttcatatatttgctccttctgtaaaccctttatctgtactgattgttttccactttctgcctattattattggtttttaaattttagattaagagtgtacatgtgcagattcgttacatgggtatattgcatgatgctgaggttggacttccattgattccgtcacccacatagtgaacatagtacccaactggtggtttttcaacctccccacccttttcctccccacttttgaatccctaatgtctattgttcccatctttgtgtctgtatacacccaatgtttagctcccacttataagtgaaaacatgacatatttggttttctgtttctgtgttaatttacttaggataacgacctccagcagcacctatgttgctgcaaaggacacgattttattctttttttatggctgcatagtattccgtcgtacatatgtagcacatttaaacaatctaatccaccattgataggcactttggttgattgcatgtctttgctattgtgaatagaactgcgatgaacatataagtgcatgtgttttttttgtaagaatgatttattttcttttgggcatatacccagtagtgggatttctgtgtcagatggtaattctatttttagttctttatggaatctccaaattgctttccacagggactgaactagtttccatttccaccaacagtgcataagtattctattttctctgcagcctcaccaacatctgttgttttttgactttttactaatagccattctgactggtgtgagatggtaccttattgtagcatctgtctgatgattagtgataagcatttttatatgtgtattggccattgtatgtcttcttttgagaagtgtctgttcatgtctaaatgacccttttaatggggtcatttgttttttgcttgctgatttaaacttcttatagatttgggatattagtcctttgttcagatacatagtttgtagtatttttttcccattctgtagattgtctgtttactctgttgatagtcagaagctctttagtttaattaggtcccagttgtcaattttttttgttgcatttgcttttgagggcttagtcataaattctttgctcaagccagtgtccagaagagtttttcctgggttttcttctagaatttttatagtttcaggtcttacatttaagtctctaatccatcttgagttaatttttgtatgtggtgagtaggtaggagcctagcttaattcttctgtgtgtatatagttagccagtttctccacatcatttattgaatagttatatcctttccccattgtttatttttgtcgactttgtcgaagaatatcaggtggttgtaggagtgcagctttatttcagagttctctgttcttttccattggtctatgtgtcttatttttgcaccaatactatcctgtttttgttaccatagccttgtagtacagtttgaaatgtgatgtctcaggtcaggcgcggtggctcacgcctgtaatcccagcactttgggagatgaaggcggatggatcatgaggtcagaagttcgagaccagcctggccaacgtggtgaaaccccgtctctactaaagagacaaaaaaaattagctgggtgtggtggtgtgcacctgtaatcccagctactcaggaggctgaggcaggagaatcacctgaacccgcgagctgaatgttgcagtgagctgaatgttgcagtgagccattgcactccagcctgggcgacagggtgagactgtgtctcaaaaaaaaaaaaaaaaaagaaaaagaaaaagaaatgtgatgtcttaggctttgttcttttggcttaggattgctttggctatttgggctcttttttgattccacatgaattttagaatagttttttctaattctgtgaaaagatgacattagtaatttggtaggaatagtattgaatctttagattactttgggtgataatggacattttaacaatattgattcttccaatccatgggcatggaatgcttttccatttgctggtgtcatgtgtgatttctttcagcagtgttttgtagttgtccttgtagaggtctttcaccttcttgcttagacgtatttctaggtattttatggatttttttgtggcttttcttaaagggattgcgttctttatttggttttcagcttgaatattattgttgtctagaaatgctactgatttttgtatcctgaaactttactgaagtaatttatcaggttaaggagtctttagagttttctaggtatagaatcatattgttggtaaagagagataatttgactttctcttttcccatttaatgccttttatttatttctgttacctaatcacttcagctatgacttatagtagtactatgttgaataggagtggtgagagtagacatctttgtcttgttccagttcttgaggaggaatacttccagcttctgcccattcagtatgatgttggctatgagtttgttgtagatgactcttactattttgagtctacttttatttttgatgctactgattactaagttaaaactttcttggtgaggaaattggaggacctggaatcagacttcctggtggtagaatctatcttccatgatttcctaactctgtaatcttagacaaattatttattctatctgtacctcacttttctttctgtaaaattggaataataatattaccaatcttatagagtaactatgagaatcagagccctttaaatagtgtttggcacatatcaaatattcagtagaggattactgtagtttctatcattagtatcattattgatactgctgttaatgtgagagtctatagaactgattcatttttcgtattttggtacagtacctgttatccagaaaacagaataaatgagtaattcactaaataatgagtaaattaaatataataattgtgaacttattctttaaaggcttttagaacaatactaggctcaatgttgataagctcagttgctacattgctacaccaatgcaaaaccaaaagtgatggtagtattatcattttaattggtttttgctcattttaattgtatacatcaggaaatatggttttataaatcagtacacctattcttgagcctttgccatttcttaattttgcaaattagttttccattttaggttcaaaaatatagagttcactgtgtcatgggacttagaaggaatttgttttcttcctgcaatttccattgagttaacaaacagatcttggattcacttctgcagttctctagagttcctgcaagtgtctcctttcctattaacttgttcgtcctcagaggggtcatctttgagtcacagcttttggcatctgaattctagattctgctttttctaaatggaagtagttgatgagactcggagacctttgtacaaagcctctcatttcttggacttggagcctccatatttcagtaaagtgcttttacaaaactggaagtatcacttttctttttagcatctgtatgaggcattccttttaccactcaaagactctgtttatagctttcatttgatggtttattgtaattttaacttacgttgatcagtagttttcttgatacagaccacatcacaattgtaaatacaaagcaaccacacatttcagccttatatagtttcacctacttaagagaatcaatgataatgtgatgtttcttgacttttctttccacatcactgtttacttgtggattgaagtttccatgtgcatgttttaatttttgccaagaaaaatcaatcaagtgcactgtagctctgctttagattttatgcctcatatgacatagagtatataaatagtataaacatgttaaatggagaaaaatcttgtggggggatatcttagtttagtacctggatttttattgattatgtgtactttattgttttagctcaaatgcagttttgtttttcatttgttattttcagatttaaagttttcctggtgaatttgttttctcaaattcttttatcaccttttttaaaaaaaaatgttgctatagcactctgctagttttaacatttactattttctcaagacagagcagatgagtttgttagggaaagtggatagaaaagagtgacctcataataccttcctgaaaacaagatgctttcatttcagaatcattaatggaagaagctattaaatgaagattgtacagttgttgtttttaaataggtttttaaagagaagttttaggttctcagtaaaattgagagaaaggtatagataacgtagttttggggggaaataaaattgccagtgggatatattttaaaggaaacctgatattatattgcctctaaattatactttaaaatttagtgctatgaaaattaatttaaaaatattttaaacctaaataaactctatgtagatattttatatttttgtgtatttcattttggatataacacatttcttttctctgtaagttttgcctttaaataaatgccagatgatgtagttatcccttgaaactaatccagaatttcttctttgctttttactgcttgtggaaatattttttcttttctatgtattttttacatgggcaaatcataaactccagatttcaaaatagttttatttttaaatggttaatgagacatgcctctagagggcaatattttctcattgtaatcaaggcaaccctggcatgaacctgaggtactagggatgttaatgtcttatcagatcttaaatagcctttcttcctttttattatgttttctgtgatttattcttcaacgtcttcttagagaattcaactttggaaatatattactatcaattaatatcctttctgagtactacatgcagatccagttcctctgagtgaataccattgaatgaatagaggcaaattttttagttatatcatttgagtatgtggggtcattatgctaaatgtttttttattctctatgtgttgctattcagggacttgttatctgtatactttataatatcagagtgattaaacttcatttttgaggcattgaggcattataagggctaatagttatctactcttttctattaacattgattggacacttactgttgttgtttaccctttaaatataatttttattttttatcaaagaaatacatgcatttattataaaagtcaaaaatataattttatagtgaaaggaggcactttttggcctatcctccccactctcgggtgtcattccccagaggcctcttcttttaactcttctgtttttttctcagttggttttttttgggccctttcctggaaatcctattacttgaataatgtatcttctacattgagcccctaatcttcttgtctattttctatcttttttttaactttatgagaatttccccaacgtatgtttcagtcttcttgttgcatttttatttctgcaatctttttaatatgattttctttgaattttttttattatcacacccttttcttattttatgtgtaatatttttctctctttaagagatcgttataaattttgaagcttttttgtgctccttttattatgccctcccctcccctcccctcccctcccctccccttcccttcccttctttttctttccttttttttctttcctttcttgtctccctttctttgcctttttaaatcgagacaaggttttgccattttgcacaatctggtctcgatctcctggtctcaagcaatctgcctgcctcagcctcccaaaatgctggggattacaggtgtgagccaccaagcccatctggagcagtgattttcaacccttgactgtccattatacttaagctagatagatttgaaaaatactgaggcctagactccatcagactgattgaaccaaaacactgacctcagtgatggggaatccttgatggatcattggctgattatttttatttttacattctattatttaataattcatttttattttattcatttttattcagctaatcaacaaatcaatactaaggaactgattggaagctttttgaatgtgggaagggcataccgccttataggtatcagtggtctatcaggtaggaatgccattttattatcatacctcaaatagtcactatccgtaggtcttttcatgtacgctggtcagttttcccacaaagaaattcttctatcctctgttcagggtggggttggggtaataaagagtttctggcaataaacttagaagttagttttcaaggagttgaaggagttaacattatttttgtctagtgattagaataacaaaaagaggatttggagaacctgtttgcatttgattattgtcttacttccctagttaggaggacagttaagtaagaaattctggtctggttccactgaaataaaaatatttctatggaaatctggagatggaatttttagttgctgaagtgaatgaatgtaaaaactacttattcagataaagaagtgcaaatgggtagaacaacaaattttgggaaaagaagtgaatgttcatttccttatgtacttatcaaaaggaagatctgaaatgttttttttttttaatttggagaaaaattggagagggagaagagagtgagtaggcttcttaggatttgtagtagccagagtttgaatgattgacccatatgaacagatttagaaattatcagacttgagaataacagacatgaatagtcttgaggttgaaatctgagcaggaactagaaatctgctagttgatagttgtaaactacaaaaggacaacaagacagggatcagggctataccaggattatgcacagaagtagaaattttgatggttcttaccatgatgaggtaaatgatattttgaatttggaggaggatgagaaaaggaaaaggatttaaggttcattgaaagagttattaacattggatgatgtgtttttgcaggtgagaatattgaagctagaatgaggcacaagagggaaattactatttcagaatggaccaaggtggaattaacatgggcactgttgttgttggcttcagaagaaatagagcattccattttctgtgttaagagccatctctagtaaggaatgcttaattaatgttcaataatatttcactctggtctagttttggagcagattgaaatgtgtctatatttgataaaaccatagatgagggaaaaaataccatgacagtactcataaatgaatatagttttccggcagtgctccagctgattaggaaagtgtttcggcttgacagggaattacagggaaagaagagtcattatttctcaactggggatggtcgtggtatcactcctctttgtggttcttactgtcaaggatcttttgtaaaagtaggttttacgtacgtaggtaaagtcataggcatacttttggaaaagtaaatttagaagagaagggcttgaactattagtattcgtgtggtgtgcttagtttgatttttttctttttctttttttttggtaaactgttccacaaattgttgataatttaggcagctaaatggagtattggtttcctgttttcatcttgaggaaaatatgtaagcatattttgatagatatttaaatgttttaaaactggaaataaagtatatgtgaatagaaaaggttttatctgccctgttgtcaaaaatgctgatttggccctttcgtactgtactcccatctttgtatggttgttacaatctgttgctctttcccatctgaaggaaatgcatctttgacacttctcatgacctgcgtcatgatgctgaaatagagccagaaaatatccttaacagtcatgggtaaaaagaaggaaggcgtccgtgggttggggcgggagaataggggactgtgaggagaagagagtctttgctctttcagtttacatcattttgatttttaggaaagttacttacattttgtggctatactttttttttttttaggaaaaaatttcttttttttcttttttttttcttttattattatactttaagttttagggtacatgtgcacattgtgcaggttagttacatatgtatacatgtgccatgctggtgggctgcacccactaacttgtcatctagcattaggtatatctcccagtgctatccctcccccttccccccactccaccacagtccccagagtgtgatgttccctttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcatttttcatggctgcatagtattccatggtgtatatgtgttgtggctatactttttattcaagagaaaatgcttcgattttatattaaattgttccttaagtatacattctttaatgtataggtatacaaagtacataaagataagttctgcaaatgtaaaattaaatagttttgagttctccagatctaagaaaatacactttaaatcttgcagttaattctatatttcatcttcctacaaagtgtttatctcagaaccaacttctgatacttctacatcttgtatgtttagcagtttaagtaataaagtcacatttgttgaaacaagaagataggattctatattttttccatctacagtaaagcatttctatttactctgttgatatacaaaattcattgtgaggtaaagatgggagagttgagtatagggtattttcaagaaataatttaatgaggacttatactttggggagcacatttcacctcagacttgttctaagggatgttagattatggagccttaattcagggatttttcattaggctaaaactccacttttgagcacttagtgtcagtactatatttgaacttgattcagaggagtgggaaattttgagggtgctttaatatgatacatttagaaataggttgaggcttaaggtcaaagatctttttaaaaaatttttatttatacgtatgaagaatttactttcttccctcttgtgttaaatatagtctttttactgttatatttgatttttcattgttgaaggagtgtcaaactacaatcctaatacgtaaaatgaattaaaaattgctaaaccttcttaaattttaagagcaccaactcttaataaactttcttcattccaaaatcttggagtgctctaagaataataagtaatgaacttaccactttgagggaggagattttgttcatttaacttacaagtttgggttgactctgtgattgaaacttaattgcatgaaacttttcagacagattttttatatttcagtagaattcctcacagctagttctattatttttccctttgtgttcttgcattttataaacattgtttctaactgttgatttcatctccttttctagggaatttttgcctcctaagttttcaatattccttgttctaggcccaccttgttaccttttggagttgtgtcaactatacttgctgtacttagaattttagcaacaggaattatttctttatgacttttaatttttaggcatcaaatttctaaatttattgggtttattttagctttaagaaaagaaaaatacttaaatttgtatgttgtagtagccaacacattcagataataattaacagatgataatggattcacaatagaaaaggaaaactacctagcaaattatttattggagtattcgtacataaatatatacagtttcaattctcctgaaagtacacttttaattctagtgacatttaataagccctaggcaaagctccatgcaggctactttgtatgtagtggggagaagtgatgacactatcattaataatctcaatccccatcctgtttaaaaaaaaaaaagaaagattggattcttgttttcaagtccattttgtgggagatttctctaatcttcctaccttctcaccctttctcaaagtacctacagtaatgtctatggtgacgtgaactttttactcaaagaaagcaacaagtgtttttgcttgaaatgcatcaaaaattgcagtgtttttacttcaccatcgattgcctccaaaaaaaagttataggcaaaatgaatcagtgcccacacaggattgtccttcagtattttctgtctttatttgtcacccaaactgtttgttgtgtttatagtctttaaaaatgtgtgtctgtgtgtcgacacacacacacacacacacacataaaattcattttcttttagtgtgtgttctactctccttggctcctgtgaacaagcattgcttccgcccagtttggtatgtgggtcagaaggcactgtttctcaccagggtgctgctgtttccttttccgacttgagtagattgcagattatactggaacatgcctgagaaaaggtcataaaggagggtgaaagtcctggaactgcagctgggaagcttgacattctcatctaggaaaggggagaagagagagatggagagagagacacacactcccatcccaaccaaaaataacccacctgcaggaaattcccttctacacagggtattttttgttaaataactattgagagtttggttgaaaaaactttaatgttaaattggatggcaagcaagaactaagcagtgtttttaacttttcagagcccacatttccagtgactatttcaaaacaagctaccattgtattctttgacagagtcaagaagtcagagcttttcaactacagaattaacttagttaaactccttggtatattttagatttttatccctgtcaattccacagcaagatattaaaaacagtccaaaagctttgctcttctgtagaagacaaaagtttaccaaaaaataaaaaataaaaaaataaaaaaaaaggccccgtagaactcatcatctagtttttatttttgaaagatatgatatagggaatagaacatctacatgatgtcttagaataggtaaagtgttgcaaagagggcaaaaataaaggagatatttgggactggggctgtttccgtagaattgtcttctgaggagtgccagagagtcacattgacctcgggcttcagtgtggctcagtaatccgatttcaaaatgcaagagttccaaataggagaccaaagacactaggtgaggagcttatatcctagaacaatagtgggtgttgtagataagtgtatggagaggtgatgagaacagaatttaatacagtcgtaggagtctagagtactgagttataggaaggtgtctattgtaaaccttcagaaaagtggagtgcctaaagtggataaggtctgtgtctgtggtaagaataagtgggatgatatgtggacctcctaataacactgctctttcacagggcaccattgcttagtgtcctttagctctttttgcaaatgaagctttgccgtttctatacttatctctaatactctaatactatacttacctcatatgtctaatgacaacagaaggacagtgctctttttatcctccaaatgtttcacttgacccactttattccattgtaggtcttagtttctcataccttctgttcctaaagaatctttctttgtcctccattaacaataacttttagaaacctgtaacaaaaatttctctctctctctggtatgacactcctttaaggtactttctgatctacaactattgtcatttgattccttaatgttattttaactgattttatgtcctttggttcacaatatggtaagatatggaaattttttaaaggtagaaaggatgcaaatacattcattttttattttccctcttcttgtttgtatctcggaagaaagacaactatacatatgtacacacagatacactgatagtaactttaatatttaacataatctgaaatgttcaacaatttcagttttgctagcttcagagagttcttgcagttggcagtttgccacattcacatgttctcacatcactgcattcagaagctaagaataccaacctggcagcttctgcacagagggtaaagataaaacagaagggagtctaactttgcagccacattacctgggagttgctgctgatgtcttttccacaaatgtccaagtttgtcaaagcccagtaaatcttagaaagtttattttccttgtagcatctgtgttttataatgggtcttttaatttgtttttactttgtctgcagggatttcttttgtccggagttttcagactctgtcttttttttttttttttttttcctgtggaagtgagtctgttaatgatgactggtttgggaatatgcctctctgcaaagctgacctgacaagctattcctccagcgtggcaacaaagcccattgttattttctctgttcacttttatcctcaacttaatccatttttcttctgtgtttttatagtatagaatgtctgggaaaacataatttaggacaaagcataagtaagatggtattttgaagttagcaaaacttttagtaaacagatcacaccatgtcattctcatatatgcagacagtggaactatgtgttagtatggagattgagagtttgtgtcccccaaagtacacgtacctgtagatatcctttatccaaaaggtaacaggaaaaaaagagcacaagaagttgttttcataattcctttttttttttaaattgcaaacttttagaagataaacatagaaagtcagtggttgaacccgaaagtgaatggttctggtgtaatggctttgtattgtaatattaaaaacaataatagcagtaaacaaaaaactgaaagcagaacaaaaacaagacatcatagctttaaacatcaagggatgttttaaaaattctgatttttaaataattttgtatccccaaatagaattcctgctttaacttattgagaaaccattttattggaactcgggatttctttcccccaagagaactccatctatcgtggggactggtaaacctctaaaggatcaaagctctagtggatttggataaagacccaaaagcctgaggcttatgcaagtttatctatatagagtaagcccaaaaaactgggatgagagtcttagatgagcttattttctcatgagatttttgggacttcctctgtctgcttgtgccagaaatactgtgagaatattcattctcatggcatttgtcacttacaggtctcctcttagctggaatttgaaagtataatagtgtgtgaaatattttatgtatctcaagacttcatgcagtccactaccaaaactgcacttaaataacctctgttctttttcattgtactcatgcaataaaggaaaaaatagaagagtatagtaaagaaaggttagtgaaggtgataccttgtaactctcttcatagatctcagaaatattatttgtatcttatgtatttctgagaggtgaagcaaagaaaaagaatagcaatagacttcatctaggtccaaggcagacactgcaggtttcttcctgctgaacttccttatacgaagaggcttgaggtttaatgaagaattctggcttgaaaatttaggcttgatataaccacatggaaatgtctaaagatctatttttaaagttatcaagtctaaccttctaggccagtgaacgtgagactaagcagaatagtgaaagccgcagactccagtcatctggcaaccttctgaagtactgagtcccctccagaattattttttctatagatcatagggccgtatttttctctacctcctggacatggaaataaatatatttccttcattcattcagcaaacatttattgagctgttagctattaatgactagtaagacactatcctcaggagtataggcagcctggtggagtctccagtattgtggaggacaaatctggaggtttgttagattctagctgaattttcaaagaaaatccaagacagtgtaaatagtgtaaaatcatttataaccaaagattttaacaataggtcctggaagaaaggattgttaggctgtcttgtgtagttattgcatttatttatttaatgtgtattatttacatgtctgtgtcagctattgagatttctggtctaagctagctctttcattttactaacttctgatgttatttatacatttctcctgctttattttctactagaaaagcaaaataaaaagatagagattccttcctttatgctcaaaatttgtataccttttctccctttttaagttgtcctttaaaacaataataaaagtgactccttactttttgttcctgagtcatttttcagatgtatttattagcatggttttctcccatttttcattttttgttaatatgtctttctgtaacattacattatgaactctttgaaagtcccttggacttactccttcagaatctagaacagggcctgataccaataagcctccaaaagtgtgaagtgacagagcaaagattgagtggaacttttgcttggcgcagtatgcatctttgttaatgtcttctttttcagtgtcagtctttaaatctttgttctctgttaccttgattttatcctatcagcagttcctttgcttatggcttacaatctgacttttccacctcactgctgaaactaccctactgaagactattagagttagctttttctctgagtttgtcttcttagatcttggccttattgagcattttattaatatactcattgtttcattaaaactgtgtttataagttgctagccatatccattaatatgtaagacagacaccacccctacgaacataaacatgaatgtaaaacctacacaacttactttgctctctcagatgtgctggtttcaaatggactctacagcataaacacaggagcaggctgagaaggatagatctgaagttctttgtatgctattctgaggttgtcctttatcctggtgagacagtgaagcattttaagttgtgcctagctaaaccacagatttggaacttctcagtgaatcacttcattttcctagaccactccttttatctgtcaaattcaatgacttcaacatctatactgttccctcgctgaagaacttaacctaagttcctactcctctggctcaattgagaggtcctcctaaaactgaaatattttatctgccatagttagagattcctcactactcctcacataatggcatccctttataccactctcccctcacgttatccttcatgcccagaatattccttctctcctacccttatccatattttgtccaattttcaaaatctagatcatatcccatttgcccttttccttgagcccttttccatataaagttgttcccacgtctgcttatctttggttcttggcaattagcacttaatgattcctgtttgtgcctgttagactgtaagcttcatgataacaaggaaaacagtcccttacagtgttatcttaagctaaggcactcaacaaatatttgtttactagttgtgaaatacatatgatgtacacaattcttaattttcaccagcttgtgacagaaagttgcagtctgatttcaaattcaagttaatattagcatagttgtctaatagcgattttataattatttacatctatattggccttgagagtgtgataataaattacttcgaatggcttaactatgaagcagtttttctcatttcttccacaaatataatattttaatgtgatttccctcttcatattttctacaaggttctgtgttgtggcctaaatcatcttgtgtgtattgtgaattctgtcttttgttattcctgcaacaggtgtagatggcttctgttaactttaatgtgtattctgaattggaaattgaggagatagagaacgatttattttatttgcatgaatttcttatctttccccatattttacaaaagagacatttatcaaaggttaacttgatagttctatagagtaatataaaaggatagatttgtgtccaaggaagaagtaacatttggttaagccactatcctaattctgaagccactgtcatcttgttacgattttttagaaaggcacttttgacttttcactacctctcaggctaccattagatactgtgtggtagttctccctctatcctgaatccatgctatttttaaagcaaatgtcttttaggatgtgttttagaaataagatattaattaggactttcgggggggatgcttttgctgtgtacataaattggtcaacttaattcgaattagtaaaaaaaatttatatgtgtgtttactgtggttatttaaaaaataccttatctattgctaaccacataaatggggttgataatttttatcgacagtcaagaacagtgatataaaattaacattaagtcaataagaagttttttgcatgaaagagttgttggattacaggcactggcttattccgtaacacagaaaatgaggtaatttttatagtttctctgtaaacccatcaattaataagactcactagaaaactacagtaattgagaaaatgtggtattggtgaaaggctacacacatagatcaatggaacacatggatcaatgcaggaatagaaccacatgtatatggtcagttggtttttgacaaacatggaaaggcaattaaaggagaaaggataatctttttagcaaatggtgatggaacaattacacttctatattaaaaaaatgaatacaatgaacctcagctctcactacatacacaaaaatgaactaaaaataaatcacagtttgcttttcccctgtcaaatcaacattgcactggaagttctaggtaggtcagtgaggaggaaaaaaaaaaagggcatctagactggaaaggcagaagtaaaactatctgttttttgaggatgacataattatgtatgtagaaaatccttaggaatccagaagacattattagaactaagaaaggagctcagcaaagttgtaggatacaagatcaatgtacaaaagttacctgtatttctatacattaacaatgaataatctgaaaaatgaaattaagaaaacaattccattttcaaattgcatgaaaaagaatgaaataattagtagtaagttaaccaaagaagtacaaaacttgtaccctgaaaactacaaaacaacattgaaagaaatttaagaatacctaggtaaatggaaaggcatcctaagttcttggattaaaaggtatattattgttaaaatggcagtattccacaaattgatctccagattaaatgtaatccctatcaaaaactcagctggcttttgtttagaaattgacaaggtatgggggaactagcagattgtgttggatgtaaggacctaagcagggcaacaaaccactttaactgtctttagaaagattaggaattcagccctaattcccaaagactgaaatatgttaataattaagtcacacttggtgttaccagaatacttcttttttgtttgtttgtttagagacagggtctctctaatgccacctgggcttggagtgcaggggtgctatcatagctcactgtaaccttgaatttctggactcaagtaatcctcttgtctcagtctttagtagctaggatgacaagcgtgtaccacaatactcagctaatttttgatattttttgtagagatggggtctcactctgttgcccaggctggcctcaaactcctggcctcctgccttggcctcccaaggtgctgggattacagtcatgagctatccagctctccaagaatagtttggtttcttctcatccacataattgtaattctcttggcatcaattctacctttgatgcctttcttaaatgattactggagtcagtgaaaaccctatcggagatagagaacgggagatagagaaccttcctcagtgatgcttttctttatttttctctttgtagggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccgggtaaggccttagacttgatgcttttttaacagctgttttatagggttgaatgaataaaaataaaacatactttttctttgtgtggtttttattatgttcttcatttccagctcaaataagacttaatggcatcagattaagtacaaagcatagaacttgcacaagcatacttgcacacaaccatgtatacacacattcatcgagaaaaacaaaacagtgacaagctgtgaaaactagtattggctaatcaaaaacagatccatctacttcgtcttatgcttactgccttgtggctttgcctgcaagtacagtttcattttcctggctctttcgggatttgaaatgactcccaaattttgacagatacaaatatggagagaaccttagatgacaaccatctttttagtactttgaaaaaatcatctatattgagatataatttacatataataatctgtcattagtgtcaggacaatgtgatgtcattggtagttttcaaagccagtgcactaagatttgggctttatttaagattggtcattaacttccttaaagacttttgattactcacttgatttatttgtgcttattttagcaatttgctaccccttaggaatataagattatcacttcaataggttcctgaaaataaactgctaggtctatgatatcattagatattcaattgtatattaacactggaaatccattttatatcagaaaatatatgtctataggcaaattatttgttttccataatgagcaatcctgaagtttaatctaatttgaaatgaaacaacttttttacatttctgtattaaagtagtcaagagaaaaccctgtctggcctcaaacagtcctcaagttctttccaatgaaaggaatatattatttggctgctacgtcaatatatcttaattttgttgtgctcagtattaatgtgcttacagaggtcacttttgtgagaagaaatactcagtagtctcagggacaaggcctttgagctccaggtatcaccacaacatagaaattgactctgtagctaggtggagtggtgtttgtatataaaaagatcctgttgctgcatgcagacataaaattgagtctgtggcatttgctgtgtttttcagcaaaacttcatcccaaatcagacatcttaaggcaccaataatttggtctgtatatctttttaatttttttcagctttttaactccttgggcccaggaaaagtataattttaaattggatttcaactttctcttcctctgttagtttattttaaaataatttaagaataatggctgtgaataatgaagaggttatgtcctttatattcacaattaggttattttttcattgtatattacattcctgggatgtagaatcaaaaatgggactaaatctggaatcataactttaaagtttcttttttacttactgaagttagtcagtacataattgtatcatcttgattcactccagcattgtacaattctccaaagtacttacaaattttagcctgtcttttctgaatctaagtgaaaccatcctcaaaattgtttctctgtaatttaattttatattcagagtgagggaaatttaagaaggttcaaaaggctcctggagtcataaaagcatattctggtgctttgtttctggtgcgtgtttatttaattttaacataagagctgtcctgttttataatgcaaagaattagctctctttttctaatgagcttctccaaatatatctctgaaatagtaactgaagtttagtgcataaaatgatatgatgttagaatttaattcataatatttatggtgaggggtaggaagtgagtctgcttttttatgtagtatttgaaattttccataagaagataaaatctcttgctttctttctctctctctccctcttacaacccgatttctctctacactgagatgaatagaaactgttagtcatttggtgtcctcctgtgttactacacattatgaatttagataaaattcttatgtttccttttcttacaaaaatttgctctctgttctcagatttttggagcatgtattctgttgcgttatgaacaatttattaataagggaactgttatcaatttgagttgttttatgtgctttgaaacaaatgttagttaagatacttgtatcatattgtttactaggctttgtatctcaatttataccattttatttctgccatagtttcgaattcttttttagcaagccttgtattgaagtgtttagagagaataattgatacttgtcccacaatgagtactaggttttaatttatttgtgacatagtttcagacttacagaaatgtttcaagactagccaaaggaattcttgtctacccaaattccccagtttttttttttttttttttttttttttttgagacgtagtcttgctctgtctcccaggctggagtgcaatggtgcgatctcagctcactgcagcctctgcctccctggttcaagtgattctcctgcttcagcctccctagtagctgggattacaggtgtgtgccaccacacccagctaatttttgtatttttagtacagacagggtttcgccatgttggctaggctggtcttgaattcctgacctcaagtgatccacctgcctcggcctcccaaagtgctgggattacaggcatgagccaccacgcccggccccaaatgttaatagatcaacttatttgctttatcattcatattctctccctctgcctgcataaacactaacacgtcattcacgttctctccctctgcctgcatatacactaacatgttacgtttttgcagccttaatatacccttatccctacatacttcaatgtgtaatttctaaaggcacagacattctcttatataactgtagtacagttatcagaagaagagaccttgaacgtacttcattagtttttcttaattccacataattgttgtctataatgatttttctacttgtagcatagctttagtgtactacaaattacccaacctactgttccttttttccctcaccatctactattttttatcccttcctattaatatagagtacagtgactgataagactttgatgatagtggtcagtcatacttgactgttgctagatgacaagactcaatatctttaagccagaggtccccaacccctgggccacagactggtgctagtccctggcctgttaggaactgagccgcacagcaggaggtgaacaacaggcgagtgagcatcaccgcctgagctctgcctcctgtcagatcagcatcggcattagattctcgttaagagtgcaaaccctattgttgtgaactacacatgtgagggacctaggttgcacactccttatgagaatctaatgcctcatgatctgaagtgaaacttccatgaaacctattcctggtgccaaaaaggttggggatcgctccttaagccactctctgaagagtttgttgattatacctggaaactactattgacttttctgattgttcttttactataagttatctaaaacatttaatcataaagttttcagaatataatatatggtttgattatcttaaaatttaacattttcactaaaatacatgtattttgccttgtcaaaagtaatatttgattcgtgagaaccaaatatattctgtgaattttcatttttgctatattctgagttttgaaacaaatctcagacaatatttcatcccattagctttcatcctattagattttaaaggctatatttattttattaaattttttttactatgacaaattcttaagactggagttagctaatttccattaattattggcattaaattgtattgtatttgctgagaaatctgatggctccattaacgtcaccagggtgatgagcacatgagagttttcattttccatgtctctttttattctggaaattctcatttactcaagctttgcttttataaaattcctttcctagtatttttaaaataaaatcaacaagaagtatttgacatggattatgtagaaagagaacacagagtgacccacttatagacaggtaaattatattctgttttcaatatacctgataatgtagttggtaaaattatgtacttaggttagataagcttccacttcatctatgtccgaggtattttgcacatggtcataaaataaccataaagtgttatatttctaaagtagagatttctaaagatttctaggatccagtaattaaatacccaaattgagatagaagcctcaacttaaaccttaaggggacaaaacgtgtgtttaccatattcaacatctgccttcttatgtttgcaaatacatatgcctgaaagcctgtgcagtgtcagggaccatctgtctcactgcgagacatacatgaggccagtagaactacaaatagcagaagacagatgtatttacaccttcttgttcagtaccttgaagcagcacttggaggtaataaggcctgttttggcaacagctgctgcttaactctgtgacagtatacattgatggaggtaaaagaagtgttagacattatttggctccaataatcacccattcaaacagactctgttttctttcagtttaagactggaggtttaaaaagtccaggttatcatgttcttatcatatgtaagtaagaatagttctcctaatctattaaaagtggaattaggtgctaagaggttgcaccatatcttggatgttaggtttgtagtagggatttattagcagcatttcatagatgtttggcattatcaagtgagtgatcaagttttaaaaaatattttctatgtaacaattcacaaaaaaatgttcatcaatgagcttaattttatctgcttaaatctaaaattatttatatttccaaattattttatggacacaagcagagaacagtaaatttcaaaaagaagtcatggtaggtagttccgtgggaataaaaaatattaaaattgaaaatgaagttacttccttgctcttactaggtggagcactttttgtgaagtaaacatgggatgatttgctctctcgtaggtttccttttccttaaatggaagtagctcctcatttctttccccctccccatctttatatttactcatttcatttcttctcttttcttttgagacagagtcttgctctgtcacccaggctggagtgcagtggtgtgtgatctccacccactgcaacctctgctcttgggctcaggtgattctcttgcctcagcctcccgagtagctgggactacaagtgggtgtgtgccaccatgcctgtctaagttttgtattttttgtagagattgggtttctctatgttgcccaagctggtcttgaactcctggtctcaagtgatccaactgccttagcctcccaaagtgctgggattataggcatgagcaaccgcacccggccatgtttattcatttctttgtgaagatttaggtggttattaggaagcttcagatgcaccctgtagaagtaggttaagtaatgtagtggaaaaaatatggaattgggagtctgaggccctggcttcttctcatctgggttctgcacctatttgccagtgtgtcctaggtaaatttcttcacctgaaaaaaaaaagtttatatatatggattataatcttttaatccttatcatgtatgagtttctaccagttctttggtcccatttctaagcctcaggactgttgagcagccgtaagccagtgctgatgggctcaggccccacttagaaagcatagatgcttttaaatgatattaaatggaagcattaaatagcatttattcagacacatccagttgatatttgtagaccaaatctaccatcagacttggctatgtgagtaaatgatattggcatatagtaggccttgcagaaggtctattccttattttaattcaattaggtacaccttggctcagttacacagtttggcctgagccttaaactttataggcaaagttcggagaattaaattggaaatatttggagaaagacccactagatacagatataatagcttgggtaattccccacctcatgtttctgccttatgtaagtaccagttcttcatagctaagcaatggatgtttggttctagatattaaataatggacaatgtattttcattggaatatgtatggatgtgactacatatgcaatatatttaacatagtttgagttccaatttttctgctatatcagtggagtacttaaaccacaccatactgtaaatctgggaattttttttggatgatgtctactatataccatatatatattttttgtttgtttgtttgttttgttttgtttttgatatggagtctcgctctgtagcccaggctggagagcagtggcgtgatcttggctcactgcaagctccgcctcctgggttcacaccattctcctccctcagcctcccgagtagctggaggcgcccgccaccacgcttggctaatttttttgtatttttagtagagatggggtttcactgtgttagccaggatggtctcattctcttgacctcgtgatccacctgcctccacctcccaaagtgctggaattacaggcgtgagccaccgcgcccagcctataccatatttttaaaagtcagcaggcataaatttctacagaagtttgacattatttatgttatgttcatctctttttttgccacatataacagaattttaacattatcaatgtttttttcctaatgaaaagtcacccaggctcaagtgcagtagtgtgatcatagttcactgtatcttcaaactcctgggctcaagtgatcgtcccacttcaacctcctgagtagctggtactacaggcctatatcaccgcacccggctgatttttaaaatgttgtgaagagataggtcttgctgtattgcccaggctagtcttgaactcctacgctcagtcttgccttagcctcccaaagtgctggaattataggcatgagccaccatgcccagcctgctaatgaaaatcttctaaatcttgagtttatcacttaaaattgggtatcatgtgtatctcaaattagacacttgtctgttttagcttcagtttcccctacagatcaatagtttactaccagtaatacgataggtctctttggtagggagcaagtaaaattaatgaaaaattcaaagtataacttaaaaatgatattaggaataatttactgatatgcatgtgggaaatgcaagttcacttcagttgttgttttaacagagggcacacagaatttagaagtcattagcatccctagaatttatttttagagaaatatggctctgcttcaatatttgacacataatgttgtatagctttttctctgcttcatctctgtttattacatttaatatttatatgggctcattctgatgtctgttctgtggcagtgcctgaattgtcttaggacatgattaattgaaaaataaggtttatagagtatgtttataaaatttgtctcttagatgccacgtacttctttaactctggagatgattgaacagaattgttactaataccttttagcactagagtcagattatagaggattggaggatttcaaatcaaatctagttttgcttttttctcatattaaaaaaattcttcgtgtttaccttgttttcagctagtaagattgaagactttgtggcaccatgtggcattcaacaaaatgaatcagttgaatgacttacatagtgttatggtatgttataaaacataattctttcctatcttctgggagtctcctgaagaaaccctttgagaactaatggccaggtcatttcacggtggcctatatataagtctgtaatatttctggatttttagtctcttgaccagattttcctgagatttgaaaatcagaattcaggtcaaaaaggatataattatgacaaattgagtaggttttatatggcatatttgttaagcctgctaaaatttaatggtgattggaaaacaccaattattcgagtttgaatatagtaatttgggttgcctctgttaatacagagaatatttcattcagtatacactcccactcacatcatctctttttctttccactctcatctcactttaatacgaaactatagctgtgaacttttgggaggggagagtgaagtcataggtgaagacagctggatcatggatttgtactttgtgactttatattttcattcctttgctactgaggaaagatgaagcaggcacatttcaaaagaacagctgacactatccatacaaagacagtaattacgtcagtcactataattctttggagtttgtggatcttcttttacatgtatatggcagaggtctagcttgtaggactaggccagaggcagatgagtatagattttatacatgccaattgtacatgctaaaccaggttctaaccttgtctctccagttccctttctccttgagttctgttagccagtgaatcctagtttgattgaattaggataactttaaactaacacaagtgggtcaaattgtgaatagtgaaccttactgtattcaaacttaacaatgatgttatttatttagtacaggcctgtaaactacagtgtctgagttttacggtgcattttaggattatgggacaaggaagtagttggagaaatctccttttggcaacatgttactgcctggaaaggaaaatctcgaggtttttttttttaagtttctatatttttctttggctaacgtatgtttcctttttacataaaaggaaacctaaacctggaagaaaggtatttactggctctacaggtagggaatatcagatggtcttttgaatttttagacacttgaagtttttgtttcatttttgcttgtttggtttttgcagccaatggaaaaaccttttaagtaataaggactaagttaaacttctaaattctttataataaatcaatatgctgatgttctggatgagatgggagactgccctgagtaggtacaatataacgacgtaagcctggacattccagattacagtcacttctggacaatttggttagttcaggtgtcttgcctaattaggtgaaattaagagaagttgtatactatatgacaacgaaaacctcttcattttagaggtatttgtaggcatatagaaatggcgtgaaccattccttttcctatcatttcagaacgggctcactattcagttgagagattgtagtcttcaagtagttttagttatttaaatctgtgtttgtcaaactgcaagctgagctctagtaacattttggttttgaggtaattagtcatgaaatcatataaggagattatggccaacatttttttttctttaatgaagtagaataaaagtgcaattctgccactggttctgtggaccagcagcattgctgttatctaggagcttatcggaaatacagaatctcagatcccagccagacccacagtgttagaatatgcatttatctgcattgtaacataatctcaacattaatgtttataaaacattgaaataaaaatagtaacatttattacagataacacattcattaaattattgtttctgtcttgtttgtgtgtactcgtgcacataccagcttacaccttaaaatgtatttctatgggttcacagtcaaaaaagtttaaaatctactattttaaatgtggatgctgacatcgtaccgctgggtatgttcttatctaactgagagagagctatccttgcttggcattggcattggcatcatctctaaagttttgttttattttttatctatcctatttttccttctacctcactttcttctagttatctcttgcgtgtctctgttcctttctttgtatataatgcgcttcaagcctcaaaattgtactcactatcgtgaaaacatttttctcaagttttgctttgtggtcaaatatactcagtttactgggaaaaaaattaaggctaatcagcaggatttttattttttaattctagaaccaattttgaagaaggaaatacccacattttaccaatgtgcttttctcctccatttgttatgatttccaaatgtcagatgttacagtaccatttggtttggatatcattaaatcactcagttttctttatgtgcagatgtgcatggcatatcttaaatgctaggaacagaattttgagaagaaatatgtataacattgaagtcccagtttcccagttgtatttaaaacaagtgattgtagctttagtttgctgcgtactaacctaatctagtgcagaccaggtaaaggaagctaacctcttagaccactattaagagatatcctaatttcctggattatggccaaaaatagagaaaaattatactagttgtacttagtgttttttcctttgaccaacaatatacaattcaacttacgacaaataagcagcttgaaaaatatgtgcctctttctgtggttctgagactggaaccagtgaaaagcagacaattcatatcaaattttttatccagtcatcgttagctaattttaaccattttgtgtcacatagctacacatttgttgctattgatctcactcttctccatctggttattccatttaacttataccttgttttaaagggcttcagcagtgaattttattttattttaacttagaaatactacaggggtgctccagaaaagggggagaaatagaaaattttgaatctctaactctgaaaattaagggccttgttactacacatcattctgtttattggttatatcagacagtatgtacagcagaattgtaaatgattactaattttttagttatttttatccatactctataacagtatgatatacttgtatttgctaatgttaaatgagtttttctctaattttttgtgcatttttcccccttttccatgaaggccttatctctttggagcggggtgtttttccataaaagccccatggtgagttccagttcagtcccgcatgcctcattcatttgctgtactctcaaaaagtaatttgttttgtagttttgtttccagttgcatggcctgatcacagatagatgcaccaagttactgaataatttgtagatggaacatgaatgttgatatttaagctttagaaaagtggttttcttggtttcacttcattctttaaaaagtaaaaaacaaaaaaaaaaaaaccacagatgaattttttttaaatagaagaattctctcataatgctcgtaaatattacaagacaaggctaacacccaagtttaaagctttgagtattatggcattagaagttacctacatatcatgcatagcatttgaggacatgatttattttgaaatataaatatatttaaggtataccaaaagcaccttataaagtttttgttgcattttatttggtcctaaagagacaaaagttctgtttttgaatagtttaggtatttaaggagctacataatgacaaaatatatattttacataaaacctcctaaataatttattattttgaattattagcacatactcatcatagcttaattatttggtaaattctttcatgtcagtgcacagaatacagctttgtcagtcttagacaggaaggtcatagaaaagaattcgaatatatttaatactttcatgtaaagataggaagtagaatgtgttaagaatggtataaaatgtttaatggttaagagtcagactgcctgggtcttagatcccaattgacacacttactagctatatgatttggggggagttttctaaaacctttctatttcttatttccttatgtattaaatgtacctatgtaatggactcactatgagtattaaataagctgatacatatctcagtatgtgttagtatataacagtgcctggcacatagtaaatgtgcagtaaatgttagctgctaccactgtttcttttcctgtttcagggaaaaataccgtgtttcaaaagaagcttatttaaattagattatgtttttcacttttaaggatatgttaaccagtgcgaagttttgagaaatgtaagctatattaattttattaatttagtcagaatactgaaaagagttctgcacatatgtgtagttctcataactgctaaatggggattgttcatactgttctattacactagaaaaaaacattccaacgttttttcctcttggacagaaagaagcttaaatagttctttaaggttaattattatttgacacaaacttatttcaatgtttatatgccataggaagatctgaaaattttgttattgcttaataataggtgacataaaacaaatcaacataaaattttcctccttgaaaattataattagacacagtttgcaaaactattctaaacaaattcaggatatacaagaatataaatctcatgaaagttgatctttattcattttgttaaccagatgtcttctaaaaacaaataagatacacagatcttacttatgagccttccagtgatcagtgaattttaaatgccacattcaacatatgacaaaatttctttgtaaacttagaattaaattccattttaggataaattcttcttctaagtacaaagcaaagagttgtagtatgttaataaagattgaagttttgcatagaagtaaaagatggaataacaactgttgtatgttaagtaagtaaagttcattccttcaacagcttacgtgctcctcacatttaagcaaaagcacttgtcaaccagaaatgatttgaggttgaaacaagattaaaagagccagattaaagaaagggatatattaaatatagtagacttttaaatcattgcctgtcttttagaagactgctttgtggtttgtttgatgccatcgttagctcacaagaaactcgtttttagtcacttatactagactaaaaggttctcctttaaaatgttactttcccagtggtgcatgttttttccattaagatcttaatgaaacctcaaattaaggcagcaaatgaatataaatttgacaacttcttccattttgtttataagagctcctttgttttaatagtttttgctatttttccatgttatttagcattcaacctgagaatgtttttatgtactgttctgaaataaaacattatatgctaaataaatatgtttttagtatatccagttatagggtaatatatgtattttggatgaaaaatgaaatttttaaatgaaatgtaaattttctacaaactttttattagtttcgagttgcaacgttaacacttagctaagaatttgcttttggtatatcacaatttctgctagttctttattctccattaaacaggtttagtcctttacattcatatactttcagatgagtcgttataaaatacagtcgttccctttggtaacaaaataagcttgttggaaagtaaactatgcatcttcaacattttagtcactttggacttccctggtattatgtgtcatctaggttagtttaggatatttgagtttggatgactatataaaataatacaaaagaattacacatataacatacttttttaaacataggaatttaagataaataatcccagtgtgaatttttgaatctgaattttgctttcaatattacaaataaataggaatgtatcaagctctgaatttgcatgtagtgttgtatttaagctactgttatttttgaattgcttatcaaaaaacatacatgacaggtagacaatgggtagtccatataagtatatttcttcctcataaaatgttttcatattatataagggtaaattttaaagaattaaaatttgcatattaaattagaaagttttaattagtgttttctaagagttttgatcaagctataaacagttcatgtaaactaatcttgttctcttaaatattttaaaattttatgatttcattttttgaaagatacgatttatatggagaggagaatttattcttacctgccacatttacacaaatctgttagacctttaagaaaaatttatgacagaatagaataatttcagacagattattaatatctttagttatttgaaataaaatgcttccagttctcccatttaggtcttatgttagaaactaagattgagaatgagaaaaaacttctaaaagaatataaagaatattttttcttttatagaaagctgttataccacttgtaatacttagatcaatattgggtcttacatttaaactcaaatattgactattcttttatgttttaaaaatgaaaagaaacggtgcttctgtctcatgttagcgccttccatgcttgtgtccttccacagaaggcactggagcacattgctgcttatcatgctgtccacagatacttcacatctgtcctattcagatggagatcattgtcctgtaatttttaagcagatatcattagaattttgtactcttttttttctctctttgcagttgggtgtggagaaaaaaataggccagagaaattcaatatattgacctggctggattacataataaaggccaagggaagaaaaatggggaactttagtagcctttgcaaatatttttgaagtcctagtaatgttaatatccctataacttcctctgattgcagtgaaaatgattctcgttctatggttagacagttaagcgtttcctcagaagaaatgacaaagagttaaactcctgatttttaatttagcatcttatttgttaatttggttattcggtttttttgtttgcttgcgtgtttgtttttcttttgattacattgattcgtatcaggcttagtaaatatgatgttttatgattgtcatttttatgatgctgaaagttgaatttattccattttttcttttattttttgctcaaaagttaagtcaaatttttaaaaaattattgaacatggggttatgtgtgaaaaactaagggtagtaaaggaacaggaattgtcagtagaaaggagtccatcgagagtatgtcttgttctcatgtataaccattttaaaaaaaaatggatgagtccacataatcaatacagttaaacttttgggcatcaatacaaatttaaatatttttctatcattgtattattaacttaataaatgattaaataaatgagggaaggcatccaaacacccagagaaattctttctaaacttgcaaatgttctttaatgagattttttaaagaccccttttggaggagaaagggagatgttgagaacaagagagaaaaaaaaggttagcattggagtgctttcctatgagggttgggtcagcaatctgtaaatttacataatatacaaagctagcacttttctaatacattcacgtatgtatcatttttcaatgttttatctttctgtcaacaaaaggttattttgtgatagaaatattctaggtcattgtggaaaagttcatacattgtatgtcactggcatattgctagaaaagcccttctacttctgccaagctttcttggacttttaaaaacttaggatgaagggcagattgaacccaagttaaaatttctaactttgagtgtatcccatagaagatattttattcataacgttctttttattagattatttctcctttttattcctctgcaaatcttaaagacacacacatatttttatgtttttattttgctgaaataccacaatcattccagattatagattgatgatagaaataacttgatatgaatgtgtttacccaatatgcttcatacccaacacacaacactatgttatgtagcagatagcaagttattttcagggtgaaaactcttttgactccttaataaacacagacttttactaatgaaatttaaggccctatcagaggaaaaaagaaatgatgaaatataaaaataaaaatggtaattctttactgaaattaagcatagttttaccataaaatacttattttctgtaggagatactgagcttatgtaaaaataacaccgtgttgatgctttttacttgtgtgttccaaaacagaattgtatgtaacttatagatgtataagagattttagcttttgacatgagctgattagactctaaactagtaaacatacaaaaaatattttttgtatgtcaaaaaactaaattgacgtcctctcatttttctactttttattatcatgttagaaagtttgccatctggcctggaagcaactatttttaagtctgtttaggatgcatacttcagagggaccatattttctcttaagaagaggcatgctcacttgttacttaccacatgatttaaaaacaacaacaatgacatccagtaatttgcaaagagctttgagtttgtcccaatgaagcttgttggtacattgtagtagctttgttctctgatggtgattctagtaaaagcacatagtcgcacaattgcaaactgctttcaaaaaattctacaatacttttctctttcccgttcccccagccaccatcttcccaaaactcctaaggattaaaaatgaccagtggtacctcaaagataccagctagaggaatttgtcagttcaatgatagcagtttagtgatggaaataaaagctttgaaagaagccttatattctcaggtaatgcaacagagagcatcataaccagaaagaacaattctgatgccagtgacccagatatcatgggaaggtgcatatttgttcaggtatagggcagagaagagtcttcctttctggaggtatgttactacagttgtgacagatgcaagtatgaagaggtgaaacagtttatagagccagattcagcttcccacagaaactttttatttaaaaacgatgtctttattccctgtcactggaagtctcactgtgactggttgacattttaggcatggatgttttttgttgcaggaataatgagaagtgttttaagaaatgtaaatggcagaagaggtttctttcatatatagtaatatgcattaccatggattttgttcaaagtggggagaccaaagggaccaatcatagttgcctctgatccagacttagccatccttagaggaagatgtttaaacaagcctcaggaaataagatgtctgagagactatttaaaatgtcataggaactgggaaactgagattaccaaagcaaagtctgaattttttgaagattaggttggggctgagggccatatagaaaagttagtatttgctgagtactgtgatatgggaaagtactgccctgggaactttacctgctttgtctaatatagtggttctcagagttgagcatgcatcagaatcatctggagggtttgtttcaaaacacggattgttgggctccattcccagaatttctgatttagtaggtctgggatggggcctatgagtatttgcttgcactcctaagaagtcctcaggtggtactatgagctggggacagtgctttgagataatataatcattaaaataatcctatgaagtaggcattactatttctattttacatattagtagtctgagctctgagaggttacataacttaaccaaaagtcacacagctcagaggtgccagcactgggattcaactacatgtttcttcctgactccaaaactatctctttccatcccaccatactttagtaaaggatgaaaacaaaaattgagcaaaataaggtagaactaatgtttgacattggaggctaactagcagagaggaacatcagagctctagtttttattgtttcctaccttggctgtgatctttaccagtgcacgatgaggctactggtttatgaattagagaaaataatttatcaaaggtgattggcaaaattgctttgggaagcccttgataaaccaaaagagaacagaaatacgggattgaaaaggtgtgaggtcgatattagaagctgagcatgaaaacttatttgtggaaaacagaggagatctacttcttttgaatggcagtgacaggaagtaatggcagttactaaatgtgtcctcagacatatgagcaacagaaaagatttaggtttgagaggctattgatatgtaattccaccttggtctttttctctgaacaaaaatagacacatcattttcacaaatccgagaagaaaaagagacaacaggaagatcagtgaatataattgcattagatgattagctattcttcccttgcactgtctaactctccatagcattgtggccgagagagcattttcaaggcttcattctatatcacctcattttcatccatgctgtctaaattcatttatactgttaatcccacatcttatagattggtgcaaaggcagtggcaaaaaccacaattacttttgcatcaacctaatatatatagaaatgaagtgataaaccattttattattgtgagatgttcatgctggtactattgcttcactttgaaatttctagggaaatgttactcatctgaaaagaggtgacttggattttgccagcacatacttcaaaaaggagttgatttttattggtcttataaatgttgctctctttacaaaactctggaactttgaaataattctacttttactccagaacatagtctcacatcaccatttattacttaaggcaaaatgcatgttcatactggaggatttgaataggggtggaatttaaaggaaaaactgtcattacctaaaggagtatcatttcatcatgataattgttttttactcttattttattttttaagcaaagttaaacctcctccacaaatttcacccagcaaatcgatgggcggagaattttgtgtggctgctatcttcggaacatccaggtcatggtttgcaaataatgcaggtctgaaaagagaaaaaggtatgtatttttactgaaaaatgaatgctctatttgtaatttttgcttcttaaggaaaatttttagcagtttccctagaataatcttgtacccagtagtctggaaaccaatttttttaatgtaattagcatgtcacttctcaactactcaagcctagtcaagaagaaaaactatcctctcagtatgaacgttaatgaattgcccactgagtgattttgttttgttttgttggtgacaatctacaggtgatctcaatgctgtcaattctatacccattttataccttttacatttttacaagctagtttcacccctggtctgtgaagtacagagaggaaaagcgtcattgtccctgttttagagatgaagaacttgagaccagcaagtttaaatatcttagctaaaagtactggttagttaggcaatggaatcagagtttgaaaccagattttctaatgctaaaaatcttcacattaaaaaaatcaactctgccatgttttaaaacacaattaaggccagtcgcagtggctcacgcctgtaatcccagcactttaggaggcagaggtgggcgatcacgaggtcgggagatcgagaccatcctggccaacatggtgaaaccccatctctactaaaaatacaaaaattagctgggcgtggtggtgcacgcttgtaatcccagctacttgggaggctgaggcaggagaatcgcttgaactcgggaggcagaggttgcagtgagccgagatcacgtcactgcactccagcctgggtgacagagcaagactccatctcaaaaaaaaaaaaaaaaaaaagaggaaacagcctgccagtgagaaataaggctcagcttttgtggttaccattgctcctttgaattaatatacagtagtctctccttatctgtggaggatacatccaagacctccagtggatggccgaaacctcggatggtacggagccctatatggtacaatgcatttcagtctaataactgagataggtactatgggactaatgggttggtagcgtatacagcgtggatatgctggacaaaggatgattcatgtcccaggcaggacagatgggacaacgagagattttaccacgctattcagtctgccatttgaagcttatgaattgtttatttctggaattttccgtttaatatttttggactgcagttgaccatgggtaactgaactcgcacctaaggagggactactgtagttattatctttctaatccctgctttgatcaccagggtcaatacctaaaatgtttataggattagtgctttatagcatgtgaatccttattgcttctgtttagaagagaatgcctacgttcataaaccaagtatataattttgaatgttatgattttccccttaatattttagtattattaaagtaggtcacaaaccgggttgttactggggcacttctctggtgagttccacaggctgtattgttcttggcaaaatggctctcctttatgctaacactggcagtcagacatgagccctttctcttgttatcgcctttcagtgaccctttacttggtaatgggatctcacgcgcagcaggttccttacctaagtgggagaggatactgttaagtatgcaagccttccatttccttatcccatctttattttttttgttacctccttaggtttaatgatgctatcgaaaggactttttgttactagttaaaaccctctgagaagctcgatttcaaatgcttctcccttctgttctaattacctttttaactttctactcctttatgtccctctggctgatcattagctattttctcaaatcagctgtaattgattcgcctgacacagagataagatgacctacccagcattcatgagtgattttatatgctcctaggtttactgtaaaaccggagagagaggactaaacctgttttgctagtgggtacatgtgtattccttataaagtcagttgattagatccatattcagcacctaacttctcaaagtatggctgatcttcatttaccatggcgccagtgatcccatggagagaaagaagaggatttgggggaaggggatgcacatgcatgcctgtgtatgtgtgttgaatagactttattttctaaaggagctttaggttcacagccaaatgagcagaaggtccagagatttttccatatataccttctgtctccacacatgcaaagcctcttattatcagtatccccaaccagagtggtacgtgtgtttggattgatgaacctacattgacacatcaaatgttttttgtttgttttgatccacaaatttaagttctaaatttaagtcttctgagaaaaaaaatagatgagacattaggctgatttaggcatacaactaacctttcatgcaagtcatttggtacatgcagggtaactaaatcctagtccatacattattccttttcagttagtccatttcctgatatcattcatttttcataatgtgggacaaattacattgtagacaagtacaaaagtctatgaaggattttactatattaggatttggggcatagtagtatcattcttgaagtaagttgcttaagattgaaaatactctgatatcatagacattttcatattcactagcatgtgcttatacgaggcaacctttaggcaaggaacaagcaccatatgaaaaaattcctgtcgtctgagcatggtggctcacgcctttaatcccagcactttgagaggctaaggtgcacagatcacctgaggtcaggagttcgagaccagcctgaccaacacggcgaaaccctatctctactaaaaatacaaaaattagccgggtgtggtgacaggagcctgtaatcccagctactcaagaggctgaggcgggagaaccatttgaaccagggaggcggcagcctgggcagcaagagcaaaactccatctccaaaaaaaagaaaaaaagaaaaaaattcctgtcttttcattttctctgagcagcctcaggagcagactaataagatcattaacttgtaaaaattattctgtgctccatttatgccatcataacacatcgggttctgtttctctgtttgtagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttaggtagtacctcttttctttttttctttttaacagcttcattaaggtatagaagattaaaagcgtataatttgataagttttgacatgcatacagctacgaaatcatcaccacaattaacatggtaaacaaatacatcactctcaaatgtttcttggtgaccctttgtaatctctccttctttcaccccctttgtctctacagattagtttacagtttctagaatttttttttttttttttttgagacggagtctcactctgtcacccaggctggagtgcagtggcgcgatctcagctcaagcgattctcctgcctcagccacttgagtagctgggactacaggcacacgccaccacacctagctaatttttttgtatttttattagagacggagtttcaccatgttggccaggatggtctcgatctcctgacctcgtgatctgcccgcctcagcctcccaaagtgctggaattacaggcgtgagcaaccgtgctggcccagtttctagaattttatataaatggaatcatatagtatgtaatttcttaaatctcactttcatctagcaaaacaaacaatacttcattccttttttttgttttgtttttgtttttgtttttttttttttttttttggagacagtctcgctctgttgcccaggctggagggcagtggcacgatctcagctcactgcagcctccacctcccgtgttcaagcggttctcctgcctcagcctcctgagtagctgggaccacaggcgcctgccatcccatctggctaatttttagtagagatagggtttcaccatgttgtcaaggttggtctcatactcttgacctcaggtgatccactcgccttggcctcccaaagtgctggttttatagggatgagcacctggcctttcattactttttcatttgacataatttacatacaataaaattaacccattaaaagtgacttttcacaaagttgtgcacttatcactgcaatcagttctcatcaccctaaaaagaaacctcatactcattagcagtcactccttatttttctccaacccttcagacctaggcagcagccagtttactttctttctctatggattttgctactctgatcatttcatgtaagtggaatcatataatatgtgaccttttgtgtctggcttctttcacttagcatattttcaagatctatccatgttgtagcgtgtgtcagaatttcactcctttttatggctacataatactccattatatggttatactgcattttgtttatccatttattagttgatggatatttctactttttaagctgttattaaataatgttgctgtgaacattcatgtacagattcttgtgtgaacattttttttttttcctgagatggagtcttgctctgtcacctaggctggagtgcagtggcgtgatctcggctcactgcaagctccacctcccaggttcacaccattctcctacctcagcctcctgagtagctgggactacaggcactagccaccacgccagctaattttttgtatttttactagagacagggtttcactgtgttagtcaggatggtcttgatctcctgacctcatgatccacccacctcggcctcccaaagtgctgggattacaggcgtgagccaccgcgccggcccatgaacatatttttttaattgtcttctgtatgtaccttggagaatacctctgtttgaacttatttcccccttgcacttctgtgttaaattttcttggatttatgcttcctctatttgcaatctcatgctcaccgaaaatagagagtaacattgagatagccattaaggggaatagaaactaatatagatagattcaaaggtttctctgaaagtaattctccaagatacagtggttaagccttataggaatgtttattaagaatcagagtccatctcaaacgtgcataatgattagaatctttataagctataaccaaaaggaaaaaaaacctggaataaaacctctttaatatagttcattgtccaggaaagaaaaaattgctcctgacatgtatggaaggaaacagacaaaaatggatatgaaaatgatccctgtccttttgacattttaaaatattcttgtattgatttttggaggctccagcattctttactactactttactatgctggattgatctgatcaatatctgatttatcaagcttatttaggagtgggcagatctaattaaagttactacactatcattgttgaaatagtaacttatttcagaactcagatgctaatttgatctataataagtcatccatttacacagctgtgttttattaaccatttttacctacttcattttattttaaaatatacacatattttaagaatagagaggtcagaaattacataaattagaactagttagttgtaacatttgaattttacacctgtttaatcttctgaatgtcttgcctatcctgttggagggtcttctgctgttaagcttatattgactgcatgttatttgtatgaaagactgccacctttttattttttctaagcagatggccttgtgtttcaggtttcatcacattcattttaatgattacaagttcattttaatgatcacaaaagtagtgtgagtttaagtcactgttcataagtgatgacagtcatggtgatttacatcccatctattaagcttaaatattaatattcttctcctgtttccttagaacccctcaatggaatgaattgcagccaccgtttaatgcaaaccaccctctgctcctcgctgcagatgcagtacagtattatcagttcctgcttgctggccgtaagtagttcagattttttttttcctttcgtatggtctattcagatttcatcttaaaatgctagctttgaaagcaaacattaccactggtccataggccatgggccttaaagaatcagtttgaggcaaataagatatttaatatgaatataaactgtaagccttagtatacattatgtctctgactgcttatattctttacctatgaaatatatttctgtaataaaagttaagttgatagggaatatctggagggctcaaaaattcaaacaaacataaaaaccaccacctgaaaatgctaggatataataaaaagtttcataaagcttggaatctgtttctaacatggaaaaaaaaaaaccccaaaacttagcacagttaaaagtgcaactatgaaaacaatgccagcaggcttttcttttggtagaattttacttgcaataatgaggtaaagatttcaactacatttgttaatttgtttgtttacttatatgtttaagcgtgagcatttgtagagactgaaccaagttcattgacctagataacagctttttatatgggagtcatttaaaggcaatttagtatttattatccagtttgcgtttatagaattaaaaattatttacaattataattcagttttgtagatatagacagaatccttaatttaatttgatggctctgagtagtgcacgctttaaagaaaattcttaaaaatcaacattgacatgtttttaatgaaactttgttgtatttaacacattgtcttgcccggtatattagaaagcatgaattaaaatagttgtcgaatgattttattttatctttataatgtgctatatattatactggaaacagaaatattttatagactttgctctcaagttatgaaactctataactgtaatcaatagttggcagtcttgctctctcatattattgttgaactctctgctttttctagggcatttttattgagtgcctactatgtgtgaggcagttctgatttaaaggtgattagtatattgcttctctcctcaatgaattccctaattcaggagatagacatttaataaaaaagtaaaataaagtggggtaggtgtgtcagtggagggttataaattgaactgtgagagcagtgacgtgtgttgcctatggcatcacagacgggtgatatgtaagtggttttcgggttgattcaagaagcagtgcatatagaagttgttagtttctagattttttaagcatatatttaactatcatatgaactggaaaaatacatgacatgaatatgatatgaaataagaatcatgagtacattttccattacctctcaaggagcaaaactaattgttgaattaagcatagttgactctttcagagttaatattgtgttttgtgttgttattttgatacctattaagtctatttaatagacatactataacaagtctgaaatatttataaaacacataggggaaaagatatagctatatctatctcttaattgttttttgttccagtgattgaccttattgacattacactctgcttgattttagctgccctaaacacctttgtctaatgctcagaacaacaaaaatccccaggtgcataatttaagaaccaccactgttggcagtagtaagccattacatgttttcaagcataggaatgacaccatcaaaattgtattttagaaagatcattctgggctgggcgcagtggctcacgtctgtaatcccagcactttgagaggctgaagcgggaggatcacttgaggtcaggagtttgagaccagcctggccatcatggtgaaaccccatctctactaaaaatacgaaaaaattagccgggtgtggtggtgcatgcctgtaatcccagctacctgggaggctgaggcaggagggtgacttgaacccgggaggtggaggttgcagtgagccaagatcacgcccttgcattccagcctaggcaacagagcaagactccatctcacaaaaaaaaaaaaaaaaaaaaaaaagaaagaaagaaagatcactctggcagcactgcagcaggaaattcagaggaagggagtggaggctaggtgatcctagagcaagatgagaccttaaattaatgctgtattacagagaagacaggacagacctgtgagatgtttaatagttggcatagaaaagaattagaggctgggcacagtggctcacgcctgtaatcctagcactttgggagaccgaggtaggcagatcgtctgagctcaggagtttgagaccagcctcggcaacatagtgaaaccccatctctactaaaacacacaaaaaaatcacccaggtgtggtggcgtgcacctgtactcccagctactcaagaggctgaggcatgagaattgcttgaacctgggaggtgaaggttggagtgagctgagatggtgtcactgcactccagcctgggtgacaaagtgaaactctgtctcaaaaaagagagggacaatttgaaactaagtagttactaatgattctgtggtttctcatatggaatacagcaggtccttgaatgatgtcattttgtttaacatcaattctttataaggctgatgagaaaaaataatcgctccctgcctggggccattgcctgtgtggagttgtcacgttctccccatgtctgtgtgggttttcagtgggtacacaggttttctccctgataccaaaggtatgcatgttaggttaattggcatggctacattgtgtcccaggctgagtaaatacgggcctgtgtgtgcgagagtgccctgcaatcgaatggtgtcttgtctaggatcgggtcctgccttgcaccctgagctgccaggatataggctctgtccacccacaactctgaatgaatgaatacaaattattgtaaaataaaacttcttaaaatatatggtaaatcacagaaatgcacaacaataaatgttgctatatgaaagtgctcagcaagcccagcatattggttattatctgttttttaacttcgtggttgtaggaggtgctcattaaaattttcactttgcaaacatttattccttgatttaactcaccagcacttcaagctccactactcagtgattcgctagaaaatgagtaaataatcatattacttgttttcattaatctttcttaaatgtatgtatagctcacatttattttgatgtttaatattaaagcatttggggtctttattcagaagtttactgatgtttttgaccagaaaaaaaaatatgccttaagaggtgggggcgcggtggctcaggcctgtaatcccagcactttcggagaccaaggccggcagatcacgagttcaggagatcgagaccatcctggctaacacggtgaaacactgtctctactaaaaatacaaaaaattagctgggcgtggtggcgggcgcctgtagtcccagcaactcgggaggctgaggcaggagaatggcgtgagcctgggaggcggagctcacagtgagccgagattgcaccactgcactccagcctgggtgacagagcgtgactctgtctcaaaaaaaaaaaaaaaaaaaatatatatatatatgccataagaacttaactcttgtttatatcagtcagtggtaaaatgggttttgtaatacttcatttcacttaaagtcacagtttccatgaacttatcaatgatgttaaatgaggacttattgtataatgcatttcattttagaccttttgagttccaggtggactaatattgggataaagatgaaaagacctgggttctagttctaaatccagcaataacttgataaatgtagatatcaattattatacttgctcttatagagatgttatgatgatcagtgaaatgatgctaaagtccttttttttttttttgagatggagtcttgctctgttgccaggctggagtgcagtagcaccatctcagctcaccacaacctctgctccctgggttcacgcaattcccctcccaagtggctgtgattacaggcacacgccaccacacctggctaattttttgtattttagtagagatggggtttcaccaggttggccaagacggtcttgatctcctgaccttgtgatccaccccgtctctgcctcccaaagtgctggaattacaggcatgagccactgtgcccagcataaagtcctttttaaaactgtaaaatagtttatacatttgagcattattattataagcttttgtttcttacctcagaagaatatattttcaaatgatagacttctgggacttttggtacaatttacaaaaccttttttgtattctgcatttacagtggactacctggcctgggcatggtggctcatgcctgtaatcctggtactttggaaggccaaggtgggaagattgtttgtggccagaagttcaagaccatcctgggcaacatagagagaccctgtctctacaaaaacattataaaaattagctgaacatggtgatatgcacctgtagtcccagttgctcagcaggctgaggtaggaggatcacttgagcccagcaatttgaggttacagtgggctgtgattacaccacagcactctagcctgggtgacagagcaagattctgtctcttaagaaagaaaaaaaaaaaaaggctaggcgcagtggctcatgcctgtaatcccagcacttttggaaggccgaggcggggggatcgcttgaagccaggagtttgatatcagcctggccaacatgacgaaaccccatctctactaaaaatacaaaatttagccaggtgtggtggcgcgcacctgtaattccagctactcggaaggctgagggaggagaatcgcttgaactcaggagttggaggttgcagtgagctgagactgcactactgcactcctgcctgggcaacagagtgagtgagacttcatctctctttctctctctctctctctctctctctctatatatatatatataaatatatataaatatatattatatatataatatatataaatatatatttatatatataatatatataaatatatatattatatatataaatatatatataatatatatatattatatatatatttatatatatataatatatatatttatatatatattatatatatatttatatatatataatatatatattatatatatataatatatatatatttatatatatatataatatatatatatataaagtaaaataaaagcaatactggcgccagtttcaagagaatgcccacccatctgttgcaccctttctgcaagttagagccattaagcggactttattactctcttgctttctcccagatttcccttactgaagccatttgtaaggatattataccttttaaaacacaaatatatcatacctggtgccagaaagttttttgttttccttaactatattggaaatcacctatttcccaacttgaagactttaataaatattattctcaaagaattttcaaatatagtcattccttggtgtcatgggaaattggttccagaacctccctcagataccaaaatccacagatgctcaagtccctgatgctggtactatatttgcatatgacccacgcacatccccctgtatgcttcaagtcatctttagattacttataatacctaatacaatgtaagtgctatataaatagttgttaacactgtattgtttgggaatcatgacaagaaaaaagtctagacatgttcggtagagacgcaaccatccttttttttttcacagaatattttcagcctgtggttggttgaacccatagatgcggaaccagggatatggaaggctgactgtataactttttggtaaactctaatacaaacttcacaaatgttgcaagcattttttttgtgtgtgtttggatctgtggatcaagtgaagcagacttgtacaaactccggaaattataataatagtagacaaagaatgatgtaaatggaaatgggaaagagactttgtctcagtgagaagagagtaggagagcaggatgtttagcaaggaatctccactccccttccagcccagtaatcataataaatacactgctagttaataaacaagttctgtatatgtggcaaaaagggtggcttgtggtggaaggaagggggaaccagccctaaacactaaacacttcttatgtaaccttaatataaagtaagtaaaaactccagatcctgtattcttaaattatagtaacatttcctacctatattaattgaatggaatgaccaaaattaatgaatttttatttttattgaagaattttgctgtatcacaaattgataccccaaattgaggaattttggtgtattgtaaattagatcatactagaatgttccatacagaggtcactgtagaggcacagatgacttctctgttattaggtggaacgatatgaaattggcatttttaataagttttttaaaagtctgatatttcagcagtttcacagattaatttatatatgccaactaaatatatagatggtaatctaatttttctgtttaactcagtaaaagtaaaagtcaagaatttataatccaaaagatgtttttgccttggtcaaagaaattttgggaatagtttataaaaagatgacagcagaggtcattagtgatttctgtgttagcactgtatttactccctttaaaataaaaattacatactatattgccttccaacacaggcattatatttcagtgtattcctttgccaaaaacaaagataaaccatagaacatatcagtaaataccaaccagctttgaatatgatcccaaaatagacaataactttttcttcagtctgctgtagagcttccaatttgtaaattaaaaacagagcttactgagttgccttaggaaagccttatttaagggaaaaataatgtttcctcctttctttcaggtaatttggcagcaacagtgtttttaagttgctgacattaactagctttgtggcagagtgggtttcagagtttggacttctttctaaatcaggctgtgatgtgtgaaaagttcctctgtaaacttactgagttttatttgtaatagaaatatacattcattcaatagaaatatagcttagatatacaatagaaaggtgactggggtccatagtacttccctgtgtattattgggtgtatacttggtttcttctaactttaaaaggaatatgagaaagatggagaaaatattttatatgtttcaatttgatctcaaattttggggagatttagtgttctctcagtttcattgactatttcttgaggttccagttgagtagtagcttcccaacaagatggactaacaggggtcagttttactttcctgcatgtagcaacaacagaaacagaaatcatatatgaaacaattgttttcaagtcatctgacattagggaatgaaggacaatgatccctgagagatgggaaacaaatgagacaagccctgcacttgccttagtttatcgtctttggagtttctaggctgtgttacagtaagggagaaagcaagtgaaacccagggaactccctcagttgaggagacagagctgagagtccagtaagaccaaagaagagcgggtgtcggcaaattaccatgtgcttttattgtaaataaagttttactggaacacagccacactgtttcatttttatcttgtctgtggccacttttaagctataatcactgagttgagtaacagtaactgagaccatatgacccacaaagcccaaaatatttactattttcaaaccctcacctagagtttgttggatgggatatcaggggagatcttcacagagaaaaaatgctgaagactgcagagggtccttttccagtattcaacagaatactggtgcctctgaggaaactgcagcctaggaaacaaccatctgagtgtcttagagggcacaatggtcacacagagtcaggactagtgacactaacagttactatgactgtattccatatgttcaaaaagttaagtagacttctcaattacttagatctaaatataaaaaactcctaggtgtgaaaaccacagtgtgtgaggagaaagcttcattgcataagactgaagatagattataaattgcagaaaagtaatcccagcactttgggatgccaaagtggaaggattgcttgaggtcaggagttcaatacctgcctagaaatagagtgagaccctgactctaaagaaaacatttgaaaaattagccaggtatggtggtgcatacccttaatcccaggtactcaggaggctgaggtgggaacattgcttgaggccaggaagtcaaggctgcagtgaaccatgattctgtcactgcactccagcctgggcaacagagcaagaccttttctcaaataataataataaaatcaataaataaattgcagaagaaaagattagtgaacttgaagatagagcaagataaagatcttgtttctaaaatgaaacacagaaagaaaataacttaaaaagagtatcactgaactgtgggaaaatatacactaataaacagaatttctgaagaaggggtggtgggacagaagaaataatagccaaaatatttccaaatttgatataaactataaaactgcagatagaaaaaggtcagtaaatcccaagtacaggacaccttaagaaaggcataccaaagtgtattataatcaatttgctcaaaatcattgacaaagagaaaaaaaaatcttaaaagcagccagaggaaaagacatgttacacaccaaggagcaaagataagcagatttttcttttcttttcttttcttttctttttttttttttttttttgagacggagtttcactcttgttgcccaggctagagtgcaatggcgtgatctcagctcactgcagcctctgtctcctgggttcaagtgattcttctgcctcagcttctcaagtagcagggaccacaggcatgcgccaccacgcctggctaatttgttgtatttttagtagagacggggtttttccatgttggtcaggatggcctcaaactcctgacctcagatgatcgtctacctcggcctcccaaagtgttgggattacaggcgtgagccactgcgcccagccagcagatatctttgaagtatggaaagaaaataaccatcaacccagaattatattctgcctttgccccctaaatctctgaagatgaaggcaaaatattagaaatctcagattcatgaaagcttaaagaagttatcagcttcatatgaaatgttaaagggagtccttaaaacagaagaaaactacgtcagcatgaaaggaattaagagcactgggaatggtgaaaaacgtaggtaaatggatgagatatttttctaatttgtaaaaatgtaaataattaaaatttaaaatataattgacttgttttaaaatattgactgttaacagaaaaaaatggcatattgtttttaatatatactgtgtgtgtacctacgcatgtgtgtatatatatgtgtgtacacagtagcataaaggccaggggggtgggaaatggaactatactattgtaagatttttgtaatatatgtgagtggtataatattacctgaaggtaaactgtgataagttaaagatgtacataatgaactcaaaagcaactactaaaataacaaaaacaaaatgttgtatctaatattccaacaaaggaaataaaatggaaacaagcaagagcatgtaattctaaccatatcaatactcattagttataaacggacattctaataaaaaatgagattgtcaaattagatttaaaaagtaagttctaactgtatgctacttataagaaacacactttaaacttggaattgctacattaatatcagactaagtaggacacttcactcaacagcagaatacacattcttttcaagtgtgcagggaatatggaccaatatagggaatcttctcggctctaaaacaaatcccagtaaatttaaaaggtttcaagtcatacaaagtatattccctgaccacaagagttaagtaagaaatgaattacagaaagatctttggaaagtgcacaaatatttggaaactaacacacttttaaatagtccatggttcacagaagaaatctaaagggaattaagaaattatttttgactgaatgagattgaaatcagatatacccatatctttgacaactactcagatttttttacaagtggattgagctattaatacttgggacacgtttgatgaccctcaagaaaattaaaagcccatctccaaagtttccacactgcatgatttcatttatataacattctcaaaatgacaaaattatagagatagataatagattagtggtgcccagggattagggatggggtgggagagaatgtggctatatagagttattacaaggttgatctttgtggtgataggacagttctgtatcttgattgtagtggaggttacaccaatttacacatgtgataaaattgaatagaccctcacacacataaattgagtgtaaaactgtatatgtaaatttcattatatctgaataaagtctctggattgtatcaatggtgattttctgattttgcaactgagtgaaaggtacacagagtatcactgtactattttgcaactttttgtgaatctttaatcatttcaaaataaaaacttgttttcttttaatggtgatagggtcttactctgtcactcagactggagtgcagtgtcttagtcatggttcactgtggcctccaactcctgaacttgagtgatcctcctgcctcagcctcctgagtacctgggactataggctcgcaccatcatgcctggctaattcaaaataaaaaccttaaagaaaaacaggaaattttgtgagatggcactaaatccatactcaagggaaaaattatagggctaatgtttatattataaagggaaaagatctgaaatcaatgacctcagcttccacattgagaaactagacaaagtagaggaaattaatgcaaaacagaaaatacaggaaaaaaggaaaaagatcagagtataaaatcagtgaaacagaaaacataaaaacaatagagaaaaagcaatgaactatggtgtgcttttcttctgcttggggtttatgggattcttggatctgtaggtttgtagttttcatcaaatttggaaatttttatacaattatgtcttcaaatattttttctttcactctctctgtcactttcccttttttggaccccagttttatttacgttgaccacttggtactttcccagcttactgaatttttgttaagattttcttattcttattttcctctctggttttatatagtttttaattctgtatctgtaagtatattaattctttttctttgtgttaatttcattcaatgtattttacatttcggatatcataatttttatctcttgaagttccatttggatcttctttatatcttttattttcctcttccttatctacatgtttgaccatatggaatattatggaaccataggcagcacgacgtgttagaaggcagcagatgagaagtaaaagcaagtgattagaagtaaaagcaactagtacagaatttggtgtcatggaagtcataaaacaatactttgggaattagaaaagagaatcatgagttgaattaataactataaaaagtcttactgtaacctgacttcgaagtagttgtgttcctttgacaaaatcttagtttttattatgctaaagacaattaagtctgttgtgagtttctttctttctttctttcttttttttttttttttttttgagacggggtttctctcccattgcccaggctggagtgtagtggcacgctcttggctcactacaacctctgcctcccggatcaagtgatcctcctgcctcagcctcccaagtagctgggactccaggtgtgtgccaccatgcctggataatttttttatttttagtagggacagggtttcaccatgttggctaggctggtcttgaattctgacctcaagcgatctgcccgcctcggcctcccaaagtgctgggatttcaggagtgagccaccacgcctggcctgtggtgagtttcttctgaatagctgggctgtctattgatttataggctttaaaaaatatgattgctttactaatctcttggccttcacttacattttgtttggcatttacatacaataaagtagataggacttaaaagtggtattgagctttagtagaggagtactaaaattagtagtcagcaacatgattaaggttaaattctagggatcttgattcccaaacaaattttgtactgctggcatacaaatcacaacattgagactagaaagagccaatatttttcattctaatataaagccatgcatttgggtttagaatgaagtcattttaaaagattttactatcctgttgtttcatgagttttgagtccaatgctgatatgttttgtgcatgttgctgttatcaactccactccctgctgcctataaaaaggacaacgatacaaaaagttaaagaaattattggtgttttctaccgtggatattgtcagtgccctggaaaagcaattaaatatgcagcaattttcttatgagctgctccctttcaaatgtcacattagatttaacctaacatcctggattgcattgctgttgtggtatgtgtactgtacatggtggaggtactcaacaatatttccttgcattgtccataataaatatttgcccaagactgggtaggggtggaaggggaagaaagaaatgtttttctcttgtagaggaaacttgtaatgtaggacttatttaaagagtgtttatagtccattgttgtccatagggtgtgtcatactgctctctccaggtctgaaaatctgggatagttaaaatttcacttatttacacttaaacttctcagttgacatatccttccatagagaaatgatttcagtgagacggtgtttttctttaagaaactaaacatttgagacatttagaccctgaatttagccacatgtatgttttataacttggggaatattatgaaattaaagtttcttgttcactgaaaagatgtcagatagctgaatgaaagtaccatcagcaatctgcaaacattgtaaatgatggacttaaagtttgtattagatttccctttttgcatttgtgttcattggttacctacttctccatctcttcgcatagatcttcagacctgtacaatagagttcattgagtttttctgtcattgctggtctcgagatgtttcaacattaaaagttctttccattacaacctaatgatctgtaccctattctgaagctaatcttggcattttctgtcatttgctttagtatttaccagttggggaaaaaaagtgtgcgtgtcgtaccaccatcctgtcataattctttttttttggccagggggagacagggtctcactctcttgcccccaggctggagtgccgtggcatgatcacagatcactacagcctcaacctcccaggctcaggtgattctcgtgcctcagcctcctaagtagctgggactacaggtgtgcaccaccatgcctggctagtttttgtatttttgtagagatgaggttttgtcatgttgcctagactggtctcaaactcctgggctcaaggccagggtcaatccacccacctcaacctcctgtagtgcttggactacaggcatgagccaccacacccagccctgtcataattgttcttaatatagaagtgaaacaaaaggaatgtctctataaagggctgctttttactttttaatgtctttattttacagaattctatgtgatagtagtatctcagtgttccttcagattgttgtatgacttgctatttttcagatacatttgagagtaagcattttttccactgaagctagtcatatttattgcactggattaacaaatttggctgggctaggacattgattctgatagattaaagaaaaagcatctattggttgtaaagcctgtaggctatcagaactctgctcctgatgtcatttatgctatctcacgtaagtttaaggttatttacatacagatactgatatccctcaatgtgtggttttatgattgggtagtggggataggggatgcaggatttggatatatgtttgcccttttcttcaaaaaatgaggagctaaaatagaatggtctgtctgtgcttacctgcagtaatgtaatgggttgatattggcaggagcttgtgggttgatgtggcatcacttccatcactacggttaattgctaataaatgactgactgggaatttaggaggaatgctacaactgtctgctgtgttagtggtaacaggaattctggcgccatttcagggtgactatttgtatttgtctatcagagttagaatacagttgtttctctcagtttcagccttctctatagaatttctgtcaattgtttgactccattaagtgtgcagaggaagtaaaagcctgaatgaccaatccaccaggggctatggatagaccctttctttgtccatactcagagcactgcattaggtctcattatccatttataataagtgacctctgccccctgggtcattgaaaaatattcagtgtgcttttctgacacatagggcacctttctcagcagacacatgaaacaatgggacgtctggtagtctggagaactggtatacattgcaggttttaaaataaatacacagccttgtgccaaattactcttctaatttttttttctctgttcttacatggtttataaatgggccaaggggatcctaatgtctggaaaataaatgtattccttatctcttttctttcttattattctagttttaaaaaattgccgtgtttttccatttattttctagaaatgatttgccttcatctctgattttgcatttcctgatagagaactatagaaagccttggatatagtgaatggagagagttaccgtctttcaaaagtgtttgccaaatctgctcaggatggctctggaggttatctgtgacgtgctcaaaacctgtcttcttctagccctctgttctgcccaaactggtagtaaccaggctggaaaaggatttgacccttccttggtcactgcattccagatttctttcgtggtataaatgtggaccacctgccagaaagctttgcgtatgtacttgttctgtctccagctccaagtgtatagacagacttgggaagagatggagatagaaattgattagtggccaaaataaagatggaaagtaagaaaactgtcatgtccagagctttacatggtgtcaactgaaggacagccttccgcgagttggagtcttgaccaccagtaactaactgtgtggccttagtacagtgcccatgttatatactgatagaagtcagtaatttacttgaaatatgttgggacaggaaaaataaaagactgagaaccacttattttgcaagtcatatgaagaaacgttaagaggcaaattaaaattttaacttatactttattttaattaaagtatttaaaataaatttataaagtataaaaattcttttatagatattttttaaagtttaagatgcaggctttgtattaacaaagccctattccccttagaacttactgatgttgtgtttattgttatatatactggcttgtttattttattaaaaatacatgagctacacagagatttgaagaaactcagtttattacactgaattagctgccatcctgtccaggagacccaggggttttattataacaaaatggttttcctattaagtgatgtactactgcatgctctcagatattgagacacagaggtgttatctccataaaaatgaccattgcatccatgcacagattttttctctccagttatggaaaacctcatagttgttagaactctctccatgacaaggattaatatattaactggattatagcactgtttgacaaattgctcactaaatacatcaaaattgattggaccttctttatttgaattgacaaatggctgcattaggagaaggagggaaatccattaattatagctgctctcgaccataggaaatgtaatcatataaatatggattttgctaaaacaaaaatgtcttctttatggtagtgttgtttatatgtatatctgcatctctttgccattaatagaaggcctgtgcttacttaccatcttttaaataataaaaaattgatttctgtggtgttaaaaggtgtgttctaccctctcctgactatataatagttttttaaatattccagaaaatatcagggaaaccctgtagttcagcctttctgctcagttttcaattgcacctctatttgtccatcttgtgcttctatgttcattgatttcccagataaccttacagatttgtgactgctccagtgtaagtttatatatgacagggcctttacttaggaaacaggaaatccagacactgatggttttgacttccttcacattgttaccttgagtgagtcattgccttctacgcctcaggtttctcatctttataattaagggtgtgaaaatctttttcaactttcagatttggggagatccctgccctagaatctcgtaacttgtccagaaactcatgaaaattcagacccaagacatgttaaaagaggaggaaacaagcagctaggacacctgaagtcaaggtctttgtcttgttacttttttttttttcacattttatgtagcaacaggattttctaatagtttgcaaataattcctgattatacaatagtagaaacaaagcagcctgtgctattctttatggaaaatgtatgtttcataaacatttttaagcgatctttttgaattatttcttatttccaagaatacctagaaatcccttctttcttcaaattaatgtatatatgattttagtttttcctatatgttttaatactttgttttaaattatagtcttgtgtctttagcatagctactttttttttatattgaagcctcttttagctgctgattatgaagctaacatatttaatattatttttgtttctggagttctgactgttccatttatcaaaagttttaattttgctttgatagtgtataagctcttatcattactgagtttctctttctttgaaaaaatttttctctcttgatttttcttactgaaagtaaccagcccagtaaccgaggcataaggttggtgggtgagtgccacagattgtctctctgcagcttcagtctcttcttccccttattgttgtcataggataggagacttttggccatatgattctgtggaacttggcaggggaccagaaacaccatattgccttcagtgcctttatgccatcagtttcttgtcttttatactacgctttctttgtattttatgactttgtgaagaacatctgtaacaaccctatatgatgtgaaatctggtcaaagctgagatttggggattttttgaggatagcgtttttttcttttcttggtcactcggctgatttctgtgctcttttctagatgctagcatgtcatccgtggttgcatcatgtacacctttaaatatgaaaccaacaaaccagtattttctacgatgaaaaattttaatcagaggtattatagtgtatgtaaagtagcactttgattgtttctctcactgcatgtgaagcttccttcaatgtctgtaaccttgtgttgtgacttctggttaaagtaatttttccccattgtttgatcacagtataggtatctctgatcaggatacataactgtttattatgattatagaaaagattatattaagtgaagcagacattgaatagacaaacaacagactctcaatcaatgatataattgacgtttggggataaaaatctcttacatgttttatatgataaatttaacttaaaataatgaacttagtaggtaatgaagtgataaattgaggtgaggtgattttgcttaaggtgaagaatgtgatctttagagtcagcagtcctgaatttgaactctgtctctgctacttgctatctgtacagctttaggcagataacctccccgaactcttttttctccccatctttttttttttttttttttttttttttttttttttttgagacagagtctcgttctgttgcccaggctggagtgcggtggcacaatctcggctcgctgcaagctctgcctcctgggttcacaccattctcctgcctcagcttcccgagtagctgggactacaggcgcccgccatcacgcctggctaattttttgtatttttagtagagatggggtttcactgtgttagccaggatggtcttgatctcctgacctcatgatccgcctgccttggcctcccaaagttctgggattacaggcgtgagccactgcacctggcctctccccgtctttaaaatgggtattaataatacctaccttacaggatcattgttagataatatgagataattgatccaaaaaggcttacccaagagcttggatagaaaaaagaaactcactaatgatagctggtggttgtacttagttgtgtgagaatgaatacccttcttccgtgaggtctttcttgcttctcatgattccacctactttatgacagatactgccaggtggcacaggtgaacatactttgttgtgaagagaaagcgtttgtattatatctcctctgatcttcagtggtcagctggacaagtatggctctaatattgggcacattttcaaagctatagaaagaaattttactggctgggcacggtggctcacacctgtaatcccagcactttgggaggccaagttgggcagatcgcttgagtccaggagttctagaccagcctggccaacatggtgaaaccctgtctctactaaaaacacaaaaattagccgggcgtggtggcgcgtgcctgtaatcccagccactcgggaaggctgaggcaggacaatctcttgaacctaggaaggaaggaaaaaatgagtgggaaagagagaaagtgaaaatgaaagaaagaagggagtgaggaaggaagaaaatgcaggggaaaagaactacctcactttgttatacaagatgaaaataaaatggtatacagtaatgaaagtaaaccagacctaaatatattttttttattatttttatttttattttttgagacagagtcttgctctgtcgcccaggctggagtgcagtggcgcaatcttggctcactgcaagctccccctcccaggttcacgccattctcctgcctcagcctcctgactagctgggactacaggcgcccaccaccacacccggctaatttttttttttttgtgtatttttagtagagacggggtttcaccgtgttagccagtatggtctcgatctcctgacctcatgagccaccccgcttggcctcccagagtgctgggattacaggcgcgagccactgcgcccggccaccagacctaaatgtattaacatggatgatacatatagtgttatgtgggaaaaaaaacctgttctagaaaagtattactatgattttttaaattatcactcactgaatgatcctgaatacttcatgtattccacaccctagccaagaagagtcaagatgactctctgtcagtctgcaggtcaagaaatggttgttcaatcttttgaaacattcataaaatagtttttaaaaaaattattggagaaacgttagacgtacatagtacacagttagttgtataaggaatctaccaattaccaagtttcaacaatttacaacattctaccacaaagtatcctaagaaagtcattcactattgtgtctttttacccatgattcttcactatacatctgattataaagactttttaaagatcacaactccccaccattacgtaaaacaggtgaggcagggacagtgatttgtggagatctctgtttagtagtttgacgttgtggagtaggcaaggaagatcaagcctggaaaatgctcttcttacttttggaaagttaaagaaaaccctgcagtagttgtgggcttgtgttctctgtctcatgctttcccctatcctctcggttttgagaattttctgattaatttagagttaaaatatggaaaacatcatgaatgcttaatgatcatttaagaagattttagattattttcctaactatagggtgaaaatgtttggtgccttccaggtctaaaagcttttgtctctccatgccagggcaactttgcctcttttgcttaggcaagagaaaatctgtatgtaattcttcctgctgcataatgatgtggattttcctagtatgtaactagataataaataaatgaaacatgaaaaaaccacattaagtctttgcaaaaaaaaattatttttgccatttttacatttgcaaacatcaccccccatcctcgcctgcttttttgttgttgtttgtcagggcttagtgtagatgctagactgaatactacattagagcctttgctattcaactgtgccattgtagatggagtcaagaacagtaagttttcaatcactgtcctattgcctacatgtacagatgggtacatcgattactgcacacaatttaatgaccaaaaatagtgattatttacctttacaacatcaatttacagtaggttccatatatgctctactcatcctagtatcttatcaagtatattttagagtgttccttgaatttataatggagaattgattattcctgaaagaaatgcatctaacattcaggtttggctgtgagaataccgttgctactgttgaagcattacaactcataattctacacagaatttagcttaggatgctttcagcaaataatcattcttctgaacaaaaaaacaacgtgtttgagcagttgataaagctggtcctatgtttgatatttgtgtgtataaatacagagataatgataaataaacagatacggagacattatgcataagcaagttagaagtagcacaccccctttaaaaagttactgaatctaaaaatagggggaaaaacacataacccactatgcaataaggtcaacttttattttgtttatcgttttccaacttctgttgatatatatctgatttgtttgcttgcatatattgactatggtgtgctgcaccatctgtatcaattgtattgttcctattccacaacttttaattaaatatgaatttttatatcatgtttattttataaacatgatatacacggtttaaaaggtaacaaaaaatatccagtggaaaataaatcctccgtatctcccaactaacctcatcccctcccaggaggcaactactattagtaatgtattgtattctatactcctgtaaaggtaagctttaataagaatgctcttattgttacatatgagtctggccagattatataacccatgataagacaacagttgttattcacaagctataagcaaggtactttatagttatgatacaattctttaaaatagtgtggacttacttttccagctatcctactgttggtgatttaatgtacatacagtgcagttgtactatcaaatgagttgcactagtgtgagttctagtagaacacattaagtagatattgtgtgtgtctctccaggtagatatgaggggacttcaaaaagtttgtggaaaaagggagttaaaagatacaaattaaaaatataaactttatttctcaagataagccccatcaagttaaagatatttttgtaagcgatgatactagccatttagtccatcctaaaaactgaaggtcctgggaatttaattatgtcaatgctgtcttttttacattaactaaagaaaaatggatgccctttaatgattttttttaagattagaagcaaaaagaagtctgaaggagccaaatgaggactgtgaggtagatgcctcatgatttcccatcaacactctcacagaactgcccttgtttgctgggaggaatgagcaagaatattgttgtggtggagaggactctggtgaagctttcccgggcattttcccaccaaagctttggctaattttctcaaagcattctcataatcaacagatgttattattttctttggccctccagaaagtcaacaaacaaactgcctcaagcatcctaaaaaactgttgccgtgacctttgctcttgcccacttttgctttgactgcaccacttctgccttttggtagccattgctttgattgtgcttcgtctcttggatcctactataacagtaaagccatggtttatttacagttttttgtttttttgttgttttggtttttttttttgaggcagagtcttgctctgtcacccaggctggagtgcggtggcacaatctcggctcactgcagcctttgcctcctgggttcaagcgattctcacgcctcagcctcccgagtagctgggactacaggcacctgccaccacgcttgctaattttttatatttttagtagagacggagtttcaccatgttagccaggatggtctcgatctcttgatctcgtgatccgccacctcggcctcccaaagtgctgggattacaggcatgagccaccatgcccggcctcctgttatagttctttgaagaaatgcttcaggatcttgtttccacttgattaaaatttccattgaaagctttgctgtagtctgcagctgatctgggtgcaatgctttaggcacccattaagtgaaaagtttgctcacctttaatttttcagtcagaattggggaagtggaaccaattgagatatctttggcactggctgtagtttctgctgttaatcattggtcctcttcaattaaggcacaaagaagatgaatttttttcctatcaaattgatatggatggcctggccactgaagacttcatcttcaataccatcttgtcccttcttaaaacgaactatccatttgtaaactgctgatttctctggggcattgtctccataaacttttggtaaagcatcaataatttcaccattcttctacccaagcttgactgtaaatttgacatttgttcttacttcagttttccatgaactttttgaagacccctcctaaactccaccttgtccttaaaatggtttgaccttgcaagtgctttgagaggatggttatagtctgttcacttcttagaagtatattagaggctgggtgtcatggtatacacctgtagttccagctcctcaggaggctgagacaggaggatcacttgaggcccaggaattctaggctatagtgcactatgatgatcatgcctgtgaatagccactgcatgccagcttggtcagcatagcgatacctatctcttaaaaaaaaaaaagtatacttggactgtttgaaatttttccttagtagagtaactgatctggctgatagcatgaacccattatgctttattctttctctccattttatgagatatttagggccactaagaagtaaaactaaattgtgagcccagccagactctccaggggtaatttgtccagatgctaaatgtcaaatgacctcttggtagcaggaacaataaatgaaagctccttagtttatgtcttctgtagtaatattatgatactgtgggggtacagaaaaggagatggggagaaaagatgcacccagagttgtcagtttttcagtgaaatctattagtttatagacagagaagatatatactttttctaattatatattgcctgtgactgttcttctgggaatgtgacataaaaggaaagtgaaaccagagatgtacaatactgactgttagaaaactttaataattaattagagaacatctatggtactacagggtcagggcacaaggaagatcattgatccctataatatataatgtagataaagcttgttcccctttatgtattgttgttgcattggtatagggatggctgctaatcaacagaacagccagtgatattctgtggaattgctttactgctctgtgtattagatttagtgaattcctctacatttaaattgtcacatttataaatcagtgtgaatttaatactacccattttcaagtagttatgtgtgttatttttaatctgaaagggttctccctttttttagtcatttaaaaaatcacactttaatttttgccactttgatatgtatgcaatgataacttgaatcattaaatctccaattactacgatttaaatatgtttgttggatattataattcctcctctgtgaattgcttgttcattgggaactgcctttgttcattttgcttttggattatttgtcttctgaacctttgttttaaaatggcaaattttagtttctatactaagaaactacattcccaagcagaatttcatccttatatcctgagtgctttctgatcagaaacagagtttggtaaatagcccttgcttattgtatggctgctatataaatgctgtttttaataagcaccaaaaatatattgaggtttgtccttgggagagagtttatcactgttggcctttgggtgaactttgagcctgagctgtttcattcaaggcagcatgatgtcatttaactgcaaatttctctgttgctagaaaaaggaatgttgttcctctaaataacctaaacgactgaaaaatgctggcacaacattattcatctctcaggtctccactaaaaactttcacgtgctaagggttttattgtttgtggaggaagggtggggatatggtaaagagtaggagaaaacaaaaactgtgtctggtcctgaatctgaagaattccactgcccatataaaactcagctgccagtaggacccagtaaactcacttgtccagataagagcttttgggtccatctttgatttttcacttataaatcagtgtgagttttaaatttataattaaacttacaaatgcatttaatcttcatttatagatcagtgtgaatttttgaattaagagactctaaatttctatttctatatattcagcctattatcatattttaagtttccaacaaaatcttaaagcaggtaactatatgattatctcacatataaaactaggtaccattagggtcagcatttttatccttaatttgagaagcagatttctctgatagtgatagcattgcaattaatttcaaggagtagaacagcttcttaacatctgctagagttgggaggctggagtttacaaacagtggtacctgtagttgatcagctatgtcctctaaagcttccagagctacagctaagagaatttattactggaaattcaagaaatgtaggaaagggtagaacaagaagaacaaaaccaaaccaaatagacttttccttcattactttcataaataagcactgctcgatgttcattatgctttgtgcttgtttatataaagaggatgcttacaagctgtgtgtagtcttttaacttttacatgcgttggcagttgtttttcattgctttaaatgaaatggtactggatacagatatttttatttttattcttgctttacaaagaaatatttaaatcttataaacttcatttttacaaggtctaatttttttcctgagtatcttaaaccatgtccaatataatgagagtaattaattacctgctctaatgtacagtatatttaatatgttaatgataaatatcttaccttttgtattctaagtagaagactagattagttgcagatgaacttttttgatatctagctgtttctctggggatattttagaaagaatttgattccataaaattgaggttttcttctcattcttttgggggaaaaattgaaatgttaggtttaaatttttctaggaatggtaataactcattctcggaatcctggttcaaattcacctatcctaacctgtattaagtagtgttaaagaactagatatttgaagaaacttaaggatgtcaacttagaggtctgttaatgtttatacctttaatcttgcaattattatttatatactttaatactttgtacctatagtttagcagtatgtaaagcaacacttttaactttctctaaccgataaataccatattttctgtgggtaattttttaaaattctttacacattgattcttgtattaagttgcagaaggcatctaaaaattcaaaaatagaactcttctaagattttgatttgaaaagttatattattaattgactttttggaacattgtgaattttattatataggattcagacctaaggatgttattaaggggacattaatctttcatttcataactttatttatgtgtgtatgtgtatatatatatatatatatatatatatatatatatatatatatttatacagacttggcagtatttttggtttagattaacaggactaattttcaaaggtcagccctaaagcagattggcttttgtttgctttacacatactcacatatgaaaatatataaataggctgaacacagtggctcacacctgtaatctcagcactttgggaggctgaggcaggcggatcatgaggtcaaaagatcgagaccatcctggccaacatggtggaaccccacctctactaaaaatacaaaaattagctgggtgtgtggtgcgcacctgtaatcccagctacttgggaggctgaggcaggagaatcgcttgaacctgggaggcggaggctgcagtgagctgagatcatgctgctgtataccagcctggtgacagagcaagactccatctcaaacaaacaaacaaaaaaaaaaaaaaatatatatatatatatagaaacacacacatgtatacacagaagcccatatattcctataagaaaaataccataagtgattttttagctcttatttactcactataagcatgatttgcttataaatactaaaaacagacaggctcacagttacctcataatgatctactcatcctgcctttgctcgttgatgtatatttagcaaaagcctgtgtgtagaggcagtacttttgaagttgtattctctaaagtaaattgatagtattccctattcagtattttccttttcagtttggcagataaggtgtgtttgaaaattactgtactaagaacatggctagatttatatccttgtaccaagtttattaattatctaaggacagttggtaaatataaaagatactaaacatttttctttagggtagctattttgtatcttggtccattgaacttggatttgcaagatatgtaactttatttttctttaaataaactctattaagttttttttagtacctccattcgaagaaaggtggaaaaattaatctcaatcaattataccacctccaaagttacatctaaattctctagggtgttcagggtataaaagtatgaggtaagggatttggggacattttgtcctaattgtcaccactgacatgtcccatttccccaccagatcattggccattggttcatataggtctctgcagcatccattcttgtttctcatccagctcctgtcagttgtctggactatgtccatattattcttgtacatgtatgaaacattcttctcctctaagctatggagaacatggtaaggttgtcacagacctggctgtacagacacactatgtgcacaccatttctactcttgtaccatgtgggatctcttgccacttcccttaactctgcccaagattgaagacataagttttcaccgccattggtccctaaaacttcttctgggattctgtcgtttcccactcctctttgtgaccctcttttttcccctttctgtctctgccagtctcgctccaatctcagggtatcattcctaatatttgagtggttagaagcatggaaactttgctcttatcatattttctttttatcaaggttgtaaattcttttttccatgtgaacaggtatgtcattccttcccaaggtagtaaacatagaatgttcttcctacctggattgagagaaattttttaatataaataaatgcaagtggtgaaataaaatggatagactttgtcagaggagcaaaagagaggataattctatttaaagaaaaagccaaagaagcattaggtaaagccaaagacacaaataatggtaacccacaattaaaaaacaaaaaaccaaagaagtgacttgggaaatagtagaaggagagatgaaaaagaagcattgaaaaaaatcatgcaagaccaacaagaatccccaaataaatggaagtcaaagattgcagatttacaggaaaagggaagagtaataaagctacccagcctgggtttgcgatagggaaggtacagtttcagggcaggtaaactaaatttgatagtgatgatgaatgtgatggagaatggtgcaactgagccaatgaaaagagcaaaagaagaaacaaagaagaacctgcgccacaaggacaaaaaacagaaaatggtgccagagaccagtagttgagtgcacagatttttaaattcattttaattaggttttaagctgcttttgttttgggacttttaaaacaaaatccaaattaggcctactattcaatgtccacctgcaagaaaggaaaactttcaggccaggtgtggtggttcatgcctgtaatctcagcactttgggaggctaaggcgggtggatcacttgaggttaggagtttgagaccagcctggccaacatggcaaaatcccgtctctactaaaaatacaaaaattagccaggcatggtggcgcacgcctgtaatcccagctactcaggaggctgaggtgggaggatcgcttgaacacaaggtggaggctgcagtgagccgagatcatgccactgcactccagcctgggtaacagagtgagaccctgtgtaaaaaaaaaaaaaaaaaaaaagacccttttcacaagatggcgccgaaagcgaagaaggaagctcctgcccctcctaaagccgaagccaaagcgaaggctttaaaggccaagaaggcagtgttgaaaggtgtccacagccacaaaaagaagaagatccgcacgtcacccaccttccggcagccgaagacactgcgactctggagacagcccaaatatcctcggaagagcgctcccaggagaaacaagcttgaccactatgctatcatcaagtttccgctgaccactgagtctgccatgaagaagacagaagacaacaacacacttgtgttccttgtggatgttaaagccaacaagcaccagattaaacaggctgtgaagaagctctatgacattgatgtggccaaggtcaacaccctgatttggcctgatggagagaagaaggcatatgttcgactggctcctggttacgatgctttggatgttgccaacaaaattgggatcatctaaactgagtccagctgcctaattctgaatatatatatatatatatatatatatatatatatcttttcaccatttaaaaaaaatagaaaggaagcttttttgttgttgtttaacttgtcttttttgttattcacatgagaatttttttgaatgtatagttctatttgtgtaatttcagatgattcaatatcaaaaggaagattcttccatgaaattgcctttgtaatataagaatgtattagtacaaactaagaaaatatatgctatataaaaagagcaaaaacttagtttatttttacctttttgtgcccaaagcatttgagaatgaattttaaactagaatgttggctattgattatgggcccttcccacagataatttatcctgtctcctaggctggccttctgtatttacacaggcagcctggtaacattagaaagaattacttgtcacaaagcttttcaatactatatgtagactgactaaaatcaagagacttactgatttctttgtatgaaagttgtgtgacgctggcaggtcatatctgtaaaacagaagccacctaaggtcatttccaaacacttaaccacctttgactaaaacaacaacaacaacaactacaacaaaaactaagaaaagtattaaatactggtaagctgaacattttagatctgtccctttaacttatgcatatactggcttgatatgtcccccaacatcagccatggaaaacagagcctggctcttctgctataatggccatttatactgaaatttgaggttatagtgaagaatttagaaggataacaagtggacaaaaaaagtaaatcctatgaaaatgatagtacctttctattttaaatttcctaataatttatagctaacttaatctcataataaccatgcttatttcagaattttcttgtctagattttagaaatggcaataagtaactaattattttcctcctaagctctcaaatgaaaaccagtttttcatattttttccttttaaagaataatgtagattctccaaacttttactactgatctattttagaggaatggcagtgagtctactcctgtataatgcagctctcaaattttaatgtgtaataaaatcacctagggatcttgttgaaatgcagattgtaattcagtagggctgggtgggtggagcctgaagttatttatttctaacaagctctgcgagggatgtcaatgttaatggtctgaggaccacatttggaggaacagcgttctggcttggtggtatactgttgggactgttctaaggtattccatactacatattgtaattcctaaaactgtatagagaatccaatactaaatataataggaagaccaacagattttaataaatatattacattaccaattattatgaacagtaatatatctagttgtatgtttaacaccacagtgccaattaatgattaatttattgtgaaaaaaatatgttctcttattgcactcttctttcagacttttcaaaattatttggattatagttagcttctaattataagcttttcctgttttgatgtttgtgcttttacccaatttagtaataaaaatgtatcaaacatggaaaaaatggtgaggcagaggaaggatatttatttgataatgaaaaatattatcccaccagatttattttttatattgcccatcttctgatggcttccaagtatgcttaattagaaaactatttttggtgaaaaaaggggatggaaattcttataatctctttaggattttggggtgcatatttatggtactatttctagatgtatatttggaatctttattacttcctttggaaagttaatgagggcagagaggatctttctcccttctcactgtggaaaattccaaacatacacaaaactagaaaataatagtatagtgagcctccatgtacctatcagccagctataacaatgatcaactaatgaccaatcctgttttcatctgtaattctacctcccaccttcatccctgcactgggttattttgaagctaatcccagacattataatatattatccctattttgatgatggataaataagtgtccagccattctagtgccgttacttacttagtacagaatccaaaactccaaccacccagtaaatacttattgagtacttgttctgtgacacgtactagtctaggctcagcatatataaaacacaacataaacttttggagaaattcacattaggtactagctagttacgtaaggcatggttactcacttctacttaaaaattgctaattgctttccatcatattactcgagctttattaccaaaaaaaaaaaaaaaaaagaagaaaggaaaagcccacagtaatctgctggtcctacttcctttgccttactgacttaaccttccactcacaacatggcttatcccacccaaccacagtggcctcctagctgttacttattccctttatgtttacatctcaaaatctttgtacttaacattcccttggtcacacctctccttcagatatttgcataacatattacctcacctctttaaaatcttctctgccctcatctgctttccagcctctacatattttccatattcacatttttcactagtatttaaggggtgggaatttcaaggatcctcttgttctcttctgtattaagaattaatatagaatttagtggtgggaagataacttagccttttgaaaatatcattacttatcagcctttcaatgtatatcaattatttccaaaagaatgctgaaataatagttattgtgatattcttttcttcttgatataatttgtcatcacaagaatgtaggtgtatgcttttgtgatcatttgtgttttgtacaaatgccaccatgccgcttggctgtagaactatgattttgaagaactagcagctaaaagttttgattactgcagatcttacactttaatactgtgtatgcctctgctgagtaattcactgaattagcatttctcctcttgcagcaagttaagataagctttttgtgagtctgtgtcttttaaaatcttgccctaggttatgctttgtctactttatttgtatctgtttcactaagatacagtttttcaaaatactaccttgttctagcaagagctcagtgaggttggcattctctttcactgcttgggtaagtgtataactctttctgggaacatatattaagaaatttatatatttacatcctctgatttcatatgtaggaatctaactcaaggaaatttttgtatgttgatgtgtatatataaatgtcttttggtggtagaaattatgagggttttcagcttctcattcttttctatttcttccacacttctttaatgatcatctcttactttcttacttttctttctacttacctcccctctttttctctgttcctcccagtacttcattgcttgatttctctgagtattaaaatggtaggccaggcgtggtggttcatgcctgtaatcccagcactctgagagccaaagccagaggatcacttgaggccaggagtttgacaccagcctggtcaacattgtgagatcctgtctctacaaggaagaaaatattgggcaggcattggtagctcatgcctgtagtctcagctacttattagactgaggtgagaagatggtttgagcccagaagtttgaggttacagtgagctatgatcatgccactgtaatccagcatgtgtaacacagcaagatcctatctcttaagaaaaaaaaaaaaaaaaaaagattaaatacaatcatgtatgaggttggggggttatatgggaaatatccgtatctttagctcaactttgctgtgaacctaaaactgctgttaaaaaaaaaaagaagaaaaaaagaaaaaaatacctttagagacatggagacagacagagtgagtgagtcgtagcttccaaagaagagactaagattttgaggagataatatctggttcatattaggaactcagtaaatatttttgaatcattgtattgttttactaagcaaatgttcctatttgaatgaaaaagtaggctgttgtaatttgactatgtcataccacttaagaatcatgaaaactactcaggtatctaagaaagatgatgtatttctctggataaatgaattttttttaggactgaaagcattttttctattaagtgtgcatgtttatgcctagcatttatatgaagctactaaataaactcttttaaagaatcctaatgtcatcccccaatgaatagatttgtcgctgctcttcagtgtacttttgctattagcatatgtagttagttgtttatttcttttattgcaagaagatggcattactaaatttctgtagatattttttaaagtatcttattcctaagaacttcattcttacttgttcaataattgtttgaattgcctttttgctttaaagtattatattttatcttataaattaccatagtatccaaaatggttgtgcccacgtctgtttttccactgcatggaatgaagtggtttaaatctattttctttctcctatagtggttccccctggaagtcctgggcccattactcgacatgggtcttacgacagtttagcttctgaccatagtggacaggaagatgaagaatggctttcccaggtaaaactctgaaatattgagagtattaaagtaaaataaaacagaaatttactgtttttattcttttccttagaggtaaaaggggagaattggtaactctttattggattatcaagaattagttgtctttccatattacaaattactccacaaatattgctgcaggtgtacatatacatattatatatacattatacgtgtgtgtatatatatatatgttagcttccataaacatggcataaaatttgtgtatttttcacacaatccatttaaagccttagggccttggaatcaattaatttattaatttttgagacagagtcttgctctgtcacccaagctggagtgcagtgacacgaccttggctcactgcaacctccaattcctggtttcaagcgattctcatgcctcagcttcttgagtagctgggattacaggcatgcaccaccatgcctggctaatttttgtatttttagtagagaaggggtttcgccatgttggccaggttggtcttgaactcctgacttcaagcaatccacccttcttggcctcccaaagtgctgggattacagacgtgagccactgtggccagccaggagcttggaatttaaataggctctttggaacacattttcatcaggtttaaaataaaagttgaccttgatgaaacagtgaagccactcagcaatctttgggatttgttttgtggagccaacattttccgaagattgagttcatactttcattattggaaatataacattccaccctgcagaaattctgatggtgccttggtttcctttcctaagcccatgtaatgctgcttttagtggtctctaagccagccctacaacattgctgggactgcaggcacgcatcaccatgctggctaatttgttttttttgtttgttttttaatgtagagacaggatctccctatgttgcttaggctggtcttgaactcctgggctcaagcaatcctcctgtgttggcctcccaaagtgctgggattacaggcaagagccaccatgcccagtctccaacagcttcactgaccatccctccccttgccaggtgaagctgtcttcatctcaagggctttgaaataaaagatacttgggcagatgtcaaaatgatgggattacaaatgacttcattacaaatgctgttatgtctgcctcaagtctgacatcattttatgaagctaatgacctatctcaggttaccaatctgacagcttttcatcggacaggtgcctcaaaaatgtggaggccatttgtagtttcatttctttctcaaggagggtagcctgaaaactaaagtctggaaaatcaaaagtaaagtaaactggaaaatcaagcagtgtctaggtaacatgtatttatttcatcacaccaaaaatattcacaggaagttccttgaaggaagttgattcttcagttcctggcatgtggcggtccatcctttcttaatgttaggaagataaagtaaaccccaaatgtgtgttttttccaaaatcaaaatgttgtccaaggaatgctggcagagaaaccactgtccttcacttcaacttttcaattagaaaaaggggtaatgtgtgctgtcagtgtgaaagtatatacaatgtgtttgtccggcacacaacaggagagtgaataggaacatctggccatcgcctcggtgaaattgaacaggcatctgtttacctctgggctctgtgacactgatggttttgagcttaaagtacacagaatgctttatctgtggcctaatttacattgctgaatacaactacttgaatcagaaatcactgtcctcaatctgagcatttttctccctgtgattagtaggaatgtgaatattgttccaaagaccatgatgcttttgcccttttggactcacacagggctacactctgtgaaccttttcagttatgttttgttaagaattaatcaccacaatcagagaaatgtgattaaatataaaagaactcaggacaaaaataaggcatgtgggaagtcaattacataaagtatttgcacaggcatgaatgtaccattgacaagacatttaaactagtttgtatatttagtctctcattcgagttgattatttgtaaaaaaaaaaaaaaatcatgtaatatatatattttcaggtttttccaagtgtcttctacccacttctttgactttataatgtttaataaagtattggcggccgggcgcagtggctcacgcctgtaatcccagcactttgggaggccgaggcaggcggatcaccaggtcaggagaccaagaccatcctggctaacacggtgaaaccccgtctctactaaaaatacaaaaaattagccgggcgtggtggcgggcgcctgtagtcccagctactggggaggctgaggcaggagaatgtagtgaacccaggaggcggagcttgcagtgagcggagatcacgccactgcactccagtctgggcaacagagcgagactccgtctcaaaaaaaaaatgaaataaaataaataaaataaaatattggcaacattccctatcccccccattgagcgtgaaattcataaagcattttggtattactgttttgtagcacatcaaatgcctgtgtcgatatttgtggcagttgagaaaacacactaattaatggtatttggaagacaaaaatctagtttgagagaaaatatataataatgttttcatttaaaagtggattggggtaatattagggcagtataataaatattataatattttattgtggaaataaagtggctttgggcattaaaattatttcagacctttacttttccttggatggttcaagaacaacttcacgtttgtcataagcttgatcctcagtgaaggaattgcttttaatctgtggattaataggtgtagtattcagtgcatgcccacaacatggtaagtactgtctagaatgaatgaaaaggtagaccctacggagctgacactagttatatgaggcaagcaactggtccttttactttcatgtgatttttgtcttgtatatgtgtgtgaggtgtgcatgtgtgtctgtgtatgtatatgtacacaaaatgtatttttggcttatgttgatgaaaagcagtagagggatattttgaatgtctacatcagctgtgattatcatcaccttttaattatgggtgtcctatccctttgccactttaacatgggcttcttgaagaatgtgggtgttaagaggaagaatgggggattgtgaagtctctcaaatcaggatcacaaaccatttaaatcatcattgctactccattccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggtaggaaatgagaattagggagtgatttgaacaaaaggattaatatgttcgtgtgaaatgagcatcatatgtaatatttaggtttccccttttggcacagtatcatgttgcagactacatgtactgttgcacgtaattccctgtcattacttgagatggtatatagggtctcgtgggatcacattacgtgcaataaatacttgcttttcagattatattctccctaaatctaatagtcactgcacttttcaagcaattccactttttgatgctttgcttatatttctaactgcttgaatctgattatgtattcttttcctgatctttctgaagttggcaccacctttcaattaaatttcatctgtgatttttatctaatcctgtatctcccttcttttagattatataaagtttttggatggaaaaacgttggtataaattcaattatagtttatcttctatatttttataatacatgttctctcatccttatttgtaggaatcctaggacaggtgtacaaattatgctttttattattagcttttttttttaattgcaactcagacagttttgacttgcagtctcaagtttgcttagcagtttaatttgttataccaagacttgacacattagggtgcaacagataatgaaggactcagtctaatgtaatataatctcccttttcttgtcttctctttaaaaaaaactctatagtatatcttgaattgaatataaaacaaccctctgacctttttcttgcacaccttttaaaaaatagtgggaaaaaatgttccagttacatagtggaaatacgtttttgtcttctttgtcagtaacaataaaaaatttttataacaagatgaaaattgttgcaaagttggattatgcctgatgtatctgtttagaaaatatgacacatatttactgagtacctgccaggaggtgccaggagataagcctagagtacggccggctgcctacttgggtctgaattgcaactcttcatctcactccctaatcctgctctcacccctattctttgtcatctctattttattttatttattttttattttattttttgagacggagtcttgctctgtcactcaggctggagtgcaatggtgtgatctctgctcactgcaacctctgtctcctgggttcaagcagttctcctgccttaggctcttgagtagctgggatgacaggcgcccgccaccagacccagctaatttttgtattattagtagagacggggtttcaacattttggccaggctggtcttgaactccttacctcaagtgatcctcccgccttggcctcccaaaatgctgggattacaggcatgagtatttttttttttttttttttttttttttgagactgagtcccactctgtcacctgggctggagtgctgtggtgcgatctcagttcactgcaacatctagaatgtattctagcctcctgtattcaagcgattctcctacctcaacctcctgagtagctagtattacaggtatgtggcaccacgcctccctagtttttgtgtttttagtagagatggagtttcactatgttggccaggctggtcttgaactcctgacctcaggtgatctgcccgcctctgcctcccaaagtgtggggactacaggcgtgagccactgcacctggcctcatctctttaaattactccacaaactacctactcaagacagaatctagaggttatccttgaaatctctcctttcacagatgccacatctaattcttcaccaacttatgtcatttctattcaaaatacatctagaaaccttccactcctctccattcctaatgccagcaccctagcaacatctcacagactcctaactgctgtccctttttacatttttgctttcccctgactgatgtatcttcttaaagaatgattcagccaggcgtggtggctcacgcctgtaatcccagcactttgggaggctgaggagggtggatcatgaggtcaggagttcgagaccagcctggccaacatgatgaaaccccatcaaaaccctaccaaaaaaatacaaaaaatacaaaaaattagccgggcatggtggtgcacacctgtgatcccagctactcgggaggctgcggcaggagaattgcttgaacacaggaggcggagatttcagtgagccgagatcgtgccactgcattctagcctgggcaacagagtgagactccgtctcaaaacaacaaacaaaccaacacacaaaaaaagaacgattcatcaagaagaatgtatcttcttttaataccttgtttagtattttttgtttactctgctttgtattttgtttttttcttctctgcattttttttgttccagcataattcctccagctttctaaaaatgacattttttgaccaagatgtcaggtaataatgacagaatacagtgagagtgtcagaccaattttcagtgatgctaattgattaaatatggtctagattaggacctgaagccatgatcagggagtcaattctttgcagtcctcaacttagtgattcagtgtactcgtgtttacaacagtcatttggttatttaaatcttaataataaagcgtttaaaataagtaaccaatttattctcttcacaactatataacacatttagtttttttgctaaaccgtgcacaagacactgtctcattttttttctagtgattgaccagctgctatttataaagccctgtgctgtactttttctgaggatgtctttgccccattgtttcgtggcctcctcagctttctttgttactcttttcctcaggtatagtccttctattaagataattctaactcgcttcttttaaaagcagatatagctacttttcagaatccttaagaattttcctcgcagactttccctttgttaataataataaataactccccaaattttgtttaaatctaaatgactttaaattgtttatgtttgattagaatattatcctgtttacaggacacatataacctttagaaacctttatactgagcagcaggtttataaatttctgttaattgcatttgtaatttatattttaaactttcagcaggtaagcttggttgggaccttggctaagaccctacagcagtttttatgggaaatatagattttattcacatcaattttaagtcctttttagtaccaccatttcccacccggcatccaattagaaacccaactattgagattctcctcattctcgtttatgatcactctagcccagctccttgtctctcatctgatttctacacgcctgtgcatggtggcctatggccgaccattggctttactttctctcttaaattgtgaagtccttgtttagattttttggggctcacctgacccttgacacctagtacactgtcctgtaccccataggataccaataataatatgtagtgcagtgataatcttcctccctgccgcctaaccaaaatgggaaacaggcaggcatagtgttgactctcatccataagggaatcaggcaagctccctacacagagcaggtgtttaaaaagaatgggcaatgaaatatttgctaacagacctgagaaacatataatgtaaaagatgctgagtatgcaaagcctctctttccactcgattagctcctcagaaattggttatcatttattttattttatttaactgagatataattcacataacatgaaatttaccagttttaaaatgtacaagtcagtgggttttagtatattcactatgtttggcatccatcccactaatttcagaacgtttccatcatcccaaccagtttttctctttttttaattatgaagaaaattcaaacatgtataaaataaaaagaaaaatagcataaacccccatatatctgttgtccagcttcagctatcaagtcatggccaatcttgcttcatctgtagccccattcacaccctacctccaactctggattattcagaaaccccaatataaattgactaactataggagttgtattagcccacataggaagttgtttagactagaagggggcataattttgaatggactgaccatatctaagaggctagctttttgttgctctcaagaacaaggaaacttcttttccagacactttaaataaacttctcttttctaactggcccacattagcttaggcttacctatcccctaactaaccactgccgagatgtgatgagattaccatgattggcttagaaaaattagctggggtggaatgaatattgggtagtcctacatagcagtgatcaatatttgttaatcagtattttcaccttccggtaatagatcatcctatacctccctcctgttttttcttcctcacaacaaaagcatgcatttcataactagtctgcagttcatacttggcatttcaggcttctgtcatctgtcccatgtttcttatcaactttttatcttccatcaatagcctttatgaactctatacttcagccaaatcatgcacttcaagatgccctgaatctatcgtattcagtcactaatctaagtttctatatgttgtagtcctgtgcttaaagggcatttcttgctcctcttcattatgcgtatatactattactatatacagacctaatccctgttccagctctgcaagatctctaactgatgtggaccctgcatgtattcccccatctcctcaatctgagcttttactatttatgtcattcatatttacactttagttttattttgcattgtcatgaatgttcatgtgctatgtcatatatatacacattggtctgtattttatgttttgtttctgcttgttctcagagtaatgcctacaagcaattaatattcagtaaatacttactgtatgaatgaattaccagaaatgcatgcatatattgttgtaataagtttttgtttcactaagttgcctgggactttcagatcttttaatcttccagatacttttatgttaatagtatttattctaatgcagctagaaagagacactcggcatttggcatttatatgtttattattcttttttttttttttttgagacggagtcttgctctgtcacccaggctggagtgcagtggcacgatcttggctcattgcaacctctggtttttgggttccagcagttctcctgcctcagcctcttgagtagctgggactataggtgcatgccaccacacccggctaatttttgcatttttagtagagacggggcttcaccgtgttagccaggatggatgtttattattcttaagcaactttaaattgtgtgtagtaatttgcacgtttactgaggttctaattgattgttgtatgctagttggtaattttataaaggtagctcagttagtagtgacccaccccggccacagtacatctttgttatcctatgcttactgtcagatataaagtaactttcattgagcattttaatggagcatctcaaaatttgaaattacacattgctgccttttatggaacacattaatagctatggtgatattagtgaatttcaggattctcaaaactcttcatgtgtgtcccttggaaatcccaaaggtttcagtataaacattttcagtgtttaatttcctctcccattctacttattgtatccctttaaattaatgtcagcttttcagtcccttccttaaaaatctatggaataacacacaaagataagttagaaggggtccagagtgtagagaatatttgtagtgttttatccttgtgcagcaattagggactgcagctcccctgtttgtcttgttttagaatggatggttctttaatggattgtgctactccagcattcctgatttaaggtcatttgtagcaagtgacagttttgatgccagtaacatatgtgaattaaattaaattgcattgcaggatccagccagtccgctctgaccccgtcagcatgccagggtcatcccgtccagtctctgatcgaaggggagtttccacagtgattgatgctgcctcaggtagaaaaccacctctgaaatatttattgggcagtcctgtgcatttttaactaattttctcgcacaatgtagaggatgacatttatttgctttcctctctgtttttttgttttgtggtgtgtgtgcattttaatacagtactgtgcctatatttcttgctgaacaatgccatgcttttaagcattcctaaggttggtgaatgatgcagtggagttggcacttgattaaatgtaatgaacatagtattgaaggctacagggttgatgactgttttgcctttgatcactgaaatgtggagaagcaaccttgacagagaacgtaaatacaatctatggattcaatttactcaacctgttgagtatcaaagtgcctaatctgtgggagtagagaggagacagtccaaatgctatagcttgaatgattttattatcaaaagcatcaagtttaaaaattcattaacttaaccctggtctatctatcacagttattaatttcctatccttggaaacaagctatgaatatgtatcattagtacagagaaggagatctttgcctttataggtgatcgttgctccattagtattataaaacttttcagccaggcctactaaatggtagaattgtctgtagtgatatattttctcgtctctaagtcaagtgataaaataaggacagtgatgccttgctttatagtgcagctggggagcatctgaagacagcgcatggcaggattttgtccaaaaattctctctcaagtagaattattaaatactcggcgttagtcaaacagttgagtcagagaggattttaatctatagcgatttcaaaatccctagagactgctgatttgattgaggcttaaactgtgaaagaaaatggaaacaaacacaaaactgatttgtgaaggtcactttaaaaagaccaaagtttctgtctgtggatatggatatatttttaagtttcaaagctaatgggttttatacatattcttagctttctgattttttggttagtggattgtaccttgcatcttactgagctgccccatctagggctatgccttcatttttaacgtagactattactttagaggactcatacttgttcctactgctttaacttggcaaccatggttgtcccctggaaatgagcatggaaatgtgtagagtcgctatcattgcttcccggcactgaatgagatatcgagatagggaacttaaacaataaatcttttttatagtcacattctgagaatgctaagagattgttgtgctcgtttggaatgatcgtttacaattgtgaatcctggaaatgttacatattttaatctgaagtattttattcaagattacaagagtaggccttgattgggctttttaaaccttcttaaactaccagattactgatgttttattgtcgagtgactagctactaggaacacatgctgccaaagcagttaccttgtgttattaaaagtagacatattcaatactagattctgaggtaacactccatatatatatatttattttttatttttttgagacagagtctcccactgtcacccatgctggagtgcagtggcacgatcttggctcactgcagcctctgcctcccaggttcaagcaattctcctatctcggcttcccgagtagctgagactacaggcacctacctgacaccacacccagctagtttttgtatttttagtagagatggggtttcaccttgttggtcaggctagtcttgaactcctgacctcaggtgatccacctgcctcagcctcccaaagtgttgggattacaggcatgagccactgcgtctggccaacattccatatttatcatgtagcaatcttagctgtatgtaaagtcatctcatgcaacaagggaggagcttcagtgaactgttatttaaatccttttgcaagaagagtttttaagttgacttttgaataaggaattagatcctacatgtaaataatctgatatgtaagtagtcctaagattacttaatttgcatcagagatacactgtatgagtttcgatggcattgaccctctctgcctgaaagtacccatcttttgagtaggaaagaacttcttggtggctaagctttattattatttttctaggcctgttttcattccaggaagccatggtacctttctgaaagacaaccaaaacagtgaaacatgtgtgctgccttctttaactttgagctaaagaagcctcatagataaggaattggacttttatgagtaattctctcttcagctacctctcaattggttcagatcccttttgaatgagaaatatatgttaacgcattttttgagtgaataatgttttgtcgtggaatgtccatctactttaataggaccaactgttgtcaacagaattactttctacatctgtggaaaacaacatctaggctaacaaaaatcaaggtagcaagtctaacgaaatcgaggctaaataatttgagttctttatgtaaacatatttatgggaaaattttgttgtagattcttctgttaaaaagaatctaataaatttttataattgctcttgaaccgggaagtgcacctctgattatgatccatgcattggagtcagctgcacatcaggaagttgcttatctggaggtttcattgcctgttacttggagatacgaccagtgtggcacctcctctgttggtcttcattgccctgtattaccttcaagcattttatatgacttcatggattatcttcttaattattcctatggcacatgttacacctaaccctctattttagtgacagctcttgctctgtctaaccttgtggcagtataattgtttttcatataattactttattcacagataatagaatttaatgtgatataattaaatcctttgacaattataacagtttttaaagtgaaaatattttatttaaatcttgggtctgcagtttattttctagatatctatgtattaatccaacaacgttattccattgaaactaaaagaggtgtgcagagtgtgccacttttaccatgtaatggtttttttcacaatttcttaatatctggtaatctctggttcatgcttttgcaaagaaacacattgcctaaaatacatatttttaaattattaacttcagtgatttaagcaccgggtaaattctatgcctttagacacctatgaactagattcttactgtctctctgtaaaatacatatagagtatttttgattttcagcagttctataactgcttgatgagtagatgttattcccataacatctgtctcatcttgtctttggtgattctaatgacaccataccagctgggcgcagtggatcacaactataatcctagcactttgggaggccgaagcggtggatcacttgaggtcaggtgtttgagaccagcctggctaacatggcaaaaccccgtccctaataaaaatacaaaaattagctgggcatggtttcacatggctgtaatcccagctactcaggaggctgaggcacaagaattgcttgaacccgggaggcagaggttgcagtgagctgagattgcaccagtgcactctagcctgggtgaccgagcaaggctctgtctcaaaaagacaaaacaaaacgaaacaaaacaaaaaccatcctacctaaaatttgtgggggttaaataattgtaagatgttccattgttggctgaggagatcattttggaaatggacacattataggattttaacctaagacacaggctacccagaacaaatgggatttggggcagttgctcactttttcccatatccagctgatgaacaacaatgtcgatgaatcattgatagtatttctagccaaagcactgcatcaatttattcattttcctgtatgttcattttggctagatagctaagaatttctttctattctttgtaccttataacctgtgcccttcttttgataaagatgtaggacctctaaagagaaagcagaaagacagctgtcaatgtcttgttggaactttgttttccagattgctgactattcttgttccaaaacttgaaggctatacctaatagataacctttccttgcttctgagtcatcaaatcaaagagcctagaaagatctggttcacccctgagtttgtttgtcctgatttgtggttttactatggagatggatgtttactaacaaagaactcagataattgagatcgaaagacaaacttatgcgtgactcatatgcagagcagacatctttatcaaactctattaaagaaaacattttataaagttatgaggtgtggtggaagcagtgtttgtgtacatgcctgaggaagtgtggtggaagcagtgtttgtgtacatgcctgaggaagatggtagtgtgagaaggacaatgtgacagataagaaaaatgacttcttatcctgagcagccttggatcataaggtattagtgttacatcaagcatttcagtaaatagggacaaagttgcagacttggggttttttgttgttcttgactcaagagaaatactacttttgttgtacaattgaagtaataaaaataattaatttaggagataccttttgagcacctaattttctccactatcaaatactgtttactgaagaaaattacacacttaaaatcccaaactagtttgatttgattgattttataatgatcatttatgcctactttatgtatttggcatttggtatatcaccttaaaaaaacaaataatactcattaatagagaagtgtgattagataggtgacaaggaggttatttgagcagtttttgttttgtcttgcagtcaaatctgtgctggaaggaccttcttatagaggcattcttttatcatatagagattttgttcatggactgggggaagagtattctttttttttttttcttcgagacggagtttcactcttttttttttttttttttttttttttttttttttttttgagacggagtctcgctgtgtcacccaggctggagtgcaatggcacgatctcagctcactgcaacctccgcctcctgggttcaagccattctcctgcctcagcctcccaagtagctggaattaacaggcacgcgccaccacgcccggctaattttttgtatttttagtagagtcggggtttcaccatgttggctaggctagtctcgaacttctgacctcaggtgatccacccacctcggcctcccaaagtgctgggattacaggcatgaaccaccgcgcccaacctgggggaagagtattctaagattatatttcactgtattgacagttgccatttcaatctgaggcctacttaggtactatttcttaaaggctgtcagaggcatagagatgctgatggtaaaaataaagagattagtgagagacattgttcagtctacaatgatgtggccacatagctccatggtcttagagctagaactgagtggaaaaagccatgacttcataatcatggtcttgaacttttgctgaaaccttcaagtcattctcctaccatgccattcacttctacatcagtaaaagaagattaagagtccctatgcaaaactttttttaccaccttttgtggaaggggtgtgttcaaattatttccttaagtaactcctgaatataaagttcttcagaaatattaagatattttttgaataaatgatgtgattttcaattaatagagtttcagatattcttgatgattataaagtgacaaaaactccagggcatataccttgggtactgaaagcttgtgtgggatcagtaagaagattaaggataagagtgaaattaaaagaaggctcagccctgacctgtgaacaatccctcagaggggaaaaaatattcaaactcaaatattaagattggcttttatattagaaatgagtaagtgtatacattaaattaattctaatctttcgactatctgctgtctatataaaatcaaaagtaagttttagagattaagaacatagggaaaagaccttatttgcccataaggaaaatgctcagctgtatctctcctcttctgatttaaacattcctcttattcttctttctttctttctttcttttttttgagatggagtctcactgtgttgcccaggctggagtgcagtggcgtgatcttggctcactgcaacctctgcctctcgggttcaagcgattctcctgcctcagcctcccgagtagctgggattacaggcatgtgccaccatgcccagctaacttttgtattttagtagagatggggtgtcaccatgttggtcaggctggtctcagactcctgacctcgcgatccacatgcctcggcctcccaaagtgctgggattacaggcgtgagccaccgtgcctggccctttcttctttctagtatttataggatgttagaagaccaaagtcaagttaacaatgaggaaaattttagttcagcacaattaagaaaaaatgatagccccatttgaagatgaagaaacagtaaacaaaagtagaagaagctattgggaaagtgtcttctgatgacacattgcttctttgaataaatctttgtgtcaactaaaaccttgcctatgctttctatattgcaagcatcaggtccttgacatggctttaaatctttcctaagcattttgagagggaattgatgcaatacttctcactgttgatatagtagggttccacatatttacatgggactttttgaccaaagacccaacttttcacttttgtacatttactgtgcctctcatacagggctggactgtttatgtagtctgttgcatcacactatggtggcagggggacagagttgggggcactattagaatttgtttaagtctgaaccgggaattccatttgtcttagtgacatgagtgtcaaaactgttagtgcaacactattttaaactgtctgcaagagcctgagaggcttatgcttataggtgccatctataaacttagaaacaaacaaagagcccctctccattgaatagtaagcccagtgggcaattaaagaacagcttgggaccccacttggtcaactagtcagaaccagagcttctgatattccctctggatattgttgagaactgtcacagaaaggctaaagtaaataatcaaaatgaaaatagttgttccagagaaaagtcttgttctggaagcttggtgttaaggaaagaataatgaccactaatttgtggatctttgttagttctagtctcagcggagtccctttcagcttgaaacatggatgaacctgtgttttcaagcacctctgaagatgtttttaaaattagggtataatttgggtatagcaaaaatgcatgttttaatcatacagcttgatgaatttttatactcagccaccactcacataaaaacatagaatatttccgtcaacccagaaagtttcttatgccccttccagttaatactaccagtgacctagaggtaaccatttttatcatcacagattacctttacctgtattaaacttcatatgattggaatcatcttgtgtctgtgcttttgtatctaacctcttttgctcaacttaatttgtttgagattcatccaggtattacatgaatcactagttcatttttaatattgcagtgtagtgttccattcttcaaatataccacactttatatatccaatattctgtcatttccagcttttggctattaggaataaagctgctataaacatttttttataagtctgtctgtctgtctctctctctctctctgtctctcgtcaacatatgcatacatttcctttgggcatatccctagtactggaattgccggatcacaaagtaggcatatgtttaactttattaggaactgccaacacgttttccaaaatgactgtaccattttgcattcctatcagcaatgcatgagcgttccagttgctccacattctcatcaacacttgatattattgatctttattttaaccattccagtggatgtgaactatggtttgaatttgcttttctctgttgagtaatggtattgagcatctttaatatactcattggccatttggatatcatcttttgtaatgtcctagttaactcactgatttttattagatatgttgtctttattgaataccaagtgttctttaaatattctggatatggtccttttgtgagatatgtgcattgcaaatattttctttcagttaattgcgttttcactttcttaatggtatcttttgacaagcaaaaatctaattttttcattgttttttccttttatgttttcacaaacaaaaaaaatcttttgtccagtcttttttttttttttttttttttttgagacagagtctcagtctgtcactgaggctggagtgcagtggcatgatctcggctcactgcaacttccgtctcccaggttcaaagtgattatcctgcctcagcctcccaagtagctgggactacaggtgcccactaccacgcccagctaattttttgtatttttagtagagatgaggtttcatcatgttggccaggctggtctcgagctcctgacctcaggtgatctgcctgcctcggcctcccaaagtgctgggattacaagtataagccaccatgcccagcccctccagtcttgaagagataactcttttctagaaattgtatagtttaagccttcacatttaggactatgatccttttcaaattaattttttattgtgggtggtcaagtgtggtggcttatgcctataatcccaccttgggaggcccaagtgggcagattgcatgagcttaggagtttgagaccagcctgggcaacacagcaaaactctgtctgtacaaaaagtacaaaaattagccaggcatggtggtgcacaactgttgtcccagctacttaggaggctgagatgggaggatcacttaagcctgggaggttgaggctgcagtgagctgtgatcacgccactgcactctagcctaggtggcagagcaagaccttgtttaacaaacaaaaaaaaattttattttgatgtagggcagggatcaaggtgtttagtttcttccggttgctcccacattgtttatcaaaaagatacgcctttcctattatgaattgcactgatgcctttttaaaatttttattttttcttgggttctttattctgttacattgatttatatagctgtctttttacccacattgtactaccttaattactgtagatgtttagtaagttttgaagtctcatattttaaggcctccacctttgtttttcattctggttatcttggctattctggggcctttgcatttccacacatgtgcatttgtacgaacataccagtggtttttcaaactctgggaattcccaagacactttcaagtggtctattaagtcaaaattatttttatactagtatcaagttattatttgcctttgttttttctactgtggtgaaatttagtatagatggtgcagaagcaattgtgggtaaaactggtggcctgttatcatagtaaaggcaatggcacctaactattgctagtagcctctgctacctacttaagagttcttttttaagctgtattcacctaagaatatctttaaagcagtaaaaatcatcaactttaattttattaagttttgatccttgtgtaacatcttaatattctgtatatcaagtgggaatgaatgcacagtagttgtcttgagggaaagccattgtgatttgtaaactgaactagcaactgttttcatggaatcccattttatctgaataaaacaaactatgtttattcagacatgggcatttggcagaaattttctcaaaaataagcaaaccctgtcacttcgaagaaaacaactaacaatatttattaccaataataacattctagctttcaattgaaaattagaaatttgaaaaccttgtatccaccactgtctgtttaacagagtcccaatatttaaagacatttctcggccggacacgatggcacacgcgtataatcccagtactttgggaggccaaggcgggtggatcacctgaggttagttcaagaccagcctgaccaacatggtgaaaccctgtctctactaaatacaaaaaattagctgggtgtggtggtgcatgcttgtaagcccagctacttgggaggctaaggcaggagaatcgcttgaacccgggaggcagaggttgcagtgagccaagatcgtgccattgcactccagcctgggcaacaagagtgaaactctgtcttaaaaaaaaaatttctcattaaataagtagtgatattaactaatatgattttttgcataatagatattaaaatatatcagcatttggaacatctgcaacattttccgaatgaccagtttcatgttgctacaaaatcatgcaagagtaaaggactcattccaaatgcaagataggacaaaggattttaatgtaatagaatatgaaagttaattgatatagtttcagattccacattgcaactaatttgttaaggatcatatcaaggaagaatatccccagaacctgaaaatgctattaatatactttatcttttagcagttacgtatttgagttagaccaacttttcttcgtgtacgtcaaccaaaacagcatatcagaacagatagaatgcaatagcagatatgagaatctagctgttgtctattagaggattttctcttaaaaatgttacttttctcacttctttctgtttagaaaatatttttatatagaatgtaattgatatttctacatagaggctttatcattgtttttaaattagctgatacataattgtattaaatgttgatagatatagtacatataaaccaaagatctttggggtcctgggttttttgttgttgttgtcgtttgtttgtttttttgagacaacctcactttgtcatccaggttggagtgtggtggtgcaatctcggttcattgcaacctctgcctccaggttcaagtgcttctcctgcctcagcctcccgagtagctgggactccaggcatgcaccaccatgcccggctaatttttgtatttttagtagagacaaggtttcaccatgttggccaggctggtcttgaacttctgagctcaagtgatctgcccaccttggcttcccaaagtgctgggattacaggtattagccaccgcacctgactggggtcctgagtttttttaagcacactgggatcctgaattttaaaatgtttgaaaaccactggtatgcatattctcgtacacacacacacacacacacacacacacattaaattactagtttgtttgtttatttctacagaaattcagatgagattggattgggatttcattgaatctgtatatcaaatttggaagtattgacatcttaaaaatactaaatctttcaaaacaagcttttttaattttttgagatggagtcttactctgttgtccaggctggagtgcagtggtgtgatatcggttcactgcaacctccacctccagggttcaagcgattcttgtgcctcagcctctgagtagctgagattacaggcaaaacataaacttttataactattcacttatttaagccttctttaatttctccttgataagtttcaatgtagaagtcttacacatcttatataaaagttttttctttctattattacattttgatgataactatagcacgtttttatttcacttgtcagttttctttacagcatatagagtaaaatacttttctgtataataaacttgtatcccagcctgggcaatatagtcagacctcgtctctacaaaaaaaaaaatttttaaattagctgagtatggtggtatgcacctgtagtcttagctacctgggaggctgaggtgggaggattgcttgagcccaggaggttgaggctacagtgagccaaggctgcatcactgcactctagcctgggtgacagaggggaaaccctgtctcaaaacaaaaaatgaacttgtttccagcaacttttccaaattcgtttattcattctaatagtagaatctcttggattttctactatgtaatcatgtcatctgcaaataaagatggttttatttctttttaatctttatctttctcccatattacacttgtttaaacctccactacgatgttgaatagaaatgatgatattgaatattcttgttttcttctcaaccctaggaggaagggtttattatttcactatgaagtataatgacaataagcaaaaatttatcaaaactgaagcagagagagaaaaatactgaaataaaatagaactcactgtgagcggtatatcaaactatagcagtatcaaactgtctaacatctgtgtaattatttcacatatgtggaagaaaagaagaggatatggcaaaagaaatgcatgaagggttgagaattttccaaagttaatgaaagacataagtcaaagttttaagaaactcagtgtatgctgagtgagatattaataaacacaaagaaaaccatacgtagacatattataatcaaactgttcagatctaaacataaggaaggaattttaagaagcctactctgtttctttatttgtttttttcttttttcttttttgagactgagtctcgctctgtcacccaggctggagtgcagtggcgcaatctcggctcactgcaagctccacctcccgggttcatgccattctcttgcctcagcctcccgagtagctgggactacaggcgcccgccaccacgcctggctaattttttgtatttttaatagagacgggatttcaccatgttagccaggatggtctcgatctcctgaccttgtgatccgcctgcctcggcctcccaaagtgctgggattagccactgtgaccagcctctttatttcttaggtttatatttaagtgatggtttggacttttgataaaaagagaaattggaaaagtagcagggtgatttttaagtttccttggcagtgtgagatccccatgtctgaataatcaagaggctctatgaggaatcttcaggatatttttcaatagacagaagtaaaagagatgggaaaccagtattaatttataaacagttaggtgcccaacactgtgctaggtcttgccacatgtctcatctcatttaatcttctttaattaggatcaaggtccattttagcaatagtcaaagaacaggacttaggacacctagctcctgatacttaaaattacttaaagtgcattatggtgacacctcagataagtctaaacctctttctaccctgcctaatcaaatattcatttcaaaacactgtatgctgaaatgagccacgtgggagttgaagagaatcaactattcaggtggtgaaaatgtgtgaatgcagctggcagatgaagttccagtgtgatgaattcccagcttgtccttattgctttaggcaacaactgacaggcctgactggtcattggctttccattcctggcattgatatgactgaaaattcttaatgtcacagatccttaaaagctgtctctgttatcatggatataaatggtgctggagggtccttcttgcatagagaggtaatcaatatggtctagagttcttgacctgaacctgtaattacttggacattttgaaggtagcttgttgttacagaatattcatatattcagaacattgggactgagttgtgcatggagaggagaaaaatagagtctttgtccccctttctgttcttagtatttaagaggccttcataatcacagaagagagtgatattataggattagaacattgtatttttggttttgggtgctgaagttctaatcttacctctgaagtgatcctgatattttgccaaagttgtgactttaatattctgtggcttgtaattgtgatttttctaataccagagtagaattctggggaggaatttttctaaacccaaatacctcaatttgaagtgaggcttggctttaaataataacacatttgagtttgagcttttcctgcaattaagtggtatgctgcaaaaaggaattcggttagcagattttatggcatccatgatccatggacaagagtgagtagaaggagatgatactgatagcaattcttaagtctctaaatgtttttacgttgttgtgatcaggatttctttgccaaatgaaaacggtaaaagtggaagcatgaaacaccttaacagtaggtgtggatcctgattgttctgttactgcttggcttaagatacccctggatgggctgggtgtggtggctcacacctgtaataccagcactttgggaggccgaggcaggtgatcaccaggtcaggagatcgagatcatcctggctaacacggtgaaaccccatctctactaaaaatacgaaaaattagccgggcatggtggcgcacacctgtagtcccagctactcaggaggctgaggcaggagaatgtcatgaacctgggaggcggagctcacagtgagctgagatcgcaccattgcactccagcctgggtgacagagtgagactctgtctcaaaaaaaataaaagatactcctggatggcattattattggattaccttatatgtagcatgcttagaacagagggggaaaaatgatggcttataataaaggactgtttgagaacaagggctgtctttgtatctccctttgcctggtattggtaccttccacagagcagataatcaatatttcttgatatctgattaataatgatagtcagtgatgattaataatgatagtcagtgataatcaacaatgataaccattgttgatttcttataaaacataaggctttaaatatcataacatgattacaagttggtaatgctgagtctttatcttcgttacctgacttaaacctggtcctcagttaggtttgcccttatgttatgatcactattcctttgtatgggcctatggtcaattgtgtaatcaagtgaaatattttacaaagcatttcaaattatcttttatgttatgcttttaaagcagcattatgtttaaacagaatatttctttgatacaagctttcgttctattaggcttagcatggaaatttttgttttaaggttatctttataaagcattaactctagcgaagtcttgctttctggaatctatggtcaggactggtaaacatctgttgaaaagaatggacaggcttttgctttctgctcttactaggctaactttcagacataattttagggatattttgggctgcctttgaagctagcccattttgggcataggacattggcatatggagaactgaccctaagttccattaagccaaaacattttgttgaagaatttccaaaattttagtggtgtcattacagtttagttacttgtacttatgctctagacagctacaagaaacatggtagaattgacttctgttgtatgaagtggcgtcttgagtcttaaacctattttactttggtgttctacaatatttggaaaggcaacagttattatataaatgttcaatgttaagactgtagagaacactaagttacacttgacacttagttgaactccccagtcagttatcccttctttagatgagtttatgtagttctcaaatgaatgcttgtaagactgggaacagaacccatttactcttctgtttctctctacctaaagaggaaatagcgaaccctatgatcttctatttgggctaccttttccttttcctatgttagaaattcatagccatgagtcagtacctcaaattagagtttttatagccatgagagggacccagttcctgaatcagacggcttaagccagagagaacttactatggtgcctgacacttttcatttctcttgaaacatgttcttaatctttctctttattccaactcacccccttgattaaattaattactttctcatgtgttcttaaacttttactgttatgtgtaccatctgatattaaaattagttgggtattgtttttcattctagactatgagctcatctttgtactccccgtagctccctgaatggttttgacacataataggcactcagcaaatgttaatgaattcaatatttcatcatggaacattgaaaccaagttcttgcatttgcctggaacagtaattacctcctcaaagagaaactgtgtggctagggagcagaagtgacaaggagaccatctttccactagagtcctttacaacacggccctgcattatccatgcaaacataaattaaactctgtttttaacaacatactttttagattttttgttttcaacagttgaagatgctgaggttaagagatttaaataacttgtctactgtcacagagctagtagatggtagagcaaaggtgtgaatctgtgaaaccttcattttttcccggaccttgaacagcatctcagccaaccttgatttcattcatataatcatcagggcatgtatgtgacctaagaactatttatatttattctttttatcatatactgttgtatcatagaggacacaaaatacatcacctccactctggaatggcacctctattttaaaagaccattggcaaaacctctccgatgagattttgatgatggaagaatgttatattcaagactcacctaactatacctgcatctcacagatacttatcctttaagcagtaaacagttattttcagctaggaaagccactctcaatcaggtagtggtttcttaagctgaaaaaggctttccacttaagaatcgtgataggccaaggtcattacctttccgtctacttatgggaaaattcaaactaaaggaataccagtgtttgaaactcacaattcactctatagtggggagtgggggagtgcaaggcaagcaaagtgattatatttcccttagaaatattgttaactattttttcaaaatatggattaaagcttaaaacatacccaaaatacactgattctaaatggacctgacaccttgatcttcaatcatggaataacatatgagtgaggattcccaatggaccattgtacactacaatatttattactataaagatctaagagctcttagccactttcaaacttttaagagttgttcagctctcatcctcttgacttgtgttttcacattttaaaattctggtttgttttgtgtgatgtattcagaattacctccctaccttgatttcagaataatatttggctttttaataaatttaaggaagtgcagatatgaaagtatacccattaatgcatggggactgcagtacctttaactggcccatttttggcctctgtttatccatctgcaaaacggtgactaggttttgccttctagttagttgatatgataaaaatactaataaattgaaaggctgtgggatgatacctttatcagttccttctatggatggtgtaattttcactgtagtttactttagcatatatggtctcaagaataaaaataaggaattactaaggaacctcctgaatgcaatactattaacattcacaaaaatagctatatgcaaattagtagatgtccttagctgagacaaaattattttgaggttgtgatcatgaaaattaacgtaagctgatataattttgaattgtatgcatctgttttcatgaaagaaacctatttggagaggtttattcttgaaaaattatggaattaaaagttaaataggattcttaacatctgtttttaaatcttgaattatatgcagctcatagagtttctctcctgtatgcatattaaatgatatataatgaactatcagtggttttaggtaacatttggttactgaatacactatgctaagcatttcacgtgcattatcacctgtattcacaaaatattatgaggtaaaagcactgttacaatttccatttttttcagaagaaggtgtgatttagagaaattaagtactgtatactacctcccaactttggcagtgtcatctgaatttttttgtcatgaacatgttttacatagcttgttgttaaagtccatttttgataaattttttgaatagacgtgtgtaatgcaagtgcatgagctttgtggttaggtgtagatttcattcccatttctgtagctgactgggtacatgaccttgagtttctttgtccataagaagagtataggaacatctgtctctgatgttgtaaaaattaatagataataaaaatcttctggccatagttcaggtacataacaaggactcattaaatgtcagttgtcaccaccttaccttctttccgtaaaatatttcctttctgtctgtcccaaagttttagttttgctcttcacgtgtatcataatgtattatgagcatcctaagaagataggttatactattgtccccattttacagttgagaaaacagactgaaatgttgtagattcctggttgaatccctatagcagtctgattccagagcctgtgtttttagctataatgtgctttggtatgaagatatattccaataacagattatattctgatatttcagacaagaatctaaatcccagaaattattctcttgtacccgcatccctaccattcagttcttcccttcttagattatgctggtataacagtgtatctccttattactcttgtaataaatttgtatattaaatgctcaaacacccttctgattctaaaatctgtgatcctctgtcatttggatacatttgcagtagtctgaggcagctctgagaatcgtttaagggaaaagtattcatcactgtggctttagtaaggaatatgttgacatttttactctaactccaggaactcctactgacctgaaattaaccagttcatggaggtttttggtggggactaaggaatgaaattaactccctaagtctcctcttcttaaaaaagaacctcaaaatactgctgcccaaatggatttaactttagttatatttgtttttacatgcaaatacattttactcagcctaaaaaggcaaagaaatgaagctatttggtttgcagaggaacagatcactctcctgagcatgtcagactgtttatgtgtgtttttcactccatcttactctgtctttgtctttcatgttcttttttctgtctctgtttcagtttgtcctgtttctattgctccctcacagcaactatcttcctattttgataatcctgtttcatctctataaggaaaaggctctctcaaggatgcagaaaatgttactatttttataacagtccctaaatacacaaaagattttaacttggctataaaactttgttcttggcataaatttggcagatagtctttcgcctgggtgagacttttcattgggatcctggaagtgttgggatgtcactattctccactcttgcttctccaagtatgacattagtggttttagctcttgttgacccatctttaaaccaaagctttatagcctattagaagcacagtgtggatttttcttatgatacgttggaataaaagaaaaaacttttctaaagttacaaatggtttcatttaccaaaatgactatttcacttggaaagttttgtcttttctgtaaaaattccaggagttgggtgggcttgatgtcctctctcccattccacctccccacccacagactcatgtcagcaaagatgctgagagttttattccagtcttttaggaggcgagaccttgaccaaggagtagctaagacatatttttctgcttttattttttaaaaactttttaaaaaaagtttttcatataactttttcatcttgtataactgaataaagaaaattttttattgaaattaaagtaaggaaataccacaggatggctttaaagtgtttgtttcactgtggcacatagggcaaatgccttggaacatcagtaattactatttgaggcaacctttggggattgagatatatgcctttcagatctgcacttcatctcatacttcatcatttattggatcaaatagcagtctcatttacttaggatccgtgtcagcgccttgagctccaaatcgggtattacatgtcaccctgtgaaagatcctctgcgttaccccatcaattctgcttcattaaaggactttagatgatcatcttaaagctttaaagaaatgaaaaatatttgccctctccataaaaaaaatgcttacaactttatcttacattttactcagcagagtaactttgcccagccctggagcagaacattcttaaaagtaagcccagtaaacctaagcgttggatggttctgcaagtaaccactgcaaaaaagatttcctggtagaagtaagtagtgtcttttgctagtgtaccaggttgtttaataaaactaggaatagctgagagtaggaaaactcatgaggctttttctcatcacaagctgtgtaatacatacttcaggtaacctccgtgggtttcctcactgctgttggctcagctgtggctttttatggaaccatagctgcatttccatctctttcatccctccctttttatgagaataaaaagtgaattgggtgctatttaaatattctctacttacatttattgaaaactaccctgccgcagggcacagcacattggaaaactgccttgcaccagcccagttttccactcaggtggtttaccccaaaacctggcctttgctttcctcagacctttaatttctttaaactaaatgatcacagaaaaacctaggaggagctagttccatttgtgaggttttcaataaaacttaagtggaatgtggctagaaaagcagacccatgaaaggccatgactactatgctgacactagaggaaaaacccacagaattttttttatttttttgagacagagtttcgctcttgttgcccaggctgcagtgcaatggcgcgaccttggctcaaagcaagctctgtctcctagattcaagtgattctcctgcctcagccccatgagtagctggggttacaggcatgtgccaccacgcccagctaattttgtattttttttagtatagatggggtttctccatgttggtcaggctggtctcgaactccccacctcaggtgatccacctgcctcggcctcccaaagtgctgggattacaggtgtgagccactgtgcccggcctaaacccacagaattcttatacctcttgctttaagtgttgggagaaaatggaaaaaaaaaagttagagctttagtactggtacactttgggacagaaaggcagctagggatgtttggttaaattcatttgtcacatattggtgttttatttaaaatattgtccagaaataaacaattcatacatgttcaattttgtgcctttctgagtagcctggtgaaatcttacagcatccctcccagaccgtgaatcatccctttgtctggcatctccaggctgtctatgctacctatcctttggtcacttggcagccgtcttggttgcagtattacagtgcttgtattcaggtaacctttattttacttaatggccccaaagcacaagggttgatgctggcatattgttataattgttctattttattaccagttattgttgttaatctttgtgcctaacttataaattaaactgtatcataggtctgtacatataggaaaaaacatggtatatacagtcatgtatggcatagtgacctttcagtcaacagtggaccttatatgctcgtgcaacagtgttccagtaaaattataataccagatttttactgtaccttttctatgtttagatacacaaatactgaccattgtgttacagttgcctacagtattcggtacagtaacatactgcacagattttttgtctgggagtaataaaagaggttatagcatatagcttaggtgtgttgtaggctattctatctaggtttgtacaagcatactctatgatgtttgcacagtgatgaaatcacctaataacacactttctcagaacacatctttgttgttaagcaatgcgtgggtgtatagtgttggtactgtccatggtttcaggcatccactgggggtcttggaacgtatccccatagataaggagcgggggacagttgtagaataaattatattttgaaacttgcttcatttattgttagcagatttccttcaagtcattaaatatttttgaagacatagatattttaatggtggctggatcatttatttgtctgattttctatcattaaactttgagatcgtttagaattttttaccatactaatttagaataaataaattcctatatataaatctttgttgttatctgtgattatttgtttaggataaattcccagaagtggaaattctgggtccagaatacgtatatttttaagtcactttatgtttacatattgccaggttgccctaagtaaagttctatcaatttgtgcttcattcattcattcagctaaggttgatgttcctcatttccttcctttagtcttgctttgctaacactaggcttacttttttttttttttttttttttgagacggagtctcgctctgtcgcccaggctggagtgaagtggtgtgatctcggctcactacaacctctgcctcccgggttcaagtgattcttctgcctcagcctcctgagtagctgggattacaggtgtgcaccaccacacccggctaatttttgtatttttagtagagatggggtttcaccatcttggccaggctggtcttgaactcctgacctcatgatccacctgcctcggcctcccaaagtgctgggattacaggcgtgagccactgtgcctggccacttttgtgtcattttatcatgtgcacagattcatgtaaccaccaccatcatcaagatacaaaccgttccgtcaccacaaatatcttgctcatttcttcctgctccattatagccccactcagttcccatcccaccaccatctctgacccctgccagctactaatctattcatctctataattttgtcattttgagatttttaagaaattgaattttacgatatgtgaccctttgatattgcctgtttttaaaatggattataatgcctttgaggtccatccaagttattgcatgtatcaatagtctattccctttaattgctgagtagtattgcatggtatggatgtcgcacagtttagttaactattcacctattatacaacattttggctgtttccaggttatggctatttcaagtaaaactgccttgaacaatcatgtaaaggttttcatgtagataaaagaagtttcattccactgagctaaaggcccacaagcacagttgctgggtcacattgtaaggatatgtttaatttttcaagaaacttccaaactattttccatactgtctgtattattttataatcctaccatcaatatatgagaaatctacctgttgagaaagaattattgaagtctccagctataactgtaggtatgtctatttcttccttcagttccgtcagggtttgcttcatatgttttgtagctctgtttttagtgcatgcgcatctcgggttgctgtgttttctttgtgtaactttttatcattatataatgtctttctcttatctggtaattttcttttctctaaagtctactttatcttgtattaaggtagccacccccactttccttcctgtaacttttacgtgatatatctttttctaacattttagtttcagtgtgtctgtatcattatatttgatatgttttaaatgaatttcctgtaaaaaacatatagttgagtcatgtgttttagtccattcttccaatatctgtcttttaattagtgtttgtagaccatttacattgaatataattatttatctgtcagggcttaagtctgccattttattttttattttctatttgatctctgctttttctttctctgtttttttgtttgtttaggctcgatttggtttttcttttttgcctgccttcctgtaggttatggaacattttctaaaattctatcttgatttgtctatagtggttttttttttttttaatttcaataggcttttggggaacaggtggtgtttggttacatgaataagttctttggtggtgatttctgagatttttggtgcacccatcacccgagcagtgtacactgtatccaatgtgtcatattttatcctttgccacccctcactctttcccctgagtcctgatagtcaaatgtatcattcttatgccttggcgtcctcttagcttagctcccacttatgagtgagaacatatgatgtttggttttccattcctgagttacttcacttagaataatactctccagctgggcacggcggctcatgcctgtaatcccggcactttaggtggctgaggtgggcggatcacgaggtcaagagatcaagaccatcctggccaacatggtgaaaccctgtctctactaaaaatacaaaaatgagctgggcgtggtagtacatgcctgtaatcccagctactcaggaggctgaggcatgagaatcacttgaaaccaggaggcggaggttgcagtgagctgagatcacaccactgcactccagcctcatgacagggtgagactttgtctcaaaaaaaaaaaaaaaaaaagaataatagtccccagttccatccaggttgctgcaaatgccattatttcattccttgttacggccgagtagtattccatttgtgtgtgtgtgtgtgtgtgtgtgtgtgtgtgtatacacgccacattttctttatctactcgctgattaatgggaatttggtttggttccatgtttttgcaatcgcaaattgtggtgctataaacgtgtgtgcaagtatcttttttacataatgacttcttttcctcttggtagattcctagtagtgggattgctggaacaaatggtagatgtacttttagttctttaaggaattgccacactgttttccatactggttgtacaagcttacattcccaccaacagtgtaaaagttcccttttcactgcatccatgccaacatctattattttttaattttttgattatggccattcttgcaggagtgaggtggtattgcactgtggttttgatttgcgtttccatagtgatgttgagcatttttccatatgcttgttggccatttgtatatcttcttttgagaattgtcttttcacatccttaacccactttttgatgtgattgtttgggtttgttttgctgatttgttggagttctttgtagattctggaaattagtcctttgtcagatgtatagattgtgaagattttctcccactctgtgggttgtatgttaacttggctaattatttcttttgctgtgcagaagctttttagtttaattaattcccatctatttatctttgtttttgttgcatttgctcttgggttcttggtcatgaagtatttgcctaagccaatgtctagaagggtttcttctgatgttatcttctagaatctttatggtttcaggtcttagatttaagtctttaatccatcttgagttgatttttgtattaaatataaggtgagagaagagcatgcagtttcattcttctacatgtggcttgccaattatcctagcaccatttgttgaagagtttttatgtatagttttaaaaattatggggggaggagccaagatggccgaataggaacagctccagtatacagctcccagcgtgagcgacgcagaagatgggtgatttctgcatttccatctgaggtaccgggttcatctcactagggagtgccagacagtgggcgcaggtcagtgggtgcgcgcaccgtgcgcaagccgaagcagggcgaggcattgcctcacttgggaagcgcaaggggtcagggagttccctttccgagtcaaagaaaggggtgacggacgcacctggataattgggtcactcccacctgaatattgcgcttttcggaccggcttaaaaaacggcgcaccacgagattatatcccgcacctggctgggagggtcctacgcccacggagtctcgctgattgctagcacagcagtctgagatcaaactgcaaggcggcagcgaggctgggggaggggcgcccgccattgcccaggcttgcttaggtaaacaaagcagccgggaagctccaactgggtggagcccaccacagctcaaggaggcctgcctgcctctgtaggctccacctctgggggcagggcacagacaaacaaaaagacagcagtaacctctgcagacttaaatgtccctgtctgacagctttgtagagagcagtggttctcccagcacgcagctggagatctgaaaacgggcagactgcctcctcaagtgggtccctgacccctcagcagcctaactgggaggcaccccccagcaggggcacactgacacctcacacagcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgtctctcctcctccaaaggaacgcagttcctcaccagcaacggaacaaaggtggatggagaatgactttgacaagctgagagaagaaggcttcagacgatcgaattactctgagctacgggaggacattcaaaccacaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaatgcgatcaactggaagaaagggtatcagcgacggaagatgaaatgaatgaaatgaagcgagaagggaagtttagagaaaaaagaataaaaagaaatgagcaaagcctccaagaaatatgggactatgtgaaaagaccaaatctacgtctgatcggtgtacctgaaagtgatggggagaatggaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcagccagagagaaaggtcaggttaccctcaaagggaagcccatcagactaacagcggatctctcggcagaaaccctacaagccagaagagagtgggtgccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccagtaccagctgctgcaaaatcatgccaaaatgtaaagaccatcgagactaggaagaaactgcatcaactaacgagcaaaatcaccagctaacgtcataatgacaggatcaaattcacacataacaatattaactttaaatgtaaatggactaaattctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcagggattgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacgcattaataatgggagactttaacaccccactgtcaacattagacagatcaacgagacagaaagtcaacaaggatacccaggaattgaactcagctctgcaccaagcggacctaatagacatctacagaactctccacccgaaatcaacagaatatacatttttttcagcatcacaccacacctattccaaaattgaccacatacttggaagtaaagctctcctcagcaaatgtaaaagaacagagattatagcaaactatctctcagaccacagtgcaatcaaactagaactcaggattaagaatctcactcaaaaccgctcaactacatggaaactgaacaacctgctcctgaatgactactggatacataacgaaatgaaggcagaaataaagatgttctttgaaaccaacgagaacaaagaaacaacataccagaatctctgggacgcattcaaagcagtgtgtagagggaaatttatagcactaaatgcccacaagagaaagcaggaaagatccaaaattgacaccctaacatcacaatgaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagtttaccaacaaaaaagagtccaggaccagatggattcacagccgaattctaccagaggtacaaggaagaactggtaccattccttctgaaactattccaatcaatagaaaaagagggaatcctccctaactcattttatgaggccagtgtcattctgataccaaagccgggcagagacacaaccaaaaaagaggattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacagaattcaacaacccttcatgctaaaaactctcaagaaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtatccaattaggaaaagaggaagtcaaattgtccgtgtttgcagatgacatgattgtatatctagaaaaccccattgtctcagcccaaaatctccttaagctgataagcaacttcagcaaagtctcaggatacaaaatcaatgtaccaaaatcacaagcattcttatacaccaacaacagacaaacagagagccaaatcatgagtgaactcccattcacaattgcttcaaagagaataaaatacctaggaatacaacttacaagggatgtgaaggacctcttcaaggagaactacaaaccactgctcgaggaaataaaagaggatacaaacaaatggaagaacattccatgctcatgggtaggaagaatcaatatcgtgaaaatggccatactgcccaaggtaatttacagattcaatgctatccccataaagctaccaatgactttcttcacagaattggaaaaaactactttaaagttcatatggaaccaaaaaagagcccgcatcgccaaggcaatcctaagccaaaagaacaaagctggaggcatcacactacctgacttcaaactatactacaaggctacagtaaccaaaacagcatggtactggtaccaaaacaaagatatagatcaatggaacagaacagagccctcagaaataacgcctcatatctacaactatctgatctttgacaaatctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaagacttcatgtccaaaacaccaaaagcaatggcaacaaaagacaaaattgacaaatggaatctaattaaactaaagagcttctgcacagcaaaagaaactaccatcagagtcaacaggcaacctacaaaattggagaaaatttttgcaacctactcatctgacaaagggctaatacccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaagtcaaaaccacaatgagataccatctcacaccagttagaatggcaatcattaaaaagtcaggaaacagcaggtgctggagaggatgtggagaaacaggaacacttttacactgttgatgggactgtaaactagttcaaccattgtggaagtcagtgtggcgattcctcagggatctagaactagaaataccatttgacccagccatcccattactgggtatatacccaaagcactataaatcatgctgctataaagacacatgcacacgtatgtttattgcggcattattcacaatagcaaagacttggaaccaacccaaatgtccaacaatgatagaccggattaagaaaatgtggcacatatacaccatggaatactatgcagccataacaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtagggtagggggaggggggagggatagcattgggagatatacctaatgctagataacgagttagtgggtgcagcgcaccagcatggcacatgtatacatatgtaactaacctgcacaatgtgcgcatgtaccctaaaacttaaagtataataaaaaaataaataaataaataaataaataaataaaataaaataaaaattatgatcctttatgtatctttattagtggccaatatatgtatattgcattatgtatacctaacttatcacagtctactggtatcactatttcaccaatttgagtgtagcccttcttccgtttatgtccctttaccatcctgatttataatataattatcttaaacattctcttacatgcatttagaaccacatcaaagagtgttgtttttgcctcaactctcacacataatttagaaaacttaggaggagaagaaaagcttatagtatttaaccatgtttttgcttactatgttttttcttccttcctactgttccacagttacttcttcatttgttttccctttgttaagagatcttcctttagtcattcttttagagtaagtccactggcaacaaattcttagtcttccttcatgtgaaaatggtttgatttcccctttattactgagtgatattatggctgggtataggattcaaggttcatagttcttttcctttgtactcagaaaaaaatattgtgttactttctttgagcctccgtgttttctgatgacaaatgtgatgttaattgaagtttttttcccatataggtaaagtgccatttttctctcactgctttcaagattttttctttgtctttcattttcagaagtttacctatgatgtgtcttctagtgggcttctttggaagtttcctgtttgaagttcaggatttagcttctttaatgtgtcaatttatgtctcttaaaagtgtggatattattcaagcattatttttcaaatactttgccaacccacaccctttctccactcctttcgggcttaaagggatagaaatgctacatatttcattataatctcacagatccctgagcccctgttattcagactgggtaatttctattgctccatgttacagtttactaattctttctgtgcctcttcattctgttactgaacgcatccacttagctttttattttagttattgtatttttcagttctaaaattttcttttgaggccaggtatgatggctcacacttgtaatccaagcactctggaagtctgaggcaggagaattgcttgaagccaggagttggagaccagctggggcaacaaagcaaggccctgtgtctacaagaaaaaattaaaaattagctgggtgcagtggcttgcacctgtagacccaactactagggaggccgagggaaggagaattgcttgagcccagagtttgaggctgtagtgagctatgatcacaccactgcaatccagcttgagtgacacagcaagcccctgtctcaaaaatgaataagtaaataagtaaataaaaattccacttcattcttttttatatcttttacttgtttgctaagactttctatttctttgatgaggctttggggttttttagagcaattttagttaggttcccagcaaaattaagcagaaggtggggagatttccatatactccctgccaccccctacatgcatagcctcgcctgttatcaagatcccccaccagagtagtatatttgctataactgatgaacctacattgacaagtgatatattattattacccaaagtttacatttctttcattttcattttttatgtgtttctagcatgttcataattactcattgaaacatttttatcatggctgctttgaaagtctttgtcagataattttaggatctctgtcatcttggtgttgatatctattgattgtctttttttcatttgttatgatatcttgctggctggaagtatgttgaatcattttcagttgaaagctgggcatttccctatgatatgaattgtacttaaaccttcggttttaaggggctttctctggtatcacaatggcaggggaagtaggatgttctacctcgtttctgccaggtggaggtagaagcccaggttccttaccacactactgttaccacccaatcaggttactacttgggagagatggaagtcccggctcccaacgtagtctccaatgacagtgcattagtgctggatgatacagtcaaagtccaaaaagggattctcccctagacctctttcataagcaccccagtggagagaaggagtggtgcctccttactgccaagcaggggtgaaaatccagactccccatttgtcctgcaccaaaactgcacgtgtgtgttaggaggtggttcttgttaacagcagatagggatgaaagtcctgactgtacttagccttctccaacaccacccctgtggaggtgttgggcaccttgtcatagcctctcaagggtggagtctgggctccctacttggcctttcccactgtgggtggtgggggtgctgcaagtttttgtgtggcgtttgggtagagagaagcaattattgtctaaaagtttctgtcttgctaggctacacattcctgttttttttggcaagagagagcagccttttgttgtgacaaaagcatagacagaccttgaggtgtagaaatgttcaataacctttaccaatatggggactaacttcgcaggattctggtgctgatatttgaaatagatattgttttttgcctaatctggttttttttttgtttcttattgcatactaacactacccccaaaatgcattttgctttttaaattatcttccaaaacgttgacagtttctgtgtttgtcaattactttaatattctatatatttttaaatggatggttggttgggagtctctagacacaacacttcacactaagcaaggctgacagttaagtgatgcggaagccattatctcacctttgtgcttgcaggctgtggcctcttgccttttcctacttcataataaatagcattagcattgaggaactttttaacacctattgaggacagggtttttctaatcccctctcagagaggcttttaaaaatgaatgactaaaacctaacaaacataacatacataaaagagagctatgtagcaatcttacatatgaatttagattcagaaatagcaaataaaataccaacaaaccaaattgaatgttacagtaaaagaatcacctaccatgaccaaatgtgatttatcccatattataaaatatattattgtaatgtatagtatttgttggtccacgaagaaaacatgatagtgtcattagatgctgaaagggcatttgataaaattcagcatttatttatgagatttattctgagataactagaaatagaaagatgtcttctttaaataataaataatagctatcttaaaccaaaaaccgacatcatatttaatatgaaatactcttggcattcctcctaaaatcatgaaagaggcaatcatactaaaaccattatacaattactctagatgtagatattccagacaaggcagtaatatatatatataaaaaaagaagagctgtaactacaaaatcaccatttacagacaatataattttttcacttagaaaattcaagagcattatctttgaacttatcaacagatcagacacttggtaaatatgtaaaacattcatactatttctataaacaagtgaaagctaattagacggttgaattctttagaatatttcactcctgatagtaccagaaaatataaaatacttaggaataaccctaagaagaaagatatagaacctatgtaaagaaaactatgaaattctacagagtgattaaaaaattatttacatgaattaacaatatatcatgttctgaataaggagactgattattttaacaattgaaggtattttgaaattaattcagaacttttatgcaatcccagtcaaaatgccagtggatttacaatattgataaaattattctttagtgtatctgaaagtatacaggcaagaattgctaagataactttttaacttgacaataagtaggaatttcacaacattttattgtgaaaaatttcaaacttacagaaaattttaaatatagtacagtgattatataaacattttcactggattcaacaattgctaacattatgtgacatctgtctacacaaaggagaaatttaaataaaaatgaataaatggtgttctgttgtaaatgcgatatcagctacaaacccatatctttcctttcccttaaaacacctcctcaaaagaataactatatttgctatgagcagtttttaatgtgtgtgtgcatatacacattcatgctcgcttttccctttaactccttattatgaaacatttcaaatatatgcagatatagagtgaatagcctgatgtatccctgaaaatcaggtagttttgacacttagcaacccatcaccaaactagttttatatgctaccccgctactctaccatattattttgaagcaaatccagatgtcatgatacttcatttgtaaatattttagtacatatctctaaaaataaggacttttttttaaaaaacaaagtattatcatgcctgagaagattaacaataataatgtgatatcaaatctccagttcatgttaaatttctctatctcatttttaaaatcatgtttcacataagacttatacattgcaattggttgatatatttcataagactcttttaatatgtaagtttatcctccatctccttgtttttactactttatagtttatttattaaggaaaccgggacatttatcttatagcatttcccacagactgaattctgttgatctcttggtgtccttttgttcctaaaatttcctataaattgtttattagatctgggagattggtttgatcaaattttatattttagcaaaaatatttcatgatttttgtaaaggtttcatgggcacttgaaaaaaaggggtttattttctcttttcagcatacagagttgcaatttcaacagttagatttacctcattggttacgttacatgctttctgagagagagagctagagatgtagatatatagatatatcagctgttatggagttaaaaatcatgaagttaaaatctcatgctaataatatttttctgtatttttccttatattctatagttttgctatatgatgtcaacattgtattatttgatatatagatagtcataattgttagagtatcatcgtagaataaaatatacctgttaacatttctaggtgtcctcttttcccccttctttaatgcttttgtctatttaagattgtaaccactgctttgcattttaatgaacttagaagagtacaaaactgtgcaaaaagtattatgaaaaattatgcagttgtggatttatacaactttatggtattcattcatggatgacacgaaggaaacagatcaaattgtaaatagtgtttaacctccaagtgataggattatgaacagttttaattttcttctttaaagtttttccaaagttttctttggtgagcctgtgttattataaggctcaaaaacatctattttatatgtgtgtgtgtgtgagacggagtcttgccgtgtcacccaggctggagtgcagtggcatgatctcagctcactgcaatttccgcctcccgggttcaagcagttctctgcctcagcctcccaagtggctgggattacaggcgcctgccaccacgcctggctaatttttggatttttagtagagacggggtttcaacatcttggtcaggctggtcttgaactcctgacatcgtgatccacccgcctcatcctcccaaaatgctgggattacaggcgtgagccactgtgcccggccaaaaacatatgatttttacaaaagaaaatttaagagaaagtatgcaaagatagattgattttcttaatattttcagcatagtcttgccacagctgaaataggaagagtattgaacagtctcccttcccccagttttaatcacaactaaaatcatacacatgcatcttccagtgacgcatttgaaatggtgaaatctgattgctagaaattgtgatgtgaataagtaaaaatttactagagtctctgatatgacttgaggattagaagtagaatataggaggccttctgaaaatctgtctcacattcactcaggctgcccttggttttgagccagataacaaacctttcagttgaattttttccatccagacactggcttaaatgaaggtatactgaacttggagatgtcatttcagcatttggctggaagagctgttgtagaggagcttctttagataggaagccatgagggaattctctgagtacatgcattttcacacatctgctaatgcaaaagccccgtgtgagcattagtactcaggaatgtgatgtggattcgagatgatctccacaggattttggcaggtcagaacaaacattatcttgctcccatatgtttttgtaggatcttgaaagggaaatcatatacatttccttaaactcacatgctgaattttcccacatagacaaaaaacaaaacaaaacaaaaaaccatctcagcaaaaataaattcaagaatatgtatatatgatgttcatatatttagcatctgttgtcaatacagcaatgtaagctgatggctattggaattcacatacagtttgcatttactttgatttatgtttaaatggcttatctcagaaaacttgacccaagagataaagactgtgaaagattccacattatgggtaagtcttttttttttttttttgagatggagttttgcttttgttgcccaggctggagtgcaatggtgcgatcttggctcactgcaacctcctcctccctggtttaagtgattctcctgcttcagcctcccaagtagctgggactacaggcgcccaccaccatgtccaactgattttttgtacttttggtagagacggggtttcactgtgttggctaggctggtctccaactcctgaccttaggtgacccacccaccttggcctcccaaggtgctaggattacaggcatgatccaccacacccagccactgggtaagtcttctttaatttctctctacactacatttccttaggtgcagcatatatgtgacctggtgccccacacctccactgcttccctgccaatatcgctgttcccccagatggacacacctctcaatagttttgtagtatttgatataactcggacatattcagtataaaaacaaccagggaacccctgtgaagctaagaaaggattttcaaaaataataatgataatatatactatagacaaagaccctatctgttttttatcacccttgagcaaacccagccctatttggtatggggccttacatggagtgggcagtcattaaatgttgactaaccctttttctaagtcttttttttttcctattttaatttttattgggggggagtgggggtactcagtcccagaagacctaagtcttttaattctctacttgtagtgcctctgtaaagtgatccgtaatctgcccagtattaatagtttggctcctttttctctgcaaacatattattaaaagttgaataaagaaataaatcctgtgcatattggttgattctcattggcatatatgctgacatatttagttttatttcattctctgtgacacccaagaccttctgtagaactgaacataattttgagagaagaatgaccactaatcactatttgttttcatgttttgtgaatgagttttgttgccatagtctcatgtgtctaatcaaattgatcttcaaaccagttctaatcaaatcagttcttttatgtgcttatactacatggttttcagctatcaaatgttatttcaaacttgtatctaggagagagatatatatatatacatatatatgtttttattatttaacatttggagggaagtcagatatctttgatctcatttcttttactcattttgtgtttgtttatttaacaccaatggtttcctattggcttctttagctggaaaaattatttctacaggacaataaaacctgggattctcctccacaaaatgaaacatgaagtgataataccattaatctattaacaaataattgcccttgggttcttttcctggtatctcgagccaccaagatatagcttttacttgatctgaatttgtcagtctataaaagtagggattataatataacaatgcatctttttatttagtttgttaactacattctattgtagaactgttcttatttttaagatcgtagagatccatagaagtattggcattcttgtaccagttattcatatttcactgcatgttagtattttggcatcatttcttacataccctgttattgtttaggggaaaaatgtggaagcatttcttgatattttttcactatttttccctagtgagttatgtagttaatcatattaaactgtttttcagttttgaaatatgagagatttgtcagccctttgaaaaaatggttatagttcattttccatatattactcagcattatgggtctgcctgccaagtgatcccaggtgtgggattgcagcaggtaatttcctgagctgtatggtacagatgattttctgtgttagaagatgctatcggctcacctggcctcttagtgacagagaaatcctttgtttattcatttagtaggcagattaaccctaatgaatattggcttcctggaaatagatacaggtgacaatggcaaagtgaggagtggggagatgtaagacaaattcccttttctttcttcacttataaataatggtggctttcataggagagtgttttaaatcagaaaggaatgcaaaatatttgaactaaaaagatagatttaaataatcaacctttaatttttagttttgaatgtctaggtatgtgtatatttttcagaagaactagagattttctaattttggcaaatacttaaaagttttatgttgccattatagctaaacgaaaatatttaattaaatacttcatactggtttgggcagagctactcacttgaacacgaaaatgctttcctaatatgtccttgtattcagataaattttgtgaattagagaagtgtaacattcatcagcctctctcagcctgtgaaagaaaatgtgcattattctgtgtcctttcttatagtgtggtcatattgcttcaatgacatatttgttttctcagagcaaggatgaaggactaatctaggcatcagaaaattattcatagagttatgctataaactataaaaagttcctagaaataagctattttaaattcattgctttgttatggcttttagaatattgacaaaaaaaatttttatcaatataattttatggatatttgattgtgtaattatcaataatctatgatgaaaatgaaatgtttgtgattgcaactcttaagttttgctcaccaacagagtactttacaacatttttctgtgaatggttttggacatacactattcccaagatgggaatgtatagatacagatgtggaaatctcttaatgttcaaccagacttttccagatcttacagctatgatttatactgcattctccaaagacttccaaaatgtcttcttttacgtaactttatccattagaggaaaagttaaaattcttcccctcctcatgctaaatgctgaagataggcttttcatgataccttttgtagttgacttataaaagctgtagaatttcaaggaagaagtgaaaaaacagagtttacctttccacaaagatttaaaatttacgatttcttctagctatggagttgagattctacttgaattgtgttattgggaattctgagtaatgtgaaatgtatgtgaattggaagcagtaataaattgtgaatgaatcttttgctttttacttaagattactttatccttaaaactaatgtttctataacctctgaccgaatacagaagatccaaaatacttccaagggtgagaatttttccttgcccgttgtgagcagtttaattcattagaattgtgtgtgcgttgtggcatgtgggtacatcagaagtatatttgcaaattctgaatttacatatcaccttgagaaaatgtgaggcaatcctttactgaattgtcagtgatacttattttcagagacattagaaaaaaagagcagtgtatatgtgtcatgttatcgcacgtgaaccactgcctatgttaaataggtttttctttccttttagtgaaaaaccgaaggacaatagtcattatatgattttgtattttaagtattttcataatccaacataaattggcccacccaaggattatgtctgttttataaagatgtgtttatatagtcattgggtgaaagattgcagaagttgaaccactagttttgaaagttgagccagaccaggaaaaatcaggatacaatttggcacttatggagacgaaatgatttcctttttagctgctgatttctactgggaaatgtatccttggactgaaaattgcatccggaaaaatgtttatgtagtgtttttcaaatgactgattattcttgtaacctttaacatgaactgtgtctaattttggtctctcttaactctttcacgactaggggatttttctttgtgggaaaaatattacaaccgtatcattactactttgaatacaggaatgtcttacatggtaacaagaatacaaaatgtgttaagatttctttctgggttatttttccaagcgggtagtagaacgcccaaggttatacacccttcgtcacaggcacttaagttttagattgcatttaaattaggatacatctcgaaacataaacaaaagaaaaaagagagaaaaaaaaggatacatctcagcagctgcatctcttccacttcactaccagctacacacatgcagtaggagcttcttgacattttcatgggtaatatttggtcttcgcaagtatcagtacttctctattttctttcttgtacatttagtgacttttctggctaaattattgctgaatattgtccgtcgcagattgaggggtctctattccatgttatctccattcaaggagccaggttagcgaaggcttcaccactgagttattctaggtaaccattaggtttataaatataagagtgttttctcgtgtaagtgagggttttatattactgatgtgatgtgtgagtgagcagggataaggggacactggacatctcatggtggtcacttctgcttacaactcatgagctataattgtgctgtccaatacaatagccactagctgtatttttttaaatttagatttaaaataatgaagataaaatgtataattcattttctcagttgcactagccacattatcatattagacagtacaaggtttagaacatttttatcatcgtagaaagttctgttgcagactaccaggctagaactttaagaggatggggaagtacagctatcttgtatgcccagaggtgggaaagaaggaaatattaccaaacttcaataatgtctgtcatcattggtaaactgtatgcttgaaaattactcctcagatcctctatatcctgtttttctgtttttgggggagtggaatagggaggaagggggctacaaagttagttgggtgatataaaaaaaaataatacatatacacacgaatgcatacatactgcttctgtgtgaaaaaagaaaacttaaggagtacatacttgaaattaacattctgccaagcaggagtcattctgttggatgccttcctctgaaggaagactgtattgcatttgtgtggctttggggaagacattcagcaaagaacaccacaattcccattgagctcagaaaatgtgattaaggagtttgaatgtaattacccaaagtttggcttttcttttaaagaacccattcattttagagattccttgatactgtaaacctgacaactcaatctggttttcttttaggaagccttccaccaggaatagtgtgagtcaaggatgagtacatgaagatgaagcccatgcaatgaggacagcctaggccgtgttaggctttgacttaaatcagatttcatctacggctgagatgcagaggagagacttagtgaaatatgcagagctccattccagttcctttcttatttgtttgatgtacaggcttatttaagtgaaaggtgggacaccagtagatatacattcagacaaatcaccctgcagttattgctcaacagagtaataataatagatttggagaatgttctgtgttttcaaagacagaggttaacaagcaatggacaaaccttccgttcttctctatcccaaatcgtttgaatcgtttgactgctatacacaatccccagcacttataaaataaaaaaagtatggagagagagaaagcaagtaacccagcagagtttgtgacagaaactgttagccctcttttgtattgtttctgcatcgtcctgtcaaacatctggaaaccagcatattggcagtcgtctcacaacatgattttgcatttacatcatcgtgctagctggtagaattttttcccccaggaaaaaaaaatcggcaacttttggtctgtcacaaggtcaagtgatgattagtgatgtagtctctcctaaacacatggttagcacagaaaatttaaatcagttccccaaaatttggtaaccattaaattacttcctaagtcacttccggatgtcaggcctaaggtggagagggggacagggctatattgagttctccgcagttttctaacagagagatttagtttggcagctgatccagccaaggaaacgctcacgcaagggcagagctagacaggaaacacttttgaaagtgctgttttgatagaggatcaggagatcaggcaaagagctgtgaactttatgtgtagcctaggccatgtagcactaggctagccacctgagggtatggagtaagaaaggaaattaaaggagaagggccagagatcttacaggcaattttcttttctcaaaagagcagtgctaaaaattatgaatttctttgaagtagaggaacataattaatgaatttctttgttgttgttgttgtttgtttgtaaaacattctgccatcattattcacctttacatttttaacatgattgttagcttagactacgagagctaacctcacccattctaaccacctttttatagctctcagaagagctgtcttctaaggaaaacactgcactgagcaaaggttgtacttttgtaagatggacgttttataatgataagttttgacaacttgctctggttgccatgtgtctcccagtcctgctggtgggtgggtatttgtcaggaatgagaatacgtctgagatggtctgctttacagcagccagtcttgattttcaacttccagggccttcggcatccttttggctctgtaaacatagaaggctttgctgcccttggctgtgctgttggagaaaaggagagcatcctgtttagggaggtgccgatcttcagtttcagaaccattgtttgacacctttagttcctcccgtggacttcatgtccttccttgtccatagtttggaacttacaatctgagtattccttctattgagctactcttcaaggtctacagaagccatttttgtttataaagctgtaatttctcacagcagatcatttcattatttctgtcttaattacagaatttcaaagaaaaataaaatccttatctgtacttaacaaagactgccaacacttttccatagaccaccaatgattcttgttttgtagctttttgtttataaaggcaatgttgtattccacagcatcattacacactgcttctgtgactcagacagctggcaggtccaagatagagcatatggatgatgctctaatgacatctgtccagttgttgtaatcacatatttggtggacagctaaaagacccactttcaccttaactgagtttatgtgactaattttaaatttactgtaaacacttttttatacgtctcatgcttattaatacttaataataattccacaagtatttctctcaattctaaatcccagagcaccatagaaactggcaaaatatcttcccaattaattatgagaaattcatctgtacaattttcttattaattctcgtatccaaaagaaccacaatacaacccaagaccccaatcattagaataaccacaaaaccgattcttaattacctcttgcctgggacactgcagaagtaaccaaatcggtcccacaaacataagcctctctaaccctgccacctcccccagtttatgttacgtaatatggtgagaatcttcttcctcaaatactttttatcctgtcatccctgttctcaagaatcttcagttgtatcccattttacaccaggaagttcaaatgtttgaatggagatttaaaaagtctagctatgcttcttgtacatcccctctaggagcacacccactctaatcaaactgacctttttagtttagctgggctccaaccagttctgttctagctcctgaagtcagcgtcaagaaatattggtcttggccaggagcggtgcctcacacctgtaatcccagcactttgggaggccaaggcgggctgatcacttgaggtcgggagttcgagacaagcctggccaacatgcaaaaccccgtctctgctaaagatataaaaattagcctggcctggtggcgggcacccgtaattccagctacttgggaggctgaggtgggagaatcacttgaacctgggaggcggaggttgcagtgagccgagattgcgccactgcactccagtctggcagacaaagcaagactctgtctcaaaaagggggaaaaaaaaagatgttggagacctaggttctagagtaaactctgccactacctagctaggttgacctttaacaagtctatttaactttttcttaggttatttctaagagagtttcaaaatgaaaaaaaatactatgtgtttgtaattttatgattataattccatttaagtaaaataacaaaaataacactcgtatcatagacattagagagttcttacttggaaagtttcatttcctaatgacatcactgaaacagcaggtatgacagagggttccctgactttgatagttttaattatcttaatttatcctctgttcctctgccttgggcttattaagttttgaattaggtatgaaaattattaagccaggggtataaattacaattcgttaaataaattcataatatattttatacgcttaaaatgaaattatattccaaactcataattaagtatgaacaatttgcatttgagattttaaaataaagcctaaacatcggtcccttccttcttcattaatttatttctccataaaggcctttcttccttgaggtctgtgagcctccaggcctttgcagcctgtagtggtctgcacttctctgtttttctttccctgagagtgctgattagtgacttgcggtgtggattctgatttatcgcagaccagagctgccccttaggggctgagcagaaacactcatgaaggagccctgattaaaaagagtggtaatgaagacaaatgtttcagagggagttgagagaaaaccagtccttggcattccccatagctcctctgagcttttgaaaaggaggtagtggtagccaaaggaaatatttcttctttgttgtttatttctcatggcactggaaacatttttcttttcctcttgggtgttctaattctcacttgttaactgcttttcatgcagggttgcaattaacccctggcagatacctcaccgtgttctccttatagccactctgtccccaaagaagtttttaatgctttgacctataaccattttaaaattcttcagacttgacacttgcctaatttctcagatcattaaatcacacttctggttttttccagtgatttttactaaatttgatgttaggtacctataattaccttcccttcttcttatttttacaagacagaatgccagcagaaaaaaacaaattcctgttcacttggtaattttaaacacaaccaggtcaaaagtttcaaatctagtgttaagtccgtaactgaaggcaccattccaaaactacttgagtataggtgagaacttgacagataattatggttgcttgacctgggtcttggggcatctaccaaatcttaatggtagtctcactgtctgtggccatgtgagctataatctactgccctggtcaaacttaaccaaaattctgttttctttcagaagattccctaacattggaataaatggtaagaatatagattgtttgtgccgggcttatacaatgggtctctaaactatattgagtggtcaaaatgccacattcagaatacttagagagggagaaagataaagtgccttggaagccgtgaaacattctagggagcaagagcacaccactgtacatgctcctggtttgtgtgctgcagactgtgttaaatgcagaggaggcaaggtggagagaaggaaagacaagagaagtggaagatagagtccactcccctatccccgtcaatgagaagaagctccttaccaggtctgtgtgggtcacggggcaagatcaaagaatccaagcaaggttcataaaatgccaccacccctgattcatgacctgacctactgaaaggtttaacttccagaggcaggttgtggtttctgatccaatcaagtggattccttttcttggagaaagtctcactgtactgaaagaatcttgtcagatatccaaggctaaaggaaaattttaaatctaatccaatcagatgaagaagctgataaaaaaggtataaccattagtgggagagcagcatttaaaattctctctatggcttttctgggctttttacctctgtctcaaccaaaaccaaaacaaaaccccagaacaacaacaaatgagttgaatgttgctcagatttggagtatttgatgttacccctttctgatgaacgtctgagattaaagatctgcattaaagatgaaatagaacacactaagaaaagggttgggtaagaactttcacacatactttgtttctattgaggttgggtccatcttgaagatcagactcttccccaaatacaaaggcaaggtcagggtctgagttaggctaactgatgtcaagtacaagttctgtaggaaaaaacaaaaattgctgccactcatctaccaagagacaaagatttaggctgctggactaattgccaagtttgtaagattacttcaggagcaccctccaggctagtagaattccgtgcaaatttcaaccatttgacattacttccctgttaagtagggaagaaagacttagtaattttcaggactgaaccaaattccccctcaagtattgatacactctcttcccagtctgaaatactggcatactgttatttatttttcctggcttcaaacaggcatattaagatttcatggatctctgaatctttctttgaggatctgggaacacatcagaaaaaccagatagaaaagagggaagaggaaataggttatttccttagcctcctgaagcaaatgaattggaagggtgctttctgtgactttcattggcctgcaactgcctggaatctcaaaaaaaaaaaaaaaaaaaaaaaggaaacccaaaaaaccatctttgattccttactgtgtaatcttttaacaaagtattttgcaaacatacttagcatgtgattttcacatatgtgttccaaggagcaatggagcagagttggagagatgaaagcatttgaagactgcaaagtaattttaaattgagggatgtactaacaaaggagtcatatacaaaaagggaggagaggtagagttggcctgatgtggaaaataaatatttcatatagtctgctatagtctggccagtatgaattaaataaaagtcacattcataatgaacactggagcaattatacatcctaaaaagaaagggaagaaataccatttcgtaataagaagatgaggatcaataatagtagtgaacacttgttgattttttaaaaatcaactgttaggcactgtgctcagactttatgagcattgtctcatttttcatcgttttataaattaggaaattgaggtcttgtgaaagtaacgtgcctggattgacacagtaagctggtggaatgaggattcggaaccacgcatgtctgactccagagccctcgctttttacaccagcctctactatctccctgtgtgactctggtcagttaatccatttataaaatgagagtattggactgagcaatttctagatccttttggttctagaattataggaaagtattttaaagtcgagagaactgtgttatggtgggacatttagagacaaactgaaatggtgattgtaatgacatttcaagttaatgatagctagcattgatggagcctgtactatataattatgtaattatatttacaaacacctcatttaaccttcaaaacaatcctttttgacatcagttttttgttcctaagaaaagttaagtaacatctccaaatcacagaactagaattattcatgaagagtcagccacatcaaagatccaaaacacgggttttaagatttcaaatggttaatactctacttttctcttagattgttgttttgtttttttttgaaataaaacatttgtacaagtcagtaaaagtgatatacagtatttcttcaaaactggaatgttattagagttcttgcttgaaaatagttccaaattaaacatatgaggtttccagtagtttgaagactttagaatccgacttgagatcaaatcggaactgagacagtgaggtcacctaaactgcgacgtgtgaagtgccctgtttcatgcttcttataatgacatgataaggccattagtattatctttattataacagatgattataaatggtacagacttggtttcttattatctggtactttttgtcacttagccctaattttcttaattcaaagacatattctgttagtactagggagcaagtttaagactgactttgccacactaatcaaattacatcagtgtcaagtgctcactaattaacacaaaatttatatctgcattaggtaaatgtcatttcaccacagtggcctgaaataagctttttattcctttgaattagcataccatttcattgtaagtattacaaacaagctaatgacaaaatttaggcccatgtgcatttgttatttagctggaaatagccagaagacagtcagtacttccaaagatctgtaggaaaatgccctgcttcattttttaactgatcagctagctgacttgtcaccttgaggtcctgtgtgtacatcatagaagggcttagcagactactgccaccccctgtctatatgcagcccacgggctagaacagttctcacatttttaaatgggaggaaaaacatcaaaagaagattttatgaaacctgaaaatcacatgaaattcacatgtcaggctcataaataagttttaatgcaacagagtcatgtctgttcacttatgtattatctatggctgctctccctatgatggcagagttgagcagctgtaacagagaccgtgcggcctaaagatacttactgtcgggctggttacagaaaatgttttccaaacagaagctgtattccaaattctttcctaatgtggcatacaaagcctttaggatctggctcctgtgtgcctctcctgccgctgctgctgctgctgctgctcctgtttccgcttctgccatggccaccgccactgccgccgcctcctccttcttccctgcaccccttcgcgcctgccttccccgcgaccggcagcctgagctctaacaattctcaactactagcacctcttagactccaaaatgctttgcacctatttaaatgttttcccgtgctcttccctctacataaaatcatttctttccatcctgagtacccatggcaagctcctatcttccaatatttttacttaagcatcccctcttcttctctgcacctggagcatcttggacatagctttgtttccaccttgcattcacccactagacagtaagctttttcaagacagatactgtctcttcttcatctctatatctgtagaacagggtttctcagcgtaagtactgaaggtattttggactggacaattctttgtgtgcagctgttttatgcatcatataggatgtttagcagaacccctggcctctacccgttagatagcagcacgcccccttccctcagatgcctccaaatattgccaaatgtccccttgtggacaaaattgtcccatttatttattgagagacggaggctggatgttgtcgcccaggctggagtgcagtagcgcgatctcagctcactgcaacctctgcctcccaggttcaagcaattcttatacctcagcctcctgagtagctgggattacaggtgtgtgccaccacacgcagctaattttgcatttttagtagagatggggttttgccatgttgcccaggctggtctcaaattcctggcctcaagtgatccacccacctcggcctcccaaagtcctgagattacaggtgtgagccactgtgctcagccaattgtccccatttaagaaccactaccctggaaaccagcagtaaccagaccctggtgggtgctgagaaaatgttgaattattcagatagttgattcacattgaattgtatacatcaaatgtaagaattatgaattacatttcaataaaacttttttaaaaaaagtattggtttactattagttattattagtggcattattatgaggtggtttccatttgttttcctcagtggccaccagtgcaactgattttgtcatatactgtactcattgatgccaaatatatatatcttatttaatgctgacttcaaacctgggaagttgatttgtttatctcttcttaactttttggaaatgcagacacaaaaagattcagcaaattgcttaaaatcgaggtaactagcaagcatatatcaagggatacatgactcggcttctgtctagtttcaaagcctgtactcattccatctgaccatgttgcttccataagccacatgccagccacataatgaatttcttgattagaatacaatgcatatacctaccaaagatagtatgtgcatatagcaaatatgagcaatttctaaataatgggagcattatttttgttcaaaatgctaaaaactggggccaggcgtggtggcacacgcctgtaatcccagcactttgggaggccaaggtgggcggatcacctgaggtcaggagtttgagaccagcctggccaacatgatgaaaccctgtctctactaaaaattcaaaagttagctgggcgtggtggcacacgcctgtaatcttagctactctggaggctgaggcaggaaaatcacttgaacccggaaggcagagattgcagagccaagattgcaccagtgcattccagcctgggtgacagagcaagactccatctcaaaaagaaaaacaaaacaaaatgctaaaaactgaattatcagtagaacagcccatgtactctgtggacggtgatgggtttttgttttgtgggagttgttgttttggttgattcggtgtttcctttgagtccactgaggagccactgttttcttccatatctttagatcctgatatggtaggacatgcacaatctattttgaatcatcataaagattgaattttcagcctacaaaaacaaaagaaaattcttagggcatcagttctcatctttcagatagaacctaggacctgtgaggctggtaatctttggaatagcactgtatggtaaaactttctgtgataatggaaatgtggcgtatctgtgctgtccaatataatagtcacatgtggctgctgagtgctgggaatgtggctgttataaccaaggaactgaaattttaaatttcatttaattttaattgatttaaatttaaatagttgatgtggctattggctatcattttgaatagcacagctttagaaatcttagctttgacaaaaaccacaaacttaagtttatccccagcaaacatcttaggtgccagagacggcagatttggattgaataaattatccatgttgagtatctacgtgggaactcctagttatacagtgcagattcagagattactgttgtaccttggctatgtgacttacacacagaccaaattactctgctgggggtaaattcatactccagtgttacttcaacatttctgaacatctttttgtaagcaattttgcattttttactgacttgattgttgtagtaattacaaaataaattatccatttagggggcagtgttgaagcattgaggaataaaaggataaatgtggtatatttgattgttttcagtgtttaagaactcttattggaataagagacttactttattgaagtcttataattttttactagaacatttgttttttggctcttgatccaaatgacagctgaatttaggaattcagcagaaaagtaacaattctttttgggcatttttctgattatttacttggaaattcagaggattccatgtcttggaatattttttttcatacccataagatttgaatggtgaagataagaaaattataataagttgataggttttcatcagcagtacattcttaaaaagaagaaaaatattttatttcaaatgctatcctgaattagctgtaatcttcaagttatttttaaacccactttatgcttttgcttacatttgtttattaaatctattagatctagaaaaaattagagacagagatgaattttttattcttggattttcaagaattgttatctttttatttatacctattttccccctgtacttgtattgctagtgatagaagttctgaattacggatacattcttaggcttaaagagtacacattttttcccttagagttatagatgatctaatctaaaaagttggaggacttaaaaagaaagtgtgaagatttttttttcttcatttcctgatttgcttctttaaggaagtgcgagaaggttaaagatgtctgtgatctggccaaacgaggttcacaaatgctgttttcatatttgtggttttggtgtttcctcttacacatgtgtcttccttcttcagtttctcagtctgtcgagagagcatggctgcaccctgtgcattctgggcacacatcatctgggctcagtgcgggctttgtttatagcagaagccataatgtataatgttcaggagtgggtgagctacctaagaaactccctttgaaggattccttgtgtggactgcttatcagaaaaagtgtaaatgctattattgactgtttcctagaactcatacatgcagtatagttcagtgcgattaaaagtcatcatgctacatgatgtagggaatataaaaaatgaagaaggcatgctccctggcccccagaaacttggaattcagttgataaaaatacaaccctagtgaccatagaataaggcagatggagttctctcagaatgcaaagaaaggtaaaatttgttgtaatgggtgatcagagaaagttttatggaaaaaatgccgtttgagctagaatttgaggaatacgtggaattttggcaggagaagattgaggaaagggatacctactgtcaagacacaaagtgatatgaccgggcacagtggctcacgcctgtaatcccagcactttgggaggccgaggtggatagatcacttgaggtcaggagttcgaggtcagactggccaatatagtgaaaccccatctctactaaaaatacaaaaaattagctgggcgtggtggtgcattcctgtaaacccagctactcaggaggctgaggcaggagaatcactggaacccagaaggcggaggttgcagtgagtcaggatcacaccactgcactccagcctgggtgacagagcaagactccatctcaaaaaaaaggaacagagtcaccaagacatacacatactggaccaatttgggaaagtacggaagtttgctttgaatatatagcaaaggatatgtgagggatagctgtggaagatccaactgtcaaggaaggttaggaccagactctgaaagtagagtgctggtgggagatgtggaacaggggacaagagatggaaggttttgagttggggaaaagtattctggcagcaggattgaaacattaaagaaaagtaaccctgttaagtggttatcacaatcaaacatttaccaagtaatcactgcaagtggattcaatttgtaaagtcacataaaagttgcttatctctccactttttttttttttctggagaaacagcactctggcatttggccatcttagtatggcctttatataactttggaatgcaaaagaaaagagaaaactctctttgtaaagtcaattaaaagctaattgtttgtgattttttaagttaataaatatatatttacatagtttatagttgttacataaaactttcatgttcttttccttatgaaatgactctatgactttgggcacattacagattgtaatgtagtggattgatggtacatgatttaagggaaatcttgtactaatctgcaagtatcctgaaaaatgttaagtaaggaaaaagcatgcctccctgtgctctttgtccatttgagtgttttttttttcccccaaaagtataatagtgaaatggggcaggcatgaagcccgtgagagatcattgctaccacttctacttttcattatcatgtctctttatcctgattcacctgtacagcgggactaggctggttcatttcaacacagtaatgagtattcatcctctgttgccctaagaacttacacctactggttcataaatggtcataaatgttcaacatttacgaatttatgttgaagtacataaattcttcaacaaggggcctttacattcatatgtagggcatttggttgcttaaatattgaaacaattataaagaagttaaattaggctgggcatgggggttcattcctgtaatcccagcatgttgggaggccaaagtgggaggaccgcttgagaccaggaatttgagaccagtctgggcaacataccaagactctgtctacaaaaaaagtgttaaaagtaaccaggtatagtagcaggagtccatagtcccagctacttgggaggctgaggtggaaggattccttgagtccaggagttcgagactgcagtgagttatgatcacaccacagcactccagcctgggcggcagagcgagaccctgtctcaaaaaataaaataaaagttgaatcacccacgttttagattatgagcttattaaaacttaaacaggctgggcgtggtggctcacacctgtaatcccagctctttgagaggctgaggtgggcggatcacgaggtcaagagatcaagaccatcccggccaacatgatgaaaccccacctctactaaaaatacaaaaattagctgggcgtggtggcgcacgcctgtagtcccaactactcaggaggctgaggcaggagaatcgcttgaacccaggaggcggaggttgcagtgagccgagatcgcgccactgcactccagcctggtgacagagcgagaccccacctcaagaaaaaaaaaaaaaaaaaagttagacaattatacagagatactcaagttcttgaaagaagtttgttgaggataagatttatttaaatggagtagttttactcttatttccactctcattttctccttttccccagatatatacaccttctcatttattggtgtttattacatgtaagattctcttgttttatttttttttaatgagctaagtttattattaaggtacttggctatgtactgtatataccttatctcattaatcttgttgacaatctgctaggtaattgttattatttccattttagagacgaggagacaaagacttaaaaaggttatttgcccggttagtaattggcagagccaaatttaaacccagatctgtacaattgaagctgatgtcttaactactatagtacagcggctttcttgatgctagatgatgtggccccagttttggtaatggaggaatactgatccaatccaaagtggatgtttgcatggaggagtcagagaattttaagaatgaaagggtacatggaagccatcagccctcatgtaaaacaaaagtcctgtgtatctgataaatgttctctgtttaactagatttgtatagtgccctgggagtactagttagcattagtaacaacattctggggcaggggagggtgggggaacgtatcatcagaaaaaatggatttggggatatagaggtgaaggcaggaagaggcagtcatatagaatgatgtgcttggaagatctctgccttttcatgtactgcatctgacaaaaatggatttgatgacatctgggatttgcttcaaaataatagaggaggagggaagtggatttggatgtggatgggacgggattggcctggtttgatggttgttggggttgtatgatggatgcatgggttttattatgtttttctattttgatgtatgttcaaaattctccataataaaatgtttttaaaagttatttgaaagtactgtttccatgattttatagtggtcagattatgtatatgttttcttatccaaaattcccttggtttttctcagaagctttttcttctagcatttgttcccttttagaatctccctcacctctctttctgattatttattaaaagaactcaattttttcagtgctgaaggagaagttaactatcaaatgcccatatagctacagtattgggataatttatctaatttttcttatgagtaagttctctttgactttatttttgaactcaacttgcttgcattgttcttgttagtaaaaaacattgctaggatgtacttagtaattggagtcagctgcacttaagactgttcagccagactgttattttagccttcactagtagggtttttaacaccagtttgaccttactttgaaacattctcaaaataccatactttaatatcaatttatatactttcatattaaggcagggccgggtccctggggaaaaaaataatgaaatttttacttcccacaaatgtagaataaaggtagatattctgattttgttttttaaagaaaaatagaggtaaagactttaaaatttttctttggtcaggacataatgcttgcaaatacattctaaaatataagtgggccaggcatggtggctcacgcctgtaatcccagcactttgggaggctgaggcgggtggatcacctgaggtcaggagttcgagaccagctggccaatatggcgagaccccgcctctactaaaagtacaaaaattagcccggcatggtggcgtgtgcatgtaatcccaggtactagggaggctgaggcaggagaatcactgaaacctgggaggcagaggctgtagtgagccaagattgtgccactgcactctagcctgggcgacagagcaagactctgtctcaaaaaaataaaataaaataaataaagtataagtcacagaaagataggacacctacaaattaggggtgctggtttcattggccagtgtgtcctaccattgctttgggatagagactgaatcctcagtgtgaagcaccaagtagatggtgattattcatgaaatcagaaagaattttttttctgaaatactaaattcccataacctatgcaaattacattttaggcaagtaatgctcaaattttctataagtgttctgaaaataagttataagtttttgttcatttcataggaggacagttgactcctttctactcttttttttgccgttgtccctattttttgccactggtaaactcctgcctagaggaatgccagaggcagaataaattttggagcatggattttttttttaaggagggttatagtatcctgaagacttcatttctttctctgaagacacaactatcagcaaatccatataaggcaagtgactccctaccatctcctccgagtcttctacgtgtatgtctagatactatgacagatccagtgcctgtgaagacctggaacatttcagacaatcacacagatgttttcttatgctatatataggaattaagcaagtgtttcataatgaagtgtccctccaagcattctctatcttctggtaatgcaaaagtgttagacatccagtaagcagccctttttaggcctaaaatgttgactactttatctctgttacctttctgaaatgtttggcctaatattttttataacatctctgtgaaagtttgaaaatttatgattgttgatcctcaatagtcaaaaaagtagtcatttaacaatacaatatttctctcgtgttcttgagcatgtatttaagttagctttagttaaccctttattttctggacttcttcaagtcagctctcagaattgtttttacgggttgctgaggaagctaaaggtcaaagatattttcttagtcagttgatttacctcaaagaattacttcatgtagattaactgaaataatgatgctgctaagattcgcagattaagatcattatagcatttgagtaggccctcagtgacaaattgctctaaacctgtttggctcaccaccataaggtttaaaacataaaaatataaaagtgcttaaaattttctttctgtttccttatcagaaatattcatttagaccataacaactgttagaacaagataacaactccaggccagctgtcaaatgtttaccattatcaaaactctccctggagggagatgcaactttggctcgcctcaccggcagtaatttaatttttccttcattctgactcggaaatggcagcatttttcaaagcttcctcccactgatggctgaaattttccttgtgaaatgatttccaccagtcttgaatctttcttgtttctgccgtcttcacctttgctgatggttctgcaactcatcaccagctatgcaaactgacagttcacatcctggggcagcagcggggtctggcctgcagaaaggagcagcctgaccaaatttacgctcacaagatctcttaattcacaaaagcatttgctctagttcctgttctctgctgcaggggctacggagagggagtgggggctgggggaggaccattgggagaatgttctgaggagaagagaggctctcttcacactctactgagtacacagactttggagatgaaaaacagacggagagaggcatttccaaccatcttgctgatctgtgcaggagttcattgaactgtacagcacagcaccagacccttgtgtcatttaatgttactttaaaaaattattcttaaatgttcagcacaaatatccctcccctttttacttaagctgaaaaagaatataaaaattaaagagaaattgaaaatctaagtcttgcagtgagaatgaccagaaatcgtttccctctctggggggttcctgtttaatatgaaagtcctcttaacaagcgtggacagaggaagttttaggtttgatttgaacttcatgtacaagacatatttcatttttttttcttccctcacaaatttcaacccaggccacttgtttgcagagactgccaaaccttccattgccgcttccaagatactcctggaatctgagattaccttttatcctcttgatggaccatgttgttatttttgtcattttccctgcagctcttctgctttgctggggaggactcatccccctatgcatcatctaccccccgatagctgacacagtactgttcacaaggttacttactggttttttgtttttttttttttgagacagtttcacgctgtggcccaggctggaatgtagggatgtgatcacggctcactgcaacctccacctcctgggctgaagtgatcctcccacgtcagtctcctgagtagctgggattacaggtgtaagccactacacccagctgatttttttttttttttggtgttttttgtagagacagggttttgccatgttgcccaggctggtctcgaactcctgggttcagggatccatccccctcggcctcctaaagtgctcggattacaggtgtgagccactgtaagcgactatccagccaaggtcgcttacttgtgtaccagtttgggtcactctgaaaattgctttgaaatacttactgtttaaaatgactgagctcttaggagtgtttctgccctctccccacaaccctcaaatatctaaaacaacctaatcaaattggtagttttcatggctttcaaaatggaactaaaattaaagtaaaaatgatagaatcttgagctagagtggcagatttgaattctaggctttgctggtccactgatgatgttcattttctttccttgtgactctcataatcagagtaaaaagatgagattgtaagtgataacacaatccattcagaatgtatgactttgctgaattgaggttgatctttaagtgtgagtaaaatgttatgcaaattggtagtttaaataatatttcagaggggaacatgcacttgctagagaaaatgaaaatatttcaaacccacttagtttttttaatggcagatgtttcctttttttaatttaaaaaaaatttttttaagacagggtcttgctctattgcccaggctggagtgcagtggcgtgatcatggcttactgcagcctcgacctcccaggctcaagcaaccctcccgcctcatcctcccgagtagttgggactataggcacacaccaccatgcctggctaatttttttttttgagacagagtctcactctgctgcccaagctggagtgcagtggtgtgatctcggctcactgcaacctccacctctcaggttcaagcgattctcgtgccttagcctcctgaggacctgggactacaggtacgcaccaccacacctagctaattttttgtatttttagtagagacggggtttctccatgttggtcaggctggtctcaaactcctgacctcaggtaatccgcccgcctcagcctcccaaagtgctgggattacaggcatgatccaccgcacccggccatacctggctaatttttggttttggttttgtagagagggggtttcaccaggttgccaggctggtcttgaactcctgagcttaatcagtctatccaccttggcctccaaaagtgctgggattacaggtgtgcaccattgtacctgggccaacaggtgtttcttgtatcaaagtagcgctaatagatttctgtttctcaaagtgttctcaagtataactcacctgcttccttgtttcagactggccatttccctaattgcctgaattagcggtgtttttatattctcaataaagctttgggggatacataccttagaaatgtataagttggggcggggcaccgtggctcacgcctgtaatcccagcacttcgggaggccgaggtgggcgggtcacctgaggttgggagttcaagaccagcctgaccaacatggagaaaccccatctctactaaaaatacaaaattagtcaggcgtggtggtgcatgcctgtaatcccagctactcgggaggctgaggcacgaggatcgcttgaacctgggaggcggaggttgcagtgagccgagatcatgccattgcactccaatctgggaaacaagagtgaaactctgtctcagaaaaaaaaagaaagaaagaaatgtataagttggttgggaatgcagctaccaatacaagatacagtatgtgctaaattccacaaggaacattgttgacagtaagtgctataggaattttagataagtagagacactcagaaggtttagaaaactgtgtgtgtgtgtaatttatattaatacatctcacacacacacacagaagtttttgtattatttccagagcttgatatattctctgcccataaaatgtttagctgataggtctgtgaaactgccctcaaatttggagccaactcattttatttggtgtagtagctcatataatagttaccttttattgagtacttactatgtaccaaccattatgtgccagacactgttccaaacactgtgttaaaccacttcatggaacattcaaaaactcagaggctacactggctggatttaagtggtgggggttatacagcaaattacctacatttaaggttgctgctgccgtttcattccatgttgccaactgcagaaatgtgggctccgtgttcccagactttccatttagtcaaaagagacaggaaattcacatttttatggatatttcctgattttttaaacactacaggctaactgaaacagtttgtgacttttgcattgtatgttccactccattttatcctcataacatccctacaagataggtataattatttgtatttgcgcactctcaacacagctaatacagagcaaaagtagaaatctactgcaggtctgtctccctccaaaaactatgttgttattgcgcttcctcatctggttccctaaactcatgaaggtggtactgttggcaaaaaaatgtactgtttggttaaagccaggcccttaacaaaattatcaaacagcatggtactgtaccacagagtgccattttccagaaaacagttatttatggctttgggagaattgattgtaacatgaagataatgataactgcaaatatcaaacaaaagctctgttgactttgctccagattttttatttcaaccccatggtacttctagaaaaggcacacaaatactctaaattgttaacagagttcttcaagtttctcaaagagtggcaaaaatattagtggcaattttacaaagcctgaccttgccagaaagagatatcagtagttctcggtgtctactaaatatttaatcacttttattaaaattctaaatgaacttagacgccttgaggagttaatgcacctccacaaacctgctttccgctggtaagatcaggcccattattattattatgtacagctgtaaaaagctggttccatagcataaattgcgaaatacttaggcaagaagattattcgagaagaattgtattgcttgttcagttatatattttgatctttatagctagtagttttttttctcatgagagttggagattaaccttgcttttaatgtaaaaagtatatcagtgagggtaaaaatagaaaatgaaaatagatttttaatggcaactttggttcttagcattaattttacatgcatttttcattctgaacttttaaacagttttgagaaacatatgagagatttgtgaacaggggcaagggagggtcaaatgtatcaaatccttggattccagcaaatgtaggatttgtggaagagctgagaagcacacatgtgttgggaatgtaaattaaaataaaaccccactttgtgaaggctttgaaaagagagtgcaccctgttatggcaaatgtctgaggcgtttgtcttcttaataaattaaccaaatattaaaataaacattacttttatcagcctgcatttttcctctctggatgaaagtgtttcaggaaaaatcataaaagaatctatggtagctcagagaggttaaactcaacagttgttttctttgaagtctctggccatgaggttaattgccaaaactgcttgtggaaaaggtggtaacaatttaacaagactgtacaactgcagagacttagatgaatatcaggtgtttgcagatgttttttcctaacaggaaagggggtggggaggagaggcggaacagaatgagaaacaggggaagagagaggcctgaataaagtcccaactaaacagccaataattctttgtttgcttagccaatcatcctgtaattggccaggaggttaataggagtctattgattggtcaggaagattgcttactgtggctgtttttacagtatgctcccagacagaagactgcaattactggagctctcattcccactctttagggccatggctgctctgatttatgaaacccgatcaggttgctgttggcagtttatgttttaagtgttgccttctgggtctttgctgcttatgggtcactgtgctatttctcatcatttattgtggtcatttgaataggtaagcttatttatgacttactgaagtaggaatacattaaaagtaataaccaccacccacgtgcactgaaaagtgggaacaatcgtacaagatgtgtgacagagctctgcttgttctagaaatagagattctgctaccagtatagagtttacaaaagaccaggaaataaaataatacagcccttcctttctctgtcttcaacagacatgtttctcaactctcctcattaattcctgctaattgattacacttagatttgctttcgtataacttctcataattagatttggttgctggtatgttagagttaggaaactgaggccaagttgtaaatgtctttaacccccagactgcttttggaacttgtgacagggctcttctaacttaacccatcctgacctggtcttgaccttagcattactaataaggtacttacctcatcatttcgtttctcacttactgaacgtgactataaatcctcctgttactcaagatcttggttttccacacttttgcaaaccttcttttgtagttccctgggagcccagttgaaggggagtaaatctttaattctgataaggccctggagccacagacttctgtgtagccacatctagacaactgaatttcacttacacttccaacttctcatttaaagctacaatgaccacaactactgcaatgactgttactgctactactactgctattacaggttgaccatcccaaatccaaacatctgaaatctgggatgctccaaaattcaaaacttttttgagtgagtgccaatattacactctaaggcaatgttcattggaggattttcgatcttcagattagggattctcaaccagtaagtatataatgcaaatattctaagatctgaaaaaattcaaaattcaaagcactcctggtcccaagcatttcggataggggataatcaacctataccactacctcctcctcctgttttttcctactttttttttttttaacctgttaaggtcttccgcaaattcctgcattgcttctaatctaaacatctctttcattcaacgttttcttttttttttgagatagggtttcactctgtcacccagactggggtacgtggcacaatcatgactcactgcagcctcaacctccctggctcaagtgatccttccagttcagtctcccatgtagctgatactgactagcacgcccagcaaatttttaaatttttggcagaaacaagttctcgccattttacccagactggtcttgaattcctgggctcaagtgagcctcctgccttggccccgcaaagtgctgggattacaagcatgagccactgcacctggccaacatctatattttgaatgactgttgtatgccaggtgctcttggcaaggtctctggatacagtgttgatgagatagaccacaggcttttcatgccaatactcctcctgcaaacgtgaatgttcctaaaatgcaccagacttactataagaagtatggcaagcaccagctccacatagtgacacagtaccggaagggcaaggattctctgtgtgcccagggaaagtggttttatgataggaaggacagtggcttatagtagtgtgtctggagttggttccttcggtgggttcatggtctcgctgacttcaagaccgtggaccttggcagtgagtggtacagctcttaaagatggcacggacccaaagagtgagcagtagcaaggtttattgtgaagagcaaaagaacaaagctttcacagcgtggaaggggacccaagcaggttgctgctgctggctggggtggccagcttttattcccttatttgtcccctcccatgttctgtttttgtcctatcagagtgcccttttttcaatcctccctgcccttagctacttttaggatcctagtgattggtgtgttttacagagcaatgattggtgcattttacagagtgctgattggtgcattttacaatcctcttgctagctacagagcgctgattggtgcattttataatcctcttgtaagacagaaaagttctccaagtccccactcgacccaggaagtccagatggcttcacctctcagtaggcagactgagcctatttttctagaaaagggttaaaactaggaagaaaatagtgctaaggcttgaacatgttgagcccaacctcagatctaagagaatgctggtagaggaggtaagaagagaagaaagggccaaatgatccagttctaagtttcaatctttttattattaatattattgtaaagataataaagtcttaaggttaacttctaaaaaaaaaaataccccaatactgcagattcctggtcattctccttcctcaaaggacccttttagtttggtgagtatacttctctccacaaatcagtgaaagatgtgcttaccccaactggggcaaaggatctaaaacagcctcctggagatttatttttctgtaagggaatcccttattgttaaactgttatttttgtactgcctgaactgggatataatgccttttctacttccttcttttgaaagaaattttctatcatcctatactaacttacagtttttcttgtcctcctgagcttgctgcagctcaaaagaaccttcataatttactcccctgtctgtcagtagaagctggaactccctttctcttcccatagcttctgtaaataagagaagtggccttttcctgcctgtctcccattacctcactttagaagtctcttctggtggtaatctcaccttttatgagagtgttttcaactattgtaactaacttgttgttcccataatacaatgttgtaggacagtgctaatccgacttgtccttcagtgtggtaattatgggccaagtaaagtaaaatgttagttgctaagtctccagtggggtactccaccaccagttctactggactttgagaatatcattcctgcctttcttcttggttcacgtctaggcaagattacctctttttctctgttttcttactattttaataattgtttttactatgaatatcagagggaaagagatgactttgcccttaaaagatgctagccacataatctctgcaacctcaccaaacccccagtgtaaggtagcatctcctatttaatttggaattcataagagaagttagcttgttacttttaaatggactacagtttctttatcatctgctttaccataatccaaaaatttcagaaccccagaggaaggtccttaagattaattatctctaccattgtatgccgttagaatccttgtatcatgtatcattttttttcttgttttttcgtttgtttggctaaactttgctgtttacctcattatcaacttttatatcagaactcaacagcagtcatattaggattctttagtaacacagcgatgtgtgcacttttatcttcccatttgggggtgaaatctgccactgttttccaaacgaattaacaaccaaccaacaaccacacacaaaaaaggaataattcatgttctgacactagccagcttaaaagtctcattgttttggtatcctttcactgttgctaaagaaattaagaggatggagaaaacaacaatccattggtttagtgaagggaagcaaggttgagggagtaaatgtgatgttcatccccccactgccactttgttctcctgaaggacctttcctttagatatttgtcgcactgccttccttcagtttgttttcttttcccttgttttgttttgaaccaatgtgtcctttgaggaaggaaggaagggagggaaggaagaaggaaaggaggagagaagaaaactcatgtaatacagccaagattgtgaactgagagttggggcaaatgcaatatttggtgatgcaactatttctaaacctttgtgtgctggaccagccttgacacagtcaccgttttttggaacaactcggagggattttctttgcaaaaattctgtgatttcagttttcatagttccaggactaaattgccagcacaagcaattttttttttttttttgagacagggtctccctctgttgcccaggctggagtgcagtggggggatcatggctcactgcagcctagacctcttgggctcaagcagttctcccaactcagccaccccagtggctgggaccacagtgtgcaccaccacacctgactaatttttttactttttatttttttctatagatgagatctctctacattgcccaggctggtctcaaactcctgagcttaagcgaccctccccacatgggtctcctgaagtactgggattacaggcatgagccaccgcgcccagcctcagagggattttgttcttgagaactaaaacgtgacttctgttaatcatcagaatatttatttaatgtgtttaatgtaaaaaaggaattacatttattgtaaatgaaggcactaaatatatttttactcttaaattacaatgttgaagtatccttttgatcaaatgcaactggttttttttttttggtggggggtgtttggcttgcaaaagataaatcatttcagaaatgtttttctatttgcattttttcttgaaattttcttttgagtatggaaaagtgatcaacaaacaatacagagaatttttaatgagacatgtcaggcatcgtggaaggctcttgcctgggtcacttatgtgatgacctcaacaaacccattttattatacaatgaaaaaagtgtacgaagcttacatatgatttttttttaagtttcttcctgccagagcatggattaaagaaactttagtaaagagtaaaaaattttaaaacacacagtttgatatgaattttggtaaaagttatcagagacaaatactagtgggccaacgaaaacactgtatttataggaaaatttgaattggggcaataaatatgtcctgaggctttggtggcatcaaagtattggtgctttattttttgtgatttattgttttatcaacagaagtgagcacttgtgttcagaaaaggataattcacacttaaatcttgtttttatttaatcaagcttaaataacaggttagagtggtagcaaaaaaaaaaaaaaaaagtctaatatttagtttgaatcttaaattggtcacccagagctgctctctctaggagcgaacctctctatttgtcaataaacaagagagagatacaggctcccagataacaggcatttggtaaactggcgacagtcatacaagcgagaatgttaaaatgacttcagctctttctagcttcattatgtcagcctggcagatcacatatggcattatggaaatcagcaaatgaaaaccatattgatcagcattgagaacaaatgtaaaaaaggtggtctcagggaggagcagagaagaagaatgctttcctgttcaacctgataggcccttgttaaggccttttaatcatttattaacataaccctccttcttccctctccactcagattacctcagccacagagcatcctgctccatttatcttttaatgcttcctttatttaatttatttttaagctctaagttatactcttatttcagaattgagttttacttttcatggtattgtttaaagtgacttaaatgacttttcccaacaagctcaccaggcattcaaaggaagaaaagcatttgctgagattcacctatcagcaaataatttactcggtatgcaccacaaacaaacgcagagagacagagaaagacagtcagccagacacattaaaaaaaaaaaaaagaaaagtaaaatctgagttgttactaagcctaattctctggttaaagtttgggtcaatgtattcattttggtcttcttttcagggattggaattgagcctggtaaaattccttaggtctaaaactggaatctcaggcaccttctctttccctcttcattttctgagttcgggagaaaggtggacttttgttttatcttgtttcttttgggggaaacttagagtaatatttggtctgccaaaatgagatagagaaatggaaatacgtgctttgtggaggatcctgttttccttgagtgtccttacctgaaatggtctctttggttttgtaggttcagactgaggttggaacgggcttgcttctctctctcaccttctccctacccaacccctgcctccccttttatttttatgtcgagtttcatcatttggtaagaaatttcagagggatttttaaatatgaaactgtgtctttttgtagttgatgagtaacctgtggatgtgaatccttggaatcctaattggcacataacaataattgtttctatcctgctataaaccataagtaactcctaaaaaaattcacatgcacacaaaaaatctgcagtgtggatataagttaatgccctgaagctggtacatacagaccacctcaacgatggactcctttatgaatgatttaggtaattgacacaatttaatatttgcaattatttttcctttgaaacaacacttaaaaaaaacaaattctacaacatttaaacagttgaggcatcactctcctataaatttagtattaaatttcaaaatacgtatttgttttaaaaagcaaatgtggttaatctcgaaatcattgaactttctctttgctctggactccttgtctgaggctgtttgggatggattaattttaacttttctttcctgtttctttgctttcccagtgcatctgggggaaataactctgattgatttggatatcaaaagatgtacaatgtgaagatctaatttatcaaaacagaattcaataattttattcattttggctctcccttgagactccaaagatatattcagtaatatatttgaaaaatccaggtataaaaatgtcttttatcttctcttcatcttgtatactccttgatttctaagtacttttcctcttagactcatattactatcccactttcctttctgggctctacatcaaacagtgtaggaattacagcaggagtgctatctgtggaagacttactccccttgtttgttgcagaagagcagaacattaaacagtgagtggactatgcagaaacgctctccctctccggctcttttctccctccctgcctctttttttttttcattcttgcctctccttctcttcctctgtttctctctttctctctctctctctcttcccccccacccgcccccattcccaatgggagtgttgtttatagagcattataatttataactgaagagagtggatttaatttcagtggagaggctcgccagcagggcgccagcctgcaatcatatgaatcagcaagctgcaaactctattgaatggaaagtattatcgctggccacaaacggacactgtttctcctaaacaactcccttggtgcaggaagaccttgtcttcattcatctattttacatatctacttctgttttaattttgccatttcctaaaagtgttttctgttttagattgcagcttttctctaactaccttatttcctgatgcaatattgaaaactgctattgtatatttctgactgatttgatatctcttctttccttattctttaccatgtatgactagttttctgtttgcttctccttcctatatgcaactcttttttttatgagacctgttaaacctgccaaaagactaaccattagcattaatactgtaaaatgctagtcagtttggatcacctcaagttttatttaatcatggatattttgtttatactccgacattttttctacattcatggaaagatttattttgttgtcttgcaaacatctgggagatgatttcttattctttacatgacccatcaaatgtcttgtaatgttagtacttgtgcctttataccacatttttctcaagtgtttcagtcatttttttaggaaaagggatagaatatgtgcatgacttgtggctggtatttgttttttgctttaactcaaaatcagctgctttaatgtagctgaactaaatctctaggttattctaaaaatcaagttggaccaactttgctgatacctttttaagaagtattttactgaattcatgtagctattataattgttgggaattttggtagtgaatctttaactgaggttagacagattgcattactcttgcatcaaatatcatgctatcttcatccaggcttttaaataatttcaacacctatgccttaacaataaaatcccagttgcacaaatagcgggttaactgataatgatatttgcttaaagggaaagagggatagtacatgagacagtaaggcagctccgataaaggaatttgatttcgatttcattggaaagccagactagtctgactacatttatttaaaataaaggtctttaaagatactaaccgaaatgcaaaaattagcagataacaaaagtgaacttctaataacaaaacttctaatcagaaatttgattagaagttcatgttttgtcagaaatagatcctttttgttatataaaaggaaattatttatacatcagcttgcatattttcttcacacaatttaacatcaacaactcaaaatatatgtaatcataatttttctcatttcaagcacaaacttgtgaatccatatatattcatacattttatcctttaaagtgtgagaatagagttatagtcttcactgtctcagctaggtttttcttttcttttttcctttttgcctttgattactccataagaattacacacagaagcagaaaatcaatatgtttacctctgcttattttcaaaattgaatgttgctgtggtttgataccagagacggtatacccagtatcagctttgagagattttgtttggttttagtttaaaattccttgtgtgtgtggatattacctctgacaacaattaactatcagtaaaagtaaaatgttcattttttttttccccaagaagtagtgagtgaaatgaagaagaaacttgtgagatgatttcaggtgaacatctttctaaatccttttattcatgacttaaaaccatttggtaagtctgacccaagatgtatggatttttattgaattattaagattacaaaaactacaggcagctatcttcacacatatcttcagacagtaatcttgtgcatttttaacatccttgaggaggtgggagaactatgttgaagtgcagacatttgattaaggttggaatgactcaacagtagtgaaaacacccttgccttcatcttttcagaggcctggagaggcagaccctttgtcttttcacttgagtcctgccttctttgtttttgtgttttgttttgtttttgcctaaaagatgttcctctctacctgtaatgtaacattcaagaaaaatctggtttatctgtgcctcatcctgattaattcctattttcaaaatctaccataagaactttcaaaatccagtcctagaacagataagttgtgtttgcctgtgtattctatgcaaaagattagtttctttaaatttatacacacaagttaatacctttgagaattttctgcaattgaagtaaaagaaaaaatatgtggttggcatctttgatttttttttttttgtagtgacagtctcgctggtatctttgatttaaataaaaatatatattgaaaatagaaccatctataaatacatttgtccaaaatctttatatgctactagattcaaagatataaattaactacaaggaaatgccattcactaaaaagttgctttttatcatttaaagcagggtggtttttttttttgcagaatttttgcatgttatggtgacctgacttcctaacatattatctgattccttgatcagaaaaactttataaaaatagtctgagttaattttttttttaatttactggataaccttgtaaaagtccctccactagtcatatagtgaatatgtcacatttaggtaattgccattgccgtgctggatggttaatatacggaatttccgagcactgatctaatagaacttgctggggcatcatggcagacaagtatgtctcccctccctgtgactgcgctcctgcatggtatgcttggcaagcttagcaaagcttaaaagtcagctgcatctgtgtgatccaactttgctttgactgggagcaattgagtacaccatttgttttttctaaatatcacaaaaattgtattttccatttactagggccttttaagaaaaaaatgcctagggctgatggtttaccaacttttttaccatctatgcctccaaaatataaaaaaggtcatggtcttactactgattatagtggaccacactatggtcactctagttaaaactgtgaccttgaagcgggggttgggtaaggaaggccctacttgtggcagctttcctccacattttggagctttgatgtgttcctgcagctgatataaatgcagggagggggtgtcagggagaggcagctggctggcagcgacagattaaaatatttctgacccacaaatgtaaccaaatgcccatatttcttcatttaacataattaatgccttgtatttccactgactttgataaagtggccttcctcttcccatcccatcccccttccctgtgtcaactttgggacgactacaagagatctatagttaaaatactctgcagatgatgaaggatagcatgtctgaaaaaagctaacataaaagtctcaattaggttgctgcctagcaggaagcttataaccacattaaaatggaaaagttatttcatttttagtatactgtatttcagcagcaagagttgcaatctgagagtaatatgaaacattttggtttggctgccaagtacatccacattttgttataaatgtataattacaggaaatatgtgaaaagtgttaaatatttcttatcaaatattgttaaagaggtattctggttacatttggaatttagaaaaggcctgggatggattttgatcatgttacaaggcccacttgttgcatttaatttaaagcagttgtcccaatttcattaccacagagcatagcgttttcaaatttattctttaaaagacagagatagtggcacaaaatgtgctgtgggtttaagcaatatttgattgatcatgtgattctatcagtatcttttttttcttttattttgcctcagtatacacatttctgaatgaaaagatagacgatgtctttattttaaacaatctagtggtggttgaagaggccatctggaaaggtgatgtcaacggagggtagggtggttgctggtggaggggagtagccagcgcccctcccctcagcacacataccagcccccgcaattccagtttcatggtgcctgagttgctgtctggttggttgaactcattctcctcagcttatatttaactcgtcgcttgttctggaaaagtagtagtactgccttctctggcctttataaacatgattgctggacaaagatgagcagcacggatttgctgcgatggtcagaattcaattatattactctctctgaggcaaaaagcacacatttaataactaaattggattccttctactaagagatcctaaattcgtgtttaatagccagctaaatgtagagctgatttatatttataggctggttgtagatttggttgatagaatataaagtttgatctgtatgtggatggttttactaccccaaatgaaatgtacgtatcctggtcctgcaccatgtttttcttcagtaaaaattgaagatattttattgggaaatatcctgggtaagtaaacagtgattgcaatgtgtatggagccacggttcttacaggagtgggtatggttcacataggaagtgggagcctagttaagattccgattctctgtgggatggggataggtagggaatcatttctcaggagaaggagagcttgcgaatggaaggggtgttcctgccagctgggtttctttgcattcccaacagaaggttgtttcatatgcatttgcctctacaagaatattctcacaccatagatatagagaaaggacaggtatatacatcgtattttatttgaaggtatcctgacagaatttctgcctatcttttttcctgctacagtctgttgtacagcagcaagaccaagatgattccagtaataagccttattggtatggttcactgatttttttggactctgcatttattttagcagacttccccaataacattttgcagttttcagcttttagttgttgaaaacaaaaataataagtaaaccagttcagggatatacttctctttctgaaactgattccatgtcataatgccctccttggggaggagcaacgtctccagccgaggctgcaacccgaggaaccactcctgatggaatatgagaaagaaaagtgtattatttacattcttaatgttttgccttttgttgttatttgggacactcaagaggaccaacatgacgttagagctttttacttaataaattatatacatatatatcttgcttaagttttataggtaatcctggaagtttagtcttactttgggaaaagatcaaggcaacattctattcacattcgttcagcaaatatttgttgagcacctattatatgtcataatagtgagtgcctagaatacatttaccagaggaaatgttgttcctactaaatgagtaaaaccctgcggcacacacgataaatattatttttaaaaagtggttttaggccaggcctggtggctcacgcctgtaatcccagcacctggggaggccgaggtgggcagatcacgaggtcaggagatcaagaccatcctggctaacacggtgaaacccagtctctactaaaaatacaaaaaattagccgggcgtggtggtgggcgcctgtagtcccagctactggggaggctgaggcaggagaatggtgtgaacctgggaggcggagcttgcagtgagccgagatcacgccactgcattccagcctgggcgacagagcgagactccgtctcagaaaggaaaaaaaaaaaaaaagtttttttctatgctaaaatttaacagatcaattcttctcaactattaggagatgggatggtttctattctcttaacacctgaatgaccaagatactttagatctgaagtataattacagtatgtttttccagggcagagcttctcagagtctttatttaaaggtttcatttcagagtcctttatggaatgtagattaagaagtagtaatattccatctacccaaaagtcaaacaaacaaattttttaaaaactcaaatagccaggcacggtggctcacgcctgtaatcccagtactttgggaggccaaggtgggcagatcacctgaggttgggagttcgagaccagcttgaccaacatggagaaaccccgtctctactaaaaatacaaaattagccaggcatggtggcgcatgcctgtaatcccagctactcgggagtctgagccaggagaatcgcttgtttctcctctgcctctgggaggcagaggttgcagtgagccgagattgtaccatcgcactccagcctgggcaacaagaacgaaactccatctcaaaaaaaaaaaaccaaaaaaaaaaaacctcaaataaatcaaagatttatttgaaatgaccagatttttgggcactgaaatcagtgataaagacatgactttttttttttttttttttggaaacatcagtactgggaaatttataaagcccttaatagaaagtgataaaaatactatggaatcatgtgtgtagtaattccgaatcaatggcaagatgttgaattatcttctaaatttttaaagaaatactatgttcagggtagttttttattaaacatgtgctatggtttcaatatgtccccaaagttcatgtgttggaaatgtaatctccaatgaaaaggtgttaagaggtgggacctttaagaggtgattaggtctgggcatggtagttcacacctgtaatgccagcaacactttgggtggccaaagcaggaggacatttgaggacaggagttagagaccagcctggacaacatactgagaccccatccctaccaaaaaaaagtaaactaggtcatgagggttccacccccatgaatgaattaatgctgttatcgcaggagtaggttagttattgcaggagtgggctggttatcgcagagtgagattctgactaaagggtgagttcagcccaatttgcttgctctgtcacatgcttgcttctgccttccatcttccaccatagaatgaccctcaccagagcctggtgtcatgcgcttggacttcccagcctccaaaactgagccaaataaacctttgttctttataaattacccagtctgtggtattgttatagcagcagaaaatgaactaagatagcattcttcataatcttctagttccttatgagttagtatccacaaatgatggataagatacctgttcattcataagcatgttctgtgtactccagcatggtattcatttcccgattggaccactttcctggtccgttatggaaaggtgaacaaacaaacaaaccccacatggacattcagattgaacagtgatgatccttagttggttctccatgcaggtggctgttaaagaagcagagtgcttgacaggcctgcctgggagaaggcaagcagtaacagtttctatccattcaattcttactccttttttatgccctttccttacctaataatttccctaattatctggtatatttcaaaggaagctctgttaggaccaacagcatgtaaattagacacttttctcccaaaaggagccttgggatccaaaggaattagaatgaactcaccaaagaagccagatcctttcctaaaagggtacttaaccttagtgcccaccaatgtatatcctggccacatatattttcagtagtattatgcactctgaggacatttacattcttttttaaaagttattctacttttttttaaaaaagttttaggctgggcgcagtggctcacgcctataatcccagcactttgggaggctgaggcgagtgcattacctgaggttggtagcctgaccaacatggagaaaccccatctctactaaaaatacaaaattagccaggcatggtgtcacatgcctgtaatcccagctactcgggaggctgaggcaggagaattgcttcaacctgggaggcagaggttgcagtgagccaagattgcaccattgcactccagtctgggtaacaagagtgaaactctgtctcagaaaaacaaacaaacaaacaaaaaacttttaaaaactattttttaaaaaaatactaaaaaagttatcctactattttttcaaaagttattctctatttttaaaaagttataatttctagcggactcttcacttacattacctggattaatacttgaaagaactcaaagaggcaggaattactattttatattttatagatgagtaaatggaggcttagagatgttaggttatttcagcatagttactaagtgatagagctggaagtcaaactgaggttttgtaaatctaaattttgtctttccaccaagtgacactacataattcttatgatggtaaggacatagctaaagtaggtaattgctgcttcagcttcttgatgaatgaaggaaactgaatctcataagtttttccctttttccccataattgctagtttagtctttgcaaaacaaagcacctctcccaggattccttttggcagattatcatcaagcaaaatcctcgaattccctcatggcatattttttgtcctataaagtatcttatttaactgtagcttcatcacggtcttccctccaaactacttactagttaaaaggcacttcgtatcaggcccttctaatagcaaatagctccataaagcatttccttttttttctttttctaaacgttttattattattgttactctctctctctctctcttttttttttttttttttttttttgagacagagtcttgctctgtttcccaggctgaaatgcagtggtgtgagctcagctcactgcaacctgcgtctcctgggttcaggcagttctcttgcctctgcctcccaagtagctgggattacagccatgcaccaccatacctggctgatttttgtgtttttagtggacacggggtttcaccatgctggccaggctggtctcgaactcctgacctcaagtgatccgcctgccttgccctctcaaagtgctgagattacaggcatgagccactgcacccatcctgaactttttattattttttagtttttatttttagagacatcatctcactccgtcgcacaggctggagtgtagtggcacaatcatagatcactgtggccttcaattccctggggtagagtcatcctcccacttcagcctcctgattagttgggactacaggcatgtgccaccatgactggctaattttgttgttgttgttgttgtagagatggagtctcactactcactactccatctctacaacaatgtggagacccaggctggtctccaactcctgggctcaagcgatcctcccaccttggccttccaaagtgctgggattacaggcaggagctaccacgcccagccgagcacttccttaaagaatctatttattttgtgaaataggtaaatatttattgaatgcttattgtgtttttagcagtgtgggaggtgagaaaacttttcctttcctaattcaaggagccttagttaggaaagatgaggcataagtgcatttcaattacttaaaagatgaagaaataccacaaggcactatatgagtaattgcaaaattaatggcacagagagtaaatgcttatcgtaatattagaattgtaacactgataaagtccttatctagtcccacttccttaaaagaagataaaactcagaaagattagcaatacaggcttaaaattatacagcaagatattgccaggtctagaattcaaattcacatcttttgactaccagtctctcacctgaactaactctctccttgaactgtagatacttagatttttgagagggaaataaaatctcactatagatagttttaagcttctgacacaatctagcagatgtctgtgaaactgtgtgctataccctggacattaggcactaggtactagaaaagatggtcccctgactcaagtagtttacagtgtaatagggtagacctctaaaaaactggactacaaggtaaacttaaggaaatgacacagaagagctttacgtacatatgctgtgggagcccagacattggaggagaaaccctgtttatcaggactggggcttcttgtaggggatacctttgaacagatggcattgtttggaaggacatttcatacaaaggaaagggctgtgacttgcattttgtttgttagtgctttgatgattcgtagctattttctttttctagtctcatttttgttccccatgcctacttttcatcgtcttagccacctgtacacatgcctcagtgctaaaacctacatttcgatatttgctgtaactataggtttacttctctcctctttggtatcatacggcgctgcctgcctcctgatggtagacatcattttatttctccattggcttttatcactcattggaaacaaaggaaatttatgcccactgacaaaattaagcattggcttatttcatttgctgggtcaggtttgacttttcttttttcccatctgtctccttctgtatgtttttgatttctctaactctagactttttttctacccttccacaatttcccctctgttaactcccacactctggaagatctttttgatgactctttgatccaactctgtatttatatctatcatgcggacctctctcgttccttgagccttttctatttctcccttctcctatattttgtatttggcattgaattaccatcctgcaaaatgggctgactccattttgtgtaaaaaataaatgcaatcaaatgaaagctaatttatttttaacagggactttgaatgcctggagattaggtcataattttctcaccttttcaaatatttatctctaattttccctcctgccaaagtctagaattccagagtgtttttccctagtaatttaattaggccacaagtttgaggcttaatggtagatcaaaaaatgtatgatatgcttgagagatcaagacagcaaattgattactgttgtagcaaaggttggcaaatgtgggagaaggagcaggttctgccctgtgctgcaagatctgagtcagcgatcaaggtcagtctcagttcattaacttcttctgaaggcttatagtcattgcaaatataactgcttataccttatgttatcattatatagtacggttttggaatgacttatgttcacctcaaatgtgtcctagagtaacagaaggatgctgaaatgtctagagtagtataaactgatttctgaccattttgcctagtttcctaatgcccacaaatggaaaagtctcacctctcaaggtataagtgtggataaatactctcacatgtgctgagatcagacaggggcctgcttttaaatgaatcatccaaaaatcattatttattttgaggagcaatatacaaggattctcactgtacttccagccaatacattatttaacattagaatatatttcatattattaaggtctcaccattaagaaagatgttttctcaacagttctaatacctatgtcattcttatgttcagacaataccaaaactctttttaactgtaaattgctacccttaagcccacttttaaatgatgtttaatatattccacttgaaacaaaatggcaaatcatattaagcttaacagtttttgagaagtctggaatgaaggtaacattttatgtgcccagtcctttacatagaagtagaataacttggtttgagatttttgtatgtggataacctagctgtgcaatgagataggattctttttccttttctttccttgttatttaaaaaaaattgagatggggttttgctatgttgaccaggctggtctcaaactcctggccttatgcaatcctcccatcttggcctcccaaagtgctaggattacatgtgtgagcccggccgagatagaattgtttcatttaaggattcctcagtgtactttagaagcactccacaccaacctttataaataaacagaaagtcagaaaaattgttatactttttcatttgttaaacatattttaaagaccatttgattttcagacagtggtggtggtgataagataatgtattgaggttgtttttaagccaagaatatctgtggatatgggaccatttttacttatctcatgtaaaatagattttgatccaatttctgtgagttgatttttctgaaaatgaaataattaacattattttcttttcttttgagacagagtcttgcactgtcgcccaggctgtagtgcagtgatgcgatcttggctcactgcaacttccacctcccgggttcaagcaattcttgtgcctcagcctcccgagtagctgggattacagatggatgccacctcgcctggctgatttttgtattttgagtagagacggggtttcaccacgttggccaggctggtctcgaactcctgacctcaggtgatctgccacctaagcctcccaaactgctgtgattagaggtgtgagtcaccgcgcccggctaacatttactttctaatcagttgggtattccacacatcgaattacacaaggccttcaataaatgcaggcaccagacttacccttctgcttgaaacaaactgaacaatgatatgatgtaatggttttttgtttttgtttttgttttttggttttttttgagacggagtctcgctctgtcgcccaggctggagtgcagtggtgcgaccttggctcactgcaagctccacctcgagggttcacaccattctcctgcctcagcctcccaagtggctgggactacgggtgcccaccaccacgcccggctaattttttgtagttttagtagagatgaggtttcaccgtgttagccaggatggtcttgatctcctgacctcatgatctgcctgccttggcctcccaaagtgctgggattacaggcgtgagccaccgcgcctggccgatacgatgtaatggttttcaaggtattgggtaacaggcagttaaggatagttatccctgaaagatgggaaataaatgaagtgagccctgcaattgtcagagctcgtcgctggtacatattgaaggaaggggaaatccaggtggagtgcagcagtcttcatgagtggaggagatagaggtgggaggttgaggaggccaaggtggctagaactcacagggcagagtccccgagaggaaagagctgtacacggagagagaacattctagagatctacagaggacatcctgcaagccttcagctgagcacatgggaaactacccaaggcccaggaaagagccacttaaaaagatcagagggaacattcgctggagcttatgcagggctgggagtgatttctgttcccattagccagattggaaaatctcataatttgcaggtaaagtgatacaagatttttgtgtcaaaagtggggcaaaatttcctctaaattcctgtagccttccttgcttaaaaaaaagcaagacccacggcacctcctaattaagtcgcttataatcagtgataaagagaaaaatgttgtaaggttcttacactgtacatgaagtgatataatacatcctaaatgtgtagacttggataagttacaaatatatgctatacattctaaagcagcctctaaagtaacataggtgtagctaatcagttaacaaatgagataaaaatggcatcctaaaaatattcagtagatccaaaacaacacatgggaaccaaaaagaaaaaaatggaacaaagaataaatgtatgaactaatagaaaacatttagcaagatggtagatttaaacttggccatatcaaaagtcatattgaatgtaaatggtctaaacactcaattaaaagacaggaaatgtaagattggataaaaaaggcaagaatcacctacatcttgcccataaaaatctcacctaaatataaagacatgaataggacaaaagtaaaaggatagaaataatgatatattatgctaatactaattttattttattttttttttgaaacagcgtctgttgccaaggctgatatgcagtgacatgattacagctcactgcagcctcaaactcctgggctcaagtcatcctcctgcttcagcctcctgagtagctgggatttcaggcatgtgccaccatgccctgctaattaaaaaaaaatttttttttttttttgtagaaatggagtctcactgtgttgttcgggctgttcttgaacttctggaattaagtgattctctcaccttggccttccaaagtgttacgattaccagtgtgagccaccatacccagcaaacaggaagctttaaaaagcaggaatggctatattaatagacaaagtagacttcagaacaaagaatattatcacagaataaggaaacatttcataattacaaaggggtcagttcgtgaagagaacatatcagttctgaatgtttgcctcattacagagcttcaaaacacatgaaacaaaactgatagaactacatgtagaattgggtgaacacacaattatagttggagattcaacatctctttctcagtcctcaatagaatagacaaagaatcagcaagaaggagatagaatatttagaataacactaatcaccaacttaatctagttgacatttactgaaaaacaaaaaacactaccaacggcagaaccaccttctttccaagtgcacacaaactatttactataataattcatattctggccgggcgtggtggcttacgcctaatcccagcactttgggaggccgaggcgggcggatcacgaggtccagagatcgagaccatcctggctaacacggtgaaaccccgtctctactaaaaatacaaaaaaataattagccgggcttagtggctggcgcctgtagtcctagctactcgggaggctgaggagggagaagggcgtgaacccaggaggcagagcttgcagtgagctgagatcgcaccactgcactccagcctgggcgacagagcgagactccgtctcaaaaaataataatgaaaataattcatattctgagtcctaaagcaagcctcaataaatctaaaggattggctgggcgcggtggctcatgcctttaatcccagcactttgggaggccaaggcgggcggatcacgaggtccggagatcgagacaatcctggctaacacggtgaaacccatctctactaaaaatacaaaaagaaaattagccgggcgtggcggtgggcacctgtagtcccagctacttgggaagctgaggcaggagcatggcgtgaacccgggaggcggagcttgcagtgagctgagatgacgccactgcactccagcctgggcgacagagcaagattccatctcaaataaataaataaataaataggatttaagtcatacaaagtgtcttctgaccacaatggaattaaattagaaatcagtagccttaagggatttggaaaaatcaccaaatatttggaacctagcacatctaaataactcatggatttaagaaataaaaaggaaaattagaaattgttttgaggctgggcacggtggctcatgcctgttattcctagcactttgggaggccaaggcgggaggatcagttgaagccaggagttgacaccagcctggccaacactgaaatcccatctctactaaaaatagaaaaaattagccaggcatggtggtgcacacctgtagtcccagctgcttgggaggctgaggcatgagaatcatttgaacccgagaggcagaggttgcagtgaactgagatcacgccactgcaccccagcctgggtgacaaagcaagactctgtctccaaaaaaaaaaaaattgttttgaactaaatgaaaattaaaacatatcaaaatttgtgagacacgctaaaacagtacttagagggaaatttataacacaaaatgcctatattagaaaagaaaaaaaggtctcaaatcagtggcctcacctctcatcttaaaaaaactatataatatggcccagtgctttgggagactgaggctgaaggatcactagaggccaggagtttgagaccagcttgggcaacataggaagacctcacctctataaaacaattttagaaaattagttgggcatggtggtgcaggtgtgtagtcctagccactcaggaggttgagatgggggatgacttgagcccagtggttggaggtcacagtgagctatgatcatgccactgcactccagcctaggtgacagagtgagaccctgtctcaaacaaacaaacccaaaaacgataatacagatcaaagtggaaattatttaaataaaaacagaaaaacaaaccttagttcttcattttaacaccaatactataatccatttttaaaaatggaaattgcacatcatcaaaatcaagaaagtcagttcctctaatgatactattaatggattgccacacactggaagaaaattgtttaatatttttaaatttacaaataaaaattgtatatatttgtgatgtacaacatgattgtttttgtgtgtggtaagaacacttgaaatttactttcagcaattttgaaatgtacagtatattaactgtatgaacagcaaattattaactgtagtcaccattctgtcaaacagatctcaagagacttactcctccttactaaaactttgtgccgtttgacctacatctcaccattttcctcaccccagctgctgataaccaccgttctactattctctgcttctgtgaacttgattgtttatcaaatctgcacataattgagatcataggtcatttgtccttacatgcctggttcatttcacttagcataatgtcctccaagctcatccatgttgtcacaaatgacaggatttccttcttttttaaggctgaatagtattccattgtgcatatgtaccacattttcatttatctgttgatggacattttggttgattccataacttggctgctgtgactagttctgtaatgaacatgagagcacagatatctcttcaacacactaatttcctttcctttctgtatatacccagtttcaggattgctcatggtttgtatggttaaaataaggaaatggccaaagtatgatttcaataatcgcacggtgtattaccatacaaagagattctcttccctgcttccctacaatgctcaaacggggagaaaatgagaaaaaatcttgtagggaatacactcgatagacacagtgagttccattttatttagagtccaattgatgaattctggtagctcaattaagatagaatcaggcctcagtggaagtaaagtctaatcacagttcgatatgtacttttctatgggagcttctcaggagagatggtttgaccacacaagtccttgtacactagtgagtggtgcaggtattggcaggtgagactttggagaacagcttgaaggctgacaaagagtagtcctgctgcatcctgaggtctcagtgtgtcttgtcaaagtcctggggttaggtcaggcatgggtggttcacacctgtaatcccagcactttcggaggccaaggcaggaagattacttgttggcaggagttcgagatcaacctgagcaacttagtgagaccccatctctgtaaaaaatataaagattagctgggtgtggtggtgcatggccatagtcccagctactcaggagactgaggcaggaggatcacttgagtttgaggatgcagtgagctatgattgtgtcactgtgctccagcctgggtgacacagtgggaaaaaaaaaaaaagctcttgggtttacatgtgttttggagtccagtagttgagatcagtaactcacatatgtggtctgataaggggtgatgtaacattgtcatggggaagggcattatactccatgtttttatcttagcaaaacatatgtcaccaatgcagcaaattatgtgaatgtttggaatcatttcaaagctgtcccagctagattatatgatagctctatttttaattttgggggaaacctcaatactgttttccataatggctgtgctaattcacattcccaccaacaatacactgtggttcactgggagaaaatattaacggaagctacacattggtagaaagtattttccgctcacccaactgataaaggacttgtatccagaatatataaatataaaaagctcagaactcaagaataagaaagctaacaactgaattaaaaaataggtaagtttgagactaggtgtggtggctcacgcctgtaattctagcactttgggagactgaggcagaagggttgcttgagtctaggagttagaatccagcctgggcaacagagtgagatcccagctctacaaaaaataacagaagattagctgggtgtggcagtatgtgccttgtagtcccagctactccggaggctgaggtgggaggattgcttaagcctaggaggggaaggctgcagtgagccatgattgtgcccctgcactccagcctgggagacagagcaagaccctatctcaaaaaaaaaaaaaaaaaaaaaaagaaaaagaaaaagaaaaaatttggacaaatttaaaatgtagagaaaatattttcctttaaactgtcaaccttatttataaggtaagatgtatatggttatttaatatattatatatgtatttaatatatggctaatatatacatttttctgactttatatatagatataaaaccagaaaagctatttacccagaaaatttttttcttcctatatttttgttttcattttactcagtgatataatttttattcttacttcctgatagtaaaagaaaaaatgaacccaaccctcaaaaggctgaggccctgtccccccattgtcagtgatttgttttttctgacaggttgaaaattgtgtaatgtctatttatttatttatttatttatttatttatttatttatttatgtatttagagagatggtcttgctgtgtcacccaggctggagtgcactggtgctatcatggttcactgcagcctccacctcctaggctcaagtgatcctcccacctcagcctcccaagtagctgggactacagtcatgtgccaacatgtcccaacaatttttgaaattttttgtagagacagggtcccactgtatagtgcccaggcaggtcttgaactcctgggctccagtgatcctcctgcctcagcctcccaaagtgccaggattataggcatgagccaccgcactctggcctcaatcttttatttttaaaaatgagcaaatgatttgaacagatttcaccaaagaagatctatagatggcaaagaagcatatgcaaaaatgtttaataccgttagtccttagagatttgcaaattaaaacaaaaatgagatcccactacctgcttattagatatcccaaaatttaaaatgctgatcatacctagtcttggggaaggacatagagcaactggagctcttgtacattgcttttggaaatagaaaattgtacaaatgttttggaaaactccttgctagtttcttaaaacattaaacatgcacttatcatatgatctagccattccattcctaaatatttaaccaagagaaatgaaggcatttgtccatataagaaccgtacatgaaagtttagtatcagctatatacacttgtagtagtcaagaaatggaaataacccaatgtcccttaacaggtaaatggagaaacgaattggtatttatctataaaatggaatactactcagcaataaataggaatgagttcttgataaatgcgataatatgggtggatctcaaataagcaaaaggagccagaacaaatgaatacatactgtacggcttcatttttataatgtgctagaggatgctaactaatctgtggtaactgaaagcaagaagtggtttcctggatatccaaatggggcaggaagagagatggattacaaaggggcatgatttaacctttggcagtgatcactacactatgttcattatcttgattgtggtgatgatttcatgggtgtatacatatgttaaaacttgtaaatggtgcactttagatatgtctaacttagtgtatgcaattaaactatcaaaatatattctcaaggatggaagtttataccctcattctatattctgttcagcagtgctattttgagattatgtataccaattaatttagtaggtcttttaagtggaagttacatagtgtctatctgttgcacctgacttgtttccaaacccatcattatttaatgagagagctaaattcatggcattttgattttggactaaacattgaatatgtacattacataagactatatactatagctactaaatgggtaatcttttgtcctacatctctacattctatcataaaaaaattagacacttgtatctttgaatgtttgagttggtgttttgcttcagactcttcaaatacagactttaatcccaatctctttctttattttaaattaaaattcacaggttctggttgggtgggctgtatacattcaatctgccctcttattccatggacgtcctgcttggacattatattttgaaatctgtattacaaagtcttttatccttttattagtttagtactttaaaccttagacataaaaaagaagactatcagtgaaaatcaattgaaatgtagttagataaagatctgatgtacaagcagaaggcttagttgcagcacaatataatcaattaggactctccagctgcatacagagttttacccatccaatcacttttcacacgtttcttccattagcttgactagagttattcttctttttttaatgtgaattatgatgaatgagattgttgttatgaatatagagatgggtcattatcctacagaaaccagattgtgctggtgtttagtgattagggctatctgcttctgctatcaataaagtacagatttatctgtctcaaattatgattgggaagccagtagtcattgttatctaattcatttaacaatgttacaatacaaatgtataatataaaattgtttttgttcagctgggtaattgacataacttttaagttgtgagggtaaaggaatataatttatcaaatagaggtgggaaatttttcatggcttaaaatcaaataaatattcctcaggaattagtacccccaaatttaacaccctgggtgtagcctttaagatgtcaaaatgtggaaagaacaaatgaagtttacgtaccctatatgaagacgctggagctttgcaaagtaatgagcatcggtttattacagaagttctgtaattaattattacagtctaaaaaatgatacgatgttttcctgggcttgggttgaggaattcaggaggtgggaaggagttattggatctagtttaatgcaccaagtgactggaaatggcattgctaggtaaattgggccgtcagcctaacattagcattttttattaaaaaaaaatactcaatccttagaaaacttacacccaggtagattagtagagaaggtcttgctagaaacagctatttaattttaatcaaacttgtttttctttgcccttaaaattgaatttttgtttttgttcttattttaagtttttcctattccagactcctattgtcaaagaaaaagcctttttttttttttttttaatctacaatacagtacctttcaatacttggccctcacagatgtcagtgcatggatagaaaaatttcattgtctgcagtcatggataattttagcgtcatgtggaaaagtaagaactgttgcctgactatattggacaccaaagaaagccccagtagacaggctattcttggagcttgcaggcctgcctttgaggcccattgatgaaaagacctttgtgttttgtgccatgaggtgggggaggagtagtgttcagtactagaagagttaataaacaccaagagctgtgctcatcttgtagctttactaaggcttaatctgtaagcttgattacctcctaaccctctatctcttgcctctcccttcaagcactgcaggggctttatggtggtattagtggcattttgcccaacattggctttagggaaatcattctataagaaagaaaagcagaaagaccgaatctgtctgctgtgtgtggtcattaacacaaggataaccttatgaactccagagagaggaggggatgtctgtccttactagaaaactactggtaaaatatcactgtttttctctctctctctcttttttttttttttttttggcagcccaatttgttataggcctagtggcatcatctagaagcactcacttgagacactttcagcaggatattcagtcgtttataatggagagtcctttgtattctctgagctgtttcataaaaatatatctgcaagctgtagcgacctgggactttttgttagagacacatacacagagtttctatgtaattaattcctggtattgagatattttggagtccgagaccagattgagtgcaccattttgccaaacatcattaagtcattagtgtaagggacttgttatgaaggaccgattaaaagctcagagaagctgtcgtacatttttatattaatcccaagagctttctaatattcttttctcattctaatgagaagtctcagataatgatgtattatttcacttaaaaaaatcttggaagataaaccaagacaggaaaatgattatggccacagataagagattaaactattcagccaacaagctgtaataaataaactctaagccaatgtactgttaaactgggagccactgggtagaaataatttggctaaaattctggcccagtgttgtcagaggatatgaaagaaataatgaaaattctcccttgcctcagggtaagtagtagactgcacatccagacttgaccgtcaggtcacctgaaggacaggttccctacaaatatgaggaaacaactcagaggacccaatagcaaatgaggcacttagatagcatgtgatggcagaagcttgctacctgtctgaggagcatcagtcccatgcttcgtgtctgcacagtggaacataaagcagcagcttagatggcatatggcactatctgcagtaggctttgtgctgtaggcacagaataaagttatcctagccatgtagcacttgaaatgagggggaaataagacaaccatgtagagcctgagaatagaatataagcttcatgaggacagggtcttatcttttgtcattgcatccctagttagaatagtccctgatggattatagcagtttgatttaaaaaggatctaaggtcaggcacgatggctcacacctgtaatcttagcactttgggaggctggggtggggggatcacttgagcccaagagttcgagaccagcctgggcaacaaagtgagaacctgtctctgcaaaaaattaaaataaaaaaaaattagcccagaatggtggcacacgcctgtagtctcagctactcaggagctgggaggatcacttgaccctaggaactcgaggctgcattgagctgtaatagcaccactgcactccatcctgggcaaaagagcaaacaaacagtttaattaattaattggtatgactggtgaggaacaagatgattcgttccttgcctaagcccatgcttacatgctaaggcctgaaactgtgaagacctactggtagtggttaaatgtaggattttaatcagatcagagcaaagtatggagttgccatgaaataattctgatagccactcagagaactgagaagtgatttattgctggaggtgatattatctttgaacctttgcttgaccatttatggaccaatacacccagaaacagtcttttgtgtagtaacccagccaaagagcttgactattttaatcatttccctttgatagtctggtcatttcttttgtcttttgaagaaaatatccactaattggtgtttctttctgagttgccaaatgctgagaaagcagacagtaattgatgtagtgaagatattttgcttctgttactctgatcatctacatatagagatacactggatgataagagtcaactctaaaatcaaaataaatagaagctccaccatgatttttttcattgtctgctgtaactaagtttgcctttattcttgagttgaagtacatgatatgacagcagaggttggaaactttttagttgcttaatattttatttctaataccaaaagtcttgctttttccttctttttttttttaatcttgagacacggtctcactccgctgcccaggctggagtgcagcgtcatgattctagctcattgcaccctcaacctcttgggctcaagggatcttcccacctcagcctgccttgtagctgggactacaggtgtgcaccactacacctggctaattttttaaaatttttgttgagatgaggtcctactgttttgccctgttggtctcaaactcctggcctcaagtgatcctcccactttggcttctcaaggtgctaggattgtaggcatgagccaccatatgtggccattgctttatgcttgagattaaaaatgctgtctcatagtatccagatattctaaattttgtgaaagcatcccaccatttttgagaggcatctaaaccatttttagctagttgtttattaacggtagtggaagagtgtggactatgagtttgtgataacggttttttttaacttcttattttgaaaaattttaaacataggcagaaggagaaagaatagcttaaaaaaaccccactagccatcacccatcttcaataattatcaataaataaccaagcttgtcttatccttatctccctaatcctactctttgctggttatttttattttaacagccttatttaggtataatttacatacaatacaattcatccatggtaagtatacaatttaatgatttcttagtaaatttacagagttatgcatccaacaccacaacggagttttagaatattcctattaccctgtgttcccatatgctccttaataggagctcacactccccaaccctacgcagtcattgatctaatttctgtctctatgtatttgtcattctggacatgtcatgtaaatggaaacatacaatacgtagtcttttgaggctggcttgctggcctaatgtttttgagactcatccatgttgtcgaatgtagagtgttgtggactatgtcagcactttgttcttgtggccgtgggccccttttcactgagccttctttgcctttatcttcacttgaatttgtgggctatgtgctgaatgacttccctgttactttcagtgttgttttagaggaaaacacagttgttgttttgtctttgttttaatgaactgatatctcctgtgtgtccatgctgattcttaagttgtttaaggaaatatttccttaatagaagaaccttctttcaggatcctcctattcttcctcccaatattgaaaatcattttttaaaatttgccattaaacaaatttttttgtttttcctgaagaaactccccttcatttaaaaatctatagtttcttgcttttagaaaagaaaacattactttaaaatttgccattttgtttgtcagttaccaaattgtccactctgggaaaattcgatgtgaagagctcataagaacaaaagcatgatcttaagtatggtttttagacaaacatgttttgaactccatgttgtctcaaattagaaattttcccttatctccgtagttcaaaatatatttttatttaattatattcaatgtaatatatttttaattaaactatattttaattcatatgatgtctcaagctaagcattgtacaaaggactcataaacatatgtttgttatatttttctacatgatgtttgttaagatgtttaaaatgtcccctaagcatggtgctaaagtgctatgtatctgttgttcctaagctttatttaggtaaatgttatagtgcagtttgctgtgagtttaatgttagtgaatctacaatatggtatgtccagaaaaagaaagagggagttcaccaacctgtacaaagcttcttgggaaaatgctagggtagtacctatagtgcctgattgaaactatggaaaagatagaaaggtggctaaatttgtgaatttatgagaaaatgactgatacaattgttgataggctgaaagccaaagaaatttacattacccagggtcaggaaaatgttatgcccttctcagctagtgctggctggtttgaacatttcaaaaggcaatatgttgtgaagaatattaaactttcaggcaaggtatggtctgcaaatgcagaagaatttttaaagtaccagcttaagtgttacacaggaaaagggttatgtggaaaagccggttttcaacactgttgagactggcttgttttcaattgaggagacattggcaaatgaaccaatgttacatattaataaatgacattttagttgatggaaaatgtcgtgaccagggtcttgcaggaacctaaccctgtttttcccagagaaaatttcagtattcactaattcagtgttcatagtgacttcctaagtaccttgaataatgagaatagattgtcattgataaagtaattgtgtgcaaaatatgtagagaactcttataactcaataatgaggaaaaaaactcaaaaagtgggcatttggacaaacaccacagaagatttttaaatgacaaaaaaaagacatgaagagttgctctgtcattagtcattggggaaatgatactgtgtacaactagaatggctgaaattaaaagactgacaataccaagagctggtgaggatgtgaagaaactgtagaactcttacactgtacattgttttggggaatgcaaaatggtatgtccactttttaaaatagtttggtggtttcttataaagttaaatatacacttgccatctaatctaatcattctattaataggaatttactcaagagaatgaaaatcagtgtttataaaaaaagattgtatgtgaatgttcattgcagcttcattcgcaatagccaaaaactaaaagcaaaccaaatgttcatcaactggcgaagggacagacaaatcatgttacctccctacttagcaataaaaagaaggaagtacgtagcaacacagatgaatttcaaagcattgtgctaagtgaaaaaagacagacataaaagaatatatcatctgtgattctatttatatgaagttctagaaaaagcagaactatagaggtagaatgcagatcagtgatttccaggggccaggagttgggggaaaggaattgactctgaagagggataaggggactttttggagtgatggaaatattctatatcttgattatagtgctgattacatactatatgcattaaaaaaaaaacctttatcagtctcaacacttaaaatgggtgagtttaattaagggtaaattaaagcccttacaaagctggttaaaacaacagtgacagaaactctttaccaaaacctgtaaggctttggttgacttgccagaatcaacttgccaatgcaaaccaagactttgttaccagggacattcaagatagacccttcactgagagattttaagaactcactcaaaataaataataaaattgtacctacttttccaacttaaaaaaaataaaaattttatttgaatgtataagcctctacttcagccaaagctcctgttaggtttgggctatctccatatacagtagtaataattaaaatttttctttcttcaaatggctactagtctaatggtttaaatacttacccatattctactatattgtcttccatgaccataccgtgacctctcaaaacaaaagttagagatcggaagtaaccaactgacaattacagtggttgatacactccagtttaaatagaagggtccttggttaaaatatggttcattcatcggtcaaactgtccttatttcctttaattgaattaagatggacaaatgagagatgtgtgcaagacagaaaaaaaaatcctttcacaaatcactgttatcctctctctgagtgtaaaacgaatcaattaaaagcatgtcaaagcatcttttactgttgaacaactttaatgcagaagtcatttattaaaaaatttgagtgagaaatcggttaccttatacagttaaacatagtttaatgttatctctgagaattgtggattattttatatactcatgtttggctaaaaattataactttgtgctaagaaagccttcatttttcctcttatcctcaagttgaaaatactgactaagaaaatacaaaatataagaaaatacacaattcacacttgtatacacagaatttagtttcatccgtacatttactaaatagttccttaggagagatgtaacattaggatggagggtgaaatataatttttatttttttgcctaatagccaattgctttgaaaaatgtagtccatcttctctttctagtgccttgaattgctatttaacatacgatagcttatttatatattcatacacattctataaaatcatttttaacccgtatgttaaggttgtctttgatatgatagcttatttatatattcatacacattctataaaaccatttttaacccatatgttaaggttgtctttattacagttagttatccatccctatatcttagctgttttcactagtatatacgtataaatgtatactgcttaacgaaaacatttttaacctgtgtgttgattttattacaattatctatccttttatcttagctctgttttcagtggtatacacatgtcaatttatgctgcgtaactcagagcctgcttccactttttcatacttgaatatgttttttcctgctttctaaatatggtcataaatatgctcataacttattttaattgttcatttgaatttttgtcttcatattattttaaattttcaatcggttcaaaattcaaaacataaaaggatacataatgaaaaatcctttctcccttccctgcccccagccacccagtttctctgtttagaggccaccaatattaacagttgttttttttttttgagacggagtctcgctctgtcgcccaggttggagtgcagtggcacgatctcagcttactgcaagctccacctcctgggttcacgccattctcttgcctcagcctcccaagtagctgggagtacaggcacccgccaccatgtccagctaattttttgtatttttaatagagacagggtttcaccgtgttagccaggatggtctcgatctcctgacctcgtgatccacccacctcggcctcccaaagtgctgggattacaagcgtgagccactgcgcccagccaacagtttctttattcttccagaaatgttttatgcagtacacatttgagtaggggaaaaaaatgaagtaacccttatttattcaaaatttcaagagtattaaagtaccattggtttctacatgttatttttattgagtcaacttgccaacacaaaccaacataaaccaagactgtaagtgttatcaaggacatcaagatagacccttcactaagagattttaagaactcactcaaaatactctcagcatgaggcttttagagtttcctatctttggactttatgttgctgacatgtgttctcagctagatttctggtatgtctgtgaaactcctttcttatcattcgtcttttagtcgtggacaaagccagtaaaagagagcatggatatgagttattgagtagcactgatgaccaacagagttacccatgttgcttttcccttagtttatagtctatacttaaaagtttttccttctaaaacacctagagctgagaatgacagttttacccccttaccttcataataaataaatagaattttaaaacacagaacagaaagctagattccagaaaaatgttggcaaccatgtatagggttatttattgatgactttgctcattggcagtataaagggcgtgtcacttgtcattagcagtaacaatttcaccacattatgttctctttttattttctctggtggcaacatgtgtctgaacagggccactggctgtgggtcaagaggtcagtctttgaggttaagagtggatggggtcatttgctattaacctaagattagcagctaaggttttttttttctttctttctttctttcgttttaacagatttcctccatttgtataacatgccaaattaatcttgcccaattttagaagaatttctcctttccaatctgcattttatttgcttagatttatcattaaggtattttttttctattcagatttctttctagcccccatcctagtcctcaaaacaatgttaactttttctaaaatttaaaaatgttcctgtctttaacattcatcttccagtgtacaaatgcagctaatattttctctgctcttgaacttttgagggaaaaacaaatacatggcagaattgtaggatttcagggatgtcttcacccctaaaacaatctctccttgctattctcgctattgaacagtctccaactcttaaactagcaagttttgttgttgtttaactttaaggatctattgagttggtaccctgatacctgaaacctcctacttctcttttctcttcagccaaaagtattacctattatgatgtagtttcatcagtcatctttgaaatgtaaagagagtgcttgtataataagaagtgtgttctccatggaatttttcaacaagagagttcccactcgattcctagtttatattctggtatggaccacaagtctgggaggcaagtggattttaggtgttttatatcaaagttgtttatcttaaatcttggctcatttgattactaggatattttacttacctttaaacaactttattgttattggtgattctctttctttttctctaaaccttagcagtaggtcttagcttgtgctaagcatatagagtccactgtggatgcaagtacaagcgaggagaggtccttcaggcaactgctcagagtgctgtgtcgagcttaatgggtataaaggagaagaaagtaaagtgtatacatacaaattttaaatatgttaaacctatgataagatacagattaaaaatcaactggatttcaaatcatattattcagtaaagaatggcatacttgccgggcatggtggctcatgcctataatcccagcacgttgggaggctgaggtgggaggagcctgggaggttgagaccagtctgagcaacatagtgagacctcatctctataaaacatcaaaaaatcagccgggcgtgatggtgcatgcctatagtcccagctacttgggaggttaaagcaggagaattgcttgaggccgggagattgaggctgcagtgagctgctattatgcccctacactccagcctgggtgacaaaacaagaccctgcctgaaaacaaaacaaaacaaaaaaagagagagagagagagaacagcacacttcaaagggtatggtctttgttgctatgctcctttatgtgcttagagttgaggaaggtggagaatatttaaggaaagctttctgtagaagtacacctgggagaagtgtaatagcaatctaggtagagaagataagcataagtgaaggcacagtagcaagagaagccatggtatattcaaagagctcataaggaggttgaccttgccatcatataaagtcctagcaggcaagtcataagatattaatccagagcagtgtgtattttagttaaggaacttggacttatatcctataaggatggagaagggtcttaggcagaagaggagtgacagcgtcagacttgcattttaaatgtaatttgggagctgtagagagagcagatttgaagaaagatttaaaatgaagtcagggagaccacttaaactgttgacctgacacctagggcaggggtaaatggaatcgaaaggagaagaatggagaggaatagaaagttgaaaaatagctacaagtaaaaattgtcaggcatggtgactggatatcagtcatgaggagaagggggaagagtttaatataaatcccaggtttctgtctatgctaattaagtggaagagagaatgtaagagaagcggtttaaagaggagctcaatccttttaggaatttgaccttgatgcacctatgagatgacaaaaggcaggtcagctggccctgagtaaaaatgtgggagttatcaacatatagctatggaaggtgaaagggaaagtatgcagagtgagaaaaatcgtgggtctaaggacatgccctgaaaatcagcaaaatattacagactagcataggataatttgtacagaattaactgtcaaagaagcaagaagaacctaaaaagtgcagtgccaacaggagtcataggggagtgagcttcaatcagcagtgtcattccttatagaatagtatagtggttctcaatgatgaggacagaagtagtcattgctttataacagtaagcaattatcagaggcaagagcagtttgagtagagcaggaaagaggaaagccacattaccacgaattatagaatgaatagaaatgactagcttggctgggtgcggtggctcacccctgtaatcctagcactttgggaggccaaggcgggtggattacctgaggtccggagttcaagaccagcctggccaacatggtgaaaccccttctctagtgaaaatacaaacaattagctgggcgcagttgtgtgcacctgtaatcccagctactgtggatgctgaggcaggagaatcgcttgaacccgggaggcagaggttgcagtgagctgagatcacaacactgtactccagcctgggctatggaacaagactccatctcaaaaaaaaaaaaaaaaaaaaaaaagactagcctgggctacgtagtgagacctcatctctacaaaaaaattttatttcatttatttatttttattttttgagatggaattttgctcttcttgcccaggctggagtgctatggcgtgatctcagctcactgcaccgactcccgggttcaagcgattctcctgcctcagcctcccaagtagctgggattataggcatgtgccaccacacctggctaattttgtatttttagtacagatggggtttcactgtgttggtcaggctggtctcgaactcctgacctcaagtgatccacccacctcagcctcccaaagtgcttggattaccggtgtgagccaccgtgcctggactacaaaaaaactttattaagtagctgggtgtgatggcatatgcctgtggtcccagctactcaaaagactgaggcaggatgattgcttgagcccaggagtttgaggttacaatgagctatgcatcaccactgtactccagcctgggtgacagagcaagacactgtcaaaataataataataataaatcagcctggggaacataaggagactctgtctctacaaaaaaataatttaaaaaaaaattacacatctactcagaaggctgatgtgggaggactgcttgagcccgggaggttgagactacagtgagctctgattgcaccactgcactccaacctgggtgccagagtgagaccctgtttccaaaacaaaagccataaagtaatactttaatatgaataaagacaaattagaaagtgagcaagtaggagataaattcactcaggtgataggacaataataaaacaattaaaaaatttaagatcctcaaaaggacaaagtaataactttacaaaacaagaaattatatagcaaaagcttgtagaaacgacgcaagataagaacaagtggatatgaaaaataatgacttaaggccaggcgcggtggctcacgcctgtaatcccagtgctttgggagtccgaggcgggcggatcacgaggtcaggagattgagaccatgctggctaacatggtgaaaccccgtctgtactaaaaatacaaaaaattagacaggtgtggtgacgggcgcctatagtcccagctacttgggagactgaggcaggagaatggcgtgaacctgggaggcagagcttgctgtgagccgagatcgcaccattgcactccagcctgggcaacagagtgagactccgtctcaaaaaaaaaagaaaagaaaagaaaagaaaagaaaaattacttcaaaatatcagcagtaaaataatagacattgaaatgtaactcagtaacaattttagactgtatatttgaacagtagttcgctcagaaagaagcacataggtagaaaaatgtgaaagattagttagttgagaaacatacagtttagagtccgggcatggaggctcacacctgtaatcccagcactttgggaggccgaggcgggtggatcacctgaggtcaggagtttgacaccagcctggccaaaatggtgaaaccctatctctactaaaacttacaaaaattagctgggcgtggtggtgggtgcctgtaatcccagctactcaggaggctgaggcatgagaatcacttgaacccaggaggcagaagttgcagtgagccgagattgcaccactgcactccagcctgggcgacagagcaaggctctgttaccaaaaaaaaaaaaaaaagaaacatagagtttagaaacgtcaacatttatataataagagttccaaaataatatgatagggagaagcaatgttcacataataactaccaagaatcttccagaattgtagacctcagattgaaagtataacttgagtgttgagcagagtaaataaaaataaatttgtatctatgtacgttgtagtgtaattgaagaccattgatttttaaaaggctagctgagagaaaagacatcttttctacataaatgtgaaaattaggttgatgatagacttgtaatttggtgacaatagatgccagaaggcaatggagtaatataccagagtgctgagctgataaaaaagatattatttttaattttacagttctatacccagctaaaattcaatacttttacacagtggcagtttaccactgtcatgcttttgttgaaaaagaaaatcctttaaaaatgtgcttcaccaacaaaatataaatgtagaggtaggagtgatatgtaagattcagaattatgatggtagttaactttgaattttataatgataatagaatagcaatacctttcatattataatttacttacatggaatgaaaacctcagacagtaatgacaagaatgatgtggagttgttcgctggcaattaaagcatattcaagacaaatattgagatactgagtagcccagaaaaaactatggtataaaaatttaaggacactgcggggcactgtggctcatgcctataatcccagcactttgggaggttgaggcaggcggatcacctgagctcaggaattcaagaccacgctggccaacgtggcaaaaccccttctctactaaaaatacaaaaattagctgggtgtggtggcacatgcctgtaatcccagctagtcaggaggctgaggcaagagaatcacttgaacccagaaggtagaggttgcagtgagccgagatcatggcactgcactccagcctgggtgacagagggagactctgtttcaaaaacaataaataaataaataaaaatttaaggacaaaccataatagaaatataatctatagcttccaaacatatagagaaaaaattactatagaaaactgtcagtgcaatacaaggcgggaaagaacagatcatacaaaataagatagtagaaataagccccaatatgtcaataatcaaacttcaatgacaggggatataagactgaatttttggccaggtgcggtggctcacgcctgtaatcccagcactttgggaggccgagatgggtggatcacctgaggtccggagtttgagaccagtctgaccaacatgaagaaactccgtctctactaaaaatacaaaattagctgggtgtcgtggcgcatgcctgtaatcccagctactctggaggctgaggcaggagaatggcttgaacccgggaggtggaggttgctgtgagccgagatcgtgccattgcactccagcctgggcaacaagagcgaaactccatctcaaaaaaaaaaaaaaaaaaaaaaaaaaaagattgaatttttgaaaacctagtcatattctgcttataaaaaaagtacaagccgggcgtggtggctcacacctgtaatcccagcactttgggaggctgaagtgggcggattgcttgaggtcaggagttggagaccagcctggccaacatcacgaaaccccgtctatactaaaaacacaaaaatttgccgggcctggtggtgggcacctgtaatcccagctatttgggaggctgaggcaggagagtcacttgaacccaggaggcacaggttgcagtgagccaagatcgtgccactgcactccagcctgggtgacagagcgagaccctgtctcagaaaaagaaaagaaaggaaaggcagggaggggaggggagaggaggggaatctgcagattgtgctattagctcgtattagtggtgtcaaattttaagtcagattctgctgtaagcaacaaatggcttcattctttcctcactattacaaatgcgagacagagaaagaaaacatggccttgtaatgtcacagactttgtcattggttaacccgagttcagagaggcttccaaatcacatcagttaattcccccagcaagtgaaagctgactgaaattatgagctgcctttaaagcaattctagccctcaagcttgtgaggagtcataaagatatactaactaagccgggcgcagtggctcactcctgtaatctagcactttgggaggccaaggcgggtggatcacctgaggtcgggagttcgagaccagcctggccaatatggtgaaaccctgtctctactaaaacatacacaaattagtcaggtgtggtggtgggcaactgtaatcccagctactcagaaggctgaggcaggagaatcacttaaacctgagaggcagaggttgcagtgagccgagattgtgccattgcactcctgcctgggcaacaagagcaagactctgtctcaaaaaaaaaaaaaaaaaagatatactaactatgtgactcttagattcataggctaaatttccttttggattgtttttcaaagactgaaaatgcctatattaggaaatatcttcactttccatctccagctcccctatttgtcagttcttctattctgacccctaagatgtggttcacattttaattacagttacatatggcagtctccatccaccatagccagccagcctgcaggcttgaagagaatgaaggagagcctaatactgccttctttctgacaagctctcatggagctttcacagttaagactctgtcgatctgttgcaatgactgaagtgtcctgtaaatgatcacttattacaaatgttcaggtagatgtgtcactttaagcattaacaatttatttttaactacatttctttattctttacatataccaattgtgcttatgcccagaaggactggatacagtatgtgaaagctgtaaaaattggctgttcattctcttctcatttaaccgcagatgaaatattggttgtccaggataaatcatccttaatgggatatttatactctttccaccaaacactgtgcatctctccaccagccgtactctccctatttccttttattttcccagacaaggtctcattctgttgtctaggctggtgtgcaatggtgcaatcatggctcactgcagcctcaacctcctgggctcaggtgatcctcctacctcagcctcccaagtagctgggactgtaggcatgagccaccatgccctgctaaacttttctttttctttcttttttttttttttgtagagacagggttttgccatgttgcccaggctggtctcaaactcctgtgctcaagtgatccgcccaccttggcttcccaaagtgctgggattacaaaggtgtgagccaccgcacccggcccccctcgttttttaaagatggaatttctctctctttctcaggctggactcagactcctagactgaaagctatcctctcacctcagcctcccaagtagctgagacttatttataaactttccagttaattgtgactacagttatgcacagattaaacataggtttattctggttggtaatgatcataaagaatgatctgactggctatctttgggaatgattgtttgtagactgtagtaaagatgaaaagtccaaactgatttttatctttttgtgctgttaaagtataaggatctagaatttttatttatggacattgatgtcagaagcatatgtaggtagttttaaaactgaaaatatagcttgtttttacctctcatctaactttggagaccacagtcgcctttgcagatctatctagacaacttctgaggtttattcaagcctcatttgttgctgctctaaattcttgctctgaccctatctgaaatcagtgtagtctgaactactagagagacgttattccgtaacacagtgaatctcagaatttattttttcaactgatacttccagctctggattctgtgacatttgcccaaagggaaacaccggtcccttggattacactgtgcatccattgtctgaactgtcacagcaatagcgcgtaaagctgtttgcatagcgtgctaactctatcagggtcatttccagtctgtggccgctaaaaatgaaaaccatgccccagccgggacaagaacagggtcaacagctggcaaaggatatggcaatcatttatataaatatgctttctcaagcccacaaaaacaaaaaaccccaacccaacagctgggaagggttggaagtagccccaaggctggttagtccccttccagatggggaggttagactggggctagccagactgctccacatagacttccgattcgaattagaaatgaaaagaggagaggaaagggaaaaggaagaaagcctacaagcatgactgctctgcttttcacctaacttaatcaaataagtgaagactttctgagacggaaggcttgcatttatcggcattcatgctccgttttttctgtttatcatagggtctaatacacattttaactgctgaaacagaaagcatatatgctctaaagtatagtttatatataatgtcatggttatttgtagagagattgaagaaccggtctcagatttatgtcctgtttacatctcccaaacacttatgtagaacattcaatgctagagaagataataattgtggtgttggctcactcccagaattttatccaagggatagggttcatttttgtaatttgatttacttcataatacatcgttattgcacatctaatatatccaacagaataacaaataccgttttcctgggttcaccttaaggttgcataccatgaggcaaagtattatttttgtaacctgttgatgcttcaagaggcaaaggtgaagagtatatgactttcaaactcttccaagagtgacatagtaaaataaaagacaccacagtgatgaagaaaaaatttgttctcattatctagaaaagggccgcttcttcctaataatggagagttctgctgaagccaaattgaatggcaagcagcactttcttcctctccagtcttacgtttgcttaaggaaaagcttacataatgaatacatttataggtgtaggatgagctcatgatatcagaatccataaagatatataaattaggctcttttgccaacattgaggcattgtcttagagaatcttctgctttgacatagaagttaggtaatgcattttccttcttgtaatgatctgcctgaaacaaacatttagccttactcgtggaatgtcaaaactagaaggaactgtagtgatcatctcagatacctcctctaatgagtagtaaagatcagaaagttagaatgtgcacagggaggatgctgtggacccctcaatcaggtatacatcttccaactatatacacacagaggaccctatactgagaaagaatagtgccaagccagtctggataaagaccctcgggagacctgaattatcaaagctatctgctgatccctcaaacactcagatttactgtgtaattgtataaagtaaatttcccactttgttctgtggccctatagtatcaaaacaaatgtttctcaagcatcaacactttattagaaattctcatgacttctagatgtggttttggtcatttccatagataagtaataagatgagtgtgttaggtgttggctctgaaagtctatcccatctatctatatagtaatgaatattagattttaagcttgttgggggcaagaaaagtaggtcatcttcatgtttatatccactgagtctggcacatatgagtacttagtggatgtttgctgatatgcgattaagataaagtgcaagatatgttttttttttttctttttttttttttgagacggagtctcactctgtcccccaggctggagtgcagtggcccaatctcagcttactgcaagctccacctcccaggttcatgccattctcctgcctcagcctcccaagtagctgggactacaggcgccagccaccacacccagctaattttttgcatttttagtagagatggggtttcaccgtgttagccaggatgttctcgatctcctgacctcgtgatccacccgcctcggactcccaaagtgctgggattacaggcctgagccactgtgcccagcccgatatgttgattttcaaataattcattaatttaagtattttcttctataatagctacaacaattttatactaaaacttttggggggaagggccattaccttaatttacacaatagatcagttaagttttgcaagaaggtgaaagtagacaaacatgtttttgacacattgttattgctattcctgcggtctttgattctgacccatttttagcttctgtgcatttacttttagttaatctgtttgatttgaatacactgttcagttagtctcaaacactttcttagcatttatcttcaaaccttaagtgtaaaaatgagacagaggcttagaggtgtcctcggaattttagaactaacggtttaatttcctgactcttagagtccaaatgttttcttagattgatgtggattggtttaacgtaattggaagtttgaaaggtacatgtttctaaagcttttaagataatgatacttagaaatcactgattgttccttgatgatgaatgcctttaatatatgtttacaagctccaaaacttttaatatatcttaccatactctgattactagaaatatataaatgaaaccaacatttctctatcctggaaaaaaagtgtccagtagagtctgtccttcctgagcttagttaaagcaattcttgtatctttgttttatattttttaaccttttccaatccttaatacatttgtggtcttactgggatatgccaggaagaaatttcttccttctatttcttctccctctttttagctgtctactgtataccatgtagaaccacaaaatgcatgtttttatctgttctgttgtgtagaatgtatatgctgccagccagccttactctttcctctctacactgccacagctacaactgcttccctgtcaaacattagaaaaacacaggtgggcacctagtgcatggtgttacagtaaagacaactcgacatcatactgactacaaattacctcccctagtttaaaggcaaatagtagctatcacaaccaaatttagaatgtgacaccattgtttaggtgtatgtgattcatttttattatctaatcacatatttttttcccttctaatttgtgccctgactgcaccttgtgaaaggttagaactgggataataactgtgatgaacaagttattcaagaaatacttgcaaggtggacaatgttaactttgaacagtgaacacaaagggtaatgaattactaataccatagttcccttctcaaacagcagtgacagcttaattttgataggatccctatgatctttgtaagcgtattcatgccaggaatgttgtcctcagcaatagatcctatctctatcccttttccaaaagcccggtaaagttagtttgcttaaaactacctgaaaatgtctttctagacatccaccttactgcagggccctagggtcataacctcttaaccttacgggttataggtctcttgctttttgatctttcttggttctttagtttttgcctacttcctccacaacattcaagccttgttatataaggaaattggaaacaccaattttggatgagataagttaccctttcttccagaataatccaaaaagatgattttaaatagaaacatgcttgggaaaaatttagcaaaactacagcatcctgtctaagccagtttgaagttgccccccttcatttcttatcctctttataaaaaacaaaacaaaaccaacttagaacttactgttgacttagtgataaagtttttattcaggtcccaaaggcagcttgcttgagacatcagaaggagtcagagtggtctgagcgaatgagaaggagattaatattaatacaattagttagttagcttattattcttgccttactgggcagtacactgtttgataatagtgacaactaacatcaatttggcacttactattgacaaagcattatttattattttatagccatagcaacttggtaaaggagagattattattcttatttcataataaaggaacctgagcttcagaaagggccctcggcttgccgaaggccgtatggtaaatcaatgaccgagctggtgtggaatgttagcctcctggatcctgatcgttcagcctccgaaacattcctactgaagaggcattaggactagagcgtatttcttttgattatcaatgcgggtggtagtgaggtatcctcagctgtttggctggctctcttattatattagtatctttttactattatcttgcttctgtttcagccaaaatttggattttgtttctttgccacacccataggatcaggtacagttaacctgtttgagcctaataatcaagtattgtactgaaattccaaatagaattggaaaatgtacttttttgatgggctacctttcctctttcctgcctcatccaaacagtctccattagaaataataaaaaccctcataggattttaaagccaagttagcagccctgagtcaggacaggtgtttatttttaattcatactcagaaagcactgtttacccatttaccagacagagcaagaaaggacaaatagtatatataaaaaaaaaaagaattataggtcatacagttgtcttttcattccataaaaattaggaggtctcttttaaaacattaagataatgttgaaataaatacattttaacccgaacctaaaaccaaacaatgacaggaatatttctccttaaatgcagactacctggcattcgcaggtatctgctagaggcaaagtcagaacgaatgaggaggcctgcagacagtaatcatacttccatctcatggaaatcacccacttgcctgactcacaagagcactgaagtgtgtgtgtttatgtgtgtatttgttgtgaatttgttttgattttatcaggcttgccagctgcataagcgggcaaagaatgtaatgtggaaaccatccattgccactggaaaaaggatccaagaggaattccttaagctgggaacatgagctgtgagcaacatgtttaaatagctaaatatccaaagtttgagtcatgttcatttattttgggggatacactctcttctttgaggctgaaagagtccttctggcttagactataacaaatgtggtgctggaggaggtgagagactggaagccctagcgagtttgctcaggttgtggttaatggtgagagagggtaccatgacccccttcgtgaagtacgttccacgttcaatctgaaaaatccatgggcttttaaaaaagccttttctgtactttccagtgagggagaaaggtaagggaaaggaaactaactttttttttttttttttgagacagggtctcgctctgtcgcccaggctgcagtgcagtggcgcaatctcggctcactgcaacctccgcctcccgggttcaagtgattctcctgcctcagcctactaagtagctgggattacgggaatgtgacaccacgctcggctagtttttgttatttttagtagagaccgggtttcaccatgttgatgaagctggtctcaaactcctgacctcgtgatcctcccacctcagcctcccaaagtgctgggattacaggtgtgagccactgtgcccggcctctttttttttttttttttttttttgtaatttttatgtgccagacactattccaggtactttcagaaaggtggtgatttttttttttttttttttaaagagatggagtctcgctctgtctcccaggttggagtgcagtggtgtgatctcagctcactacaagctctgcctcccgggttcacgccgttctcctgcctcagcctcctgagtagctgggactacaggcacccaaaaaggtggtgatttttctccccattttgcggatgaggaaactgatgagatctgaaacgatttgcgcaatctatcacagcgaataaggttgggatgaggattttaacccaagatctggcttcaatgcccatgcttttcttaactcccttgaagccttaacactctcaacaaagagtttactttcctttttcccctcctcattttcttttttttttaaaatattacttatttaatttttaatggtcgagtttacttttcttcttattttacttgtgtttcttctaaaggagctgtctgggctaactactccattggttagaatatgatgcctttgagcccaaaatcttgtttgatctcagaataggccaagttaatattttacaaagaaaagctgagaattaaatggcatcaccattagcctgccattgtcagaagaatatgagatgagctaagagtatatctgactcagaaaaacaactcaaaagcatgtcttgttgttctcagatggtctgagttttcaaaagaaaaaagatgatgagtcaatcgtagaaataaatagcctaaatatctcatagattaagtcaattaagtaaagattccccttatgtatttgccctattttaatgtaggtaatcaaggtactgaattttttctagacaggttgtagtatcagcgcagtgatgaaagtagtcttcctctgctgtgaattagggctaatattaaattttgtgtggttgctgaagaagtttactgtgcactagctctctcttcaaaaaaattatttaagttacattaaattttatttatttatgtgtagctcctagatctaaaagggaatagttttttcccctcacaatttcaagacttctcttttattcttctttttttcgagacagtttcactcttgtcactcaggctggagtacaatggcacgatcttggctcactgcagcctctacttcctgggttcaaatgattctcctgcctcagcctcccgagttgctgggattacaggtgcccgacaccacacctggctaatttttgtattattagtagaaacagggtttcgccatgttggtcaggctggtttcaaactcctgaccttgtgatctgctcacctcggcctcccaaagtgctggtatcacaggtgtgagccaccgcgcctgggcttcattacaatttttattttgtcttcctgatttctgggggataagaggggaaccaaaaagatagtttatgaagaacttaacagtttccacattgccatttctgtaaaatcaggaaaagaacaacagatgtattacagactagttagggagaaaagtgatcaaaaaacacttgatatttttaaattcgtggaaactttgagctacatattttgccttccgttcatctttgtaaccatttttttgtttcaggttgagtgtgattctttcttcccagctggaactttcagccttgtccccgagaccaaaagctcaatcagtgtcactctgcagagaatgttttcagtatacgagtgtcctctccttggcactcagttgggacagtcagcactgcccctgccccagagctaattaactgcattgctatcagagctctgaagtgacagaggcaaagggcagagaatggaaccaagagatcattcaaaatggggttcaagctgggaggcagtgcccggcccccttctttcacagctggggttttggcagcctgtcctcgggttgttcagcctggtgaccctagccgcctgtgatttactaactgttttacaaatgtttcctcgctctgggaggtttgatacactcttcatcctcctcagctcaccagagtcactcagtctctgagccaaacctgcctttgtttacaacttttccggaaattttcacagagggagagaaactctccctcctctttcagtgttttatttttaagtcaacacttttctcaagtttatttgtgctaaaccaaattctcctacaaggtattgctctgtattcaaatgggaattgctgcatttctataaatagaatgaaggtcatgtgaacgagttcagaagattctagatatcacattttacgggacctttacatttagttcactattttttgaaaataatattctatgtttggatttgtctttttttcccacattcatatttgactgcgcattatgtgaaaaattgaatttgggaaacattgagtggaatattttttaagctgaaatacccatgttaaaaataacaaaatgtgttgttgcttcatcattgtaactttcttaaaaacagaatttatagcccctttattaaatatttctagaatataattgcctctgaaaacacagtaccagggtttttttgttttcgtttttctttaaatctcattcccattaattgctcagtctttaccttggcggagaatgaaaaactgccttggaacttattaataagcatttagaaaaactcgacaaaaaattaaagaattggcctggcatggtggctcatgtctgtaatccaagcactttaggaggctgaggcacgcagatcagttgaggccaggagttcgagaccagcctgggcaacagggcaaaacaccttctcaacaaaaaatatagaaattagcctggcgtggcggcacatacctgtagtcccagctactcaggaggctgaagtggaaggatcacctgagcccagagaggttgaggctgcagtgagccatgattgtgccagagtgagaccttgtctcaaaaaaaattaaagaatgacaggataaaaatttagggaggccgattccatctgcaatcaaaagctaacttttggtccacactaagtaagaagtattatttttctcatttctacctatgaaaaaaaggttgaaactgaaagaaaaaaaaaggcattatttattttcctccttttctgtcttctagagccagaacagacagaatatatcctaaattggatacagccagagaatagtttactgataaaatatgttttaggaaggaaaactggttacatttcagcatatacagctggacttcctggtgggcctcccacattgtcaacatcagtaccatttatttgttgaccaacagaagaccaccagaatgaggtattttcatttctgcatacttctaattctacaagaaagatagctgttgagagagctaatatcaaggaaatggcaaacaaacaccttaggtgatcctgtgtgacattcaggaactattgcagacttccaggactcaagacagtctcctcagccataatgtcattgaccttgacatactcagaacaaattggtctgtgtgattgctaccacatgctgtagcgcctcctaaccctgccgttggtctggagtgaagcagagcaggagaaagggctcctcatcagaggatatgcttcttttatgttccttagactcttgcccagcatgcttttcccactctatttagtcttaaaatggctaatttaaagtttctgaagctttgtaggagccgcagagtgtacctagttttgccaggcaaggactgaataggtgaatagtcattgtattcttagggtgtgaaactgtttcgggagcaaaagataaggcaaacacaaccaaaaagacagcccttttgcttagttaggaagataatttatgtccccaaagctctttcagtgatctgtacccatcagaccagtagaatttgaacttttttcccaactgaagagtcaactgagatgagtaataagcacactcctcacttctggttttcttttacgtctgtaggtttttttcatttatatggagaacacaagtcgtagccagtgaaagtttgtataggcccctctgtttcttgcactctagttataggcacttgctaaatgtttcttgagtggatgaatgaataagtgaatcctggacagattgagatgtatggggtgagtcataatcctggcaaaaccctaattaaacacagtggaaccattgccttatgcacagggcaacctcaggcattctgcgttcatcgtgtctgcagtgttctccaaattctgaagcagagatgtctagatgcttgtttagtgcggagggtcactttctttatattttaaaatcagtaaggtcatacttaacttcgtttgtacatattaatatatccataaatgttggtagttcctttgggtactatgagtgactataatattaactaaactgcatttttagattagaaaattgtgaggggggaccaagcacagtggctcacacctgtaatcccagcactttgggaggccaaggcggatggatcacccgaggtcaggagttcgagaccagcctgatcaacgtggtgaaacccccgtctctactaaacttacagaaattagccgggcatggttgtgcacacctgtaatctcagctactcgggaggctgaagcaggagaatcgcttgaacctgggaggcagaggttgacgtgagccaagatctcgccattgcacttcagcctgggcaacaagagcgaaactctgtctcaaaaaaaaaaaaaaaaaaaaaaaaaaaattgtgaagggggaatcccctatgaatgtaccagtttttactttgatccaatcaagttgttttgtatggtttgttgtttgttttttggtttttggtgtttttttttttaatttgatttctacatggattcaaaataattttgtttggaaagaacagatatgtcaggggaagaagtgacacgtaagctacaacagagtatatttttcaagcacctctttatttgaagatgcaatattagtatttgttctttcttagcaccttttcgaagttttcttcacatgaactcttgcagtgtgccaaggatagcagagatgtttttcaaacgtttattggctacacacataaaagaacagaaattcctatttttcttctctgtccttatattactatatcacctgttctccagcctatgggtacaagtgattgacatcgttttcttgtcgataagtatgatacttatacatctgtcttgttcttcttactgtctgtgtattaatatttctagatgaagatatatattaattcatttaatcttcattataactttaggatgcagatactgttattattctttgatagatgaggaaactaagttcaagaaagatcccaaatgtgtccaaggttacaaagacagtgaatgcatgactagattcaaaccaagatgccctggctcctgaagctgtgctcctaatcaccaagctgtttcccatggcattctattctgtgaaggtattatcatctagttgatggcttccctatggatgttgtctaactttttttgcatttacaaacaaaactgcagtgaacatctttatacatatttccttgtgcagtggttagcatcttagaaacttgaatatatctgcttcttagcctcccacccaaatttctatgttgctttagaatccagaggagaaaatccgccctcttacatggctcaaagaaatatgctcacagagtgcccatttttcagttttcttagagttgtgagatttaaactaagagaaataaggtacatatatatttgtgtgttgcttagtgagaagtggtgggtaggaataatttttctgtttttgctgagatcttattagtaacatggctaaaaacattggctttgcaaaattctcagtcagattcttgcttttaaatagaattagaggggaaaattactattagtcttttatatggaaataacaaaaaacttaggagataatgttgatcacatacccttttttattatatcttagtaacttatttaatattttagaaagtggcttataaaaaatttattgatttctacttagtatttcaaatctaaattcaggatgggaaggtttcatgaactttccagagactagtaacttcctattccactttcctgggcttggtattttagttattgtattgtctactcatatatttgacttttcactgtgtttcattttgtctaaagcgggactcttctcctcccagggaccagagaattttcttcttgatgttctgttaaagccttgctaagctctgactcagcctgactttaaatccatagtttcattttctaacattattaatgattaatcttgaagcaccgaagaaatgaaatgtgctagtaagtgtcgttaaaaaactgagagtttttcttctgttgtggacatttcttgtccataacagcttgagtttaactcgaatctcattagctcagcttaatttgaggatgttctgaaaagagagagggagaaacaaagcacgtggtcatcccaaatgctaatatcagagactctcttttaaagctactaggtccacgcttctatgaagaaagcaggtatccatgttgttgatgctccctagagagagcctcagacacattttgttcccaaacagaattagaaggaaaaggtctgcttagctgtcttttcctgtttaaaatacagctgcccctgcagtagagcccttgtcagctcgctggtgctctctgcaaacttgcagtgcaagtctatgatataagtggtgtagagtggttttgttgctaagagaaaagtgctaaaaaggaaaaaaaaaaaaaaaggagggcctgtatctcttgtgtagctcagatcctttgggtatttaatgtacagtttcagcaaaagacactcagaattatacctctggttggttcaaaattgcttaaatgttgaaacatatggtctcatgttccatttgttagcaaacaaccagctgttctcagcctgccaaatccaagtaaacatccactgtgtggaagagtgaatctgaaatggttcagtaaaaacataaaagctgtttttgctgaagaagaagaaaaaaaaaaggccaccccgaaacaacagctagtgaaaaaaaaaaaaaaatcttgttctgataacgtcttttccctggcttgcttacagtggactgtggagtaggaatgactctagagccgtttcaatttaaaaagatttgtaggcaaacttgctgtcctcttctgttgctgaaaatcgtgattgtcttggttacagtgattattttaataaaatgcaattatctgaataattaatgtatttgactactctactgtgtcctccattcacagaggccaaaatgtcaaagatcaagtagattgggagaataggaaaattctcattataaaggcaaggggaggagggaaaggatgaaatatttggaatttcagtgcagtggtttctatttatccgaaatgtcaagggcagtgtaaaatgtatttttaaaatgtgtttctgtatggtttgtgcccattcttggcgtggctgtggctgtacagagaccattgttctttgaggaatatgagggggtgtctttgtccaaagtgacaaaaagaagacttggaagactgggcttcctttgttcctgtgcggtgctgtaaaatttggtttgaaattaggacctcagggaaggaccttcaatagagagctttcatttcctgccagcattttaatcactctggggtttaaagtggatggccggccagcataatggccctatgtttaatagaacagcttgtatcttgaaggccagttaagggatctgtcatccgcccaatattcgtcttttctgtttcctgtccatttatgaagatcacccacccttttaggtggcttccctggatcattttgtaggggagctgctgccactgcttcttaaagaggctgaacagaaacccagttgaatgtggtccagtcttcagcccacgcagggaagttctgcagagtgctttaattagacacgaagttcaccacatttgggagttgattccatcagttgtagagggactgtgtcagatttcacaaaaaatatagaattggaagaagattaaaatttatccatatctcagaattattggcacctattgacctgatatgtgctcacatcatcactgtggtggatgttaatgtcatcctgtcatgcacaggagtaacttatctcctgaggggtgaagtaacctggtgggtttgatcctgttgtatacaaaggaaattcacaatttttctaatacagtggcttgttaactctgaaggcaggcttcctttggaaccctttagaaatttacctttatagtttatgagatgatatccagaactcctaaaggagtaaatattggagacaagacttgaaagagagagccagcagtaagaagtaagggttctgaatttctttcccagctcatgcctagtgggtaagagtaagataacatcagtaaaagcctgagattcactaagttttcatgtaggaactgtcactgaaattgctctgtgaccaggtgctaagaatggccttgtgttgtcagtaatagtgaactgcttggcagaggtaattttagaggtaactattaaataggatcacaaagtgtttccctaactgagtaataacatacatgaatgaggggagagaaggaagggaccttttcaactacgagcacactctctatcccatctcatagccagttgtgctgcagacagacaaaaccagagaagccgcttttcacggacatttttcttttttgcagatacctaggggttatcatggggaaacaaaggcatgtataaacctcattcagcagtcttttcagatagagtctgaaaagagtctatcaccaatctatctgaggtcagcttaatccatacccacagagatgatgagccaaaggcttccctaagctagggtcccatagtcttccccaagctagggtcccagcgctgggtgggggacaggagaaaaggcctgaggcacgggggagaaaaggcagttgcagatagtaatgtttggaggcatgctcagttattcagaagaaatggaatgacgttaaaattctcccaaaaaaggttggaaccacctctgcttccctttccccactctgtaatcagtaatcattgtctggtgtgttcagatgataatccagttggccaccaaggggttgtgcttccttactgactgtatttgtgatctgtaagacttttcaaacacaggtttaaacatccagagactccagcctctttgacagtcattctcccactgtgtcccttttgacttcttttgtcatgtctctagtgcagatttcccagctgcccaatttgagcccttttgagttgacctcccttggatgagtagctctttgaaagctgatttaaagtgagtgttgctccacctaagagctgttggctgaaaaaagcactgtctacaacagcagaggtggccgagaaaggcagacaggctctcctgaggctggtgttgcagatttgcattggtctagtaggaattatgcatcattagactgaacttcttatgtttgcatccaggtcatttctccataaaaaaaaaaaaaaaatgccactgacattacagccaaggaaccatcattgtacttacaccagtctgttcccacacatgaagtgttatgcttcaaataaccgctcaacagctcatctgaaggtccagagtatgtttactgggtaaaatatttcaggcatagacttggagagcaagctgcccaccagggcagggccttagcataaagttaatatcgtcaaagatctgactataatccatttcattcactgttgcagtttgctgtgtgggtgtttctacaatgtgggaaacttgtttcattgaagagtctgaatattttgtaaggatgtgaagagttgcaaataatcttttctgtaaggctatgaggagaaacaaagcagctaatgttagaaagaactggtacacgattgttttctgtcatttgtaaaacaaaataggaatattctggtctttacagatttatatcctcaacttgttgctccttaaggattatacaaaaagcatacctatgaaaagatctgttctactggaaggatatcctattttgaagctcaaatagttttatttttatttacgtatttattttcagaaatagcgtctccgtctgtcacccaggctggagtgcagcagtgtaatcatagctcactgcagcctcgaactcctgggctgaagtgatcctccatcctcagcctcccaaagcactgagataactagtgagggccaccacgcccagccttgaagctcaaataattttaaaatataagatgatatatgtaataaagcataattctttgtctatagaaaatgtgtctgtatgttcaaaaggctacctaaattttgttatattaacgaaagaaaaggtatggaataaagtgtatatatatatatataaaaactatattgtatatttgcaatatagtaaaaataacatatacatgtataaagatatatacatataaacatataaatatttctgtgtattcaagtcagtagagttacccaagatgccttcatttttgcctttaggcagtgagactatgctagccttaactgaaactttattagattcagtggtgctagtttccaatttctatttctcagcttctctttggaatcacaattcattagaatcattcattagaaaatgaattggcctttgtggataccccattcttagactatagcatttggttagcatcgttcctgtgggctccctttggaaaatttgcctgtatctatatgagtcccaagtccttcctttcaaaagcctttgcttatactttatcccttattcagttaatacctttttcattatattgtacataagtgcttttatgttttagatttgaatcccaactagatagtttgggatagttctttggggcaggacccatgtcacactttttctgtattcctcagaaccaagcacactatttagcatgtaggtgttagtttcctttccttgttaaattgttatatatatatttttgtttgtttgtttgttttttgttttttgttttgagattgagtctcactctgtcacccaggctggagtgcggtggtgcagtcttggctcactgcaacctctggtccccgggttcaagcgatcctcctgcctcagcttctcgagtagctgggattacaggctcctgccaccatgcccggctaatttttgtatttttagtagaaacggggtttcaccagcttggccaggctggtcttgaactcctgacctcgtgatccacccgcctcgacttcccaaagtgctgggattacaggtgtgagccaccgcgcctggcctattcatatatttttatatgaaaaaagtaaggcatgaaaagagtcttattatttgtttagttgacaggaaatttaaagaaaaagtattgctataaccatcctacttcaaattcctagaataatctttcccactcctttcattttagctcttctctcttcctgacctataactgtctttaatggtcttatatttgcatgtttttttaagtagtgaaagaaggttggaggaggactgtacagatggatagatgtacatttaactgcagagactggattagaacacacacattcagaattttctggatgtggtttagtatatcatgattaccaaatcacagctcccaacatgtgattataagggtagcaggcaggaaagaatttaatgaaatcttgaactttgccttctgcccttttgtatttgtcccagggtagcagagaagagactatagaaatgtagtgcagagggaagacaagtgaggaattatggcagccaaatgtctcccaaagtgaaagacaagaaaaatgggggcttcactgcacagtaggctggagattctacctaacctcacaggactcctagcatggctggtttcaaaactcgtttgagctataggaataggccattcgtggtggctcacacctgtaatcccagcattttgggagacctcacaaggatcacgtgaggtcaggagttcaagaccagcctgtccaacatggcgaaaccccatctctattaaaaaatacaaaaattagccaggtgtggtggcaggcacctgtaatcccagctacttgggaggccaaggcagggagaattgtttgaacctgggaggtggaggttgcggtgagctgagatcatgccattgcactccagcctcggccacagagcaagaccctatctcaaaaataaataaataaataaataaataaatattttaggctgggcgcagtggctcatgcctgtaatcccagcactttgcaaggccgaggcaggtggatcacaaggtcaggagatggagatcatcctggctaacatggtgaaaccccgtctctactaaaaataccaaaaaaaaaaaattagctgggcgtggcggcgggcgcctgtagtcccagctactccggaggctgaggcagaagaacagcatgaacctgggaggcggagcttgcagtgagccgagatcgcgccactgcactccagcctgggcgacagagcaagactccatctcaaaaaaaaagaaaaaaagaaaaaaattcaaaaacattttttaatgaactatagggatattttgatggactgttctttggaattaacaggtccacaagccagtggcttttctggaaattactgaaagctaattcttcagaagagtatgttctagctaagggtgtactataaaggtggtaaccagtagctagcaataacaagcttgttgttggtttcactgcagaaaatttaccacttgcatgtacttactgcattggtttaccctcaagaaaaagaaatacagcctctatatacctcttacacccactagatagaactaatcaggatctcttttgatcactggagcagataagcaggaaatataactaaccaagattaatttcacatattatctattattatagtttttcctaatctaccccttgacttaatctaattattttcagttcagggagcttcctgaaaatggaggacaaggatacatttcacctatgtcttatgctttaactctttttagagaggagaacaaatctcttttgaaattcatttgttaaagaaaatatttcagagtcactagcaaaagaaaactactttcttagttgattctttttgctctggatggagaatctagagatctggggttttactcatcactgtcagtaactagctctctgtccttctgacacttcacctctctgttcttcagttttgtattttgtgaagcatctacactagatgattcctgtcctccctctagatttgtagtaattctatgatatattacttgaagaacagaggcaacatttaaatgtaaatttccaaacacctgcattccaacatctccataaagtgcgaaccaagatacattatgccactgactataaaatacagaggaacatactttttaagccacttaagctcaaactaaaattgttagaatttaaagaagtgtggaaggttaacattaacctctcccaatttccatctcttttcacatttacctccttaatttgctaacccctcagttcttgatatccaggctccattaaatgtgaacactaacgtctcttagtgcagtagttctcaaccttgactatatattagaattccttggagaccttttaaaaattccagttgaagttggagcttaggcatcagtatttttcagactccctgagtaattctagtgtacagccagatttgaaaacctttgtcttagtcagatctctgtgcttttcaggatataataggtaaatccacttctctagtatattcaaatatatattttggttggttctcccagtagtagatcgctgatatttcagaacactctgctgaatattttattgaaattttattttattgaattttattgcatagattttattccatactaatttcctgatagtcatatcacttcctttggagagatagcactgtttcagattagggggcacaatgtgaattttctattcccatttcctaagattaaattttaagctagcagggagattccttaaagtatcatgggatgtccagaagttcaggacggcctgagacagatgagtggatttagagtggtgttgatgtgcgtttgtttataacacaagatgcccctagtgggattatatcaccattttgtcagatttttcttaagtctacaaggtactgaaggggaagcttttttctttcagcagttggctctagctaaaccagaagtataaagtaaaaacacttaacagctcaaatcgacatatcaaattgaaacgtgtaggattatagtatgtatcattgtacctatgaactaagcaagtcaataagtatgtgtttattttattttattttattttattttattttatttatttatttttgagttggagtcttgctctgtcgcccaggctgaagtgcaatggcaatctcggctcactgcaacctccatctcccgggttcaagcgattctcctgcctcagcctcctgagtagctgggattacaggcacccgccaccacgcccagctaatttttgtatttttagtagagacggggtttcaccatgttagtcaggctggtcttgaactcctgacctcaggatccacccacctcagcctcccaaagtgctgggattacaggcatgagccaccgtgcccagcctatatgttgattttatgtgacatgagatgattttcaaatagactattaaaatgcaggatttaaatgtgcatctgcttgaatctaaataccttcatataggtagtcaatctgcaaagttgtttgcctaccatgtgtagtttcaagttagcactagttttggccgggtggggtggctgacacctgtaatcccagcactttgggaggctgaggtgggtggatcacgaggtcaggagatcgagaccatcctggctaacacggtgaaaccccgtctctactaaaaaaatacaaaaaattagctgggtgtggtggcacactcctgcagtcccagctactcaggaggctgaggcaggagaatcgcttgaacccaggaggcggaggttgcagtgagctgagatcgtgccactgcactccagcctgagtgacagagcaagactccatctcaaataaataaataaacaaataaaaataaagttagcactagttttaaagtatcctccattttttgtgatagtgaaaatctaggttcctgaaaagaatagattatttccccagctggatgatttccagtccttacaatggtttggaagcatttggtaggcatataatggccccacaatcgttttggcttagtttggcttgccccagtaatgtaaattataggaaatctttcttgaacaagataaacaggaactaagagcagaaatgctttcccccacccacctcccctcatggttatttggagctattaaaggagtgggcaaataaatgaagggcatattcccaggacctagacactccaaaagtctgcatttttatcctgttaggttttccagacctgatatcattaggcagcttcctctgactagttgattttcttgagaaacattattcttgatcccgtaacatcccacactgctttgcttctactcctctaagccttttttcccctcccttattaaaagtaattttttacagaaattcctagcgccaagcacaaaataaactagaaaagcgtcggacttctctgtaacaacagtcttggtggctgactttgttgctcctgtgagaggccttcatgcttttgaatgagttctgttacaacagatcactgataatttagtggactggttaccaccagaatccttgggattatctgaccttctccaagtagctctccatttcagtattgctatgtttaccatctggttattgtatcacaatctcaatccagccagaacaagaagaactgagatggttaaaggaaagactcctaaatgttgggtcatgagagattaaattgggcatcttacaacttgttcctcctggagctgactacactgactttctcagtctgaagtcccctctctactgccgcattccaaggctgctgtgagcccattatcacagtgagtagtagcatccaaaggttaggtaatgccccttttcctagccgaaagactgaagaccgaattctcctaagattgttgggcttaccttaaattcttctattaaaatggaaaatgcccaaaccccagtctgtctgtccttagagccaggaaaaaggactctgagacgtacatgctgttggcatcagttaaatttcatgttcctagaggtcctacaatcctgtatgtaaagctacagtgagtaattgcaactgcattataattattttggtaatgactcccttcctctcaccaagaggcacagggatggatctgcacagttgcctgctatgaacattgtggttcaagtagctgatatttgttgtttaggcaagcaagacatccagctgatgggctgaacatctccattccatcctgctgtttagttttgtgattaaatagccacttactcatttcctgtattgtcacataacttttcagttctcagtttgctatgaggacagagacttagctagggttactgcaggtccacatttgcctaggtcccagctttacttgtaccagtttaattatcattgccgcttatgtcacccaaaagtgtaccagtttggatgatagtcaccttatttatcaccctacattaaacataggagaaccaaaagaaagagctactaaatggaatgataccagaatctgtgcttctaaagtaattagaattagcctgtatgtcccattgttttcaacacaagtagtgtcacttgaatccaaaaaagtgatctccctcctcattttctgtttgctgataaaggatggctctctagaattaggattctgcgctccgtaactaatatttttataggaaatatgaaatgaagtaaagtccaaaagcaaacaggtctgtagcctttttgagaagtgttcactcttcttatgggggacgaaggtgagtagatgatggtaaagtaggttgtcctctaaacatacaatctctgagaaagatccttgtccagaaatcctgtgtctcagtggtacccagcgataccctggagaggaacattccagtgattcctttctgggcatatttcctagggagttttgggagtcatgcagtgatcaggttcaggacttttgggtcagacttaacatgagtcttcctttctcacaggtggcccattgacttggtctctgtgtgcccatattactggtgctgccagctcagggagtttatgaaattttgatgtagaaattagattgttgcttatcttgtaccttcttgctcatagtattgacagtaccactgaattgcttgaggcagatagcatctcagcgatcactgtgctatttcagctttctgctgctgacaacatcagaagtgttttaacagggttttaatgggcagcctctgtagctccttggagggttgcaaatagctgccgtgagaaaccctctctgctgctctgggctgacatgccctcttttctcatccagctgctgcttgtttagatggccgccttcctggtgacaagcacttcttatttgggctgagcagtactaggacttgaattccagagatgagattgtgtaacataaaaaaggaaaggtcttttaaggacgtttttttcccatcctgtttggggtaggaaaaacaaggcaggttatggggggagaggagtagggcaagaaagagggtctaaccagaaataagtttgccattcccacaacctttcagaggaaaattctggtgtgccgttaaaactaaagttttcggccgggcgcggtggctcacgcctgtaatcccagcactttgggaggttgaggtgggcagatcacacggtcaggagtttgagaccagcctggccaatacagtgaaatcacgtctctactaataatacaaaaattagccaggcgtggtggcaggcgcctctaatcccagctactcaggaggctgaggcaggagagtcgcttgaatctgggaggcagaggttgcagtgagccaagattgtgccactgcacttcagcctgggcaacagagtgagactccatctcaaaaaacaaacaaaaaacaaaaaaactgaagttttctcatttgatggagtcacaataatctatttggagaatatcaggcccacagcttctattttctatttaatagcttgcccacattttagagtttacagttaattaatgctactttgtcaacttggttccattatttgatcttcagattcaacaaagtagccgaattctcaactaatgacttaaaacttcaaattttaggattaaacagaatggatatccactccacctggaattctctttgctaaaacaatgaggtagttcagtgaggtaatacaatgacactacattgatttcccccctgtggcgccaaagacagttcttgatctctacacccagtgacaacagggtactcaaaagggaactagtggtaagaatggaagaaaaaaaaagtggccaaattaacaaggttgttggtgtgatacaagaacttggtctaatcaggaggagcctctgaggaaaagatgtctgtgttccacctagaaagtgtagttcggctgggcgcggtggctcacgcctgtaatcccagcactttgggaggccgaggtgggtggatcacgaggtcaggagatcgagaccatcctggccaacacggtgaaaccccatctctactaaaaatacaaaaaattagctgggcatggtggcgggcgcctgtagtcccagctatttgggaggctgaggcagaagaatggcatgaacccgggaggcagagctcgcagtgagccgagatcgcaccactgcactccagcctggtgacagagtgagactccgtctcaaaaacaaaaagaaagtgtggttcatagtagaatcccagtgttacaaagtgtcggtgcagatatcagctgctataattgtttctctacatcactttccctttcagggacatggaaacagtagtttgcctggctcattctaaagaagatctcagaatacttccttctaatgttagagagaaagagacttcctttacttcaagccctacctacttacaattggtttttatcattatcaccatccacagtgttgcaggctgcctgaaaaaaatctcctatcagacacttaaggccatttcacagcttcctcttcccaaaccacattgatagcactgggttatcatctgtcctttagagatttaagattcttaacttcttgtcaccagcagaggcatgactttagctattaagggataaatctgattatcacgattggaagaaaaagccagtacacctctgggacacattatggcatggatccttgggaaggcccaagtctgtttccccttcactttcttagagctgggcttctctcctaaagctgctgttgctgtgtgctcttgggactgttaccccaaccaagatcctaaaaaaaggcttagatgtgcctgtggttggggtgctctgcaaggcaccaaaaaaagaaacctgcagaaggctacataccatgaaggaaaaaaccacaagaatgtgggctacaggagagtatgatgtgaaaagcataaaccctagcgttacccggaatgctaaccacctcactaactaggaaatgggtttgcctgcctctgccacagtttcctcatttgtaaaatgaaaattacattgagaattctaacttacgtcataagtttgttggggattaaataagataatgcagtatggcacagtacctggcacacggtgacgtgcttaacaggggctgatattactattactattaagaatacatacctgctgctcactaagtgtacatatgatccctctgtgtgttcaaagtgcataattttagggaatttgttaacagtcatgccgacatagatacaaatatagagaacatatagtggcagaataaataagccaagatatgaaataatagtggggaactgtaaagaaatgataaaaataaggactcagcttaaacctttgaaagaaagggcctccataggcttgtcaaaccatagacttcaattttgaaaacctctgttctcttttacagtcgaaaagcaagaaacttcggcttgactaatgagtatggtcttggtgtggtccttcctttctggaggcctcagttttctctggaaactgggagaggtggagtagatggtctccaaggtagcttgtggtctaaaattctgtaagtctacttaaaaagaaaaggactcgtagcattcctcttttcgctgttgctcagcggtgtttgcctgaggtacagatgtttcgtggatctcccctggtacatttttctgtgaaatctcaggctcctgcctcatgtctctgtagcttagtaataactgaacatggttaatttgttctggtttattgttgattgggtgatttatgtcacgtggtatatgggttttttttgtttgtttgtttaattttcattcagcaaccagtggtcttggtcaaggtgggccatggccactctgcgactccaggtcgattcgtctgcctgttggcttttttgatttttgctttgaagtttccttttgcctcagtcagctgccttgaatgaaattatctgctgctgctctgggcttgtgatttcctttgctttcatgtttgctccctttctgaaagatgggggttgtaatttgtttgctgtttaggagccagcccttcagcttcctttcagtgatagcatcctgcctgccacactgggcttttctccttttccagtccggttgttcccaaaatcactagtttaattctctgtatttgaagaatgccaatgcaatatctccctttcctgaatcacaactgcagttggtaattgtggaatgcatttcctacaaatattaattttactttcaatatgtgacaggatgcagcgccttttttttttttttttttttttttgagacggagtttcactctgttgcccaggctggagtgcagtggcgcagctttggctcactgcaacctccacctcctgggttcaagcagttctcctgcctcagccccccaatagctgggattacaggcatgtgccaccacgcctggctaatttttttttgtatttagtagagatggggtttcaccatgttggtcaggctggtctcaaactcctgacctcaggtgatctgcctgccttggcctcccaaagtgctgggcttacaggtgtgagccaccacgcccagccacagagctgttttttataaatattcaaaacattttaaaagttaatagaaatacctctaatctggtcctagagagcttgtaaattgtctgacctggtcattctcctatctgcccttgggtactgtctccatgctcaggcactttcctatttaatatactacctgccaataactagctaaaagatatctttaaccttgaatcattagaaagatatcaaggttcttttcatgatgtatgctttttaaaaatttaaaactagcaattaggatacatttgaaaggaagactgtcttgatttcttggatattgtatagaacaacttgtatttgcacctctgagggcctttgatgaggtggccatttaatgaaacactcagctcaagtgttttcaaaacagctgatttactacacttggataccctgtggtgtgtagagttgtgcctgaagttgtcaaccaagcagcagagctggaacccagttgtagtgatcatgtctgaaggatgtctgctaaatatcatgtgctcgcttttggatagaaggaggtgggtcagagtgaagttgttaatcttcaatttttttcaaccacctctaattgagagtagaaaagcatttgctttctatcaatttgatagtcccatcttttctcctatatttgattatagaaagcagtttttatttttatgctttatctttattattttcccattgatttataagagaaatctttaagcatctatcatgtgcatctctgtaccatggatgatgggaagatatacaaagtaaagttcttgttagcaggaagatggactgagtatatgtatgactataaagtgatatcaaaagtacaggtgaagttgtggcaacattcaaaggaaagggaaatcagtttcctcttgaagttcaggagagatttcatggaagaggtatcattcaagctgagttttgttatatggaaataagaaaggaaagtcatcccaggcagggagaacagtgctcggaaaacagggtgtacatatggggacgagcaggtggtttggtttgcccatcagacagtgtggcaaggacagcaaaaggagatccagtctgagaaataagactatacagtgtagtcctttgaatactttgcagtgtttcatatacatctggagtcaactggtttgttgggatttgcatcttgcatccaccacttcttacttctgcaacctcgggcacattcctcatcatctctctacttcagtttcttggtccgtgaaaactaacaggtgaaatgaattctaagtatatgtttcatttaatgcagtaaatctaagatatcattatttcaagatttaatcaatataaaaatagactgaagtacttttagcacatttggcttcagcctagccatatttcaagtgctcagtagccacatgttgctagtggctaccatattgaactgcacagatctagaacatttggaacccattcttctgttctcctgtctttggttttatgcacacaaagagagaaacattaggattgaatgcaagccatttcatgttgataggcatagctaccacttacagatgttgctgagatgccagaagttaatccaaatacattttggtctcagttggccacaggagacttgtcagcagttacatagaatgaaagcaatcactgctagcaagtccatccttttggacatacaagtatcgctctgccttttttttttttttttaaagaaataagactcatctctcctttattctttcctgaccatgcctgcctttgtattcctgacagccttgaaaggacacagattatgtggtaaatataataatcaccccttttcacattagacgcagccctttgaattcccagcactgatctaattccaattgcttctgaagtttacctttcacacttgtgttggttttagccggtggatactatgtcaaaggtcatgaacttgtacacttcccctccaaagattcacagtatcagtgcccagtttgtcaagatctctctagattagtttatttaattttgctgcggttggttaattcacaaaatcataaggcctttttcttctttcaaatgcatagcaagtgagggacaaagaagaaggaaaaggaatggaattcagtttcctcaacatcttaattatctcagttttaagttcttctataagtgtgtctctgtggatgttgctttactgcttaaagcgtctaattgaaaccagatccttaaatctcttggaatcaagaagcagtagtaagcccagggcatattatccctacaatccagaaatacttaggtgtcttgtatttgatgcacgtgtaatcagtttactctcccagctcctttttctacctaaaatcttagtgatgtagtacagtggtaaaggggatatttattcctgttttaaaaggatacaaccaaggtagggaaggcttcgttattggtgattattcagaagacctattttctttacatatgctatggaaacaatactgttttccgctacagaatacagtttatgattatacttttgtaaattgcctgcttttcccctgtcatctgctaattccaatttgatactgttctgtgttcaaaaatacagcatgagcaagctgtaatggtgcctgtcgagagtcccagctgcttggggggctaaggtgggaggatcatttgagcccaggagtttgagtccagcctgggcaatatagcaagaccctagctctaaaaattaaaaaattcctaaaatatccactgaccataatagtgtctatcaaatgcattttcacattcttgttatgtccaaaattctctataaaaaattcaggaaataattgttttgtgatacctaattttcaggtaagcccagctggtctaaaaagattggcaatatttgaaacatttaaattatattaacagtttttcttttttgtatagttgaagaaagaattaagacatttcaaacttttgtatggagatctttgttaagtggattttatgcttgcttcttaaaatatattgaatacactttgctgtaggacagggcctagcccataataggcatgcagttcttattggaattgtgttgaacgactcactgctatgagcacccagtatttactagatcttagattttaagggttagaattttttcagggtgatcttttttgttcagatgcaaaatagctccagtactcatgtgtattttctgtattttttccttttttgccatcaaagctgagaaccttatctcttagaaacctttaattgactacctaatatgtgccagatacccatagctttacatgggatatctcatttaatcctcacagcagccatatgagattgctgttactgtatcacatttacgtattagggaactgagcttcagagagaaccacatttgttctgactgctgtcagtttgcctgcctatatcctataatatccctttcctttttaatttgttgcttctagtcctgaggaccagaaatccagataaataaaatatgctctggtgggccttcctgatgggaccctcgagggaggagaggatggagactgggagaggagttccaggttggggtgtatgaggtggttaactgtgtgcaacgcccctttcccataggttatggttactccatagttaagctgatgttacgcggttagccagaatgaactgattttggctagagccttttcttgtctaggaatggaggaattacctgaatgagttcccacagactgtcctagaggggccacagactgctctgagaagctagtgcaatttatgagtcctcttctgaaaaaaatgcagatactcatacatatacaatgtcgcatgtgctttcaggggtttcaggacccctctgaaatccatccctggatcccagattaaggtaattcatttggcctctgtgggtggatgttaatcactaatgctgttataacctaaacatgtccctaagaccagaaattataattaagaacagaggaactctagggactgtaagaagtttgaaacagaaaagggctttctttagcttttgggaggaatttgtgtttgcccatgaatgaagtgaaatgaccaggtagacagtagaaccaggcctgtgtgctggggagaccttctgtgccctaaggccacatggccgagagacaggtgggaagccaaggaagaataaattgggcataggtcctgttaatttacaccagcccatcaggttggagcacactcgggaaagttcttgctactccgaaggtgatttttagaatcagaaacctgtacttgagaaacataactttttgtgttatttatattttctgtaatgattttctgttgctctctgcttgattttatgtaaaatttgtactaaggttaaacattgaaagagaattttgcaaatatctgagcctctctaaagggaagaataggtgatgcagtggggttggcagcacttttcctattacttgggagtgaaccctcagggaaataaagtgcaaaggcttagccacaggtgtagccatagaatccctttccacctggagactgtcctttccaatttccagcacaggttttgcatctggttttcctaagaaggccccttcctttacacacattcctgcatactcctgcttcaccctcaaggcccagtagaaaccagcagtaggaccttcctcaattttcagcaagtaggactccttatttgaaggacaagtacctggctcttaattgaagtcttgaacagtttcaaagatgggaaaattctttattattttgctttgagattctcctaagccccagctgagaaattatgaaggcgactatagacacatcaaaatctattaccagaaaagttgccttaccaggaaaccgtaatttatagtgtatttttttaaggtgggaaggacacatgggtatggtgtattttaaaaggatttaaaagcactaaagtataggcacacctcattttactgcattttgcttgattgtgcttcacagatgatattgcattttttacaaattgaagatttgtggcaactgtgttaagtgtgtagacatcatttttctaacagcatgtgctcacttcgtgtctctgtgtcatactatggtaattgtcaccagctttcaaacttttgcattattattttatctgtggtcagtgatctttgacgttactattgtaatcgtttgggggcaccctcaagctatgcccatgtaaaacagcaaacttaataaatgttttgcgttctgactgctccactgaccagttgttcctccatctctctgcctttccgcaggtctcctgattccatgagccacaataatattgaaattgggccaattaatacccctacaatggcctctaagtgttcaagtgtaaaaaagaggttcgcctctcactttaaatcaaaagctagaaatgattaagcttagtgagaaaagcatgtcaaaagccacgacaggctgaaagctagtcctcttgcagcagttagccgagttgttaatgtaaaggaaaagttcttgaagggaattaaaagtgccactccagtgagcacagaagaaagtaaaacagccttgcttctgagatggagaaagttttagttgtctggatggcagataaaaccaaccacaacatttctcaaactgttggcctcaagcaatcctcttgcctcggcctcccaaagtgctgggattactgatgtgagccaccgcacctggccaccaccacattcctttaagccaaagcctaatccagagcaaggccctacctctttcaattctatgaagctgagagaggtgaggaagctacagaagaaaagtttgaagctaacagaggttggttcgtgaggttaaggaaagaagctatttgcataatataaaagggcaagatgaagcagcaagtgctgatggagaagctccagccagttatctagaagatctagccaagatcattgatgaaggtggctatgctaaacaacagatatcgatgtagacagaacagccttctattggaagaagatgccatctaggactttcatagctagagaggaggagtcagtgcctggcttcaaagcttcaattgaaggacaggctgatacacaatggcaattaaatgtcaacattcattttgaaggggatgctcaaactatagcacagaccaattttctttgtctaaatacaatagttttccttccaggcagcctcagtccacgttcatgagccacattcttgtgcttctccatttacatagctctaatagtagaggagagatgctttatgcatccctcttaccccgtctctagatatggagccacaaccttgcctgctaccagctgaaaattctcctgaagctaggcttttatcttcgaattataagatagtgttggctgggcgcgatggcttacgcctgtaatcccagcactttgggaggccaaggcgggcggttcacctgaggtcaggagttcaagaccagcctggccaatatagcaaaatctggtctctaccgaaaatacaaaaattagccgggcgtggtagcacgtgcctatagtcccagctactcaggaggctgagccaggagaattggttgaacccaggaggccgaggttgcagtgagctgagatcatgccactgcactccagcctgggtgacagagcgagactctgtctcaaaaaaaagtgtgtgtatacacacacacacacacacacacacacacacacatagtgttgatatgtgcatatatgtatactttgttttaatatgtaagctatttgtctgccaaattacttttttcataaaattttaagcaaaacagctctccgtggtccaccattatgtaccccccagaaacactacaataacataacattgatggaggttataaatttttttctcaacttttagatacgggggcacatgtgcaggtttattacatgggcatcttgcactcaggtagtgagcatagcgcccaataggtagtttttcaacccgtgccctgtctctccctccccctctagtagttcagagtatctattgttcccatgtttatgcccatgggtgctcaatgtttcactcccacttaaaagtgagaacatgtggtatttggttttctgtccctgcactaatttgcttaagataatggcctccagttccatccacgttactacaaaggacatgacttcattcttttattccatggtgtatatctagcacatttgctctatccaatctgctcgtagatgggcaccaaggttgattccatgtctttactattgtgaatagtgtggcagtgaacataggagtgcaggtatctttttggtataatgatctattttcctttggatatatatatacccataatgggattgctgggtcaaatggtagctctgttttaagttctttgagaactctccgaactgctttccacaacggctgaactagtttataacaacagtgtataagcattcccttttctctgcagcctcgccagcagctagtttttgcctttttttttttttttttttttctaagagataaggtctcactatgttccccaggctagtctcaaactcctggactcaagcaatcctcctcccaccttggcctcccaaagtgctgggattataggtgtgagctgctgtacctgacctgactttttaataatagccgttctgactggtgtgagattatatctgattgtggtttttgatttgcatttctcagatgagagtgatgatgagcattttttcatgtgtttgttggttgcttgtaggtcttgttttgagaagtgtctattcatgtcctttgcccattttttagtgtttttaattttttgcttgttgatttaagtttctgaaaatagattctggatattagatttttgtcagatgcatagtttgagaatattttctctcattctttaggttgcctgtttactctcttgatagtgtctttttattgctttatctccattttacagataagaaaccggttttagaagtttcagatatttgttcaaagtcataccatgaagtacaaagctgtttttaacccatacctttcttaagttccaaatccataatgcagaaaccatgctgggcattaaggaatcctaccttcaaaggaaatgacaaggctggagacagtggctcatacctgtaatcacatctgtaagcactttaggaggatgaggcaggaagacagcttgagcccaggaatttgagatcagcctgggcaacatagcaagacaccgtctctacaaaataattttaccattagccaggtgtggtgacacacacctgtagtcccagctactcagggggctgaagtgggaggatcatttgagcctgagagatcgaagctacagtgagccatgattgcaccactgcactcaagcctggaagagaccctgtctcaaaaaaaaaaaaaaaaaagaaagagaaagaaggaaacaaagaaagaaggaaaagaggcctgacacagtggctcatgcctgtaatcccagcactttgggaggccgaggggggtggatcacaaggtcaggagttcaagaccagcctggccaatacggtgaaaccccgtctgtactaaaaatacaaaaattagctaggcgtgatggtgggcacctgtaatcccagctactcgggagactgaggcaggagaatggcgtgaacccggaaggcagagcttgcagtgagccgagatcacaccactgcactccagcctgggtgacagtgaaagactccgaaaaaaaaaaaaaaaaaaaaagaaagagaaaaagaaatcaggagagtttaaaagcattccacaaagtcagtggttatatgttaatctgtgtagtgtgctttgtttcccagataatttagaagcaattaattctggatagacgtgtgttgcatgtaatgacagatactgattgtaatgttttattttggccaaaaaaaaggtggggggtggggagtaattttcctcaaaatcattatctggcagggtgggaggttgtttttcttttgtatacagagaaacagagtcccaggtaggaatatgtgttgtattcatggcagttcggcagacccttggaatataaccttcttcatggtccatgttctagtcctgctttgagaaccctcttttgagtaaagaaaatcttcaaaaacccatctctgggtttcatcctgaggatccaggaccggtgttctctttcttaagaggaaaaaaaatcacaatggtagaaaattctttgcaaatcctattgtagtcttgattgatctctcttctcattgctcttcgtcggcctcttcaacccttctgactgtgtgtattagaaataattattatcaccattaaaacaactttctttgtctatttcaattattttctttatgttaactattttctttttagagttgcttatctatttagcaggctactgcattagccttgagctagtattgtaagatgcaaaattatgttgccggcatcagttgggaatttcatggaatttgcttctatttgactatatttccagatggaaccatgtgccgaagtgtttgttttgggcctccatgaagtcattcctttgcagtgatctgtagctagactgcgctctcttgggactaacctgtgtgactaatttgagtaggagggtgataaactttgttaccacttaaaaaggggctaaaaatacttcttttttaaaaaactcctctccatattatctagcaacactctttgagggataatggaaaggaggtgataaagattagagctgattgggaaggttctgaatgcccaagtttcatttaggaagcttcacacctttgagccccagggaagagtttggaccccaggcttttacaggtttgtagtaaaatctgagctgcccagaacactctgtggctaatggcttttgcagaagtgattctacaactaaagatgccaatcaactaagcttgtattggttcatcgtccagatctaaaaatgattgttaatttgagttattgtgctaaatatttctaagaaatgcttctttttaagttgctgtcttgtgatcaaaacacagtaaatgaagggcttccctgaaaggtggagccagtagacttgatttggagatgaagcatataccgaacttgaagactggagaggtatttttgccttaaccctgtctctgattcactgagggaccttggataagtcacaatcttcctgtctcatgtttcttttacttaaaaatgaaagcatggattaggctagctcttcgtcaaacctcccttctcaattcaccttcctaagcacagaactctttttctaataaaattttatgcaggaccccaatctataaaacagatacaagaggagatgctttggttaatggagggcacagggagaatctctctctggcttcagttctggcccctgaggctctttcctgtctagttgagctttctttaagaggtcttccagctgtggcattccatccattattctaattaatgtgaattgagtattactaatatcaggtttggtttttttttttttcacttagtacccacatcatggagcaaaaaaagtggttctaaattgcagaatgatttaagctagtagagggtgccattcattgatattaaagattagtactggtctaaacatagcactattagaagttacagaaattcacaatagaaacccccttcctctgtcccagaatgcatggagcaagaatgcagaatggggaagtaaatgataaatctgcaaccattagtgctcactttctaagcttcccactgagtactaggatacagctctctcttcttccttcctctccttcctcaaatcctacattcctacaccattgctgagcaggttgcaattttggcctagagtgattactcctgattactcctgtccctctctctgactggagccaggtctgaagtactctgttttccacctgtcatctcagccaagaccttgcagattcaatactaaactgttgtataggattaaattctgagccttctaggaaaagtttcagaatgtgtttctttgctgttgttaattgcaaaatcaatagacctccctcccagggagaggagtttccttctcctttggtgggcttccctctagcaattcaggagctgctagaagcagattaacacctacagttccagaccagcttagagctcacttcatttcccactgtgcagcatttcaccaacccatggacctatagctagtcattcctgcctgtcctgcgccagggccttttccagccagcagtcttcccactgactgttagaactataccctctggctcaggctttttccagaaaaaaaaaaaaaaaaaaaaatcatagtactgcttcgcattttctctcaacttcacatttcctcacaaagcactaggctttgtcctaagcactttatttatttacttatttatttatttattgagacggagtctcgctctgtcacccagggaggagtgcagtggcatgatctcggctcactgcaacttccacctcctgggttcaagcaattctccttcctcagcctcccgagtagctgggactataggcgcacgccaccactcctggctaagttttgtattttagtagagacagggtttcaccacattggccgggctggtctcaaactcctgacctaagatgatccgcccacttcggtcttccaaagtgctgggattataggcgtgaaccaccacgcctggctgtctgccccccgcctgtcctaagcactttaaatgtgtcaactcatttggtctctttgaaaagagtggccaggtgaaggctgaaggaccggataagtgtagtttccagaatccttcttggctagttatagtctaagacttgcagacaggcagcctgggaagatctcaaacaagtaaccttcaatgaaaatgtacagttttgagaatttcgatatttgacagatgattgagccactcgagttgcttatgcatgaatgtgcttgtttagcaggtagagttattattctcttatgttcaaatttattaacaagggcttaatttcattccaaacagattgtgaggtgactacgtagtacagaagtacagtgaaatatgagattcctgagcctttagtggatgctgagctggagacccccgttagtgctacctctttctaaacagcgccagccatgaagcttttgaccttttcacctttaaactttgtttgaacttggaaagaagacttttgaattgtttaaaaaaaaaaaaaaggagaagaaggagaaagaaagacaagggaaaaaaatggttagggaggctgcaaaagagatgtggagactgggggaaaaggactgattatatgttagcttaacagtaatactaggaaaataatcctcctcttgtctaggagtttctgctactgggagccacagggtaatcagctcacatgacatacccagaggcgaatgctagcctgtgctgtttttgaacatactcaaacaaaggctgattatccaaacaagaatttggactgcagcagtcggaccagttaaattatagttagtaaaacttggtgccttgtgagcttggaatgttacaattgcagctggatcttcgtttgtcaggcagccttactgcacaataaaaccagagatttttatctccgcaggactcagtttaactccttgggtgcaaacagaaaagtgccagctatcatacgtcagaatcctggcaacatctgtccccactcctgtcagagttcatgaggcagtggcattttcgtggtgttctgtaggaaagtgggaggacaggggcaagttgctcttcttcttagatcttatgttggagataataatttttatttattcgttactttaacaacattttttgttttgagatggagtctcgctctgtcacccaggctggagtgcagcggtgtgatctcagctcactgcaacctctgcctcccaggttcaaccaattgtcctgcctcagcctcctgaatagctgggactataggcacccgccaccatgcctggctaatttttttgtatttttagtagagacggggtttcactgtgttagccagggtggtctcgatctcctgacctcgtgatccacccgcctcggcctcccaaagtgctgggattacaggcgtgagccaccgcatccggccactgtaacctttattaagtgttactatggacaaagccctgtgttagtactctacttatatacaaatggctataaaaagatggtataaagtagtcaattgtaaataggtttcaaaatgttgtaagtggagggatgatggagaaggtaaaaaaaaaaaaggctttttggagaaggtatgatttgagctgactttgtgggaaagtaggattgaatctttaaatgtggctctaaaagtggttttatgcagcaggaacaacacaaaggaaaaattggaggcaggaaagttggatcctggatgtgaagggaggtaataaaagagaagactgaaaaagtagaatagcctctgcatagcggacttaggatgccaggcctgagagtggacttcctttggtaaagcaagaggaagccattaaaaagttatcttttttacatagctgtcaaataataataagttaacatgtattgaaaggttaccatactgagaggtgaagccagctggacttctgggtagagtggggacttggagaacttttctgtcttacaagaggattgtaaaacacaccaatcagcactctgcagctagcaaggggattgtaacatgtaccaatcagcactctgtagctagcaaaggattgtaaaatgcaccaatcagcgctctgtaaagcacaccaatcagtgctctgtaaaatgccccaatcagtgctctgtaaaatgcaccaatcaggatcctaaaagtagccaatcgcaaggaggattgaaaaaagggcattctgataggacagaaacggaacatgggtggggacaaataaaggaataaaagctggccatccccgccagcagcggcaacccactgaggccccctagcaggctgtggaagctggttcttttgctcttcacaataaatcttgtggctgctcactgtttgggtccttgccacctttaagagctgtaacactcacctcgaaggtccgcagcttcattcttgaagtcagcaagaccctgaatccactggcaggaaccagctctggatacagtacgtgggacactgaatactcaaaataattctggaagaaaatagagactcagagaaacgaagtaactttcccaagactgctcagcccataagcagcagagtcacgattgaaatctggactgaccgtagacccccagctcttaactgctttttgtattactctctattccttttaaattggctgactttatgatcataatgcaaaatagattagccatatttttatatggaggcaggaagcttgactctaatggatcacccatattcctgaattggatgatgatggtaaagagaattgctttacaggggtgatttttatgttggagaagatacagttatgatcaccaccctgagttggtttaaatatacgggttataactttgtatgaacaagagttttgtttttgtttttgttttgtgagacagagtttcacttttgtcgcccaggctggagtacagaggcacaatcttggctcactgcaaactccacctcctgggttcaagcgattttcctacctcagcctcctgagtagctgggattacaggcacccgccaccacacctggcagtttttcgggttttttttttttgagatggagtttcgctcttgttgctcaggctggagcgcagtggcatgatcttggctcactgcaacctccgccttccagtttcaagcgattttcctgcctcaacctcctgagtagctgggattacaggcgcctgccaccacacctggctaatttttgtatttttagtagagatggggtttcaccacgttggccaggctggtctcgaactcctgacctcgtgatccacccgcctcagcctcccaaagtgctgggattacagttgtgagccaccacacccaggcacaagagtatttctgcttgaccaattccatcataatgagataatctgccctcatagctatttctgacagtgatttatggtagtgcagagctggctttggcaggtcttatgtctttatggccttgctttttctgagcgacacatttgctaccattggtgtatggctctccatttcccagtttccacggggtgtcttcaccgtattcttatcctctgctgaccctgctgctgtcttgttttctttcctgtcctctttgatatactctgttattgtaagccaggcttgtggcttctgggaggggtgattggcagggtcagtcagacataagcactgaaacgtgtgtcccagaggtggaagccaaatttcctctcagggccctgaggctaacctcctgtgatggcttcatggctagaaatagcaaaaatcgaaatggatattgcagatagtccagacaagcaaacagaagtccaaaatgcttgggtacctaagatttttttaatttgttcgtgtatatttttagcaatagaagcaatatagcatacctttgagccagtttttcctaggtgtgccaggtaggttggcattcacagttctcaggagacaatcaggtactgatttagtgagctcatttttgaaatgcaaaagcaaaaaggaataaaatagcaggttaccatagtatagatagtaggagttgattggcaccaacatctttatttagtttgggttagaacagattctctgcatatcagatttgaagagaagatcttagtttttatagcagtaccatcaaagatagttatatatccaagaggaaagcctgagtttgaaataatgattagctctacagattttcagctttttgttttggggttttttgttttgtttttaattcaatttgcaaagcctctagcagatagttctgaaacctttgtgaacgctttctgtaacttatgaagcttttggaaatttggtctagtgatgagtaattctttctttctgacgttaatcatttgcattttatcagtggctccaagattaatataaaaagagaacttcatttactctgagtgatcatgtttcaatgtgttaatgttttaggagtagcagaggataacatgcaactgttaagatctagatcatgctaaaagtattaaagttggctttcagagattagttttttcctacttaaaattaagaacttaaagattttaatcaagataatcctaaaatgtcttaaggtgcaacttattctggagttgataccagttggaatagtaaagaccaaaggagaaattgtgagttaatgtttacttttttattactattttaatcaaatggctttacaacttgaccttttaaatgtgaatatatttttttaaaagaacactcaggtatgtgaagccataattgttgtgttggaagttctcagccctaaaagttctgcacttgaatgttaaatatatgtgtgataaaaatattttgattggggttttctgtgtgggcatttacattctcctggtgacaggtgttttggtgaagagaaaagcatcttgtagatgtttgagatctgtaaccatgctgtctcaacagcagcagcagcagcagcaggaggaggagctaccatttattgaatgcctgctctatcataggcactcctctaggcactctacagacataatttcttctacttacaaccatcctggcgggtagaatagtatttttatttcacagattcaaaaacagcctaagagaagataagtggtagggacaggctttgaactcaggtttctctgattccaaggtccatattcttttcactataccatgatattaaaaaggaacaagtggggccaagcacagtgggtcacacctgtaaccccagcactttgggaggctaaggcgggtggatcacttgaggccaggagtttgagaccagcctggccaacatggtgaaaccccatctctactaaaaatacaaaaaaaaatagccaggcgtggtggcgcacgcctgtaatcccagctactctggaggctgaggcaggagaatcgcttgaactcaggaagcagaggttgcagtgagctgagattgtgccactgcactccagcctaggcaacagagactccatctcaataaataaataataaaaaggaacaagtgtagctgacatttatctgagacttatcagccttagcacacatacactaaaaagtttaaaacagattttatgttattcactagaacagattcatttacctatatcattgagccctataactaaagggtccatttcttttaaattgatctcagacacacagaagtatatcttaactaaaactttcttcccgaaaagaagcatttttaaaaggtaccaagggctgttattcttagaatgatttgatgaaatcaaagacaaaaatagtttaggcttttgattagatttcaatatgccactcttactggggagctttctcttgtttgggcatgacaggatttttgccatgagaaaccttctagagcttccgccccctcagttctcactctccatcacttacccttcaaaagactctgaatagcaattacaatacagttaagctttctttgggggaccctcatatagtgggcacactgaatatgtggatttaatattagaggcttgactatttgaatgtgattgcaaaagtcagtgaggactctgttattactacgaatttgtaggttggtatttagcttagcaagtgatgaagctagtgagtgagcctgtttaccaccaagtacccacgtcttcctttggctctgttgtcctctgcttgtttcatcttgtgacttaaaacacacacaccttagccaactgtttatgctaatgatgaaagagaagtcaaagtaaataagcttaataaaataatagtttgggcctgcgcagtggctcacccctgtaatcccaacactttgggaggccgaggcaggcggatcacgaggtcaggagatcaagaccatcctcgctaacacggtgaaaccccacctctactaaaaaaaaattacaaaaaaaaattagccggccgtggtggcgggtgcctgtagtcccagctactcgggaggatgaggcaggaaaatggcgtgaacccaggagccagagcttgcagtgagccgagatcgtgccagtgcactccagcctgggcaacagagggagactccatctcaaaaaataataataagaataatagtttggaggtaaaatgagtctaaaaaatgtacttacctattttttctctactaacatcatttaacatgtaaaataaaattttgttgaataaatgttaaatgtttctgagaaatctgagagctttcataatagtataatattcaggttttttcttgtttgtttgttgtttactaaagaggaatcatttctcagtgttaagtatatctgggaccagaaatggctcttgttatccaaggtaaagaatccaaacattggctgggtgtggtggctcacacctgtaattccagcactttgggaggccgaggcgggcagatcacctgaggttgggaattcgaaaccagcctgaccaacatggagaaaccccgtctctactaaaaatacaaaattaactgggcgtggtggcgcatgccagtaatcccagctactcaggaggctgaggcaagagaattgcttgaacctggaaggtggaggttgcagtgagccaggattgcaccattgcactccatcctgggcagcaaatgtgaaactctgtctcaaaaaaaaaaaaaaaaaatccaaacatcaggaagacagtgtaaatatcagggtctgacctaaaggagaccttgagatgtgtgctggttagccctttgacaagtctcacagtaccttaaaacacatatttatagtgaggtttgagtaacttggaagtctattttagaccaaatacacgtttggttaatgttgctaggcatagagtgtagccctcctcccttcatatgagatcctttagacgtgacaagacccgcctgtgatgcctagacccttctcccatttagaaggacatcactgaatgcaaatttgcaaaaagctatggcagaacctgtggttaaaatctcataagattcaaagagtctggaatttaagaagctaagggaaaatatatgtccagagcctatcttctaccagtcagccttgtttttgcttacataagtttattctttttctgagccaatgttgaattgaagtaatagtgatcacagcttatcacagttctctaaagattattgcctccttcactgccttcatgaattaacaccaatttcttccaaatggaattctttaaaaaaaaacaaaaaaacccaaaaaactttattgagatatgattgacatacaaaaagctatacactttttttttttttgagacggagtcttgctctgtcaccatgtcaccaggttggagtgcaatggtgcgatctcggctcactgcaacctctgcctcttgggttcaagcaattctcctgcctcagcctcccaagtagctgggactacaggcgcgcaccaccacacccatctaatttttgtatttttagtagagatggggtttcaccatgttggccaagatggcctccatctcctgacctcgtgatccgcccgccacggcctcccaaagtgctgggattacaggcatgagccactgcgccctactgctatacacatttaatgtctacactgtgatgagtatggagatacgtatatacctatccatcacctccaaaagttacctgctgctctggcagaatctctttcttatttaaagctgagtaatattccattgtgtctatatactatattttctttatccattcattcatggatggacatttagtttgcttctacatcttgactattgtgcataatgctacagtgaacgttccatacagtgaagtggagatacctcttcgagatccacatttcagttccttttgatatatacacccagcagtgggactgctgggtcatatggtggttttatttttaattttttgaggaatgtcataagtgtgtctcaagaaaatataaagacagtataagaagacttagaattgagtacagtttgattgaatcaagggtaatcaccattatcctgattttcaggactttcattcacttccttcatgtagcacagttccctgccagaaatatccatcatggacgaagtgactgctagagacttcagggaaaataataacttataactattttatgtagttgagggatgagtgttttggttctttcctaaagagttggaatctgctctgtcaaccaggctggagtgcgctggtatgaccataggtctctgcagcctcaaactcctaggctcaagcagccctcccacctgggcctcccaagtagctgggaatatcagtgtgcactaccacaacctgctaattttttaagttttttttttcaagagacagagtcttgctatgttgccccagctggtcctgaactcctggcctcaagtgattctccctgtctcagcctcccaaagggatgagttttaatatgctaattacttcaagttttaaaagaataatatgtcaaattaaagcatttttaaacctctttttttaactcaagtaatacatatttattatttaaaaagcttaagaaaaaacagaagaaaaaagaaaactaaaatcacttgtaatttccttacctacagttaacaactattaacattatggtatttattaagattcttctatgcatttgtatacacacatatatacgctattgtttgtaaaatgaaatcacactgagcttatttaccattaggtaatgagtcttacctgtccagtaatgaatgtgttttcctttgcttttttacttagcactatattgtgaatatcatgaacaaagacagtttggaaacagggtgactagaagtcaacaaaaatatgtgttacaaaagaataacaataggtaaaattcagagtattattttaatttactgttaaaattacccaaatctcacatactttattcagtctatatttttaaaaattggatatataggcccggcgcggtggctcatgcctgtaatcccagcactttgggaggccaaagcgggcggatcacgaggtcaggagatcgagaccatcctggctaacacggtgaaacttcatctctactaaaaatacaaaaaattagcagggcgtggtggtgggcacctgtagtcccagttacttgggagaatgaggcaggagaatggcatgaacccaggaggcagagcttgcagtgagccgagatcgcgccactgtaccccagcctgagcaacagagtgagactccgtctcaaaaaaaataaataaataaaaaaggatatatagggaaggagcaattttttaaagatttaactgcaattgcatagtattttgtgatttcattattcatctttctaaatgtggtgtaatagactataattttagtaagtgtatcagtccattctcacgctgctgtaaggacatagccgagactgggtaatttataaaggaaagaggtttaatggactcactgttctgcatggctggggaggcctcaggaaacttaaaatcgtggcggaaggggaagcaaacacgtccttcttcacgtggttgcagagagaagaatgagtgcccagtgaagggggaagccccttagaaaaccatcagatctcgtgagaaccaactcactaaaacaagaacaggatggggaaactgcccccatgattcaattatctccacctggtccctcccaggacacatggggattatgggaactacaagtcaagatgagatttgggtggagacacagccaaacgatatcagtaagtatttatttttatttattttttagagacagggtcttgttatgttgccaaggctggattcaactcctgggctcaagtgatcctctcacctcagccccccgagaagctggtactacaggcatgtactaccacactcggcttaattttaggaagtatttaagcaaatattattgagctgtataaaactgttcattttaaaaagtgaaaagttgtttccaaacaatgtgtcaattagtttttctctttggtagaaaaattgtatatgttcaaatcaaagttgtagaagtacctccctgcctaacattcaagtggtttcagatggtaggctttaacataacaagatgagctattgggctctcagaaaaagcagttcctaagggagcacctacatttagtacttctttttcatgttaatgaagttctgtctcattgaaagaaaaaaaaagagattgttgttgagtggaggtacctactgcctagtgcaaggtcaggaaggctgtggagctgatgggcagctcttcagaatccaggggtccattattggtgcactcagcgtgaggctgaagctggaaggtcacctcccctaacgtgaataaaactgaagctgtgagagctcaggtgatccacccagggttccacagtgattgggagggctgagactttagaattctgccttctaacacccagatttggcctacctcacacactgacaggaattctcttctatcctgggagagtcttacaactatcacgacctcataactgatctaagatggctttctggagatggtcaagtcaggaatagcttttaaataggttgctatggccgggtacagtggctcacgcttgtaatcccagcactttgggaggctgaggcaggcagatggcttgagtccaggagttcaagaccagcctgggcaacatgacgaaaccccatctctacaaaaaatacaaaaattagccagtcatggtggcatgtgcctgtagtcccagctattgaggaggctgaggcgagaggaccacagaagcagaggttgctaagactcgagatggtgccactgcacaccagcctgggtaacagagcaagactgtctcagaaaaaaaaaaaaaaaaaaaaaaaaaagatttatgttgtttcccccagtcccctaggtctctccttttacttccgcaaccaaccagaagtcaatgtaggagccttggtgttaggtgtaggctaggggtggcacctgacacggcatcactggagcctgtgtactggaattagaccagttgctacaagttagctctgttggttgtcaagagaatttccttttctttattaaaatgcaagtcatgcttttgttttaatacaatatcaaccattcagccttgacatgatttaaaatgaatatgggtagttttgcctttgagtgagagtgtgtgtgtgtgtgtgtgtgtgtgtgtgtgtgtgtgtatgtgtgtgataacctaattgacaaagcaatcatgatgttttccatgagcctgatgttatcccatcattcggagacccattttgtttaatttgttttttcatatagtttctggtgggaaaaatgcattgctttagtaccgaaattaacttgattgaaatgtcttagactttatcattttccagtggctcaaagggttatttcccaagtgtttaattttttaagtacagtgtatattaatttcactgctactttctgacattcatcattccatgagaaattatcacagatgaatacatcagacttttatttacactccaattcctactcaatgtaaagttatttaactttgacgatagcatgcaaatttgataaagatgaggtttttaaaaacctgaaccatttattgatttgctaagtataattttcacatttttcttatagtattctataatacatctttcagaaggaaaacacttgaaaactagtataatcttcaggaaccgttcaatcagaaataatgagtggagaggtcacttatcaaaaatatattgtttaaaatacttatatttaagtatttctagtctttgaggtaaaaagttctgccacaaaaagtatggattcattgggcttctgaattctgtacatgtcacgatttttgctcttgggctaaagatagaaagtaaaataaaatgttctttgtccatttagttatccttgactccatgaaattctccaaagtaattactggtgaccacaataccacctaccagcaagagcagcattgaccatgtgccaagtcccttattgccgaccacagctgctcttgactacagcagatgtttcttcttttgacttggcagtaaaattttattaagcagttttgcaagtagagagcagcatactctacctgatgagtggctggagatcttagcccttttgtgcaatcagcttagttttctcctatctaccatcaggcccccgcctctaggttccttggatctcaccaaccaggcctcaggccttgtaaactgcagtcctcttgggtttgcttccctacccacccatgtaattttcccaaagaaaataatgttagaagagcagccgcacttgtggttacaacttgcggcattgaaaggctgtcacattggaactttgttcctaccagttgtgggtttacaaaaaggagttggggtactttgttgggatgttttgttaggatgcttttctgaatttttccacatctctttggtttggatgttgacttggaaatctcttttgaattagcttcttttggagagctttctgcttttctgagcacttcttggatcctttccccaacaaagccaccaagggaacttcttctgatcctatctcttttgtaggtggtaccctatttgagtccttctgaagactggagcacataaaggcctgattttttcttctgagttggattggatggtttaacataatttgtctctatgttttctgtcttgggtaaaggaatatatttgtgaattgtggctgatactactttaaaaaattccaaaaagaaaatctaaaggaccattcctatgattattgcaacccatttctcaggtctttcaaagaaaacaactcgtaaagatactggcagttgaaggtctaagtcccagcctggcatgaattcccagagagccttgggccttgggaggaggggtaatatacaagattagagtgcaaagtccatctggtgagaatttgtctggtttgtgcttcctcagcagggaggaagtagcagtgacctcagtcctgaatggttatttcagaagtgtatcatggtgggaatttagccagctttgtggcagatgaccaaccctgatagcctgatttttaaggcccctaacacaaatgataccaggacttctttgaatattctatttagtctgtactaggacacataggacaagatgagcgactattttagacctgtaggtcaagaggtttgaagcagtatattcaccttttacacttcaaaccacttggagtatcttaaagaagtagtatactgtcaaatacttataaaacttccttcttctttgctcttaaagataagacgttgtttagatgaatatatattcttttcctgtgtattctactattcctgcaaaaatttgtttttaaaataagaaacttggctgggcttggtggctcacgcctgtaatcccagaactttgggaggccgaggcaggtagatcccctgaggtgaggagtttgagaccagcctggccaacatggtgaaaccccatctctactaaaaatacaaaaaattagccgggaatggtggcgggtgcctgtaatcccagctactcgggaggctgaggcaggagaatcacttgaacccaggaggcagaggctgcagtgagccgagatcacaccactgcactccagcctgggcaacaagagtgaaactccatctcaaaaataaataaataaaataaaatagaaacttgaaaataataccagcactgctagagtgggtatttggctcagttcaggcctgtgcctttttttgatgttcccagagcagagcactccttaaactaggatgagaaaagttaattttaatcctccaaaggcttatttgctagcacaaaaggtcatgaaacacacccaaaactatattgctaaaatctgaaggagagagatctcaacagcagagatggactctagtgtcccaacatagaattgtgtctctggctgaagaaatagtttgttttaggaacgccaatacaaaagctacagaatggaagagttttcccttaactgatctaagggaaaattctttttctcgtgttgttttaggaagctcagaattatttagaaatacttgtgaaatcatggtcacaggagttatttccaaggatgtttaagtagctgctctctgcccattattttgataattactacaccttaatctgttatctgtcaaaagggaaaaaactttctgttatctacctgatagacccatggaatacaaaaaaaatgtgatgacccaatcacatttaaagcttttaaagctcccttttgagatgatttcttagggtactaaaatatcacctgccccagagtttacaaatcagaaattgaatgaggcaggcttaaagaggatcagaaaacaagataccaaataagagcagccattgtaaaactagagaaggttacgaaatggccctgcttttctataaggaaggtcgaagacaccaggccccttgccctgggtttgtctggtggaagtttaaggaaagttcataccctgggcccagtagagagctttgccttcataattgtctgcatatgatttgacaaacataagacctcagtgttcctagatcgtttatccccctcagcaatgtgctaaatatgaagtaaaaggttaccaaagggaggatagggaagaaaacctaattaccaatcctggtaattttaaacatgagaagatttataaacaacggcttcttcatacacttgtgagttctgacatgttgtgaaaataggacctgctaagccattgaaaggattttcaatatattgtacgagatggaaagaggacccagagaaggcttgtttttcattttaaagagttgctttagaaaccaaggttgtaactgagcactgctctgtgctgtatcaagccgtaatatccagtgagtcatgaaggcattagggaagcactggagacatcataagaaacatttgagttaatgtttgagataaggaagatgattatctctaaaaagaaactgaaattaaggggcacagtctcccgttttcggacagctaaaaggcattcttttcagtgatctctcctttactaacccatgtacatgctgtgagtatgtgacctagaaaccaggcttttttaagctgagctctggatacttgtagactgagaccttgggcgagttactgcccaccttggcttcagcttcctcacctgaaaacgagtgatcaaccaggtaatctttatggggcccttctggcccaaggactctatcagtctggtttttgaacattatcctacattagacaatctcagaaaggttttatgacttgtgggtgcctttgtggtacttcacatgagcgggaggtcttaagactatggaccccttgggagaccagtgtctaattctactacttcctcctccccaagaattcagatggtgaaacaccctcatccctccagccctgcccccaggaaacccttcattcagaaaggtcatttcatttcctgtgagccagtcttacatcactggtgcaagaattgggcagtgcttgcccagctggaaggtgagacattggaggcctcagcctggtgtcccagacagtatttgtcaggctgatgataagctggtggagagtctgttaactcaaggcctgattctaatgaatttgggattccttgctgaaaaaaagactgggctgggtgtggtggctcatgcctgtaatcccagcactctgggaggctgaggcgggcggatcacctgaggtcagagtttgagaccatcctggccaatatggcgaaaccccgtctctactaaaaatacaaaaaattagccgggcctggtggcgggcgcctataatcccaactactagggaggctgaggcaggagaatcacttgaacgcgggatgcagaggttgcagtgagccgagattgcgccattccactccagcctgggcaacaagagcgaaactccacctcaaaaaaaaaaaaaagaaaagaaagactggatcctggtccatccaagatgctgcccttgagacctctgggttgatgactgatatgttggtctcttgggacaaggctgtacagttgagaaaagtagcaagaacatcagatctctgcagataatctggcccccataaaaaagcaatagcaactgggaaaaggctagactgctaggttcccagctatactggattattagacaaagctacccactccatctttgtttatagaactcattttcaggaacaagtgttttatagtgaggtggaggttgtaaagaagctctttataatgaagatcccaaatatgtgagccttctatcaagcttgatctcaaggaactttacacgggtggcagtttagaagaaaaagagagaaaaggataaagaaaaaaactaataaaaatagctgagatcactcaacagttatcaagaaacagatactacagttttataacacgaagtactaaaagtatatgcactcttaaaaggcaattaaaacgtatgctccaaaactataaaacattttcttttcatctgcaacatagagggcagattacaacacattaataacgttttgtttagagttcagtttctgatggtttccaaatgtagtctgtgtagattaaccagaaggagtccagttctcttttttaagagcgcttgtaaaggaaagcaatgtggtaagattgttatgaaaagagagtgtatttaggaaatagcacttagcagggtctctctgaatggctgccaggtcaggaagctgaagtgcaaggcttggcccttgttcagcccccccagttccagcttcttgaccacacagtacgtcaagaacatgtcacaagccagccaggaagactcagccccgcccatgggccagcttggcacggctgctttcacataacccagggctccagaggggccggaggcaggcattccagggccacgggaacatgcaagtttttaaaatagaagtgaaggacttaaaaaaaaaaaaagcctgggaattaaacagttgctgagtccttgagtccttatggaacatggttcctcatgtagagtggcagaggtgaaaagggccttaaaggttatctcatcctctgccctctgcttatagacaaggacattgacctgcttacaaccatagtgatagaaccaattgtggaatccatatctgtcagctcttagtctgctaaacacactggcttctacctcactgggctaagctgccctttcttccttggattttgactctagaaagctgtccagtaatctgttcctatacattttttttttttttttgagatggagtcttactctgttgcccaggctggagtgcagtggtgtgatctcagctcactgcaacctccacctcctgggttccagctattctcctgcctcagcctcctaagtagctgggatcacaggcatgtgctaccatgcctaattttgtattttgtagtagggatggggttccaccatgttgaccaggctggtctcgaactcctgacctcaggtgatccacttgcctcggcctcccaaaggcctgggattacaggcatgagccactgagcccggcccgttgctataccatttgttcctactacttgcctaactgttctatgtctcagtctcagtttccttgtctacaaaatggagataatatcaatgcctgggctgggcccggtggctcacgcctgtaatcccaacactttgggaggccgaggcaggcggatcacctgaggtcaggagttggagagaatatatatatatataatcaatgtctgcttcacagagttacaaggattgatagaataaacatgtgtaacatttacagtgcctggtatggaataagggctcaataatgttatctattcccattaataatagtattattagcattatactatcatctgtcttattgctactactatttctacagttgctacatcagcagtcccaggaacttggcctacggcctaggcatggcgtatgagctctatggtagtagaaggtcagacccaggattggaggaggggcagctgagtagaggggaagatgaatctcggatgcctctgggccagtgcttcataaagtcctgtgctcagattccagctgtggaacagaggtgcagaggtggattttaatgttattgttgtttttgctttgttttgcctttccatttttgttgtatagttttagttgaaagagactttagagatgattaagtatacattacagttcggcctccacggtttacatgggggaaaactgaagcgcagaaagaaaaagtgacttgccttatgtcttgctagccttacttggtaattgagtagagctctcttgtctaatttacatataaaaggaaaactggagaagaaagagccttaggataatactcataagatctaaaattcctttagcctttcttctacatcaggcccactgggaccctacttaaaaccctcattttgacctggttcctcagtcagcatggagacaagcccgaggaaaaaactcaagagagccggcctccttccttaggtattattagagagcaatcccctataaaagttaagtggatgtttgttttttatttaaaaccttcaggagatttaaccctgctgggctgctcctgcctcacccacagcagtgtcccttcaggcctcacagaacacttctgccgtaaagagggcttgctttcagaatgcttaaacaactctgacatgcacatttctttgcttaatacaaggctcactgatttagaaggtaaaattactttcttagttgatgcctcaattgttttttcctttgagttcttatctctcctttgccctagtgtcaagtcagttttcctgttttgctaaaatgtttgatcaactttaagattagaaaatttatggcggggcgcggtggctcacgcctgtaatcctggcactttgggaggccgtggcgggcggatcacagggtcaagagatggagaccagcctggccaacatggtgaaaccccttctctactaaaaatacaaaaattagctgggcgtggtggtgggcgcctgtagtcccagctactcaggaggctgaggtaagagaatcacttgaacctgggaggtggaggttgcagtgagccgagattgcgccactgcactccagcctggtgacagagtgagactccgtctcagaaaaaaaaaaaaggattagaaaatttatactgctttaaatacccagtgagtatagtatatgattgctggaaaagtcgttcatcctgaccaagaacaatacaataacaacaaaaccattacctggaaaaaccaactagaaattcagtgagaacattttagctttttccttttaaatttttaaaattctgacattgcctggttacattgaaacagccctgttgtgtcatcctactttctttttcctggtattttcctctttgggactttggtttcattaatctcaatttgttctgaaggcactaaggcagattttcaaagagctgtaattgtcacagggagagcacaatgacttattgaagtttcacatgttgctctttttggaactaccagagattggaaccaattctccatccacatctctatccgagagttaagttttctcttctctggtgcttgtcaaaagtatttctcccagctaatctcattcccagttgccaaagaaaagatctcaagcataactcctcatctccaggtcacccgacaaggtaagaagagagattaaatgaatgtgcccaagtttctttcccttacagcctccagatctccagaatataccttctttagtttccacatcacactttcctacatttcttcttaatttgatgatgtcttgagagtatctcaggaaactggtatgactaccaaggggacagaggcttttgtagcgcatcaatacccctaagtctatccatccttctccagaaacacagtgggcacatctttgcaccctgtggaatcaatgttagtgctgaaatcagagtagacttggctttgtacttttgtctgggtagttggcttaagtgccgtgtctgtattgagtgacacttctccatcagaattcttattcttttggaagcctagactatttcttcatttgaccacactgtgcagggttttagtgctaaagggttccggatgtagctgctcttgtggagaaccttatcacagctttcttttccctaagttatttgtggtaaagtcctggcagtttgtttagatgttcagtgagtgacacctaattgaagaagtggctggggctggacttcaaggtggatggttttcttaccaagtactatgaagagatttgctcctagactttagagatgggaaatgctgctctcttttcccctgaaaattgagtctcgtcaaactgacaagttattttctgaaactccgagtcataattgtaccatatttattttctgattttttttaacctttcagttaataaatgttttccagcctccatcagcctctactggtaatcaggagaaatgggccaatggctttatgtaactgaggtttctgttttaacatgaaagtactatatttaccttcaaaatgaccctcacttagatcagactacctggggttgtcaagccttccatcttcaagccaagaggtagtttggtttttgtttgtttgtttgtttgtttgtttgtttttcatttatttttatttattttattttatttttattttttgaggcagagtttcactctctcgcccaggctggagtgcagcggtgtgatcaaggctcactgcaacctccgcctctggggttcaagtgattctcctgtctcagcctcctgagtagctgggattacaggcgtgggccaccatacctggctaatttttgtatttttagtagagacagggttttgccatgtttgccaggccggtctcaaactcctggcctcaagtgatccacccacctgggcctcccaaagtgctgggattacaggcgtgagccaccgcgcctggccgtttggttttgtttaggtgtctttgtccatggagtgctatgtgtccagggttgttgcccacttcctgcctttgaaaccagtgaattgtgtcaccagagagccttggatacagagataaactggagacagagtaacacaaaaataatcatttcaaaagaaacctgaggctttcagggttgttggtatgccatggcacaaggacccaaagtgatcttctcaggcctcaaccccagcccatgcagatggtatttgagccacttacaagaaaaggtgaaccttagtactgcatataaataagtctctgagtaattccttggaggtgaacctaggttctctttgaggtattttctctaccaaaatcaagatttttggatttaaaaaaaaatttacattatgctttttatttacacagcatttccgctcacatgatttccatttagatctcaatctttgcgatcggtgttgtcatgtccattttgctgataaggcttagggaaagaaactctaaaatcacattgctaataaagggcagaactggccaggcgtggtggctcacgcctgtaaccccagcactttgggaggccgaggcaggcagatcacgaggtcaggagtttgagaccagcctggccaatatggtgaaaccccatctctactaataatacaaaaattagctgggtgtggtggccacacgcctgtagtcccagctacgcaggaggctaaggcagaagaatcgcgtgaacctgggaggcggaggttgcagtgagccttgatcacaccactgcactccaacctgggagacagagcgagactccatctcaaaaaaaaaaaaaaaaaaaaaaaggcagaattctggcattccacccatgtcttcagtcgtttcttcaagaatacttttaccaagccaccttcctttgaatggaatactttagcggtcccaagaaagtcttcctttatatcaaaatagcaaatattttggtcatgttaaaatacttttcttctcaagaactttgatgtgctgcatcttcaaataatagaaatcttaattcattattgtcttgtttaaggtaacattatgtagagggaggaacacggaatttgggatcaatcaaataattcaaaatatgattcttctctgtgataaatgtgtgacttacacttagcttgtttcttcatctagacaaatgtgaatggtaaaccagctcaaaggggtcttgcaagtattaaatgcagtgacacaaacacagtgcttaatagtagtaggaatccataaacagacatttcccttcccattttcactctggttcaaactgatcttttctttcttacctcccacttctttcttagatcaattctttgctcatgggaaatgtaattgttaatcctctcttgagcatagattttctcttcccaccttattatttttgtgcacactgttccttcctctgaagagccctgctcttctcagtgtccttcatacactcctggttaaccacctacaggatttctactcacctttcaaggtttagagaaaatagcgctcttccttgcaacctttctgattattccagtcaaaaattgtcttcttttctctgaatatctttgtctttaatagtcattgccctcttatgggacttaccatgtttcgcctgatgttgtctttaagtatgtaactttattttctttcctatcagactttaaattcattgtggaaaggggttgttacttcgtgcctttagatatccaccataatgtgtagcgtagttcctaggaggctgcatggtatgatcaaaagaacacaggtttttagaggcaggtttatctaggtttgagttgtgggtctgccacttcttcactagctgttgaccttagaaaagttgcttcaccctctgagcctctgtaaaatgtgaataatcatacctacttcatggtatcgttgtgtggattaaatgaaattgcatgtaaagtgcctggcacaaaacaggcgcttaataaatgttagactgttccccttgatcataatacaacattgattaagtaagtagactgatgttcactccttattgcatgattttctaaagtggagaattttggataataaattttagtagactcatttgatataacagggactggtatacaccctctgtagttgatttgggaagccaggcatcactctgtggaagaaccacagaacactagctaaatattgacaactgactatgccgtcttattccagcatatggatttgtattcgtaattccccaagataagattttaccgtccctcttaattttattaatccattctaaactgacagatgttgcagtgagctttgagctcttggggattcttgttttgtttctgattaaaagatgagtttccttcttaaacccaagggtctaagtatcagtgcccttctctcctaaacatcttgcttaaatgccagaagtaaacttgttattctctattggatgctaaagaagcttttcactgtctaagccccttctaaacatgtttccttctaggaggcagaagagtgggaattgtttagcatagtacctggtacttggtagctgcttagtaaacagtagttagtatcatcattacttgtatttacatttttattttgaaagagcatggggagtgtaagcagagctcacagaactaatctgtgttgatctgtcttcttcttgagggcacacagaatttgagaacactgaaattcagccagatagtgacccagggttatggtcagggttccagtatggtttgtgcttttgttccttcttggagtccagctctgactttaatagcacagtaactgccagttcctgtccataggggttgagaacatcgttggatgatatgtttaatgctgcagatgctgaggttgtctaagtcgtggtctcttcttaggttactggctggtatgtgaactgctactccagaaagcaagttggtcaacagaagaattttaatgaagccatttaagtgttccagccactggagctggttctctttgttgttctttttttccccttccatcaacctactttcaagaagaggctcatgttctggttccagggcaccagccttagagtgggcagtcgttcattactggcctaggacaatcatattggagatctccctggacatcagacacttgctatcatttctgttctcttgttggctgatcctcctagtgcttttaggggcacctgaggtcactttttgccataaggcatgtcactctgtggcatcttactgaataggatatgctttttattactttggactgacctagtgataataatactaatagccactatttattgaattgctgtgtgaggtaggcgttgtacaggctgcctaacatagttttttattaatcctcacaacagtcctttaaggtaggcattaaggtaggtattcttatgcccatgttacagataagtactggataagttaaataacttgccgaaggtttaaacagctactaaatgccgaagtcaagacttaacttcaaagccctgtttccactttatttacagaaagctcaaaatgcccctgaaactctgaaatcactgtggtatttcacactaacttaccagaaattcccaggacattaattcagggatctgagtttagtgtgtagagcattacccaatatgaaaacagtggagttccacagttttatgagaaaacccagagaaacccatagtacgttagacaaattggaattgaaacgcttaagtaaaaaaatattcattttaaggtcatctgtttatactgacacaaggtctatagaaaatgagagagttggcatcatgtttctgaaatatgcaattttacaatgggaacgtgttataaaatgccctgccactgttgttttccttgggatttagagtgagagacatgaaggctgacaactctcttcctgttgtaggtcagagcttcaaggaactctgtaatcttcccaccagctttattctctcctgaaactcacgggtaaaattagatgctggctggacgtcagtagttgagtttgaaagctttcagaggccaagtcagacaactgcagcagactgctttctcacagtaccagtttgagagacactttgtaccgactaacatagtttagtaaaccgatgagtgtctggcaattttgccgtaaaacgccattaataacaacgcctataggagcagaagaaaatgatctttgtgtggttaatcttggaaacaggatcaggctttatcttccttttaccaatatgctgcctttacctcttgatgttgctctactctagtgtactgttacagttgaaaagcaacaactctagatgaggatttagttggaactattttattatatgcattataattgactctaggaggcagacatggtgaaaagggtgtgggaagaaattatttaaagggtgaatgctctcccaaactatcatcaaacgcatttatctaatttgacacattttgcctggaagtcatagaagaagactgaggtgcccccatcagaatataaagagtcagaaacttaaaaccagactaaaaagggccaacccattagggaagtacctccctggggagcgggtggacagggaaagaaggtttgatggcagttattaaacactgattcaagaatatgtttagaggagctgcgacccagggaaatcctgcctcccagtcttagctgggcgagggacagttaagtaaaaagagttctgcttattctctgctgcaggatgctaccccctgaccctttataagtcagccttgcttgattactccttttaattcaaggctcaaaacagcttgtaaagttttttttatcattcctttccagattgtgtgggccacactgtagcattttgtccacatctgttttccaacctcattactcttctgttattacattcattagaaaaaagagctgtttatttcttttccgcatgttttccccctagtttcaaaagctaaaatggtaaatcatgtggtgtttgatgtgaccatctccacgatttctagtgtacaaattgatggttgcatatacaggaattggttgaaccttattgtttaaattagctataccccagccaaagctcacaactcatatgaggctgtttcactgtagactgagattgtcaagacttctcatttctgtatcagaatggttatatcattccctccagggcgcatagcaataacgtgaatttttttgtctagtatgactcctgcgcactttaatttgaatataattatttaaagacacatggaagctgggggcagagctttagaatttaggatggttttcctagtgaagagaaagctaagagagatgagacaaggatgtccacgaataccgtttctattcagtgttatactagaagtactacccagagcaatgaaataagaacaacagattagaggaataagaattggaagaaaataggacacagctgaccttatttgcagattatattatttgcttcaaagacaatccagaagaatgaacaaactgttagaattaataaaataattcagcaacattgctggatacagaatttgaggatgttctttcatgatggtaataaccaattagaaaaaaaaaagatcctatttgcaataataatcaaaagcacaaagaagctaggaataatccttagaaaacatatgcaaaacctttacaggaaatgtataaggcaaagttgaaggaatgagagaagacccacataaatggacataacatattcatagatagggagactttttttttttttttgagatataattctcactctttcgcccaggctgtagtgtagtggcacgatctccactcaccacaacctccgcctcctggattcaagcgattctcctgcttcagcctcccaagtagctgggattacaggcacgcaccactgcgcccagctaatttttgtattgttagtagaggtgaggtttcgccatgttgaccaggctggtcttgaactcctgacctcaggtgatccacccgcctcggcctcccaaagtgttgggattacaggcgtgagccaccttgcccggccaggagacttaattttttttttttttttttgagacagagtttcactcttgttgcccaggctagagtgcaatggcactatcttgactcaccgcaacctctgcctcccaggttcaaccaattctcctgcctcagcttcctgagtagctgggattacaggcatgtgccgccacccccggctaattttgtatttttagtagagatggggtttctccatgttggtcaggctggtctcgaattcctgacctcaggtgatccacccgcctcagcctcccaaagtgctgggattacaggcatgagccactgtgcctggcccaggagacttaatatttaaaggctgtcaattatccccaagttaatctagaaattaaatgaaattcagatgaacatcctaagaagttttgaattactcaaagtcttagcaggaaaccaatggcacacacagaagtgttcaccgaggggagtcaatgaaggacctgtttacaaaggtgtggacaaagcttaaggaaaccaagaaaccaacaggggaaggtgaggcaccctaagctagcaaaagcaaagaagcactgttagcacccctgggcctgaagctgcaagcagatggaaccgttatcagaacccagacagtgctctagctttagctgtagagaggcccacctggcaggccttcggtagaggaacagctgctactaacctggacataggggtgagagagccaaggagagaaataccttgacctgttcctccttttgcccttcattctctttccattgactctcattagctgaatataagaaggagagacccagtcgatgctgcccatgcagaggtcagcctcatgggacacagaacaaggtgaagagtggaaagtgtttctgaaggagcaatcagagaatatccagtgcaggtgtttttcatagtatttttcaaggtgatcttgaacttcatgtggaagatcggaggattaaaaccagcaaggaaagtttttgaagcaacagacctattatgacttttatttaaaatctcaatttctttcctgccagatattaacatgtattataaagctgtaataattaaagcagaatggtattgtttcagagaaagacagacagtggaacataatgtacatatatgtagaaacttgatatattacaaaccagtgctgaaagatggactgttcagtaaattgtgctgcgacaaatgattatccacataggaaaaacttaggatttcattttagggtagcaaaaataaaaaattctgaccatgcatgttggcaagggttggatactcatacactgttggtagaagtataaatcgacataatcctatcagcgggtaatttacaatgtctagtaaagttatgtggattctagagccagactattccctgtctgtaaaatggggttaacaagtgatcctcagaagattattgtgaagattaaatgagtttatatatatataaaattatatagatataattcttggaacaatggttactacaaaataagctctatttaaatgtgtcattattattgttatttctagatcttgcagttctacttctaagtatgtaatccagagaaaattctgacttgtgtataaaagaagactcattcaataatgtttatttcaaatgaacaaaaaagcagctgaaaaaaatcatgatatattcattgtatagcagtaagaatgaatgaagtaaacctgtatgtagtaacataggtaagtctttttttttttttttttagagagagagtctcactctgttgcccaggctggagtgcagtagcatgatattggctaactgcaacctctgcctcctggtgcaagtgattctcatgtctcagcctcccacatagctgggattacagggatgtgccaccgcgtccagctaatttttgtatttttagaagagacagagtttcaccatgttggccaggctgggctcaaactcccaacctcagatgatccacccacctcggcctcccgaagtgctgggattacaggtgtgagccaccatacccagcctcatagataagccttaaaaacatattgagagtgaaataaaaccagattgcagaggaatatgaataatctgatattgaggaggcaggagacatgagaatgggaaatggcacagagagatttcagccctatctctaatatctcatacctttcaaacattttctaaaatctgagccaaaaagagagctaagccattaattatggtcaggttttagaaatataaaagggatattagaagtatgatagagagaaattgctctacagagaaattgccctgtgtggtctttggaggcagacagccctgtattcaattccactgtttatttttattagctgtgtaatcttatataaattatttaacattagttacctcaccgggttagtttgacaattacatggagtactatatataagaaagcacaataccagccaggcgcaatggctcatgtctgtaatcccagcactttgggagcctgaggcaggcagatcacctgaggttgcgagttcaagaccagcctgaccaacatggagaaaccctgtctctgctaaaaatacaaaattagccggcatggtggcgcatgcctgtaatcccgggaggttgaggcaggagaatcgttcgaacccgagaggcagaggttgcagtgagccgagatcgcaccattgcactccagcctgggtaacaagagtgaaactctgtctcaagaaaaaaaaaaaaagaaagcacagtacctgatacataacagatattcaataattgttcccttccttcccctcttatacaaggaagaaaaaagacgaatcaacatctcccttggaaaatactctagaccaaatttctgcttctgtgggcctggtttctacaatcttgtttggctacaattcatgttgactttacgtaaggattgccaattcatgcccaaacttagtgaagcaagctcacttgataaagaaatgaatttcaggatttaactatgtaacaccatcattcttttttcccccccatcaagtagtatatctgccagggtttgtgtgtgtcatactgtcctggactctgtatagcaaagatttaatgaccatggaccttacctttgttctaaaaaaaaaatctttgactccaccatttttataataaacacttgcaaactcacaccttctcttgctaactgagcaggagaatagttgcttgtttctttctctatataaaagacaaatgtctttatcttgtggaaaatccagtgtcacctttcatagatactaaaatatttcctttcttcatttctaatgagacttcctgtttggttattgtttttataaagatatgaaatccatatgaaagctcttgtggtcagggtcagttattccaagggggaagcctgtcctcacgttcattaaaatgatatctcttctaggcatacctcttttgatcattaacgagcaactgaatacttttcttatgaatacttctgtaacaaccaaattagcaaatatagccttgtgcttcaggatttgatcttatttttaccttagtacttgggagtttagagtaaaacatgcaatgctaagaagagactgtgcaataggtaaaggagacaaatggcttaaagagaaagagacacacaccatccacacacatgatcattagtggacagagaaaacggccagtatgtggaaattaaaaggacgatctttcttgtatgcttctcacaagaaaattcatcctgagcaatttcatttcaggcaaggcttgggaaaggggaattagtttccaaagaaacctatgagaagcaccttgggcctgaatgatttaacactgaactaagacttggtatctgagaagctgtatctaagagtggagagatgaaataagaggcttaggaaaattttcctgcctagtgtcctcagggtttaccaagctgaccttacatgtaggtactgttttccaaaactgacatatttaggaaatctttaaaaatatctaattgccacaattagtatgactcacagccctttgcaccttctgttgttatggagtccatcccatttcgtgttagaaattttctgtaatgtaagcctatttagtctattttctcccactttgtaaacaccctttttccatagttgcaaatgtctccaccattatttgtttcaatttgtaaatttcagaaaggctagaataaacagtgtcctcacacacgcacattcatccattgccagacatgcactatctctggccagagatatagtcaaaagggtaccctccatactttctttatagcaccagaattccaaagtgagattctttgcttcttgtcccctttctaccaggataggaaagttaattttttgtgttgttgtttgtttgtttgtttttgagacggagtctcgctctgtcgcccaggctggagtgcagtggtgcggtctcggctcaccgcaagctccgcctcccgggttcacgccattctcctgcctcagcctcccaagtagctgggactacaggcatctgccaccatgcccagctaattttttgtatttttagtagagacgaggtttcaccgtgttagccaggatggtctcgatctcctgacctcatgatccgctcccctcggccttccaaagtgctgggattacaggcgtgagccactgcacctggctggaaagttaatttttaaattgccacagtggttggtaaattaaaagatattaagtcatgatgtcaagacttttattttttgaaaagaaaaaactaatttaggccaggtgcggtggctcacgcctgttatcccagcactttgggaagccaaggcgggcggattgcttgagatcaggagttcgagaccagcctggccaacttggtgaaactctgtctctactaaaatacaaaaattagctgggcatggtgatgtgtgcctgtaatcctcctggattacaggcacacatcaccttgaatccagcaggcagaatgagccaagatcgtgccactgcactccagcctgggcgacagagcaagactccgtctccagaaaaaaaaaaaaagaaaagaaaagaagaaaggtggcaagaaggtgaaacatggaattttccagagcaaagccaggaagtactgtgtaagaaaggaccatgtgatctgcaacatgaccgtaggggaagactctgccctcctttgttttattctcctccacgtccgagaacctgtcctatataggtcttcgtgtgtacaaagctcaccgaaaacccatactcacccctccccgagaaaactgggtcacatatctcttgaatatttaatgtaatgtcctacatttggtgcctagagagaaactgttactcacttgtagatgtcactcaggccacagacagactgtcattcactgaagacacagtatccttagtcacatttgatcttggggactctgcatctctgcttcttccacctttgtctgttttgcatttgtcatttattcattcagtattttctattagctaaggattgattgcttgactactcagacttgcaaattaataagacatagactctgtgtttaatgtatattcctcaatctagttgggaaagtagaattttacagtcaatgatagtgtttctgcctgtctatccctctctttttgaatcactaccaccgacccccaccactaccacaattttttcattttcttttgctttctatttgccagattcaaattattttttaaattgtcatataaaagaaaatataacattatcatcttaagtgtccactacagtaatacgtatgtatattatggtacaacagctcactagaatttttcatcatacaaaactgaaactctatacccattaaacaattcccatccccaccagtaattgtctttctgggttttttttgttttttttgttttttgagacacagcctcattctgtcgcccaggctggagtacaatctcggctcctgggttcatgcaattctcatgcctcagcctcttgaatacctgagattacaggcatgcaccaccaaacccagctaatttttgtattttgagtagagctggagtttcaccattttggccaggccagtttcaaactcctgacctcagatgatctgcccacctcagcctcccaaagtgctgggattacaggcgtgagccaccacatccagccagtaattgtctttttatgatttgcttatttcacctagcatgatgtcctcaagagtcatccatgttgtagcatatggcaggatttcctttttttttaaggctgaataatattcccctgtatatatatgtatataccccattttctttatccatttatccatcagtggacatttaggttgcctccatctctttgactattgtgactaatgctgcagtgaacacaggtgtgcaaacatctcttagaaattgtattttcttttcttttttttttttttgaaatggagtttcgctcttgttgcccaggctggagtgcaatgctgtgatctcggctcaccacaacctcagcctcctgggttcaagcaattctcctgcctcagcctcccaagtagctgggattacaggcatgcaccaccacacctggctaattttgtgttttttagtagagatggggtttctccatgttggtcaggctggtctcgaactcccgacctcaagtaatccacctgcctcgacttcccaaagtgctgggattacaggcatgagccaccgcgcccggccattatattttcaattcttttgaatatatatcaagaagtgggattgctggattgtatatggtaattctatttttaatgttttgaggcgtctccatgctgttttccatagtgactacaccatttacattcccaccaacaatgcacaagggttccaatttctccacatccttaccagcacttgttactctctgttacatttgtttgtctgtttgtttgttttgatagtggccaacttaatgggtgtgaggtgatctaccattgtgattctgatttgcatttctctgatgatagtaatgttctgctagcaacttttcatacaacttgttggccatttgcagttattcttggattaatgtctattcaattcctttggcctttttctttctttctttttttttttttttaattaagacaaggtcttgctctgttgcccaggctggagtgcagtggcatgaccttggcttactgcaacctccgcctcccgggttcaaacgattcttgtgcctcagtcccctaggtagctgagattacaggcacgtgccaccacgcctggctaaatttttgtatttttggtagagacgggtttttgccattttttccaggctggtctcaaactccttgcctcatgtgatccacccacctcagcctcccaaagtgctgggattacaggagtgagccaccaggcatggccttctgccatttttttttttttttttttttttttgagacggagtctggctctgtcacccaggctagagtgcgatggtgcgatcccggcttaccgcaacctctgcctcccaggttcaagcgattctcctgcctcagcctcctgagtagctgggattacaggtgcccgccaccgcgcctggctaatttttgtattttttttagtagagatggggtttcaccatgttggccaggctggtctcgaactcctggcctcatgtgatctgcctgcctcggcctcccaaagtgctgggattacaggcataagccaccatgcctggcccttttgccgatttttttatcaggttgctttattgttgttgagtagtaggtgctctttatacattctggatgctgcccctcatcagatacacagtttgcagatatttccttccactttataggctgccttttcacactgttgtctcctttgcgacacagtttttaaatttgatgtcgtcctatttgtctacttttgctttcattgcctgcgcttttgttatcatatgttacaaatcattgctaaatccaaatgtaatgaaacttctcccctatgttttcttcaggtagttttatagtttcaggtttatattttttgttttgttttgtttgtttgttttgagatgaagttttgctcttgttgcccaggctggagtgcaatggtgcaatctcggctcaccgcaacctctgcctcccaagtagctgggattacaggcttcaagcaattctcctgcctcagcctcccgagtagctgggattacaggcatatgccaccatgccaggctaattttgtatttttagtagagaccgggtttctccatgttggtcagcctggtctcgaactcctgatctcgtgatccgcctgcctcagcctcccaaagtcctgggattacaggcatgagccaccacacctgggtatatttaggtctttaacacattttcagttttttgtacatggtgtaagggaaggatccaacttttattctttttttttttttttttttttgaaatggagtctcgctctgttccccaggctggagtacagtggcaccatctcggttcactgcaacctctgcctcctgggttcaagtgattctcctgcctcagcctcccaagtagctgggattacaggcgcatgccaccacgcccgactagttttttgtatttttagtagagatgggtttcaccatgttggccaggctggtcttgaactcctgacctcgtgatccgcctgcctcagcctcccaaagtgctgggattacaggtgtaagccaccatgcccggatttttttttttttgtcttaggtggagtctcgctctgttacccaggctggagtgcagtggcgcgatcttggctcactgcaacctctgttttctgggttcaagtgattctcctgcctcagcctcctgggtagctgggattacaggcgcccgccatcacgcccagctctgtgtgtgtgtgtgtgtgtgtgtgtgtgtgtgtgtgtgtgtgtgtttagtagagacggggtttcaccatgttgaccgggctggtttcgaactcctgacctcaagtaatccagctgcctcagcctgccaaagtgctaggattacaggtgtgagccatcacactcggccccaactttattctttcacatgtagttaaccagttttcctagaaccatttggggtttttgttttgttttgtttgaacaaggtctctctctgttgcccagacaggagtgcaatggtgcaatcatacctcactgcagcctcacactcctgagcccaagcagtccttctgccgcagcttctcaagttgctgggactacaggcacacaccaccatgcccagctattttttttattttttgtagagatgatgtatcgttctgttgcccaggctggtcttgaactcctggcctcaagcagtcctcccacctgggcctccaaaagtgctggaattagagatgtaagccatcatgcctggctaccattaattgaagagactgtcatcaaattacgttttaaagaaaagactgaaatatattccttctatagaaaagcacttcaaacatattgtatacagaagcaatcaatgagtatgcagccaaaatataagaaaataagaatgttagaatctttttgggtgcttaatgaaaaatactaggttgttttttaggatttggtgatatttatggtgtttgtgagtgtttaaaaacatgtaattttgcccagggcacagaggctcatgcctgtaatcccagcactttgggaggctgaggcgggcagattgcttgagctcaggagctcgagaccatcctcaggaacatggcaaaaccctgtctctacaaaaaatacaaaaattagccaggcatgatctcatgagaccacatctgtggtctcagctactcgggaggctgaggtgggaggattgcttgagcccaggaggtcaaggttgcagtgagccgggagtgcaccactgcactccagctggtgacagagtgaaaccctgtctcaaaaaaaaaaaaaaaaaaaaaaaaaaaaaaagcaattttgatcatctctcctcattctaagtaaaaattactttcatatataagtcgtagtgtgtaagtttcaggctatccataactagatctactcctgttcagatacattacattttgtatcaattttgcctttttatctcttgatatctgccccaatctagatgtgttgaccttcatacctgaaacagcatcgtctgtggtctctcttcactgtcacgctggggagtccctttggctcacttctgcattagatctcctatgccctcctgtatcccctgtgttctttcttggcttacttccttgccttggtaattcctttatgtagatctgagtttcaattttccttcacccagatttctgttaacatttcttgaaataccagtatgctagctagaattctcttagcttttgtctaaaaatgtctgttttgcctttattttatttttttttttttctgagacatggtctcactttgtcacccaggttggagtgcagtggcatgatcatggctcactggcagcctcaacctcccgagctcaagcgatcctcccacctcagtcccccaagtagctgggactacaggcgcgcaccaccacccctggctaattttttgtattttttgtagagatggggttttgccatgttgcccagactgactacctttattttaagggatattttgctgaatataatgctgcatttaaaaaataccattttttaaaaagccagatgtcattctggcttgtgtggattctgacaagaagttagcagttattctttgttctgtatgtcatatgtcttttacctctggctacttttaagatttgtttatctgtttctcaccattttgatgatgatgtgctctggattgcttttatttatgtatatcctattttatagtttgttgagtttcttggttctatgagtttatcatttttatcaaatttgaaaatttcctggttatttttttcaaaaatttttaatgcctgaccctccctctaagactccggtttcatgtatcagaccactaatattgtcgcatgggtcactgtggctctgttcttttttttttttcttagaagttttctttttctctgtactacagtttagtttctattgctgtatcttcaagtgtataggtctctgtagtgtttaatcttttgtcaagtcaatttagtgaattttttatttttagaagttatgtttggttctttttatatatctcccgtttcctatcttcattcttttttttttcccccactggcttaatttattttattttattttttaaattttattattattatactttaagttttagggtacatgtgcacaacgtgcaggtttgttacatatgtatacatgtgccatgttggtgtgctgcacccattaactcgtcatttaacattaggtatatctcctaatgctatccctccccactccccccaccccacaacagtccccggtgtgtgatgttccccttcctgtgtccatgtgttctcattgttcagttcccacctatgagtgagaacatgcggtgtttagttttttgtccttgtgatagtttgctgagaatgatggttgtgttcacactttctttaaaatctttgaatttttttttttttttttttttttttgagacaagttctcagtttgtcgcccaggctggagtgcagtggcacaatctctgctcactgcaacctctgcctcctgggttcaagcagttcttctgcctcagcctcctgagtagctgggatcacaggcgtgtgccaccacacctgcctaatttttgtatttttagtagagatggggtttcaccatgttggccaggctggtctcaaactcctgacctcaggtgatccacccactgcggcctcccaaagtgctgggattacaggtgtgagccactgtgccggcctgaacatgtttttaatagctgtttgaacttccttatattaaaaacctacagccaacaccagacataatgaagactgaaagctttctcctaagatcaggaacacagcaagggatgtccactctcaccactgctattcacccaagtacaggaggttctagctagtgcactaaggaaaaataaaccaaaagcatctcaattggaagggaagaagtaagactgtttctattgctaggaaacataattgtctgtgtagaaaaacccatgaaatctaattttattaatttatttggagacagggtcttgcagtgtcactcaggctggagtgcagtagtgcaaacatggctcacttcagcctctatctcctggtctcaagtaatgatcagcatttgagtagctgagaccacagatgaacgccaccatacttcactaattttttaatttttttgtagagatggggtctcagcatgtcgcccaggctagtctcaactcctgggctcaagcgatcctctcacatcagcctcccaaagtactaggattacaggcattagccactgcacccaaccctgaaatctgtttttgaaaagctactggaactaataagaagtttaacagcatcagaacataagatcgatatgtaaaaattgattgaattgtctatgtgctatcaacaaataatctgaagttgaaattttaaaacaataccatttataataagtaaatatcatagatcttgaatggaagtatatagaataaaggattcattatagggattaggtctatacagggccttatgtgattgttggtgctgttgaagagtctgttgccattgagtctcttggtgggcctgaatgttgtgcagggctgaagctgggaagaaagctcagtgtttagcggcagagagaaagggcaaattggaacccatgtgcatttctcagccaggatctcaccttgtcgcccaggctggagtgcagtggcacaatcacagtgagcagtggctcactgcagccttgtcagtgcctttagccttgataaaatggttgactgacctgcagaaggagctggcactcttcactacagaggtgcacatgcacttggcccagaagtcagataatttgaaggagactatctcatgagagctggaagacatgtagcccggcaggctggccagcacatcagtgacggtaagcataaactgccacagcaccgtgtgccctacatttaaccttcagagcgtaatgattgctgccatcttccaccttccaaatctcatggaaatttttcttatgattaaccccaactcataatcatacatggaagagaattatctgaatcgtagttccagattagctaaattgatacagtacaaagtcattataatacttaatagttttttgatagccttaggtataaaaccttataaacggcaacctattttgcaaggttgtaggatatactatcagtatataaaaatcacttgtgttggccgggtgcggtggctcacgcgtgtaatctcagcactttgggaggctgaggtgggcggatcatgaggtcaggagttcaagaccaggctgaccaacatggtgaaaccccatttctactaaagatacattaaaaaattagccaggcatggtggtgagcacctgtaatcccagctacttgggagagtgaggcaggagaatcgcttgaacctgggaggcagaggttgcagtgagccaagatcatgccattgcactccagcctgggctacaggacgagactccatctcaaaaacaaacaaacaaacaaacaaaaatcacttgtgtttctatacagtagcaatgagcaaaccgcaaataaaattaggaaagctatttcatttacagtagcatcaaaaagaacaaagtactcaggaataaatttaaccgaagtaaaaattttataaactacaaatcactgggagaaattacagaagaactaaataaatggaaagatactccatgtttatagatcagaagacaaaattgttaagacggcagtgctccccaaattgatctacagattcaacacaatctctatcaaaatgatctctatcaaaatctctatcaaataagctgacttatttgcagaaattgacaagctgatcctaaaatttacatataaattcaagggtgcagaaaagccgaaataatcttgaaaaagaacaaagttgaaggcctcgacttttcaatttcaaaatatacttctaagctacagtaatcaagacagtgtggtactggcataaggatagacatataccataatggaatagaattgaaagtccaaaaataaccctcacatttacagtcaattgaattttaaacatggatgtcaagacattttctatgaggaaagaatagtagtttcaacaagtggtaggctgggcatggtggctcatgcctgtaatcacaatgctttgggaggccaaggcaggaggatcacttgaggccaggagtttgagaccagcctgggaaacataatgagaccttgtctcttataggaaaaaaaaaatttagaggggcatggtggcgtgtgcctatagccctagtaactcaaaaggctgaggcaggaggatcgctttttctaggagttcaaggttgcagtgagctgtaatcatgtcagtgtactccagcctgagtgacagagcaagaccctgtatcaaaaaaaaaaaaaaaaaaaaaggtggtgatgagacaactgaatatccacatgaccctacctcataccatacacaaaaattaactcaaaatggatcaaagacctaaatgtaagaggtgaagctataaaactcttagaagaaaacatatgagtaaatctttgtgaccatggattaggcagtagtgtcttacatatgacaccaaaagtacaaacaagagaaaaatagataataaactggacactatcaaactaaaaaacattcaggcttctaagaaccacatcaggaaagtaaaaaatgacccacaaaatgggagaaaatttttgcaaatcatatatctgataagggacttatatctagaatatataagaactactacatacatacacaataatgatatataacccaattaaaaatgggcaaaggatctgaatagacagttcttcaaagaagatacacaatggccaataatcacgtgaaaagatgcccaacatcattaaccatcagagatattcaactcaaaaccacaagcagatactacttggcacccactaggatgactatgatcaaaaagatagataataacaagtgttgataatgatgtggagaagttgtaaccctcatacactgctggcaggaatgtaaaatggtgcagctcctttagcaaactggcaatttctcagatggttaacagagttaccctattatccaacaattccacacccaggtgtatacccaaaagaaatgaaaacatacccacacaaaaaatggtttgttttgttttgttttgttttgtttgacggagtcacactgtgtagcccaggctggagtgaggtggtacaatcttggttcactgcaacctctgcctcccgggtcctgattcaagcaattctcctgcctcagcctcccgagtagctgggattacagacacatgccacgatgcccagctaatttttgtatttttagtagagacggggtttcaccatgttggccaggctggtcttgaactcctgaccttgtgatccgcctgcctcggcctctcaaagtgctgggattacaggcatgagccaccgttcccagataatttttgtgttttttgtagagacagggtttcgccatgttcccaggcttatctcaaactcctgggctcacatgatccacccaccttggcctcccacagtgctgggtttacaggtgtgtgccaccatgcccagcctctatcaactgttggatggacctacccaaaggaattgaatgcaggaacaggaacagatgcttctgcgttccttgtggcattattcactatagcccaaagatgccagcaccctaagtattccaacacattcatggataaacaaaatgtggtgtgttcctacagtggaacacaaaatattccataaaaaggaatgaaattttcatacatactgcagcaaagatcagccttgaaaatatttgtgactggaagaaccagccagtatggttccacttatatgacatgtccagaataggaaaatctatagagacagaaagtagattagtagtggtttcctaggacttggggatatggggagattgggaggtagtggctaagtggtacagggtttcttttcagaacaatcaaaatcttctaaaatagattgtggtgatggttgcacaattctgtgaatacactaaaagccattgaattatgtacttttttttttttttttaaagatggagtcttgctttgtcacccaggctggagtacagtggcatgtctgggctcactgcaacctcctcccagattcaagtgagtctcctgcctcagcctcttgagtagctgggattacaggcatgtgccaccatgcctggctaatttttgtatctttagtagagacggggttttactgtgttggccaggctggtcttgaactcctgacctcaagtgatccgcccacctcggcctcccaaagtgttgggattacaggcatgagccaccatacctagcctgaattatatactttaagtgggtgaattgtatgttaggtgaattatatctcaataaatctttttttttttaaggcagcctaggtctgacacacctaatagaacagaagctctcgcttctttcttctctttccatcagtcagtgatgccctttgtgggcaggtttgtgcacagatcaggggttccattccattccttattatttgggttcttcttgaagagcagcttctgcctagcccatggtggctaagagattcacaagccagtttgtattttgcaaactttcccttggggcctcagcagaggatatttttagaacagctgtgggtctaattttgatgtggcccagtgactgtacaccaggcctcatcactgccttgggataagcatatattacattcagtcttaatcccttggaggacacagagttgttcagtccatcctggtgtagaccacaaaccatgtttaaaatagtgggctaagccactgggcctccatggtgaggtggcactggtccctctgcttgagtgaagaaaaaaaaaaaaaactaggcaggtaaccacaagccaagttgggcttggctgctgcaggctgattggatgactgtggcagtaccagctttgctaaatctcctttggctcactttttctccctctccatgtctctacatctttcttttctctcaatcctgctcctgctgagtctacattaactctttgtttagcttggctccagaaccataagtactttcctttagtcaaatatttatctcttgggtaattttctccctactgtcagcagaactcaagaaatcctctggttcaacaaagagtagagtttaagggacctcagaactcttctactccaaacctcttcctttatactcgaagaccctggtgcccagagagaggaagtattatgccaaagttacccaccaagttaggctaggcctgggatttggtaccattatctcctcactcatggctcagtactctttccatttttgaatgaagaaagacattacagaaagaagcaggattctgagcaaattccaaccacttgcaattatctttgtgatagatacagacataggatcaacagtagtccacctcaaagacagttattgtttcttaaagtccaagaggctattggttatcactgagtccaacttggggaggtcatcagatttgtctttggaggggaatgtgaggtagttgacctggtagaaagtgtctaatttggaatcaggattcaggtttgagtcacaactttgccacttaaagatttcacatcttgtatgagtaatttattctctgtgcttcaatgaatagatctatatagcaggagtaacagtacctaccttggagtgtggttgtatagatttgataaaataatgaaagtaaaagcttattttaacttgaaacaaaaggtgtattcacatgaaaagattggcattgttgtgtgtgtgttcagcaagaagtgaccccctccaagtgtattcttatgacagattagtgcttaaagtgggcagcgccggagctaaaggttccgccagttctcttcacacatgcctgatcatttgggcagcaaagatggagctatctgggaatgtctcgacccttaacaggttgaaggctttctccaacaagtcccaactgattggcctgctgtattcccgcagtatctaagccttctaaaaaggtattacatactatgtggtttaaaaagaaaatcaggcacaaaatggtataaaaagagacctactcttatctcccaatccttgcccagaggaaacaatcactgtcagcagtttactgtgtatcattccaaagatattctgtgcatccttttttctttgcatcgaaaaaatacactactatgcacactctttccatatatcaatacatcttggagatttttccttttttagtatttatagaatttccttagagacaacatagttttccacaatttatttcacaatgcctattgttggatgtatagatggtcttcaatcttttgtcattataaacagtgttaaagtaaatattttatatcttaggacatttgtgtaatttcatctgtataaatagttcttagaagtagaattcccaggtcaaaggataagtgacctaggaattttttgtaatttaattatttaatgtcaaattttccatcatagtcaccatactaagttatactcccacccccaggtatgagagtacttatttctctacgccttgccagtacagtgtgttatcagattttttggtctctgcaaatcagattcaatgtgtcattttattgtaatttaaatttgcatttctcttagactggcatggaacgtattttcacaaatttaaatgccatatttagttctttcattgttcatggtctttacccatctttatactgggttttttatcttattcatattgatttggaggagctttctatatactaagcaaattagcactctatcatatatattataaatatttttccaagtttgtcagtatctttgccatacaaattttaaattttatgtgtttatcaataatttctggggtttgtatcatattaagtatagctttctcatttctctgtttttaaaaaaaattcttcgttttatggtaaatttttactttcttttccgctacttcctttttacaagactgttgtgcacataatagatgttcaagacttttttctaaacagctatttcaatttaggctgtttcatgtaatgagaggaagactgaatttggattcagaagacctcattgacaactaactataacacattcaaactagttactaggtacctgcctcctgcatttttgtgaatatctaataagatcaagtgaatttaatatatgagaaagtcctttttaaagtataaagaaattatttgggacagtttttcagtgaacacattcatatatgcttttattatttttctccctaattggtctcaggtttgaaataaaatttgtctctaggaaaaagcaaagctcataaatgtggggttttctttattgcttctttgggaataccttaccgatgagaaggctttcctgagccttggttgggagctgaatgagaaggggcaattgggcctctggtgaaaggttctccccaagtgtccaaactagtaccttttaagagtaggatggttggaaaaagtgggcaggacatttgcataatattccaggacagagagttcacttttattgggctgaaagagttcaaaggcaaagtcttctgggaactaaagttggtttcgttggcttactcttagacagatgtgacttcctgtgtcagcgagggaggctccaaggacaagttgaatgcccaagttatagaaagttatgtttgtattggtcgttgttaataaaacagagtatctggggtgtttgaaaaagaaggaagcccatcaacacagaggattatgaatcagacccttccagaagtctctatacctcactttgagagaatttccattttggtttaatgagttggtcacattgcatcatccctttatctacccaaaatgtgaattttaaacattttttatccagataattttttcacagagggaaatgcacagagcttaaatgtgcaagtaattaaatgagttttagtgaaggggagaaatcacagtaaaaatatatattttcaatatatttgtatattatatataatacatattttatatttttatatataaatttttttcactgtgattttccccctttaaaaataaatcagcccatggcatcttttatttaaataatactatgatgtcgtgatgttgtaatactaaaagttgtgttgttttttttgctccacgttgctcctttttgtattgaaaacgattgggcagccatgacattcaatggtgctgcctagttccttcagagattttaccgttttatttatgttttaatacaaaggtgaccatttttactggaaaagtaccaatgaattcaactagtcttggtttggaggactataacacattcaaactagttagcttcatccaccagacattaagcacccactctatgctaagtactttatgttacgtttagctcattctccctattatatttagttaactctcctatttagttcatcagcgatgatgaagggaagaccaagtgaatttagaggggatttgtaccaaaatgaggttgcaaaagtaaattgattttttttttttttttgagacgagtctggctctgtcgcccaggctagagtgcagtggtgccatctcagctcactgcaagctccgcctcctgggttcacgccattctcctgcctcagcctcccaagtagctgggactacaggcgaccgccaccatgcctggctaattttttgtatttttagtcgagacagggtttcaatgtgttagccaggatggtctcaatcttctgacctcgtaatccaccttcctcagcctcccaaactgctgagattacaggcgtgagccaccgcacttggccgtaaattgattttttaaaaaaaaattttagagacagggttttgctctgtcacccaggttggaatgcagtgacgcagtcatagctcactgcagcctcaacctcctgggctcaaacagtcctcctgcctcagccccccaagtagctgagacagcaggccaccacacccagttgtaaattgatttttaagcagttagaacttgaactgattcacctgggcagctttagttgtatctttggtattacgatcttgagaggtgaagccggctgggcttctgggttgggtggggacttggagaacttttctgtctagctaaaggattgtaaatgcaccaatcagcgttctgtgtctagctaaaggtttgtaaacacaccaatcagcactctgtaaaaatggaccaatcatcactctgtaaaatggaccaatcagcaggatgtgggcagggccaaataagggaataaaaattggccacctcccccacccacaccagcagtcgcaaacctgctcaggttcccttctatgtcaggaaggtttgttctttcactcttcacaataaatcttgctgctgctcactctgggtccacactagctttatgagctgtaacactcaccaggaaggtctgtggcttcattcctgagaatgaagtcagcgagaccacgaaccgaccggaaggaagaaacactggacacatctgaacatctcaaggaacaaactccagacacaccatctttaagaactgtaacactcatcgcgagggtccgcggctggttcttgaaatcagccagacccaagaacccaccggaaggaaccaattccagacacaatctgaagacttgttcacctccgatgctgcttctgggctctttgcaattagcagtgcagcccacaactgcgtttttttttttcctctactctttttttttttccctcctgctgtttaggcttcattctaactagcttttcagcctatgtgggcatttatttgttcccttaaggccatgccagttgttgcaaaggtagagaaggaatcctcagaagagctctcagggtctctgcttaggaaagcctccactcaacagtaagtgaggagatttgcccaggcatggcagggcatagcacagtgacctgatgccacctcagaagggacagcagaagcttccccagcacctagctagtgcctgttgttgaatgaatgtataagtgaagttttcaagcaagtgtcatcaaggttctctcctggttctcctgtctgtaggcttctgaaagctttgctgccctaaattcctgtccttggtctctgttgggaccatgcctactgactgatgctaacctcggggtctcttctgtcccctagtgattcaaaccagctatcctgaaactgcttccacctgggcagaccagggaccacaggaaccagagaaatgaaaagtatcacttgagaactaaattggggtgttttgcttttcccctcctcctaggttgtgtgtgtgtgtgtgtgtgtgtgtgtttcttgctaaaatgcagcaaaggaaggggaaacaaatacaacagtgcacggcagagtccctgctaataaatgtatataaaagaactgagtgctgcttctccaacataacttccaggtctgaatactttgttttctgcagattttcaacaggtgtcagttacactttacctggccctaaagtgaaaagctctacatgcttggtttggtttatccataggatctagactagactagactagaggattgacgcagtgaaaatgtttactcctctaattaagcagaattaaggtctgggctcaaaactgtcttgagctgtgctaggcataattgagatgcatggactttgtgtaaataatgtacttctaattggctttgattaagtgcaaattagaatcacacttcactccagtgtgatttacattcctaagcccttttactaactgaagtactgtgggtggccgataaggcttgtttatccaggagacaagagactaggagctaggagctgcggatctgcagtttcccaaaggtaaaggagcctgcagctgagcctcgagtttctcatgtcttccctcccatctccagtccctactttaggcgaatcagctttagtcctctaaattctaaagctctaccaatttttttttagtttcaagacttagcttacacacacactcaagttacgtgaatacatgaatattgcagtttgtcttgtgaaacctcagacctaaaaccagccccaggctttgactgtcaatatcatgacacctttttactcatggaccagaaacatttcataaaggaaacaactggtgggaagttttttccagagagttcccagtgtgtgagtgtgagtcaacagactgctacaaagtagcttaaactctgcacacatcttcctctgggatttctttgcagctttcaaagggtagatctttgcaaccatcccttggggagcctgcagggcggggtgcggagggtctgcgggggtggggcgctgccgaatatgagacatttcctcttgcttctgagttctctgaatctgcatttgaaagttatcgtgagcagatgaagcagaggttgctgggtttatactgatgtctgcgcccactcctgtgctggtgaagtctggcgtgtggagaggcctctggttattgggaggctggtaaatggccagcaggatagaaatccgacgtggtgtttatgaccctggaggccatcgataactggacctagaagggtttctccagattttctcacgttagcatgctgctgcttggtgcacgaccaaaaagtaacatgtcagaatagggattttcacaccagcagagagtgctaacagtgtgccaggatctgtgggcacgctgttagcagggctaagttaaatactcgctttacaccgttgtgaaggcagctcccagggcagccagaggagcatgtcaccttcagagtaggttggactgtaaatatgtttggtctctaaactctgccacgggcttaccagagtgagaagttagcatattgaggcaaattacactacagagatcctggccagggtgaggaaagacagagaatgctttctaggacctttatactgcattcattcatttattcattcactgaaactttatgggccacctactgagccagacaccagagatgcaactagaaagatgccatggtctttacacctaaagagctctatggaggccaggcgtggtggctcgcgcctgtaatcccagcactttgggaggctgaggtgggtggatcacaaggtcaggagatcgagaccatcctggctaacacggtgaaaccccgtctctactaaaaatacaaaaaattagccgggcgtggtggcgggcacctgtagtcttagctactggggaggctgaggcaggagaatggcgtgaacccgggaggcagagcttgcagtgagccgagatcgcaccacttcactccagcctgggcaacagagccagactcttaaaaaaaaaaaaaactctatggagttggggaacagatctctatagagataaatgagaaccaaatgtggtagatgctgcagcagagaggaggaagcctgcggtaggggctgtcttggggaaaattgtctgccatactgcatttgttcagagcaacgtggagtcagcttgagggccacatgctgttccaagaaagtgtactttgcagggcgtggtggctcacacctctaatcccagcactatgggaggctaagacaggaggattacttgagcccaggagttcaagaccagcctaagcaacatagtgagacctcgtctctatgaaaaatcaaaaaattagccaggcatggtgatgggcacctacagtcccagctactactgaggctgaggcaggaggatcacttgagcccaggaggtggcggctacagtgagccaagatggcatcgttacactccagcctgggtgacagagtgagaccctgtgtcaaaaaacaaaaaacaaaacaaaaaaaacaccaacaagccaaaaaagtacacttattattgactttctgaagaaaaagcagtaataacaacaataggatattcacatttgttcagtacatactatgtgccaagtattgttctaagtatttttgttcattttctcatgtaatagtcacagcattgaaaaggtaccattatttctattttaagaggagcaagctgaaggttgcagggattaagtaacttgcagaggaatcgggactcgaacttggttctgatatctttacaactctagcttgttactctacaccaaagtgtaaaagacagtcagaagccctgggctctgttgctgactttcttaccaactggctgtgtgctcttcagcaagtcactccctgtctctgccttggttccttccttaaccactccattaaatgaggcactcaatcaacttgaatcaaagaaattacatgggctgtggggagggaaagtgtaaggtctttgatggcttgctgtgctattatcggtagtgaattttgtgaccttgacttgtcatctgctggccctaaagtatgtagtgttgatctttgtcagtcttacttcttgacctgggtgcttgattccagaaagcctcttaaagtggggctctgtatgtttctttgttgggagtggatccaggcagcaagggcccaaggttatcaagtacaagggctttgtcccagagccatctctgctatagattgtcctagctttaggttggcatgcactttctacttcagatccccagtgagtccttgttggcaaatgtggtgctttgatcttttaaaagttgaagttcagcccaagaccttgaccaaggtcaagttctccttcattcccagtgggcttaggaggagtgctttcttgtctgactgatagagacaaggaaccaagtcggcagcaaccacaagatatggcgcactgaaggactggaaattttcttgacagtttttaatgcagagatgcctagaaagaagctaccaccccacatgccaatcctccaagcaggccttgtacccagccatgggcgaaagggctgtactgagaaccaccaaatcctggcctagccaggatggtggctggtgttttccaggtaccttggtattcaaaaaagccttagaatagcagattttggttttggaggacaggggtggagcatgaaaacatgctcatagtatttatctataaccaatacaatgtttaaaatgacccgtcccattcgggaagggccgcgcaggcctaatggcccctctgcacatttcctcttgggcaaggcccaacacaagtgcaccctcctttccaccccttagtccacttgttggaacaacttgtttcagactcttcatgtcgtctaatctttctaaccatattctggaactttgactttgaccttgagttataattccaagtactaagcattacttgggagagaatgtacccccgcgactcagctggctcactcagagtggcggggtgtggtgggggtgctggcccaacagactctagtcactcatggaaaggggtctctcttctgaccatttccagacatcttcacatgatctcagtttgatttttagcttcctttttgctcttcgcttgtaatttctcaacatcagacatggctgtttacctccacgtacattactgccatgtgaaaccactctgtcctctgagagcaaataaactggctttaatgggtatgctgtcaagtaacagctaaagggttaaaagtttgagcaggcaggctggccagcaggagttagtggtgtggagtaagagggacgccagcctgtctctaaactttttggccctccccaagtacagagatgaaggaagagcctctataaatcactggagattagagaccccgttcttgccgactccacagggttgcactgcttaatgtcaaagcctcacgtattactctaacagcactccttttctttattaaatccactttgaaataaaaaaaaaatgatgatctttccagtaagggggagaaggctaaaaggatttagaaagtatctgctatgttacattacagagactaataactgtttagggagtaagtaacatttttgcaccatcttaagccataaaagcgaagagaggtataaaggtctgttccttagaatcaatttgtttgagtgtttattttgccccgtgtccttgcctccaggtttccttcaaagtgtgagcaaagcaactgggaaactgatgtgagtgctgatagccaaaaggtctgggacactaaatttttcagaaattagggtgtttacttgggttcgtgtgtgtaaagggagcatgggaagggagtgtggtggtggaaagagttctacttttatacttaaaagaaaaaatgcaaactttgtgttcctttggaggccgaaactaagcttatctccttcatctgactttaatgaagacatattttaagcagctgcacccatgtcaaatgtcatattttggctcaaaacgtccaccttctgggtgggagttttctcaaactaagaagttggtagtaattataagctaattgaggagcagtaagcagaagtctgattgtcacaaaacgtaagttaaaaattatatagatgaaaaaagagtggcatgaattggttatttgttaaagctggcagtggggtttattataccattctctctgcttatatatgtttaagatgttcataatagaaaaacaaatcagtttaaataaaatgcttagcacttactaaccaaaaataaaccaatgtgagctaaaatattaaatcaccaattatagctttttaatttatactttcagagagatctagataacgaaaaacgacagagaatttgggtgcctctaatttgtttactacccattagggcttgaagcttctttctgtttattcctttatagtcaaatgcccattacttcaacagaattgttccaggaaggtaggattccatcattaagagcccagaaaaaaaagccttgaaaatcttgggagtaaatgtggtcaagggactttttagtttgcattttttttttgagtcagagtctcgctctgttgcccaggctggagtgcagtggcgtgatctcggctcactgtgagctccgcctcccgggttcatgccattctcctgcctcagcctcccaagtagctgggactacaggtgcctgccaccacgcccggctaattttttgtatttttagtagagacggggtttcaccatgttagccaggatgatctcgatctcctgacctcataatccacccgccttggcctcccaaagcgctgggattacagacgtgagccaccgcgcccggcctagtttgcctattttagccaagcactggcgaaccaagtccattttgtgtttagggtttcacttgtttattcagcaaacatttgatgaacaactacagcctaccaggtactttgctagctattggtgatttaaacaaacaaacaaacaaaagaaacgaataacccaggctccaactctggagaaacttaccatcttaaaaggaaatatttaaaacacgattacatataaaatagcatgaaaccttaaaaataaaggccacttttaaacattactatacttgatgtggggagaggaattgagcttgctttctgtagctcccggattatgacttagagaaggattgtgagatttgagatgagctaggaactgttttcaagccaactgctagattggtatgttgtttccatttgcattttgaagtttggaaagggttcacacctttaaaatgtggttcatatttgccgggaaaaaaatggcttgttttgctgtgcttcccatccaagagctgacaagtcacagctttttattctgactaacagcttgaaggtatcacctctgcaggctcctgacacaatgaattgcggttcttcatttatggcagtttgtgcttcgtgtacactttcatgtgtttaggatggttgcccagttttaaagtagcagctcttaaaatagctggaaatggatttggagttcaggtttggttgaaagtgggctgatggtggttgtgcgtgtgtcggtgtgtgcccacttgcaagcctgtatgcacgcccgtgctgctgtgagtcagtccagagcagtttacacaggggtccactgtgatagaaaatataaggcatgtagggtgaggaggaagagggtgggaggattgcatctagtgatcctggaacagttgctcagaccagcatttagtgttttattaggagagaacaactctataaaaggaacaagaggttcaatcattatagagtggggcgacaggaggcagctgccagcatgactttgaaaacccttggagatcctagaagacttgccacatgtaacgtggagcagctgctgggatcatttaggagaaatgcagaacttggcacccacccacgccttcaggggatagattctaggatcaccccaatgttttctttagatgagttccaaccccaccccacccccactttccttgccattgaacattctcacagcagctcttgtatttttcttttttattccaggtagttttgcagagaattaagagaaaaggatagtcccctagtttgatttgaaaagaaatgaggggccgggcatggtggctcacacctgtaatcctagcactttgggaggccgaggtgggcagatcactttgagctcaggaattcgagactagcctgggcaatgtggcaaaaccccatctctactaaaaatacaaaaattagccaggcgtggtggtgggtgcctgtaatcccagctactcaggaggctgaggcatgagaatcgcttgaacccaggaggcagaggttgcagtgagccgagatcacgccatgcactccagcctgggtgacagagcgaggctccgtctcaaaaaacaagaaaaaagaaatgaggggtgaggggtcctttatgcttgggggtcaggcaggtgtggccaggttgggagaatacagagggtcccctattcttatgcccatatgtgtacttcataaacagattgccacaaccttgcaaactatcacttacatgatgtcatgcaagtaacgaagtatgtgaatttcatttttaaaaaatctgcctaggatgtctgtttttcatcaatacatacagaatatttgcaaagctgaacccttcaactttaaaaatctccaattaaatcatataaacgtaagcaataaccaatgttcaaataagccagaagaaggttatttatggggggttattcttgacaagtgtatcatttgacatatgtataaaatttttggtaaagttttctcagagtataaatgccaataactgctgaaatttggcaaccagcacatttcttctgtggactcatgttctgtaagcaagctcagagaccaccagtatgttcgtaaaaattattactgatgtaatcttgaacaggaggtggccccaacttcatttgggaacaaatggagggaaaattaaagggtagatgtggaaatagtcatagtttcatctttagaagggatattagaaatcgtgcaggttggaaatctcacttatagcttgagaaaatcctcctgcccctctactccaagagattctgataacttctctcctgccttacctccctcaccccagtttgaaaatcattctcactcttactaataggagagctgcctatcatcagatatgttgagatggtgaaaaaaaaagttaagaactgcacgtttaaccttcttggctcgtttttaagacaagactattagggcccagagaagtcccgtagaggatagcagaacaaggtcttcatattctgtcacttggaagtgacaggtatatggacccagccatttctaagacattaaatcacaaccctcatgctgttgccatatgaccagggatcagcactgtcaagtatgaaagagagaagactatggggctggtgctatgaggaactatatagggtcatatccttaagttccattatgtgcaggatctactggaaatagcacctcatttttatttttcagacagggtctcactctgtcacccaggctggagtgcagtggcacgatctcagctcacggcaacctctgccttccaggttcaagcgatcctcccacttcagcctcccaggtgtctgggactacaggtgtatgccactgcgcctggcttatttttgtattcttttggtagaggagaggtttcaccatgttggccaggctggtcttgaactcctgacctcaagggatccatcctcctcggcctcccaaagtactgggattacaggcgtgagccacagcatcatttttctgcaaagtagtttgttgtatctctagttaaatagttaagcaatagagtatttcatccttgtattttccagtctccaaaataagttattttaaaatacaataaatgtatagaacagatcccaactactgtagttaaacttataatggagttactcatcatgtttgaaaaaagccttgcaatataatatcatatgtttttattccaggcccacaaataggtggtagtactgtgatgtccctactcacgggtcctttccctctttatttgagggacaaggaacttcccaccagcctagggaaaatcatccatcctaagtatctttaaacatttgatttgattaagtcctacaaggaacaagcagagttatgctagccacagcgtggtatttggaattccttttgttattaaaaaattccatgctggttgtatgagttcaggaagcctgaggagggataagaaatagaccttttgtctagtgctattttaacacacttcttcaggtgttggtgggcaaactggccttgaaaggccttgagttcttaacatagttgagtctcaggcccaggctgggtagcagaaatgccctacctcattgagtactcttctgtttcatctcttctgtccctgtatttgtctggattctcaaaacattgtcttgtcacttaaaaacattaagacgtgctccatccagtctccattgctgggatttagtctgtatttgatgcagctggtctttgggatgagctcagtcttccccaaccatcataaggcagtttctcttgagacttctggtccattgctactcttgagatctttgccccgaagtcagccctctctgcccctatggtgccttcagtatgacaggtcagttaaacatcagctgccttagtaattcaggaaacaaagacagcctccaagcctctgatgacatcactactcaagactgtgtctggcaggaagggcttggtgtcactttatgaaggagacaagctgagaatcgcaccttctaaacagtccctgctaagtgctgaagtcttgattggagatgtgctgtcccgaggcttctctctaagcccttggagggtatgctccctaataagctgccccagagaggcagtccagacaaggaattccctttaaatggtgggtcacaacatctggaatgattgtgctggattactagggagcctgggcagcaacgcttttcatccttccttaaactttattctcaagagaagtggtttataaggagcaggtgatacgcaaagaggcgttggtgatggagacttctgctggagagcagcctggctcctggggaggatgagcagagaacccctgtctctgacactaaatgcccagcgtaatccccaaggcaaaggacagactgagagagttttgtcagatgagtagctgtctctctgtctctgccaggggaactcctttcctgtgggattgctgctgccaagagtgacagtgccttcctgatgagggttcctttgttcaggtatttacctggttatagtaaagcctatttctgataccactcaggtcaaaaaactgtcgtgttgggatgtccatggttgccgtttgaaatttctgtaggtcaggcggggcgcggtggctcatgcctgtaatcccagcactttgggaggccgaggcgggtggatcacgaggtcaggagttcaagaccagcctgaccaacatggtgaaacccccgtctctactaaaaaaaaaaaaaaaattagctgggcgtggtgatgcacatctgtaatcccagctactcaggaggctgaggcaggagaatcacttgaacctgggaggcggaggttgcagtgagccaagattgtgccattgcactccagcctgggcaacagagcaagactccgtctcaaaaaaaaaaaaaaaaagaaagaaatttccgtaggtcatcacaattttcaacacaacagttgcttagacagctcctgcatcagcccaaaagggatatgaaaagtttctttctcccctgaaaatgagtttggttttgccagtgatatttagaaaaatatttccaaaatttcttcctagcgacatagaatgtaaatgtgtatcattaccataagagacagatgtctgtttccatactctctcattcttccagtcaggttaaacaggctttacccagaggtcatatgcattctccaagttcctggtggttaccttgagttagccctaatgacaatttgatgaaacagttgctggtaaaatcagcaaaggcaactagcacgatcactatgagttgatggtcccaaaggcccatccagtgggtttgagggaacccagtggttccaaggcaggcagtaataatatttttccaaacttcaggttctctgtggagaggctgttcttcagaattctgcctctttttgaaaaaggtaattttgacgaaggtacatgaaatagagcccgaatattgacatcatctccagccaaagttctcattccccagtgtgaattctttcctgtccctcttgcagttattactatgtttttctgtaggaaaagatgtatttactagaacatatttctaccattttattggtttatttatttattcaacagaaatttattaagcaccaaccacatggcagaggaggcatcctggaaaaattattgactaaaccaagtcttgaagaatgagttgcaattagccaggcagcagcgaagagggaatagcacttgcaaagtccgtttacaagaggagacagagcacaaacaaggagctgtgtttagttcaggatggccaggacataagacataaatgcttggagttgtaggagaaataaagggctgatcatggggaggttgggtttcatggtagagagtctgaaggctttggggagtccccttggaattttaaacaaggtaatatgatcaacacgtgtttcggaaaacccacttaggctacagtgtggaaaattgattgaagtggggtgagactggatccaggaaaccgccaggtaccaattatttatcgaagtgaggagtgatgaatgccttccgtaaggtagggataggaggaatggagaggaggctccaacatgggaaaggaaattcaggggctccatgacagtcaatgcatatgggatttagaatgcaatagaaaggtgggagtctaagatgccactcaaattctggcttgataactgagtagaaagcagtaccagtcacagaggaagaggctggggatggaggagagaaggtgtgttcactttggagcatactgagttaaggagcctaaagaacagccgagagaaagggaagccaaagtcatactccttgactttttctttattggcttagactgtctggtgatctagtggtgtgtgtgtatgccgggggagggcagagatgggcacgtgaaaactctcagcatccaagagaagttcacctaaaccctcctgttatttccaaaatttgaccagatgtttaagcaaattaacaaatgattaaagcagcagtcagcggggacctagacccctgtggaaataagcaaaggggcaaaactgcagagaaagccaagcccaggtgttcttgttgaagggaggtcagtgtgatgggggtcctcagtggtcgatgggcagagtcaaaatgaagcaagctgagtctggtggagagggtgaaatcggaaatctaggaaaagtacaggtgttcgtgttcactgtgagaataacttctacctaacagctatgctctcaacggtatttttattccgtccactgttggtagcacattctacttttctctatagccaagtatttttctttctctaagggatgtcgtcccctaaaaagactgtttccaatagtatcaaacgactaccaattagtattttgttgtagcaaaatgaactagcagctgagcagctaacttgggtctccctgcagcttcatcagtagctttttgtggggccttgggcaagtcataggtttctctctggaccttagctttcttctccataaagttaaggaacctatcctagcaggtttctagagtcactttcagcatgatccttctatatttgtgttcattactggtttgaaaaggccacgagtctcacttagaatggcagcttcttctcactcaccaaagacataggcctggacatcagcaaaacacttcagtaaattgtagttcccaacacacttttatgcctagtgtgtaacagggctggaaaactgccacagagacactcactacagcccttaactcattaggggtcatttagaatgtcaggtttaaaaatcagctgtccccccaggcccctccccacccagtcagctccctagctagcctcatctagagactgcatttctcattgatcttaaaataaaaaaggaaataaaatgaaaaggactttggctctagtatgtggaaactcttccaaatgccctggtctttgtgaccatgcaaaggctggctctcttgagcatcatcactctccgtgtgagttgatcctctagctcacattctctgccctgagaataatgatgagagagatcctcgggaaggcccactgcctttccaatctacttccaaaagggagccagaatccaagcccccaaaggggacgtcccacaccctgcatcctccaccttttcagtcatccttctcacccttctctggcaacagagagttcagtgccctcaagtgtgggctgccttccagttcaaagtagtcacatgccattatttatttatttatttatttatttatttattattattattattatttgagatggagtcttgccctgtcgcctaggctggagtgcagtggcgcaatcttggctcactgcaatctctgcctcctgggttcaagcagttctcctgcctcagcctcctgagtggctgggatgagaggcaccctgcaccatacccggctactttttatatttttagtagagatgagatttcgccatggtggccaggttggtctctaactcctgactttaggtgatcctcccacctcagcctcccaaagtgctgggattacaggcatgagccaccgtgcctggcctataatttaaatgtagatagcaaaagatgagattctgagggccgggcacagtggctcacacctgtaatcccagtactttgggaggctgcggcaggtggatcacgaggtccggagattgagaccatcctggttaacacggtgaaactctgtctctactaaaaatacaaaaaattagcctggcgtggtggtgggcgcctgtagtcccagctacttgggagtctggggcaggagaatggcgtgaacctgggaggcggagcttgcagtgagctgaggttgcaccattgcactccagcctgggtgacagagcgagactccatctcaaaaaaaaaaaaaaaaaaaaaaaagaaaagaaaaaagatgggattctgagtaaacttgggataaggcgtttaaataaattcatgccaactcatagccatttcatagcattctttagagggtttggcgttcattgcccaaagaatctcattaatatttgtgctattagtgtggggcagttaatgagtatcaaaatggttgcttcacacacagctattagccagagaggtttagttgcttacctgtggtcacacagcaagtgagtgatgagccaggattaggaacaatccaggtggtaatgaaactgaaatgttttggctctgacagcatagttcagcaaaaggatgcgggtcctaggacagggagtgcagcttagcctttgagtcccattgttatcccaggagaactgtattttctactttcctgaattctattatgacaggttttaaaaaatgatttcaaatttatgtgtatgcacgtgcatgaaaatatgtggctgctcacagatacgtgtatagaagatgaaagagaaaaatggacaacttataattacagatattttcattcatctggtatccagatgatctcccttgattctgacagttttgacaaatcagtttattaaaattgtaaatgtaacccagagctgtttagtacagtactaggcagaaggtgctttctcctcacgttacattttgctgttgcattattagaagtaaatacagcttatactgaaaggacaaaacagccagccagtcttctatgagaaagatgtcacttgccacatacagtcccagttggtttcactgtcccgagaccctaaggatgttttcgtagagctttgaccttgatgaagcacagagaagtgtctggtccccatgcccgccctcctcccctttaactcctcgcctgccccttcaacttcagttttctaaagagaaaacttgctccctaagctcccagaaggcattactcaggtgacatttggggaaggaaatgatcagtagggcaagttttaatttagggcatttaaacccattgtgcttaagtaccagatttcattgcagactctttagaaaaaatgtatggcatcttgacgcagtgttcctggccaaaaaagaaaagaaaagaaaagaaaaatgtatggcagtaagtaatgccatgcgagggcaagctgggaacagtgaacactcaaacaatgagagaagaaatgtacaaaatgtggaactctctgcattagctgaaaatagggaaaagaatacctttttttccctcatcacctaccacagaaagttcagagaagtttttatttcatatctgattagcttcaattgacaatgttttctacactctgattttgttccagcagctttcctcctccctccctcttctagcctctgcccaggaatcatttgtaggcaaacacatatatttgtgacaggacatcttcatcttagtgccacagaccactggcaatctggccaagcctgcagaccctttctcagaatatttttaaataaataaagtgtgtaggaacataattaccaaaatattttaaatgcccacacatttatgatatagtaatatatgtacttatttttaacatattaactaaacagaattcatcactgctgtactttcaaagtcaaaatgtgtgtgcaccaggggtcagcaaactgcagcccacagactgttttgtaaataaagttttatcggaacatagccatgctcactcatgtacatattgtccatacctgctttcacactacagcagcagaattgaatagctggcctcatgtcatatggccctcagagtctaaaatatttgccatctggcccctttcagaaaacgtttcccaatccctggtgtaaattgcaacagtagtaatgtgcaatgaaaagactgatttcggccgggcacggtgactcacgcctgtaatcccagcactttgggaggccgaggcgggtggatcacgaggtcaggagttcgagaccagccgggccaacatactgaaaccccatctctgctggaaaaaaatacaaaaaattagctgggcgtggtggcaggtgcctgtaatcccagctactgaggaggctgggtcaggagaatcgcttgaacccgggaggtggaggttgcaatgagccgagattgcaccattgcagccggatgacagtgagagactctgtctcaaaaaaacaaaacaaaagactgatttctcttggttacagccacaggttgctaactactgttttctgcctacattataattgatataaatgcaaaatttcagttagaagttaacaaaaacataggagtgatttttttcacagtccaaattcatggaccacctgaattctattcatagatctcatggaggcctgtggaccccaggttagtaatcaccaaatgggattacagttaaaagagcctttcagcacaaatagatactttctttacagtgtaaagaatctgcaccctttccgccccctcacaaatgtctgcatattttcatatcaatgaaaaagacatcagatcatctctagaattaggtgaagcacggccactttgaacgcttattcccattctgcagagacccagtggcttgctgaggaaaggctagttctgtcagctagtcctaagaaaaagttgagattctctacacatacagtcagctcattacctcctccctgtcccactcttgccatgccaggagaaagagccaaaaactcccccctcccccgactcccagggttctcctgttctctctggtgtattacttgactttcctcatcttgtctcttaatgtcacatcagaatgtaccacggaatctgactttgccatttgtgtggctatgatgtcttattctccagagacgacttcaagtattcagcaataactcatgtccacttaatgtgaaaattggtaccatctaatagaatcttcaacatgctaaccacactattccaataatgaaatgcaaattttcctgcctttttactatggtcatttttagattcttgaggaatgaaatatcctctttattatgaattaagaactggaaattaagatgtggagtattgttacactatttttagatagtctccttatctgaagtcctaggctatcttgtttaatactgacaatataattacaaggtgcatatcattattactcccattttcttgctaaggaaactaagatttaggttacattgatgagtgacagaattctagaattcatatttttttttcagctttgaaagaacagacaaccccactttatctgatccttcatttacaatatcagctacggcctctggatgtgtttttatctaagagaatcctacagtagttcagactttgtagagaaaggcagtgagacggaacagttctggccatagggaggatgtagggtctagatcactttctaaattccttttccacgaaatacgggctttgagagagaagaccatctatctctaaggtcccttccagtgccatctgaccatccatggctctaggatattcaaagcaaaagatagttgaggcagctcaacttgtgatgagttcccctgtctgcctttcagactggccatggaagggaaaggcctgtccgacaacaggacctctgagatggacccgaagcacttcagcccttgtcctgtgtgctgagcagctctgctgatacagcaaagctgggggatagtattgattttccagataatattagcatgtcatctcattgagacagaatgaagaggatttatggggagccagagccgcacactgctgcaggaggcccagtctgtgggcatcttctgagctgcctaaaacaagaataaaatagtccctcatctatgagcgtggggaagaatgtaaacaagcacccgtgtttggggatacagcagcggcctggaacttctgaacggccagagaaacatccagtgggtgagaaggaacacatgggcttcaccgagcaattagtgctgtaggtttaatagagtttgagtactgatctaggttcagctccatcgccactcagcttccgggatggtgatttgaactgacagtattaccacctgttgttcattggactttggcactttctcctcctgctgtcatttctcattactgcccttgacttctttctagaagagtgggtacagtggggagtgaccagcccccaggaagaggacacaggtacacggcagtgtgcaccctctcttcttttgcctatttctggctctgcatggcttgagtcagagttgatatttccccatcccttttgttcccttacagcaagcacttaccgtgctgtactgtggttttctgcttacatttctgacctctttctggactgtgaagtcctgaaaagcagaggctgcaaatgcatctctgtgaccccagcaccaagtcttgtgcctggcacttagtaggtgttcagcagcatttgttggagagatagatgaagagtaggcatattgttcctagtctaacccatcccaatcatcctccactcccagcagtgccatttgtcattattttctgaatcccagtctgtaacaccaccatccaccctatcaacaaaactagaaatgggggaatcatccttacactgtctccttcctcacttcacacacaccagtcaccagttcctgctgattgtttctctctaaatagttctcaaatttgctctttatccttttcatccctattaccacccccaagttcattgcctcactgttgtaatttaattatctggtcttcccacctttactttggcctccactcacctgtcctgtgacaccactgctctggccatgtcactacccatctaaagttgttgagaggctgcatttgcccacagtaagaaactcaagcttcttagcaaggcctgcaaaacctttccttggtcaggcttctgcctgcccctgtatccacagctctgaccacttgctgccttgagttttatgttccagtgccaccagatttcttgtagttacccatattagtcatatactatttcgtgcctagagtgtccttcttgctcttgttttttccattcccattcatactcattgagactcagcacgtaacgtcacctcatctgggaagcctcgtctaaccttatttcccccatgaaaggaaggagggaggaaagaggaagggttaaggtacatctcctttggactttcatagagctctgtacacacctcaatgtccctgacacaggtagtcacctccatagtgaattgaacatccaacatgtctttgcagttccctaatacccttgaattctattttccttcccaatcctttttttttttttgaggcggagtttcgctcttgtcgcccaggttggagtgcaatgacacaatctcagctcattgcaacctccacctcccaggttcaagggattcttctgcctcagcctcctgagtagctgggattacaggcgtgcaccaccacgcccagctaattttttttgtattattagtagagatggagtttcaccatgttggccaggctggtctttaattcctgacctcaggtgatccgcccgcctcggcctcccaatgtgctgggattataggcatgagccaccatgcctggcccccagtccttttctaaagtgtttattcatattgggatagaactaacaagtaaatgtgaccttttttaggaggattaccatttgtatagggctctatccctctgaagatagaatactggccttagtcaatgaatgaagcaacatctcttggggttgccagatgaccccggtgcatagtcaatcagccaaacctctgattcagctgcttagttgggttaacagtttcctttccactagtatggtgtgaggagtgggaaaggcagcagagtaccactcacagcctgcccagtgagcccaaagcagtagtgagcccagtcagaagaaaagcctggcatactagaaagagcatggcctttgaaagattggtcagcctgggttcaaatccactgtttgcctcttcactgtgtgaacttgagcaagttcattaagctctgtcctcatctgttaaatgtgcataatcgtttacactgaattgtggtaaggattaaatgaggtcatatatgttgtctgctcagaagagccactagctcatggaaagtgaccaataatgatggctgtggctgggtgcagtggctcatgcctgtaatcccagcactctgggaggctgaggcgggcggatcacctgaggtcaggagtttgagagcagcctgggcaacatggtgaaaccccgtctctactaaaaatacaaaaattagctgggtgtggtagcgtgcggctgtaatcccagctactcaggaggctgaggcatgagaatcacttgaacctggtaggtggaggatgcagtgagctgagatcatgccactgcactccagcctgggcaacagagcaagactccatctcaaataataataataatggctgcatttgttgttgtttcccctgtcttgatcccctggtggatggtcattgtgcagtagaaacaagagataatcctgtgtgcttccttcttgtttcactgaatttggccccaagtctacctgaatgcccttaaccagagttctggaacacttctgacttaggaagcctcaaacaccctagtatgtttccagttttccaacagttgagaaaaacatgataaagccgcaaattctatatgtggaaaagcagtgcagtgtgaagaatggtgtacacctgagtcatttgttggcaacagtgtgatcttgggtacattcctttgaatctctgcatctgagctttaaagatcccatgagctatttgtatttcttcatcaacacttcgcttacaaattaaagtactttggtactataatggtgatttggttattactatttattacctagactgcaggcttaagtatagcagttagagaatagcacactttgttttgtttttaaatgaaaaaacaattccccttaagaagtggaaagtactcaatagcaccaaatattaatttttaaatataattcaagaagcctggctgagcacaccaagcttttatgcctgtaatcccagcactttgggaggctgaggtgggaggatcgcattaatgcaagagttcaagacaagtctcggcaatgtgaagaaacccagtctctacacaaagtaataaattagctgggcatggtggtacatgcttagagtagatcctactcgggaggctgaggcaggaggatcgcttgagcccaggagctcaaggctgcggtgagctgtgtgagctgtgtgagctgtgattgcaccactgcactccagcatgggtgacagagtgagactctgtctcaaaagaaaaaaaaacaaagctcttttctttaaaatatttctttgaaactaagcctagaggtactattacctttggatcactattattaatcattccttaatagaactttggatttttccccaggcttaagtacactggttatttctaattctttgtgattttcctggcttcagatctttccaggaacagctctgggtctcttggccaatttggcatcagggctctgggcctttgcccccagcttctgtgattctctcaaaggtctttcagtattgatcagggagtcattcccactgagtccttcaagttttcttttactgcttccccacaaaccgtagaatgagaaaaggatgattgaagtgaagagcctagcctagtgccggcccaagttgggacttgctgaacattggtttccagccctgtggccccagaataccccacagttacacctcagctgtgggttcctctgggactgttccccagaaggagatttttctgccagttttaatttactttttggggaacgaaaaaaactacctgtaatttttcctgtctacttttactagagtttactagaggtttcctcaagttccttgagcataatctcagagaagaatctaacccatgttttctttttcccattgcatttactacagttacaacgataataaatgttgaattaactttcactagcttttaaccaacatgtaagcactcccctttaaactgtgtcttctgtgtttggtgtctacctgtgtaaaataggaataatcccaatcttctcaatgagattttaccaaaataaattagcgttcataaataaaaggagctatataaatctgagaaactgtagagaggactctaactaattttatgtccaagtgctctaaataaaattactttttcccaagtgttctagaaagggttacattcctgagtagggtcttaatggccagttcaagaaataatcaagttaagtgtatttaattcatacttttaattcatttttttgtaataccttctgttagacacttccatatgacctgtgtcaaatgcacagcaaaacatctgatatatggttacagatctaacacaaataatgttacgtgagcaaccccaaacagtatacaccttgacaatgtggagactcaagattttccaagcactcattaaattgagcagagaagtaatctatttcatccaataacctttcgttttatgtatttagcaaatctttatcagagagagctatatgtggacctcctaaaaagggacctgggaattcgggtcagaaactagaccagccaggcgttggagttcacgcatcccagcactgtaaacaacagcatgggcacaactggccaagtgtgtggggactcctggtgttgttgtttatggcgtctggcaaatatttctacccaagccttcagctagtttacagcatttcattttacagcccatcatgatgatagtaaccaaccccagaaaaacatcaacaagcattagcagccatagtgttggaagatgaatgtgaccccagcgacctccattccaccccccaacccccatcccactcccaccccatccccctcaccgccccctctagtgttcagtgaatttctgcagctaaagtggttaccatgggtcttgggtcaaaggaggatatttggaggaatttctctaaacacatgcttacaaatgttgagaaatagcactctaaaaaagcaggagtcatacacagaccccagctcttctcggtgagtaagacaaaaggcagcgtgatctataaatatggtaaagtgccttgaaacgatgagtctgcagaggcaggggggtgggggtagttaagggaaggcaggagggagacaacaattacatattaagttgcattggttaagaacagaaaaatataacttggcatgagttcccatactggccttttagaacggattggtctgtaacaccatactaagtctgttttctatcagtgattcctagccagcttattaaacagatttatacaatgaaagaatctcataacagaaacattcaccttctttattacttggcattatttatggtttgagttttttcagctacttttttatgcactggaatctgccaacattatacttacaaagtttatgtaccaaagtataagtaggttgggagaatattatatgtgtctcctctctccagccatgtggcctcccccagcagaggctttgaggacctatctgtcccctcctctgagtgtcttcagcatggaatcctctttctttcaggagtccgtgattcttgactgaaacaagggttagttccctacctccatgcccgtcaaggagtaatacttttttcagccttgggtttagtgacagggaaaaaagaacgttagctcatgtgaggatacgtataagggaattagataactctctacgtgatttgcaaacacctcaaaattgtcaagatggaaaagagacccagagtcccctttcgtcctccccattcattctagggtaataagggctggtggagaggcggtgtccattttttgacggaactggtatgggcagatgagcatgcctgagtactgaacactaccgtgtcactccccatgttgccattctgtagaagaggaagcaggaagccaccgacaggggcataactgtggacctaaagtggacatcagaggggtcccggcaatgcggccctgacccttccctgcctcacttgccctctacttcccagcttcaccatagctgggaagaatattttgatttgtttgttttccctgagaaagaacagtttctatctcgagtattgcctcctttcctgaagcgtgttctccgtcccaaggaaaacacacacatccagaaggcactgtgagcaaagcctggaactggagagatgacccagggtctttgggattgcggaacagctgctgtggaaaagtagtggcctgtttatgggttgaggaggcagtacagggtgacaagagggagcccgagagccccccatgaatctgtctgcacccttgtgagaagaagcccatgaagtcaaatgacagcttgtttaaggaagccatgaactagcaaatgtagttaaaagatgaagggggaaaatgaagggaaacgcttatgcttaaagcagttttcctttgaaaaactacagcatttaggctaccaggttgtgtttccttaataggaagccatatcccagccatgtggcaagaattagtcattgccttccatatgggtagtaataataaatgtaggaatttagaggctaatgaatcagtgggagttgctatgggtttgctgggtgaatgaatcaaaggcgatcccttctttctccctgcttccatctttccggtcctttcctcctgctatgcttttatgcgtatgagctttcatctctggcccactaaccccaaggatcctttgaataatctggaaggagaccatctaaagaactctctggccaggtacagtggctcacgcctgtaatcccagcactctgggaggccacagcacgtggatcacctgaggtcaggagtttgagaccagcctggccaacatggagaaaccccgtctctactaaaaatacaaaaattagccaggtgtggtagtgcatgcctgtaatcccagttacctgggaggctgaggcaggagaatcccttgaacccaagaggcggaggttgcagtgagccgagatcgtgccattgcactctagcctgggcgacagagtgagactctgtctcaaaaaaaaaaaaaaaagaaagaaagaaaaaatgaactctcaaatctgtctctagcctgcatgcgaatcatcgcccagaaactaatctgtccccctgagcccaagtattaagccgagctatgaaccaaaaattagaggtatgagagacatgaaggggggcaggcctctgtgccccgccctccaagagctcaccatctagtgctagagactgatgtgtaaacagatcatcatagtgataaaaaccgtgatagaaaaaggatgaccagttgttttggcctgtgtgtgtaggggaggctctgggaggcaggtagaatgccgatgaggatcttctatgacatgagtggctgttgagctcaggagataagaatttggagctggagcagttcacttccattttaaatcccagccctgtctcttaatagttgtgtcactttgagcaagttacttacctctctgtgcctcggttttttcatgtgtaaaatagtatacctacatcctcgggttcctgtgagaattcagtgagttaatatgtgtggaacacttaaaatactgcctgctcctaaaattactgcttggcagtaaatgctatgtagatgttactttaaaattattactattttcacatatcttatgtgaatgtgcctaaatgtgatatgtatatatttttccttttaaaaatttgagatcatactatacagagagtccagcttactttccatatcagcacatgtagatgtaccttaagacattaatttaaaaccaactttcttttgaaaaactttccagcctcatcagacattggggattctatgtgagggcacctctccaagattggatcttgctgtggttgatggagttacatccttcacagcacggtccaaattagagatctccagtcaggctgtttggtctgtgaaacatttggatatttgttttttaaatccatattaggacatgttattcagtgtttggagaaattagtatgtactaatttctaggctgcttgaagaacttggggggtaaattgttgctcttaaatccccttaaaatatagggcagaggccaggcgcggtggctcacgcctgtaatcccagcactttgggaggccgaggcgggcagataacgaggtcaggagatcgagaccatcctggccaacacagtgaaaccctgtctctactaaaaatacaaaaaattagctgggcatggtggcgggcgcctgtagtcccagctactcaggaggctgaggcaggagaatctcttgaacctgggaggcggaggttgcagtgggttgagatcacgctactgcactccagcctgggtgacagagcgagactccatctcaaaaaaaagcatatatatatatgacagaaaggatcttggcaccctgtgttgaaaagatacgtttttaagtcaaatgtgaggtaagtaggtcatgccacatctcaacctcatcaggctgtacttctgcagattgttgtggcttctgggtgtcctattagaaacaaaacaggaggggagaatcgtttgatctcttgctcctaaaatgtgggccctaggccgtcagtaagaggtactggcccttgccgagtcccagtgttctccctcattcaccccctaggtgacagtggatccaactctccataagcaagtctgggattctgcatgttgtgcttatttgctctctgtgggagggtctgttagacaggtctctccaaggaaggggaagggagcaaggagtgggggagggtgtcagctcagaggggctagcaagtccagtagatgccagttctcccgaaagacaggtcccctgtgtgattcacatctggtactgaagtggctagagcagttggcacaccgcaaattgacactgaccttggccatgctgttggggtaattggactttcaggatggactctccgaacaatcttgccactgtggctggcacaaacaggcttttctttaacagcagacgttcatgtcttcttgctccaacttttttttcttgaacaaacatatgtattgtggccaatgcaaggaaaatcccactcaccattttgatctgagttgcttctgtcctggaacaatagtctagtgtaccaggggccctcgggatgctggtttccatgccctggtctagttttatgaatctccttggaagaccctaaaggccaggaagccatcggtatttctgcagggcctcctaccaccatcggggacatcagtggctctgtatctgattgtcagagcgtgagcttcagcagtagcctcggggtcaggactggttacaaccaaagagctttctaagtgcctgccctttctcccacaagatggcctcttcacaacttaagtgggcataaccgaagacttgcattcccctttgagcatccacctcactcagttagaagaaatgtgtctccaagcactgccagcctgtgaataagcacttcccaagtgccaggtacaaagttagacacttcccatctttcacctcgttgatcgcctcaaaatcccgtgaggtttttaatcactgactcagtagcattgattgagaaatctactccgtgttaggcttagactacatagtgatgaccaaaacagtctttggattcatggcaattactgccaggtagagaaagcgaatgctgttattttgctctaagaggaaactaaggttcaaagaaccaatactttctcaatgccatataactggtaaagggtgtggccacgattacaccaccatgattctactccaaagactgtcttccctccaccatgccctactaccttcctataggaagcttaatctgcggttctacttaaaatatgaggaaacatctggaatattagttttcaaccacatttcagacacagaaagtggagcctaaggaatagcccagttggctcctctctgagagcgggtaagagtagaaaagaattgctgatctcaagcattttgttaccagaataaccccacaggagaggcctggctgaacggggatttgtgtgggccagacaatgtaggggatttatttccaaggctggaggacagagcttggactcgggtccagctcggcgtcctccctcgggtcctgctcgctgaagaggtacagcatctggaggaggactttccggccagggtacagctcctctaggctgaggcagttaacgattaaacaagaagcagcctttggctacaaagctaatggtttgggttccagggcacaggataaaaatatacaactggaaaggcaagctcccaattaagtggaagagctcaagcaagagatgtttcaatgccgcggagccagtgaccacacgtgggcctgctgtctcctccaccagccccactcgcccggccccatacttagtgctggctccagagtctcgtgggggaagccggctggcagcacacaggccattcctcttttccattcaaagaaaatcttacttgccttctgcccaacaatttatcttgcttggcatcttaggatagtagaatgtcagaactggaagggccttagggatcatctagcctagtccagctccctggtttgatgctttagaaaccgaggcacacactggggaagtgacttgagcagagtcaccttgtcagttcgtggcagggaggagattcacgttttgatcttgtaatgtccgcattctcttctccctttgtactaagctggcaccattagcagcctgccatttgcacctcttccctttgctcccacaaacctaaaagccctcggtccttctcctcttttacaggaaaagatactgaggcagggagtgtaaacagtgcccacagagctgacaagtacagatgccagaaagggaaccgcagaatcccgcccagcaggcctgggccttcaccatctgaccgcattccctctctaagaacatgttgtgggagaactgaatttggcctcctttgagctctaagcctgcaacagccctcctaatgactctacagttcctggcttcctcttgccactgactttcccctccaccgctgcctgggacaaccttacagctacagtgactttgagtcttgccaagacaagcccaatagttactttcagactcaagtgcttgccaagcctgaaatagtaattgcctgaagggttccaaaaagctgggctttatctgcagcagagactttagtaaatcaaaacacaggtcttatctccctattctctcccctctgttgtgtggtctcctaaatgaaaaatgttacctaattgcctaaaacagctggcttgatgtttaattacttcagcttgctaacctgatattctggaccaataaactatacacagggagtggataatgctctttacagatcggacttgtccaggtttcctttgtgagaaatgttgatttcagccaccagagggaattccaaatttgaatgctcttagcagtcaccgcgcttgtctgatgttggaactcctcttcacccatccgaggaacagtgtgcctggaaaatgccttgaatcctctccccagcattccaggggcagtctcctccacacgccacactgctcagcctacactcccttttctttttctttttttcgcgagacagattctcgctctgtcacctaggctggagtgcagtggcgtgatctcggctcactgcagcctccgcctccaggttaaagcaattctcgtgtctcagcctcccaagtagctgggattataggcgcccaccaccacacccggctaatttttgtatttttagtagagacagggtttcaccatgttggcctggatggatggtctcaaactcctgacctcaggtgatccggccgcctcagcctcccaaagtgctgggattacaggtgtgagccaccgcgcccagccaacgcactcctgttctgagacacgggagggcatgcagagcagtctcggagcggacgctagctggcagcggtgccattgctttcgcctcaggcttcctagagcaaagaagcccatggaagaggttgcacagcgtcgctggttaatggcaaagcccaggtatgggccagtgaaccccaatgatgctggggtgcctcttcctgtccccaaggactctacagcctcagcctcacccatcgatgcttccccatgtgggtcctggaatgtgaccaggctgactgaccccccgtttcatgccccacgcctttgctggtactggtccctgagatgtcccctgacatgcccctcacccagcacctctgccctcccatctgcctccacatgccgctgcgtcccctccacggctcccctgcagtagcacacctctgcacagctttcctctttactcctagccaggctcagagggacccacagctgacatcttaaagtcacctctattgtccacctacctacttctctatctcactgaacctctttaggaccaggattttcccttttcatgtgtgttttccagtgtctaggatagtgaccatctatagcaggtgctggccaggcgtggtggctcacacctttgatcccagcattttgggaagtcgaggcaggtggatcacctgaggtcaggagttcgaaaccagcctggccaacatggcgaaacccccatctctactaaaaattacaaaattagccaggcatggtggtgcatgcctgtgatcccagctactcaggaggctgtggcaggagaatcacctgagtccaggaggtggaggctgcagtgagccgggatcacgccactgcactccagcctgggtgatagagtgagactccatctcaataataataatattaatagtaatatagcaggtacttagtaaatgtgtgctgaatgtgggagacgtcttttttaaggaaagcctaagatgtcattcttagagcagcagaagagatgatgttcatgccccatgcctttgttggtactggtccctgagatgtccccggacatgcccctcacccagcacctctgccctcctatttgcctccacatgccgccgcgtcccttccacagctcccctgcagtagcacccctctgcacagctttcctcttcgctgctaggcagactcagaggggcctgcagctggtatctgataaaataaaggaaaggttagagggagggagagagggaaggagaaggaggataaaataaaaggaaaagaagaggtatgaattctttggaaaagaaatccatgccctcggaatgatgtggctccttccttttttagtcaaacatctgctcaactgtatgtgctgtgctagattcctcggggtcatgtacaataattcctgccatgtaggtttattaaattaacagttgcaatttatgtttagcggtttccccactaaggaattcctcgtgtatttgatcgatttgtgcaagaggctaactccagccattgccagcccttctgtaaaatggctactatatgatccagaattccctctcacctcagacactgatggtactattagagttcgggaggcttcaacagttctgagataggtgtagcatatacaaaaattccgttcactgctttgttttcttaaaaaagtttagggttctaaagagtagtgtcttctatccaaatttagtatacttatatattatatccatcatattatatttagctcttatgccctaggtatttgatcaatttgagcatttcattgccaagcttttaagagactcctgctccacgtcttcttgctgtcctcactagcttgagacaaagtagaaaggccagagagaggggactcctccagagcccacccaggacacacaatatacagtatgatagaataaaacaatgtaaaggcatgcttcttaaataacaggtcatatgctttaattatttcatctactggcagtgtattgcctttactgggaaacaagcctttcccacacacctgctttgtagggctgggctgagtcaagccgggagaaccagacagttcctggtgtttggggcctggaccaggaaaatgcagctcatggcaacatggagggcttcattgacggtgaggtgaggtcactctaggagagggctcggcgtagagacctgggtcagtggggtagtagcaccatcaggggcaactggcagtgaggcctcaatagcaccttgagaattcagcgagacaagaccgatttgggtggggtgggagagtagtagttggcaaggtaagtagggcacagttgttcctaagaactaaagcccatcaaggcaagggcccaatacccagattggggaacttgacctcagggataggacagaagcctagtaattagagcagagacacggtgtcagagccagccaagggccctgccatgggaggcctgatgtggaatctcctcccttttagccacctgagggcagacttgaacagaggtccctggtgaggtctgtgggtgggggtccaggcagagcctgaacgaatgccatacgcaagctgttctggcaggcgtaacgcgtaggaccaacagtgaaagcacagcaagaacagggtttgtgctgcaggtgtccaggctgtgcaggaagcagggccagaggccgcctctcctgctagagctacatgccgctcctcggctcctccccgccaccatcacaccaggagtcagggccctgggaggcgactagaacacaccaaaaaaggatggctaggactatttctctgcaaggtggaatcagctcttcatttaagatataagctgtggcccaaagttactgagggttctacaggtgacgtccatctaggcaggaatagaagttccaaaattaactgacttttctcagttggaaactttcttctcaggctccagaatctgcagtgtcctgtctgcactccttggtggcgatggagcagcagccctctcctgtcttccctgcctactgttagaaccaaatgtagtctttcttgaagacggcaccatctccctctcccagtgacatcagcagcccctcttccccctccccctaattgacaaatgtgggcatttccaagtgtcttaatggcattaacaagggacacaccgcttaatcacaggtggaactgccaacagatgacgggttatttcccgtgtttctccccaccctgcagtgaggcagcagccttgtgttggggtttctgaagagcactcctgctcggaggacatgtgctatttccagccagagttgtccacctgcaactttctgctagggttagcagtttcatctcccattattaagagtccagctggcgtgtctttgaagttggtcccatcatgttaaatgttaactgtaatttctcttggcccttgctggagagtgctttccttcccgttggtatgataatagccgcagctatattggccatgtgctagctgaccacctcagcaattgctttcactcccggagtgacatagaaggagctttgtactgtgcatcgtgaaacttggggtttgacctggttctgccaggaagccatgtgatcttgagcaagctcattctcttttctgatcctcatttttctgctctgtacaattctgggtaagggctagaggatttctaaagcccttccacttccaaatctgtgattccaagattgggagaatgcacagttactcgcaactcctttttctccctctaccccgggcctacacccctcgctacagtgcttctccacatgctgatcccagtaggtagccagggtcagagaatactaacaatatgtagagagctcaggatcattctgaccctttgaacttgaaatcctcagagagctttctattctaataaaagggcataatcttggtgatatgacaccccctacattaaactccattatattaaggaaaccttagaactcggatgtacaatctagcttgataatttacaattctgctgggattagtatgaggaataattatatctatttattccactgtcagaatgttgactctagaatttcatattgtctctgtcactgaagattataattaaataatatgtcgaatgtattgatcatatttttatacatttgcttgatatgctatagaggctttttttttttcaatatatcacgagattaaattcaaaagtttgccaggccatctaggtctgtttaagagattttttttttcctgaataaaccacaattttttgatggcttgtcattttgacatcaactaaagtaatttatttactccttagtgcagaactgtatctcttttagcctttagtcagactcagtagctatcatgacattagaataagaagtagtatgtgtctttgagggtaggctttaaatttcctttgtgcataaactcacaattttcatagaatagtcttttttctttttctttctttcttcttcttcttttttttattttttattttttttttttgagatagagtcttgctctgtcacccaggctggagtgtagtggcacagtctcggctcactgcaacctctgcctcctgggttcaagcattctcctacctcagcctcccgagcagctgggattacaggctcgtgccgccacacccagctaatttttctatttttagtagagacagggttttgctatgtttgccaggctggtctcgaagtcctgccctcaggtgatcctcccgcctcggcctcccaaagtgctgggattacaggtgtgagccacggcacctggccagaatagtcttttttctatgcatttattatgagaacttttccagtggaatttgaactcaagtctcttttactccaaagcccagtttttccttctgcatcagatggtccattcctagacagtggcactatgaaccaaaagacctgggttcctcactcatctcttggactcttagctaaggaatatatggtgaaagaatatattcaactgaaggccaggcgccgtggctcacgcctgtaatcccagcactttggaaggtagaggcggacagattacgaggtcaggagatcgagaccatcctagctaacacggtgaaaccccatctctactaaaaatacaaaaaaattagccaggtgtggtggcgggcgcctgtacctgcttgggaggctgaggcaggagaacggcatgaacccgggaggcggagcttgcagtgagccgagattgcgccactgcactccagcctgggcgacagagcgagactctgtctcaaaaaaaaaaaaaaagaatacattcaactacaaattttctcagcctatttctcttttgcttgagtcacaaaacattcacctactttacccagagggtataattaaaccttttctaatacttgctttggatgtatgtttcatatatattcttaagtagtgtagagggtttcttcagtctgcccgaaacacatgtaatcagctcttcagtcacagtaataatatagcacgtgtgtaatgttttacaaagggctttcatatacattatctcagatgagcattaaagcatgctgtgatataggcaaggattattactattagttcatttaatggattctttttaaaaagactcagagaatttaagattttccataacatccagctaagaaataataaagctgagactagaactcatgtcttctgaatccttaatctagggtcttttggccttctttttttttctaatgagatttacaaacataactaaaaatatatctccagcttcccttacctcttcatttgtttaaggcagattcttcattttgctgtaacatcccatcctctgaatagatatggcatgaaataaagtggtagcacctttttaacccaagtaaggacagagcgttagcaaaagaagaaagatcctgattatatttgactgagagactcgcattccttctaccccacctcccatctcccttcaccattcatactgtggcttcttggggaagctcatgacctgtttcaaagagcttgattgtagtcctgggccatgaggaaatgcatgagcaaaagcagcaatggtgagtggctgatgacctcaagaagaggccatttgatgtcgggcggtaagaggctgtggtcaggaagcactttcctccctgggccatctggatgcccctgcaggccgccaggctgcttgtgcccttatcccttcaccctcagggaaccttgctttgttgactgacagttgggttggcatttggtctttatcatcagggattcttcacaatagtgcaagccctaggaaggcgagccagcaaatcgttctagtctctgagaacaacgctgacctagtgctctccaatctggccatgcttctgctgggaaatgaggggatagtggggagaaccctggagggctggattttaatccttgtagtctgtttgaacttgggcaagttattgatctctgagcttcagcttagttcctttttaagtaaattgtggatactaacacctatcccgttttttgtttgtttgtttgtttgttttttttgagacggagtttccctcttgttgcccaggctggagtgcagtggcacaatctcagctcaccgcaacttccgcctcccaggttcaagcaattctcctgcctcagcctcccgagtagctgggattacaggcatgcaccaccacgcctggctactttttgtatttttagtagagacagggtttctccatgttggtcaggctggtctcgaactcccaacctcaggtgatctgcctgcctcagcctcccaaagtgctgagattacaggtgtgagccaccacacccggccccacttatttcctcagattagtattgggaggcgtgagtgacctcatgtgtaaaggtgctttgctcaaatgcaggggacctgctctgaaggaaggggctaggctctgggagactgttttaggggacctgtcaaactgagcagtttttaagatcagaaagaattgttttctcccctcacccttggtgaggaccagcattgcctgccagggttacacccatccctccaagccttccgccctcctctaagaagtgagattgtaactcagccactattgggctgtgacatttcttcgcctctgaggcacagccaagaacatggcctcactctccctcccacccctctttcctttttcctccctttctcctgccttctcttcatttcaaacaagtgagttgtgttagttggttttttaatgaggtttttccagcctcttgtttttttgtccttgacaataaagaactcccagttacccaaagctgaaaataaaatttggcagaagtaagccaaaagtatagtctcattggtgttgatatttttaagcctctcttgagagagagagacagagagagagagagagagagagagagagagagagacagagagagagagagagagagagagacagagagagagagagagagagagaggtggtggggggtcctctgggagacaggggcaaatcgtcatggaataagaatctgtttgagcaccctggggtgaggactttatatctttttctgaaaacaaggcgccttcctttttttttaaaggcgtgttgtggctattttgatgccttttgaaagtgccacagttaatttgattgagctgctaagcagttggtttaaaaaaaaaatgaaagaaaaaggagaatggtcacatggatttagcatcacacggggaattcgctgtaacccagccatcttttaggcagctgatgaccacgggccagattgttcatttcacaaaggggaggcttttaaaaatgagaagacttttgtctagagcccaaacttccccagggggaaggactcatttataacccgttctgattattcttctcctctgaaatctcactggttgaatatgaatttatgtggagcactcagctacaacatggaaataagtagtgcagtgagcagttagcataagggagttccagccccgggttctagtctcagctttgaccctccctggtaagctgtataatcacaggagtggccctgaacggacttaggatttggttttctactctgtgaactgaagctaatttctcctacctgggaggattgatatggaagagaaaagttgttgataatgtaaaaatgctttgagaaatatcttagctgttctcaaaattataaactcgggagtgtggagggggttggtgaatttggggagaaattggtgaccaagggtctccagttccttcctccatatggcatctctgtcaaaagttgagcctctgtttccttaataggccacttccctccaaggattcagggaccattcatcaccgtggtgcctagtccccaggaggtcagtggcctgctgcggtgctcagctgctggtaagtgatccagcagaagcaggcagccctggcttatccatggccccctggcccctgtgtgggttccttggctccgtgtttctcgtctttcccagacgcttcttcccttcttgtttgcacattcttcctggaggaaaatgatagctcattgtcaaaggttgggcgggagacgaggtaagaactgttagtgtctgtgagatgtttggggatttccagctggaatcctcacacttctttggctggagccgccttcctctgtgttctcagtgtgctcttgtaaccctctgctagatcacttagcacatgggacatactgggactcttcccatcaggctgcaaactcctccagaggcagggaccccatccttctgattctctgtatccccagtgccagacatatgctaagcactcgagaaatgtttcaatcagtgagtgaattagaggcgggagagaccctacctcctttatcatacacattgatgaaactgaagcctagagctaatatgtgaggtgatcacacagaggatactagaactaggattagactaaggcagagattcacccatttgacccctgcaaggctgatcactgtcagggcagggcagggagaggctgccccgagtatgtgtggtagtattaatatatgtacatgtaatatttgtgtgcgtttaatcccagttctagtatatcctgactatggtatatctatatatatcctgaccccgggttggctgtgtgttaaaaaatcaaactgaaatcgcctccaaaaggaaggcagcactgaatgacagtaaagtaagggctgggcctggggtcagcagcctggcgtccagccctgccagccactagctgtttgaccttggctgagtcatttcctctccctcatctcatttgccttgtttataaaatggtatccagccaggcacggtagctcacttctataatctcagaaggcgggaggatcagttgagctcaggagttcaagaccagcctgggcaacctagtgagacctcatctctatgaaaaaaaaaaaaaaagaagaaacaaaaaagaagatgtagactgtgtgatctctgaaatttctccatgttcaaaagtctaaccttcgaagacttctaagagttttagaagaaaagtttgagctgctagaggagaaagaggaaacagtttaaaaattaagttagagagttcttgcaaaggagatgtttttgttagagacactgaaaattcttctcttaaaaccatttccactagaggccatcccaccatgcacagttagcctgggctttaaaaccccgctccctccactgccaaatgagttgctgatgggaattttttgaatgtttgactctgtgtctctgtggaccacaacaggaccacaggctgttacacagttagcatttaacttacattatgaagtgacagaatcgcacttgtgtggctgatagagaccattgcaagtaactaacaaccgtacaaatagcgccctgaccttttcatatctgtggggcctgattctcaacctccatcctgtcctgcacatactcggcgtggcctctccccaccctgccctgaacagttattagggctcacagggcttgcagggtgaccctctgctccagggatatgggcactgcctggagggtggtgagcctttcctgggaagacctgcactggctctccctgagggctttccataccaattcattcttggtcagtggcaggcacatttcacactgaattccaccccatggggctgtgtctaattggacaaatttgaacagcaggcagcacagccactgccgcagggagcattgatatatggcccaagcaagggactaaaatcttaaagtgacagggccccgttttcaaagaataactggctggcttccaggagtaacaggcctgatgatgaccagcaggagagagatgggccaactccacaaagcaggggcttttttagggaggtgtttttgaaatgagtgtctccatttttcctggtcttggtggcaagataaacaggatagggtggtccctggggacagtcatctgggacccagtcatgctgaatgtttctctcactagagactcactgtatctgtatccagattaaatctggctaatatatactgcagggaagcctcggcagagaacagagtgaaaaatcgtgttgtcatacattactaagcacccaccattcatttgtttggcatccatcaaatctctataaatgctaactgtgtgtgctattaaatgcgcactgcccggacacagtggagcttgtgaagtttgtggtctaggaggggaaaagacattaatcagataatctcacaaattaacataattacaaattgtgtgaagtataatgaaggaaaaattccatgtggtatgagagcatctgaaaagggtatgcagggagagtttccctaaggaggtcccatttaagcttggctctaatgggtgagataaatcagcaaagggagtaagaggggaagaggaaaaagaaatgcttaaggagttgaaagagggcctgggtggctggagctcagcacctaagcgggacaatagcctggggtgactgtggggtcttgctgctcatgtggactttagttttatcctaaatgagaagcatgttttcagcagagggtgagttttgaaaagatcactctgaccttactgtggaagacaggagactgttagagaagtcgagtagaacatgatggaatggattaggctggcccagtagcaaatagaagtggacagtaatgagtgttatttaggaggtagattccacagggctttgttacggagtggacatgggtgggtggagaggaagagatgttaaggatgctccccagttttctggcttacttcactcatttgatgtcattcactaagagctcctagtcacatggaggaggaggcttggatacattacatttccagtggatttgaagatgttaaatctacagtcagatctatgggtcttcagcacagaagaggtgtttggtctaggggtttccttaggaaagaatggggagagaagaatgggaggtgataaaaagatggattggacaccatctctccctttaggcaactcaaaatctatttgtatttgttgttagaggaagaaaagaaaaaagaaataacaaatagtagaaggaaaaatatttttaaaggaaatataaaagggcaataaaatttttaattaaaaaacaaaacaggccgggcgcggtggctcacacctgtaatcccagcactttgggaggccgaggtaggcagatcatgaggtcaagagattgagaccacctggccaacatggtgaaacctcatctctactaaaaatacaaaaattagctgggtgtggtggcgggcgcctgtagtcccagctactagggaggctgaggcaggagatcacttgaactcaggaggtagaggttgcagtgagccaagattgcaccattgcacttcagcctggcaacagagtgaaactccgtctcaaaaataaaataaaataaaaataaaaataaacaaacgtttaaaaaatcaattttagaggcaattggactacagagtcaaggagacatttacaagttaatataataaatgtaaatgtttatgacatcatagaattgtaatgagactatattgagggttagataacaggcaagtatgtggagatgagggagcaaatagaaaatgaagcaaaatttttttttttttagacagagtctcactctgtcacccaggctggagagtagtgtagtgtcacagtcttggcttactgcaacctccgcctcccgggttcaagacattctcctgcctcagcctcccgagtagctgggattacaggcatgtaccaccaaaccccactaatttttgtatttttggtagagatggggtttcaccatgttggccaggcaggtctcgaacttctggcctcaagtggtccagctgcctcagcctcccaaagtggtggaattacaggcatgagccactgcgccctgcccaagatctgactgaataacacaaaggtgacatccagttcaaggaacttagtggtaggtgtgactttaaggtttgcaatggttgatcagacactgttggtgtaaattggtgcaccctttttggaaggcagtttggtagtaaccattatacattaatagtttattctttttcacccagcaatttattttctaggaatttattccacaaaaatataggtaaaattattaaggtatagacaaaagcactgttgtaacggcaaaggaaaaaaaatgaaataatttaattattggtctgcagagagagtaacaataaattttagtatgcacatatcgtggaataacctatagctttaaaaaaaaaaccttaataacatttttaagttttaaaaaagcaggtgaaaaacaatgtgtataatatgatcctatagagaaagaaaaaactagtagaagcataaagctccattaacagtgcttgtctctggggaagtaaacaacaaaaacaaacagggaattctcactctgttttgtggttttatatagttaaaatagtttacaattaccattgtcagttaattcagactgctataacagaataccatagactaggtggcttaaacaacaggaagtttatttctcacagttctggaagccaaagtccaagatcaaagtgccagcaagcctgggcacagtggctcacacctgtaatcccaacgctttgtgaggccgaggctggcggatcacttgagcccaggagttcaagaccagcctggcaacatggcgaaactccgtctctacaaaaaatataaaattagccaggtgtggtggtgtgcgcctgtagtcccagctactcaggaggctgaagtgggaggatcacctgagccaggggtggtcaaggctgcagtgagccctgattgtgctgctgcactccagcctggatgacagagtgagatcctgtctcaaaaaacaagacaacaaaaacaaaatgccagcacatctggtgtgtgctgaggacccactccctggtttacaggtagccatcgtctttctgtgccttcacatggcagagcatgaagacgcaggctcttttttttttttttttttttttgagacggagtcttgctctgtcgcccaggctggagtgcagtggtgcaatctcagctcaccgcaacctccgcctcctgggttcaagcaattctcctgcctcagcctcccgaatagctgggactacaggtgcccaccaccacgcccggctagttttttgtatttttagtagagatggggtttcaccatgttggccaggctggtcttgaactcctgacctcaggtgatcagcccgcctcggcctcccaaagtgctgggattacaggcgcctggccaaagcaggctctttttctaagggcaccgatcctatcatgagtactccacccttgtgaccaaatgtgccccaccgccaaataccaaaacatcaggggttagggttaatataaactttgggaggacacaaacatccaggccatgttattattattattattatttttttttttttttgagacggagtctcgctctgtcgcccaggccggagtgcagtggcgcgatctcggctcactgcaagctccgcctcccgagttcacgccattctcctgcctcagccccccaagtaactgggactacaggcgcccgccaccacgcccggctaattttttgtattttttagtagagacggggtttcaccgtgttagccaggatggtctcgatctcctgatcttgtgatccaccggcctcggcctcccaaagtgctgggattacaggcgtgagccaccatgcccggcctatgttgttatttttctaatcagaaataatagtaaagacttttgaagagaacagaagtgagagggcaggaatggtgactgactatggaatagctccgggtgagggtgaggaggaggaaaaggggttccatcctacgttcgtcctcggcgctcacctcctccaagcttacctgcagggctttgctgcacttatccatgaagaccgcaagacgccgcttacctgctcagtcttcgagcagctgtccctgattatgaagttcagagtggctgtttaacgagcatttagtgagaatttccttttagcagacactgttaggcgctagaaatataaaaatgaagaagacaccgtccctgccctaacagaacttattgttgagggggagaaattgccaagtaaaccaatgttgcagtacagaatttagtctagatgcccggaggtctcttctgagttgaaaagccttcaattcactgaagatggtctctgaaatttctagttcttttcataggctgagagaagggctaagagtaggttttttatttcttcgtttcttcctaccttccttcccttcccttttctctccacctcttctctcccctccctccctccctccctcccttcctttctttctctcttgagacctggtcttgctctgtcacccaggctggagtagtacagtggcgcaatcacggctcactgcagcctcaaactcctggccttaagtgatcctctggcctcagcctcccaaagcactgggattacaggcatgagccaccatgcccagccagtagtttctcactttcccaagtgttcactttgaattggcctgggcccccaaatgcaggccttcattccctgggcagcaggacattcttctcagtggaaggttttatgaaagaggtcagcatgtgcctctgcggccagtggactaagtccatgatgaagctgagactcacattcccacgctatagactccatagcttctcagacctccacagccacaggcccccaggagtccccctgcccatctggctattcctcagaaacacacaccagtgagcacacaggggacacctgaagtgcacagaggactccggcagcaatggccagggaatgaggagacccgagttctaatcccagcactatcactgtactccatagcatgactgggaacaagtaactttctttccctgggcttcagtttcctcatttgcagaatcagccaatggtggtgaatggtctctgccagcgttgacatcctgtaatcattgtcattgtgtgacagttctgccatctctctactaggtcaggtgaaaccacctcccaaagggcctctctgggcggtgagtgtgcactagcacagtgccaggggagctgttgaacaaatgcaactccttgttgaaaactactataggtgctttccgtaggggtgagaaaagcatataagaccatgtcctgcgttctgggagcttccaattttcccagaaaggtcagagaaatacacatgaaacagatgaaacagtagcagccctagaagcctcagcacacaggggtaggggatggagaagatgggggctagagtgggaggggggctttttggctggacagttgccaaaggttcctgctgatcttcagagtttttcctttcacaaagcatgtgacaagtgctttgccttgtttcattctgggacgttctgttctctggatctgtttctgacaggatatgatcactggagcttccaaaatttctttgggagtggggagagggttggcaagcagccagatgcccctgtcgctttatttggcacaggaggaggtcaccaggttcaagcccagaactagttcaaaactttagcctcaaggaaaaggtccaggccaggcacagtggctcatgcctgtaatctcagcactttgggaggctgaagtgggaggatcacttgagcataggagttcaagacccccctggacaacagggtgagaccccatctctatttttaagtttttatttttaatttcttttaaatggaaggaaaaaaagaaaaaggttcaaataatataatccttcctacatcccactcctagcagtgtgggaaagtgaaaggagaattcttgtgacgagaactcatgaacacagaacaaatttgtgtcactccagtcgagcgtggcttctcagtgtgtactcagcacgtggcaggtgtgattgttggcctgaggtgatgacctgcctgaatcctcagcccatcaccagggctggcaagagctttatctgcccataactgagcccatgatgggctcgagtggtatgcttttttggggtttgtaccaaaccggcctttttccctgtttcatcctgtgctggtctgtctcttttgcatgtttgggctaatcttctccatatgcgtgtctggtttggcatgtgggtctcgacctcccatgagcagggcgaggctgcctcagacaagtgcagagagttgccacccagcccgccgggctctggagctgggccacgggctcctctctctggaaaggctctgcagagagacacctggatggcttctcttctatgtttcggggacatgagaagaaggcattcttagaacagatactgcctggtgacccacctaaaacagtcttactaggacagcaggcttaaggtatgcccagcgctcagacacctagtcatccaggccctgaacatcctgctctgactacagcgtcccctcccctccctccaccatccgagaggtcagcttccttcaccatgggagcccctgcttgccatgtttgtgaggggcaaacacttcactggttggtagggcttatggctccatattgaaaggagggaaacaatttgacagcaagaaaagaatctcctaaagagactgttgcagttttacagagttctttccaactgattgcctctgctaatctctatactaccctgtgacataggaattattatccccatcttttattattatttttttttattttttgagatagagtcttgctctgtcacccaggctggagtgcaatggcatgatctcggctcatagcagcctccacctcccaggttcaagccattctcctgcctcagcttcctgaatagctgggattataggcgtctgccaccacgcctggctaatttttgtatttttaggagagacggggtttcaccatgttagccaggctggtctcaaactcctgacctcaggtgatctgcccgccttggcctcccaaagtgctgggattataggcgtgagccatggcacccggcctatccccatcttaaaaaggaggcagctaaggctcagagaagtcatattacaagtctagggcagagcggggactatattctggcttcctgactctgagttcagtaacctttctagaatactgccctccctaaacctacactgctgcagcctggaggttccacaagccctttctcatagaccccagcaaggtgctttctccctggaccccactcacacctatttctggacctttattggcaggtgggtcagagaggacacctgtgtgatcagagaaacaaagtctggtgagaggagcaagtgcagttatgcacagggagcagctggtccctcagaccttgccagccacttctgcggtggttgtcggtcttggaaaagctccatcttcagaggggtttgtgcccagcagctgatctctgcctgtaatcttcagagggcaccagttcttaccagacaatagctgtctatgacctcaagccaggcctaggacaaagtggagacgtcctgtgaggcaggcaggcctctgtctcagcatcaccaatagctcaccctcctgtccactcacattgtggcgcccccgacccttgccaatcccgtgcaaaccacgcaatgtctgccagcgctcactgccttcctgagcccaacagcccctttcttgcccactaaactagcactagagctttatcaagttcttgaaactttctttttttttctttttttttttttgagacagagtctcgctctgtcgcctaggctggagtgcagtggtgcgatctcggctcactgcaacctctgcctcccaggttcaagcgattctcctgcctcagcctcccgagtagctgggattacaggggcacactaccacacccagctcatttttatattttcagtaaaatggggtttcaccatgttggccaagccggtctcaaactccttacctcaagtgatccgcccatctcggcctcccaaagtgctgggattacaggcatgagccatggtaccctgccaagttcttgaacctttctggtcatttgcttccctgattgagagatgagtcagcattcatatattcattcattcattcattcagatattaattcaacatataatttgatgagtccctaagagagccctagagactcagaaaggtaatcagacacaatctcagccctgcaggtcttcacagcctagcaagggagacagatatgtagacagatgatcatgatacagtagaagtatcaacaaagagcttctgagctcatgtcaaagccatctcccttgaacacagatgagagagggaggatatggggatcaatagttacttccttagaagtcatggaaaaagcacgtaggagacaagggtgagctggatgaccttgggcaagttatgtaacttctctgagtttcaattctctcatctataagataggatgataaaacctatgttgcagagttatgttgtaagaataatgggccgggcgcggtggctcacgcctgtaatcccagcactttggggggccaagacagacgaatcacctgagtcaggagttcaagaccagcctgaccaacgtggagaaacctggtctctactgaaaatacaaaattagctgggcgtggtggccctgcccgtattcccagctactcaggaggctgaggcaggataatcgcttgaacctgggaggtggaggttgcggtgagctgagatcgcaccattgcactccagcctatgcaacaacagcaaaactccatctcaaaaaaaaaaaaaaaaaaaaaaaaacaccaagaaaacgatgtatccagtcattgagccaatgtcttacacataatagatcctaagagggcaaaggagccacgacaaatgttgaattgtatttttgggaaacctaagtgtcacaggaacagctcactgtaacagcaaccggtatttattagtgcccagtaaatgcttgacccactgatgggccttggcccagtagctaaggctgagagacctttactgcacctggccttcgcagaagttggtctgtggatggggagagcctgaacctgcctgaggactgaacctgactgaggtcctgaacctgagcacaggacctcagttacctggccactgtggtcatcccaggggcacccagaacagaccggagttcttcctcaggcacatcactgccccagctttcagcctggtgtcattttcagcccatttctttttctcaccaagttgactcagcaaacttcccttaggttcccttgccctttaggcaagtctgcttccactaaagtccgcaggccttgtgtgtgctctgtacgttcacagcagcgattccttcccagggctaggagggggactttcccctctggcctaacatgctgaatcgtcctttccagggcacactcgcaatgtgtctatagtcaaggtccctaatgttgcaggagcacttcttcccctctgactcagaactactattttctgcctgttgggtctcatcaaagggtctgggccttttttccagttgtaagactctcagcaatgacgccaagatgccctttggccactgctcttctacagctgcctcagctcagagctccggggagtcagggtccctgtgagtcaggttttgcaggagagcatccactccctaggactgtgccttctcctctgggtgctgactgacttctctgagaaatgctcttctgggccaggtgcaatggctcatcctagcactatgggaggctgaggcaggaggatcgctagaggccagaagttcaagaccagcctgggcaacaaagcaagaccccatctctagaaaaaatcagaaaaaaagaattgcctttctggctttgagagttaattgcctttcatagaaactggaagcaagggagaaaaagcagcttctggttgtattttcttctcagaaatctataaactccaatctggccaaaaacgcaaagcaccagagtctgagctggagagtgggcacctgagagggtaccgcccagcctagcagctgtggctgcctgccagattgacagctgtctttagacctcaccccaaggggctgccagccccccacctcggggagccctcgctcccagccccctttccatacttttcagatacagggcgtgtcggctttcctttcgcgcctccagctccagaggccctggcccagtggtgctgctctggatcaaggcctcgctaaactcccagctccctggtttgcaaagcaaacttcagccttttactatttaccttggcaagtccaggaccggattgatgatctgtaaagtggatttgttatttggctgtttgctttggcagctcttgaaagcactttgctgattacagtcccagatgtcattgcatacattaccctgctctataacggggctttgaacactttaatttgaactacaaatactattaagctttttgcacctcttctgcctttagttcttggatattaaatatcggaacagacagcctgcattctcttaggcttctttcccctggtctttgtcagcgtcctcccacggagagcttcaagctttcttcctgttctctgtgggtctttctagaaaccttacccacctatgcccacctctagcccagctacgctggcagcagccttgccagttttcacataacaggctttctagtttggaaggtgcactgtgttcatgccaagcctggcttccccgcagtcacaatcctttgtactttgtactggggcttcatttcattcatccacaggggtgctgtatccattttttgtttgtttgtcttaatgttactgacaactttgtttggggaaagctagatttgggggcatgaatgtgtcatgtcattttgcccagagaggaaaagtcttgcccaaggttacacagaaaaggcagcagcagaactttatcctttctggccaggcgtggtggctcacacctgtaatcccagcactttgggaggccaaggcgggcagatcacttgaggtcaggagtttgagaccagcctggccaacatggtgaaaccctgtctctactaaaaatacaaaaattagccaggcttggtggcacgtgcctgtaatcccagctactcaggaggctgaggcaggagaatcacttgaacctgggaggtggaggttgcagtgagccaagattgcctcattgcactccagcctgggtgacagagcaagactccatctcaaaaaaaaacaacaacaaactttatcctttctgaactccaagcctgatatttctgcccaggctcccttttttatactttatttaaatcgcctcacccgagtggaacagggacgtgagccatgtcagtgtctgtaaatagaggcagttgcaggttcacgtatcttgggaagttattggtggagagcactggtgttcctggctaatgtggggtctgtgattcagtgttctcccaggtcagtgctgcttccgttgtaaataaaccattagctgggggcctcacctcaggaagcaatttaaggcccaagagaggtggccaaagaagtcagcttgcagcctctaggaggagacgcttggctttgcccacagccctcggccccaggtcttcctcttggagcaacaaaatgctcccagggatcctcctgccaagatcctgccaggcttccctcgcctttgatttgccaaattccatgtgaacagcctctgcgtctgttactctccgaagaaaattacagtttctagtacacctaaactgaatgttggtgggattgtttttattgtttttttttcctttttctttttgcgctcaccccttaaaggtcgtttctgatctactccctctcctctagccttaaagtgtccactaggttcttggctgaaacctttcagcatttcacaaggtgttagagacagagaaagcctccttgttatggagaatttgtggtgtgcctgtgaatatttccaccagtcctgcaaggaagatagttctatcccattttatagttgaggaaaccaaggctcggtgaggtaaagcgcttcatccagtaccccacagctctagggtattgttagtctgggttctgacttaggaactgcagcgtcccttctgtgttgtgagcaactcaaagttaggtcgaatgtcacgcttaatgttgtatctcagtgactaaccctgggcccggcttatgttatgttaggtgccccataaatatttgttggatgaataaccataaatccactcaagtggttctgattttaagtgactgtgtcatccctgtggccagtctctggcgggggcggtaggggacaaacactttcaactttgaaatatttcagttgaagaagttaattcactttgtaagtttactttaggagtagagattattgcagtatttttggccaccgctctcaaattcttctaaacctttactataataagcaaattcagcagattaaggacatacttaactgccaaatggtgttctgaactgtgtaaagttaccagagtcgcttttttttttcttatataaaagattgtgtgggttctgtgaacttctctgctttttttagctcttcctgttttattgtgtttgaagtatctttgtggtgacctgttgggattggattcttccatatggaagtgtttctttaactttttaatcatttcttttgggaagtaggttaggggtagcagatgttgttctggcattgtttgccgagtggaggtaggggcttttggatctgtgagtcaggccaaagccagcctggaagaagaaggctgtcccaggggtgggaggctgcccatcactgttggatctggcagtgcaggcccgcgtgggagtcgtagctccctgtgtcctcactctgagtaacgccttttccatttcctaggaagaatacattttcccctgtgacactgaaaagttattttttttcagtgtcccaaggcaaattcttatcagtcctcaaatgggaagcctatctggtgcccttactgggaaaaaaaaaaaaaaaaaaaaaaaaaaaagcagaaaggaaaaacagcaaataagatgaactcttctttctcccccttcatggcagtcaagtccctcttcataccccatttcttagtgggccaaagtttaacatcttggttttgggaaaaaaaaaaattcacaaagacccatctgcctctcccattttctcatgttcttttggactctattactcaatcagtgacatgtgaccccctgggaaggttgttctgtggaggatgcagaaactgacgattggcagtcatcttcccagctctcggcttcaaccctgattctgacagtggcaggcgccacttgcccttggtcggttttactccctgcccctagtgcccacctctccttcatcccaggtcacacccaaaagccaatgaagaaagggttttggtttggtgagtgcactggctcccttggatccaggggataaggatacaatgggaaggcccatgaagccgcctaaaggagctcaaactagcatttcccttggcattctattcctttcttgaccagaccaaggctttgcaggtaaactagggaatctcagcatctaaagactgaggaggctggaaacattggctcaagcctgtaatcccagcagttgggaggccaaggtgagcagatcacctgaggtcaggagttcgagaccagcctagccaacatggtgaaaccccttctctactaagaatacaaaaattagccgggcgtggtggtgcccatctgtaatcccagctactcgggaggctgaggcaggagaatcgctcgaacctaggaggtggcggttacagtgagctgagatcgcgccactgtactccagtcggggcgacaaagcgagaccccatctaaaaaaaaaaaaaaaagaccaaggagatgagtggaagagccagtaaaagagactgcaaagtagcggccggaaagatgggaggaaaaccaggtgagtgtgctgtcccgaaagccaagtagagagagggtcaactatgtcgaaagcacacttgacctgctgaaagatgaggccagatgataactgagaaatggctgtgggattcaataatgtggaagtctctgcattaattgatttgttgaaaaagaaacggggacgacattaactttggaagagcggtttcagtacagagagggggcaaagcctcattggagtgtgttcaaagagagaaagggaggaaagcagttgtagacagcaagtccagacatctctttcaaggagttttgattaagggaaagagagaaatgggggcggtaactagaagaggaaatgaggtcaagaaggtctttctttttttctttttaatggaagaaatactagcatagtgatggcaagagggggtgggggctggtgcatacatggagggattgaccttggtagaaggaagggggactgtgtatacacagatgcagggggtgggtggattccaggacaggactttaaatacctttctgatggcttccattttctcgatgaagccgtcatctaagccctccactgaaagcgagaatggtggagaagatattgacagtttgagggtagaggagaaacgatgaagtaatcatttaggagggtgaaagagtgaatgcgctcaggaaatagcactggagggcagcattaaaggtccgtctggtgtgagtgatcatcaggtcaggctcagacccgttagcatggtgtgctttcctccctgctgtgagtcgctgcgggggacggggagtgggtagaagttggatttaacaaggttgtggtttcaccaggccggtatggccaagggaaagagggatgcagaagctgagagtgtgtgcaagggactgagtctaacaactggatgtggtgggaagagaggacatggagttgggggatagtgaaaagcaggcgggatcaatgtattatacaccctggtgaggctgaaggctgcttggaattgggttagcagaggcagagaaccagaaggagaagagacaacagtcagtgtgggatatatgagattaggattgtgatgagatttgcagttattgttaattccatcaaaggaagagccatggcagtgagtggcagaggggatggagaagggcgctggaagggaggagggtcagggcctgagaggccaggttgctgacagggtcatctgtgtgagtatgatcgggttagtgttgtgacactgttagagtggcagtgaagcagaagctggaatcgttaaggaatagggagtgtgagtgtgctgagggcatggggcgggcacaggaacagactgtaacaagaaggggcagtgggtggaataatcttacaacacagtcaaagttgggggttttatgaaagaaagaaaagtctgcatctacgaggagcaaaaagaacatcagctcccaccctggtctaagggatgagagagagaagtcagccaccacaggagaggactccggggcaggcggtgtcctcagaggagagcctggtatttccccaaatacggcagtttagaatttacagagagagtgagcgtatggacacttcctgttctatctgatcctttcagtaacccttcaagtggagaggcaggtacattatccctgttaggcacataaagacactgaagctggtggagccggaacactggtgcagtggcactcagcccgctgctgatggatcctggtcttctgactccaagttcagtgctctttccacagcatcatactgcctgcctttaggaggccagcagtccctccacagaacccctaaaatcacactcgattgacagttgcaactgaaaagcacacccagtccaaagccgcaatggttgttatcacgctgcttccataaagtgagattcagcccccaaagatgggttcagggagtggcaatcatccggccttttctctgcgatacccaaaatatcttaaagtcagtagccagtactaggacacaagtgggtactccctttcagggatgatttggatagcaatttttggatggaaatcatagttttaagaaagttccgaggccacaactttctagatatgatagacagaaaagtgattatgagacgtggacaggcagtgggggcaatcatgaacttcggacagtggtttagggcttggttcttttgagacagagtctcagtctttcgcccaggctggagtacagtggtgtgatctcggctcactgcaacctccacccctcagggttcaagcaattctcctgcctcagcctcctgagtagctgggactacaggcatgcaccaccacacctggctaatttttgtatttttagtacagacgaggtttcactaaatctccattcagaagctactctggcaccatacacaacggtgcacaattgaagggcttgttctgctcctccacatggcacctttagaaacgtcacttccccaccttgtgtggcaacagccttggccaacgtgcttatgaagagccatggcaggctggtcttgaactcctgacctcaggtgatccacccacatcagcctcccaaagtgctgggattacaggcatgagccaccgtgcccagcctagggcctggttcttaagaacgccattcccttcttgatcctcaggcccagtgagtgaggcagtgtggcagtccaggacctcccaacgccgagcacatcctctctccttcctcgctggggcagatgcttacacaggtagagagcccaagcccaggctagcagcctcagttgctcagtcatgcagcaggcgtatgctgaccccctgttacagtcctgggcagacagagatgtgcaccacactacagaaataaacacagtaaagggctagaggtttctatcatgtactgtatgaagagattttcttttcttttttttttttttttgtgagataaagtctccctctgtagcccaggctggagtatagtggtgggatctcgactctgtaacccccgcctcctgggttcaagtgattcttctgcctcagcctccgaactagctgggattataggcatgtgccaccacatccagctaatgtttttgtatctttagtagagacagagtttcaccaggttggccaggctggtcttgaactcctaatctcagatgatccacccacctcggcctcccaaagtgctgggattacaggcgtgagccactgagcccagccgagattttcttttaaaggaaggtgagagagtaacttcttggccaccttatcctattttcccaggctcctgggccaccgaggagggtcaattcgtggaggggtggcaccaaatgcctctatcatccctctctgccatggctcttcataagcacgttggccaaggctgttgccacacaaggtggggaagtgacgtttctaaaggtgccatgtggaggagcagaacaagcccttcaattgtgcaccgttgtgtatggtgccagagtagcttctgaatggagagaattacacaggtctccgtcctgttctctaagtaccaatggtcaggcagacacaccgacccaggcaggagcagcgatctggccatggtttatagcaacagggagtgcatcagaatcacctgatgagctttttaaagatacagatgcccaggccccaaacttttgccccagaagttctgactctagtctggagtgggccttgtagctccatgcatttgaaaaactcacttgatgtgaggccccttggagaagtactggttgaggaagcgtatgcagaggtttgagccaaacaactggatggcaaggcaacagacatcccactgccgttcctctgccacctctgagtgtgatcagatgtctctcctgtcagattccctttccaatattatcctccaggaacttgtgattatcctctgtctaagtcaaaagcagcttaattcctctaaaaacagtgcccgttgggcattttgcctggagagagagaagcaaatctgtgtcagcgttctttgctcagttctgctctgcagcccccatggcgacaccctctctctttggaccacctcctcccctttcgcttccttccacacagtccagtgctttgttaggtacctgcatcccagcaggactggggacctggctggatgtgggcttgggtagagttggccagatgaaatgtggttggcaagaaggtcctgagtgtgctgagacaggcaagagtcagtaataagatcagagagtagaagactagggccaggagcgtgggacaggctaaggatgccggctagcccccaatcccagagagcatgcagctgagtctaagagaggcttcactgatacccataaggaggcggaatatgcaaaccctctttgcttaggagaacctgagttcacctgccaaaatcatcctttgacattaaaaaaaaaaaatccccttgcttttaaagagccaacctcttaccagttgcttctcttttgtcagagacatgggcctcttcaaccaagtctctgggtcttcttgtcaagactaatttccttttaggcccagcttcatcttcacggggactttcttccatctgtgcactgatgttagtgtcccgttgtcatttaagtccttgattctctgagaccactatagagactttaaagaaggtgggtcctaagttttgagggtaccatggagagcaaagtagatgatatctctgcccccatggggcttatattctagaggaggaaacagccagcagtggcagtagtgtgttacatgctgatagggcaggttcagggcacctgacctaacctaggagaggatcagaaaaggcttcccagaagttcgatttaagctgcagttgagggatgagcaaggcgaagatgtaaaggccctggggtgaaaggaaggaggttgttggagggactgagggaggttcatcatggcttaccaaaaggaagggagtgggagagatgagccatgggaagccagcagggcccaggtcattaagtaagggacaaccatggcgaggagttgcaatgtcactccagccccttgtttgccaccatggacaggtattttatgattcctggatcggaaatacacacacacacacacatacacacacacacacgcacacccctcacagaaaaatagccactctgtcccttctcatgcggaggaagcacagggtaatctggattataaaccatccgcctggggcagagctcgcctgctgtcatcatcttcctccacctcgggatgccactcagcctcacacagcaccagctctctgatgaagaaaagaagtgacaagggcaaaatcaaaaactctccagaatgtattcagagggaaactaaagccgggaagagctgttctcttgttcccagccaacactcacactcctgcctgctctcatcagaggagactccgcttccgctatgcctgactggctggctgggcgattctttgggggctgtgttttgtgcttgtcactcccgccctgggtcacttttaggatgtgtggactgctgaatctttaaaggaaagaatgagcaagggaatctcagaggcagttagttggcaggttgtttgctgagaatgaggaaagagttgtgacaggcttggggagcttgaggagaggaagaaatacaggagggaagtagccgggaacccatggaaaaatgaaggagggagggaggaaggaagggaaagaaggagggtaggctgaggagcagggagcgcctagctgttaaatttgtcatggtgccatttgacacagcatgtgcgttttgtgtagcacagctcagcagcctggatggttcatcttgatgggtttggcaaagcggaagtggcagataggctaggaggagcagaggtggggactttacggtggacttagtgagggtgttagaggacctatgagccccaaacacggggatgggcagtgaaggagtggcaccaggaggaagccagtagattgggatgatagggaggactccaggggcaagcaggctccttgaggccaaacagcatgattagaataaggaagtgagtgggagagacaaataggaagttttatgatgaatatgtgggctttctaagcttaaaatcctagaagggccaattgtagacgatgagtgagttgagtgagttgctggagtgaaggtgaaggtcgttggtgtgcggactggaggtcagtgaatttaaggccaaaggtgttggcttggtcatgcacctgacatcatacttttagtgcttggcaggagtggttgagaaggtaacagcggggtaggtgccataatccttgttgaagtcgaggagttgacttagaaggcctgcagagtccagtgacaaggatgtttgggacagattttgtgagctctgagcttctctcctgactggaagatcatttctttggaagaggtgatgtcatccacaaagagcatttgtattcctttggagaagaagtacttccttttattgtcaggtcattttagcatgattgaaaaatcaggagaaaacttttttaaatgcctgaaaggaatgttatatgagatgtctaaagttctggcctccggttccagctctgtggcctaatacaaagtcactttatacctcagcttctttctgaaacggaagagctgcctggggctgttgtgaggctctgtgggatagcagcacattcaagcattgactgtgtatcaggtgctgtgctgagcatgttcattgaagtcttactatttttagtattcccattttatagctgtataaattgagccaagagaggtaaataatttacccagggctatgtaactattaaatgacagaacaagggccttgaagcctgagcctttaaccatttcctatactgcctctgttaggctctgcaaatctaaaaataagataaagcaatcagtgccaagtgtaggagaaggcatgaaggcaagccacttcaccacagtctcatctacgctgtgttagagggttagcatgtgctgtggggatgtggtagagggactggttcctcatccagggtgactccaggaaggcttcccagaggagcttgcacttgggctaagtctcaaatctgcagaaggcagttcgtcatgtcacttggtcacttggcacctcttctcatgttggtctgaaatatgccagatcactgacctctccctgtgtcctgttttgccccttggggacacagaaaaattgattcccttttctataaaatcactctctaaatattggatttttgttttaacaaatttttttttaaggcagagtcttgctctgtcacccaggctggagtgcagtggtgcaatctcagctcaccgcaacctccacctccagggttcaagcgattctcctgcctcccgcctcagcctcccgagtagctgggattacaggcatgcaccaccacacccggctgatttttatatttttagtagagacggggttacaccgtgttggccaggctggtctcgatatgctgacctcaggtgatccacccacctcagcctcccaaagtgctgggattataggcatgagccaccgcacccggccagaatcactcttcagatatttgaatagtgaaattgtagctttcatattgtcttccccaagttaaacaaccttgatttcttccctcccttcttcctgctaggtgccaggaactgaggcactgtgctgtgcactggggacagagatctaaaaaatgaaaagccagatgctgcccagcaggaacttacagtctagtgggaagaatagggccataaaatattttattgcttttgtctgtctcctttaccaaatttcccatcatccagcatagcgactggtgcacaatagacatctgttttgtctgttgtggaattggtgactctaggtgctatgtgaaggtaagcctagggtgttgtgggggccggtaggaagacctaagtcagacccagaaggggagtggtagacttttccggctgacctaagtcctcaaagatgaataggacttcaccagggaaggcattccaggcagagggagcagcagatgcacagacacaggggcaaggcgcaaggtggggtgtagcgttcagagtctggaaagctgctagaggccagatgatagacagttgtgctaagaagattgggcttaatcctgagggcagatgagtaaaatgttcagattcacattgtagaaaaggtcacccaggtggcactaggaagaatgaattgaagggaagccacattaataggcggaaagaccagtttaaagattgctagaataatcccaatgagaactggtaagagcctaagcccagtggctaaggaaagtaggagacaaattcaagagggcttgggaagtaaaatccacaggacttactggtcagctggatggacgggcgatgtttgggccaatgagaagatggtgttgccacccacctaagtagggatagagaaggaagagcaagggctggagaagttaggtcatgaatttgtttgggagatgttgagttggaggtgcctgtggaacatccaagtgagggtgcttggtcttacgcagatggttttggagcccaggagagacctgagttagaggtgcagttttggaagtcagtagcatataggtagtactgggtatttgtaagcgttagagtagctgaactcacccaagaatagtttacagagaaagaagagaagaggactgagggcaccaaaatttgagttgcagagagaataaagcgaggccttgggagagacttgggagcggtcagagagggaagaggaaaactgaggaagctagggagtagtcagcaatttcccaatgaagtcaacttgctttatagagtctgggttgcccacaagggaccacatcattgtacctaagctgccatgatcatgggaggacagtcacgtgcttcttgcaacctcttgggcagagattcttttttttttttttttgaaacagagtctcactctgtcgccgaggctggagtgcagtggcatgataccggctcactgcaagctccgcctcccaggttaatgccattctcctgcctcagcttcccgagtagctgggactacaggcgcccaccgccacacacggctaactttttgtatttttggtagagatggggtttcaccgtgttagccaggatggtcttgatctcctgacctcatgatccacccacctcagcctcccaaagtgctgggattacaggcgtgagccaccgtgcccggccctcttgggcagagattcttaaggctggatttgaggacccgtgctttggagcagtggttcccaaaatccctggataagaatccagtcctaccctagaatcactgtgctggaatatccagaagggcctgagaattcatttgctcagtaagcattccaagtgcttcttctcatgagggaagtctgggagtgactccagaccataggttctttccaactgcacaaatcacacccccactctcccaccctacaccctaataccctccaacctaaagttcttgagaatccccatgatcatgagccactgttactgatggaaccatgtcatgaatccctcagatgtgtgggatggaaatgctaacccactgaccgaacagagtttctgaacaactgagtgggaaattctgcacttagattattggtccagtggaaattctgcacttagattattggtccagctctgcttctccgaaagcttttagaccagagcccctcactgccccctggtgtagacagtctgattgcctactccattttgtggaataatggacctgactgtaatccaacatgttttttaaagctagcatatgtttcaaagctgactattaaagaagtgtggaagaggtaccatatgtagacaaagaagacgtttttgggcaattgccatggaaagagctaactctacttttttatatatttaagacctaacactgcttcatgtccccagcagtggaattcttgaagaatgtttaatacatctgctctcaggagtgattttgtacataaggccttcgtctctaccaaaggtattagcatagaagcagttcagaaggccagtgccctttgtgtgaaattgcaaatttgtgaaattcaaacattgtcattcatttctgaatagttaagatcaataatctctcctgaacaattggctttgggacattgtctttctaggaaaaatagaaacataaattatactcatttaaatattgcagagagaagggacctactgagtagaaaactcaggaatgtgcctctaaggaacttagggacctctccttttttgggttcttttatttcattaaaaaatatataaattttggctgggtgccatggctcatggcattacagagtgctgtaatcccctccactctgaggtcaggagtttgagaccagcctggccaacatggtgaaaccccgtctctactaaaaatacaagaattaactgggtatggtggcacacacctgtaatcccagctactcaggaggctaaggcaggagaatcacttgaacccaggaggcggagattgcagtgagccaagatcgtgccactgcattccagcctgggcgacagagcgagactctgtctcaataaataaataaataaataaataaataaataaataaataaattttattgtatgtatttaaggtatgcccaaagggacttaaatcatcacttcataaagatacctgtgtgtccatgctcctgcagcattattcacaaagccaagatatggaaacaatctgtcagtggatgaatggataaagaaactgtggtgtatgtacacaatggaatattattcagtcttttttttttttttttgagacagagtcttgctctgttaccatggtggcagtgtagtggtacaatcatggctcactgcagcctcaacctcccaggctcaagtgatcctcccatctcagcctcctgagtagctgggactacaagcatgtgccaccacacctggctacttttttctatttttagtagagatgaggcctccctgtgttgctaaggctggtcttgaactcccaagctcagatgcttcccctgcctcagcctcccaaagtgctaggattgcaggtgtgagccaccatgcccagccttcaatcttaaaaaagaaggagatcctgccatttgccacaacttggagttattttagaatgagagattgaaggatggtgctgtctggtggtccctttcagacccatcatacgtacttcagatctaaatatagcaaaggcttgttctttcctacattcattcagtaaacaattattgggcacctgttatgtggcaagatctgtgctgggcactttctttgtccttagatatctttgagacatcaaaataacttcagggtgagctcagtttgatcctggaggacaggaattgagtatctcgtgcaatattaaagctattgtaaaggcattgctggtgacttcccatttccagtttagctgcatcctgaactattttttcccttcctcaagaagccaaacagcatgggaattatccttacatctcaaagtacctggtgtaaagtggtgaaagcaccaaccgaaggccagctggcttctgggagtaaaatcagtacttgacattcagattccacgttcgatttttgaatgatctgtcatagagcctatcatttgaatcttagcacgattttgaaacttacaattagcaatagtaactagcagtattattcctcttatacagtggagaaagctgaagttccaggaggttaagtgctttgcacaaggtcacgtcgttaggacatactagagctagatcgagcacaagtttcccactctcgattgagtgctctttttgccaacagagctcaatggccttataaccacctcatctctcccccttccgcatctcagaatggcttaaccaggaggatgtaaggaggtgctaaatgaagagaagagactgcagctaggtgaaaaggcacaagcaactgctgcttgagggtagctccaagggcaggagtggaaggagatgggctggttcatcctccaccactcgtttcagatattcacaactggagagccatctcctacatcagaggacatacagctcgtctctaggcctcttccctttagagggaggcctggaaaggactactgactttttgccagctcgttgagctgtttgttaggtatttctacaacaaacactgcttttacttctttacctatttttttccccaatctgagggatacaagaaaactattctagtagtttttcaaccctaaaggcatttctaaaactaaaatgaaacagtgagaaattaattccttcgttcagctgttagccctaactcagagttagatgacaggtccatgtccagctgacgtagtaacaagaggtctctgggcccctcctgggagccccttggtgctttggcttttttcttttttccctactcatggatgaatccaatcttctaatccagtatgtaccttaggcccaaagataaaaagataggtttctttgcacacacaaacacaccctgggctgactataaatctgctccttgcctgagtatagcagaaacaaaatatgttgcttcctcctcgagggaggaattggcatttcttccacaaggaaggggtgagaggaggctctactggcctttttgaacttacttctcagctagggaaatgaataacatcctggttggcctcggtggagtagaagtggagggaaggaggggtgatgctgaccccacactcgagccacagcctcggaatctctttacccgtaggcgccacacttggcacacaatgagtctgtgagttgaggggaaatcacaaccagattaacacagtgatttgggcattttttcacacttactaacgagtgggcttttgacaaggcctaagtggagccttctctgcaggcaagcctggactccccacccctctcctctaggcagtaaggcctgtaagagaaaagggcagagatggacccaagtcttgcttgccctctgcagctgtgcagagaaggcctggtgccgccacactcctgctcggctcctaggctgctagcgggaggtatgaatttctcttgtttgctttaatggagtgttaacccccgtcgctggaactcatgttaatgcctaacacaaggctgggactgcagggagaggccaagggactggcagctgaaggcaatttgaggattgacctcatggggtggggagagggaggagaggaaagggagacatcagttgaatgtctgctggatagacaagccggatgtaacaggcccaagaccgatgtgcaagaccaaggttctgtctgctcctgcttctgtcacaggccatgtcctgtcccctcccctccctgggcctccatttccttgtgtttaaaagaggagatagaaccagatatactctaaggggaccaacagccaaaaaatgcttttggggacaggccagggggaggggagtagggtgtgggcagtgattctgcagcttccgtgcacacagatcccctgggggtcttattaaaatgcagctggtgacgccggcggtctggggaggggtctgagcagctgcctttctcacaggcttccaggtgatgctgctgctgctggtgggtggagcacactttgaacagcgaaggtattgagtgcaaaatggggttctccagtctaagttctgccccgcacttcacttccctgccctgatttcctcaaccgtgaaacggggaatagtaatcgttgccttgtcttcctctctaggggtgttgtgaggattcatggagcaaatggctgtgaaagcaccttgtaaagggtagagcagtgtgcggcgtgagggattattatcattgttaagacgtctacgcctcgttgctcaccctgtgtgatcctgcagcttctcaacttttccctcctttctccctggtttccacgcctgggctgctgagtcaggcggaccggccaaggctggcgagggctgaacagatgctctgacatgtcaaggcaggaaatgacagttcccaggcagccctctgtttcaggtgtggaacaggctccgaacacactttgtgtgataaattgtagtaacgccaggctgagctctacctccacccccttaggctgcaagactaggacatgaggctgaaagtcagagaagtccctgtgagacgagggccctgagcaagcactggccagactgtagcaaggccactcaccaggccaccccgctggttctacttccgcacccacctctggcagccatgatgcttctgcagcatgccagtttgttcactgagaccttcacagaaggtcgcacaaccaccctggacggtgagaaactaaggtgactgaggcaagtcattgaaccaccctgagccttggcttcctcatctatgaaatggagttgacagcatctgtcctgcctgtggtaaaaattgctgtgatcccacaaccaaaaggaaagagagaattatgagaaaaatatgtacttattctgtgaaaatatgtgagattttcatgagagacttcctgttccagtggactcttccaccgcccttgagtggggaacatccaggccttcacactcacgctcagcccatcacccctctgtgcaaggtgcaaggtcctctgcccacctgaagcctcaaggcctgatggaaaccatccacagccactctagtaagtgacccctccattgtccaaaacagtgctgctgcttagcctgctcttctcaggccaagtctttgttgaacagcttcagtgcaaggacctgggaagtcgggattctgtaatgtaccttgcccccagtcaggatgggaggccaggcccagatcttcttcccaaggaccctgcacctgaaaatctggtacaggtttgtcctttggagtgagagctcttgggtttaggtggttgagagaggtggaaggttgaccacacactccaaatacacatgtttattgcccaagctgggaacaccatttttaaagcccacatagttaggagactaccaaaataacaaagctaaaaatgggtcaggtatcaaacgggtcaactccagtaccggcaggcacatccgggaccctccccttcagggcaggtggactcctcctttcctttccccgcagctactgtcccagggccttagaggaacaaatagcccctggctccagatcagagccagtgtgcccacccatccctccctgctctttgaaattcccaaggccagcagggggcccaggcctgcaaagctgggcctccagacacctccgccagctggggaggcagagagttcgcactctgaggaaacgcagatcctcagaggagagtaaaaggtcagaaataatccaagaggacaagccactcgtgtctgtgtgtatattgggtttcacatctgaaatccagtcatgataaatctggtttttgaaacatcttctttgactaataaaaacagaagacttcttggccccaggtttcagacttcaaagttctcagttgagagcctcgtgtttgacttatttgtggagcacagaaatcacaggatttagctgggttgctccctccaccccctaccacccaactgcaagaacacttaaaaattctggaatggaaagactgagctgaaaaccccctcgctggcactccagccatattttcaaaaaaaaaaattcagcatggtagttttagtggagaaatgacaggctttggagccaaatgaacctaggatcctaatcctgactgtacccttgaccttgtcatcttaagcaacaatcttacttctctctgccacagttccttgaactgtacaaattggaacaataacatccacctcataagttattgggatgatttcagtgcaatagtgtgtataaagtagctatgcctgatgcaaagtggacacccgacaaatgttagttatcttacctttcctgatacctgaccacagactaattatttggaatgaggactgtcctagaaaacccagtttgtatgcttgctgtcttgagagattcagttccttgtttttccattgaaggaattgctaggtttccgaggatagtttgtcttgcagtgtattctgagccctgccataggaatcctatcacagctctatgtgtatgttttctatccacctgaagaagcaggccagagcagcctacaggaaacattttctttttcttttctcttttttgagactgagtcttactctgtggcccaggctggagtacaatggcgcaatctcggcccactgcaacctccgcctcccgggttcaagtgattctcctgcctcagcctcccgagtagctgggattacaggcgcctgccatcatgcccggctgatttttgtatttttgtagagacggggtttcaccgtgttggccaggctggtctcgaactcctgacctcaggtgatccacacgcctcggcctcccaaagtgctgggattacaggcgtgagccaccgcacctggccaggaaacattgtcattgcagcccagctacaaaatgattcttctcttcctccttggagggggagaaatcatgagtgtgccaagtttaaaacagaagagtaaagggtctctggcgtccagtctgggaatgccagcttcagcctgacttggaaagctctcttgttccctgaagcacctccatgtttgttctgaatgtggagccagtcgagattctccttactgggacctacactgatgactgatctcttgggctcacagccctgctcaatgacctcatgatgtgtgagggcctcagccatttcttgacagtcatgaaaaggtgtctcctaggaagccgggcctgtttatccagaggttagttgtaggcaggggagacaaagaggacaggtaaagggacttgattttaaaatcaactccttccagagttgttcttctagccctttctgatctgatgtatgaaatttgtacagaggtggaatcgtttctgccatttttcacacacaagttggtgcacattcctaatatgaattaaaaataaatatgccatgtgtacacagggatgagtcaacattgcatgcagccagccatggccactgggagaagagtcagacatgggccatggagctgcaggctcacctgcccccggctgagtcaggaccgagcacaggacttgacagaggaggcatcgcagcaaggtcaggtgcctcccgtgcttcttatgggcccacctggtcccagcatgagtgcttctcccaggaggcatttttttgtctctcgactttttctttctttcttttttttttttcttaaaaaactgattacagaaactgtaggccaagtgcagtggctcatgcctgtaatcccagcacttcaggaggccaaggcaggagcatcactggaagccaacagtttgagatccagcctgggcaacgaacaagactccatatctacaaaaaataaataaataaataaataaattaattaattaaataaataaataaataaaataacaggtgcctatggtttcagctacttgggagaggagggaggattgcttcagcccaagagttcaaggctgcagtaagctatgattgcaccactgcactccagcctgggcgacagagtgagatcctctctctaaaaaaaaaaaatttttattttttttttttttgaaacagagtcttgctttgtcgcccaggctggagtgcagtggcgcgatctcggctcactgcagcctctgcctcctgggttcaagcagttctctgcctcagcctcctgagtagctggggttataggcgcctgccaccacacccggctaatgtttgtattttgagtagagacggggcttcaccatcttagccaggctggtcttgaactcctgacctcattatctacccacctcagcctcccaaagtactgggattacaggcatgagccaccatgcccggccaaaaatttttttaaaataataaataataataaaaaatataaaatacaaaaaaataattaggaaacagctgggcacagtggctcaagcctgtaatcccagaactttgggaggccgagacgggtggatcacttgaggtcaagagttccagacccgcctggccaacatgttgaaacctcattctactaaaaatacaaaaattagctgggcatggtggcacatgcctgtaatcccagctccttgggatgctaaggcacaagaatcacttgagcccggggggcagaggttacagtgagctgaaagcatgccactgccctacagcctgggcaacagagtgagactccatctcaaaaaaaaaaaaaaattgtgggaaacatatagaaaaatataaagtaacagaagagtcccctatagcctgactacccagagacagcgtggttaacattttgtcgtgaatcatttagaatgtttttccatgtttcttttgcattgttcaataataataactgtatacttttgtctttttaaatttaacattgtatcttaaagaattctaattataaacatcatgtttatgactacctaacattctactgcaagaatgaagtataactttcttaacaaataccatattgtagggctgtgttaaaatggcaatgagcgtatttatgcatgacggttgttgcttcctaggttatttattttggctagatttctggaagtggcatccctgcctaggtcagtagttgggcacgtttttaatttttttttttttttttttgagacagtgtctccctccatcacccaggctggagtgcagtgccacgatcttggcagactgcaacttccacctcctgggttcaagtgattctcctgcctcagcctcctgagtagctgggattacaggcatgcaccaccatgcctggctaatttttgtatttttagtagagttttcccatgttggccaggctggttttgaacttccggcctcaggtgatccgcctgcctcagcctcccaaagtgctgggattacaggtgtgagccaccgcgtctggccttgattcttaatgcatattgccaaattgcccgtcagatagcttatactagtaatattcctgcccgaaacagtcaatctcattccgttcttacgcgtgttgagtataactctgcttgtttatcgaagaatttagggagctaaaaagttctatccccaccctcagatgtggggagatcagagctaagaggttgcttctcctactctcctgtgccccctgcaggcatcctcagagaaagtggggtgcacatactcaccatacgctttcactccccaccaaaggcccttgctatgtaattgacgcataaccagtcagccttaccggtggcattgcccaggctccagtatttctcctctggctgcttgcctctggcccagtgttccctcagtcactctcttagcctttcatagaatcccactgccccaaagaagagctgcttacagagccctggggtaatcctctaattttgaatgggcctgtgtagcttacaaagcacttgtcaaaagacaaaattataacaaacttcattatagatctaattggcttttatttgtgattcatgaatctgggcagcctccattctacaaaatagaatgagagctcccactgggcagtggtagaacagcgggttttttaaggtgagatcaaggaaacaatagaaaaaaaaaaaagctcattggttaacatcaggttacttcaaggttttgttttttttttttgagacggactctctctttgttgcccaggctggagtgcggtgccgcggatctcactgcaatctctgcccaccaaattcaagtgattttcctgcttcagcctcctgagtagctggaattacaggcatgcaccaccatgcccagctaatttttgtatttttaatagcgacagggttttgccatgttggccaggctggtctcagactcctgacttcaggtgatccgcccaccttggcctcccgaagtgctgggattaaaggcgtgagccactgcgcctggccaggttctttttttgtaaaggattaaaggctaccctgactcagttagactgaaatctcccattttcaggaatagctggtctgttttgggatctatctgcttccttaaagtttcagtttgattgtgtggcatttagcatgggtgattccatttcattttggtctggtgtgtggggcctagtgcaggagctcagttcaaaacagtggcctcccataacttttcttttttttttttttgagacagagtctcactctgtcgcccagactggagtgcagtggcgcagcctcggctcactgcaacctccatctcctgggttcaagaaatctcctgtcagcctcccaagtagctgggactacagatgcacgccaccacacccggataatttttatattttttagtagagatggggtttcaccatattggtcaggctggtctcaaactactgacctcaggtgatccacctgccttggcctcccaaagtgttggaattacaggtgtgagccactatgcccaaccaacttttgtttaatacagtctttcataatactatctggtctgatgctcacaacagctctggaagccaaatatttgtttccctgttttataggtttattattttcctaggctgctttaaggaattaccataaacctggtgacttaaaacaacagatgtattctcttgtatttctggaggctagcattctgaaatcggggtgtgagcagggccatgctgtccttccttgcttcttctggcttctcaccactcctggcattacttggcttaggcaggataactcacatctgtctttgtcttcacatgggcttcttccttctgtgtctctgatcccctcttttctcttttaaggacaccagtcattggatttaggacccaccctaaacccaggatgatctcaacttgagatccttaattacatttgcaaggacccatttccaaataaggccacattctgaggctcctgctggacatatcttttgggtggcgtggtggggtggaacaccattctacccattgcagtggataaggaaagcaaagttcaaacagggaaaatgactcttccaacgtcatgcagtgagaaagtaacaagagctggcatttgaacccaggtcttctgcttaacatatgcctttaattgggtaaaaacaagactcttatggtataactgctgactgttatctggtttgtagaaaatgaaattggtagcttttaccctaggatacctcaaatatcagacaccattttctggaagtatactattgttaacgacattgaaactattagtgccaatgtgaaccccttaaatgggcatcatttatttattttctgtgtcataaatggggaaattaagacctagagggatgattctgctgagagagaaaaagaattaaaaaaaaaaaaagaaaagacccagacggagtagcaacttgcccagagtaaccagaaaagttaatgggagaattccagttatgactcagatgtaatctatgttctaagctttaaagtgtgcattatgcaattgcatattttgcagttgtgaaaatggtctccttgtcaaaataactgtgttagattgcaaagaaattcttagtccaattgccattgaactccttttccctggctcaggaccatgcgatatgatacacataatatataacataatataatatctgatctatatctatatctatctcactgtgggagaacgctggctcatataattggccatcagatgtgtccacaggtataatatataatatagctgtggtatatataatatatctgtggacacatctgatggctaattatatgagccagggttctctaaggaaacaactaataaaagagatatctccagagatgcatagatataagaagatttattttgggaattggaaatggaggtcaagaagtcccactgtctgttgtctgaaggtgaagaaccaagaaggctggtggtatataaccaggggagctgatggtgtaagtcccggtccaagttcaaaggcctgagaaccaggagtaccagtgtccaagggcaggaattagtgtcctaactccgacagagagaacaaatttgcctttcctccacctttttaatatatttaggccctcagttgaatgatgcctgcccacaatggtgagggcaatcttctttcctcagtctaccaactcgaatgctaatctctcccagaaacaccccccagacacacccagaaataagccttgctggctatctgggcatcccttagtccagtcaagttgatacatgaaattgaccattgcaccaagaagagctaatgtcctcagcctgtgcttatgggaaccaacttgtagtgtggagaaaggggtgctccccgcagcagcactcttaagctccgtttggtgagcagtttggtaagcttgccaaggaggctcccctctacactggttcccctcatcatgcctgggatcatttcttagttattgtagacgtcatcatcacaacctctcaccaaggagggcttacatcttgcaaagcactgcttaatgcaggttttgcttttggtatctggcctccctggtggttagaaatctgatcagcaggctctcagcaaaatccaaacctgggcagaacctcattaacgcaaagcggaggctgtgccacagtctcttaaatagctagagtgtgattagacactatcagcttagaggagcatcctacctgtccccctccacctgcagtcactaggcttccttgcctctttaacaatggtgtacaaaggcaaagcacgtgttcccccagcctccccaggagctaccagcttgccagctgtcacagcatgcctttaatgggtttgtgaaacccaagaacctgacccatttctcctctggggaaagagtataacacaggatgccaagctgggaagcaggattcgggacactcacctggatgagaccagctctctctgccgtcctagacagattgttttgttttttccaatttccaggatctccaaatctaaaataagtgcacagaaggcagtagagtaaaattgtgacattgttttctgctcacttatcttcttcttccttcctctcttttaattttaactccactttctgcctactctgaccctagatattcaggctctggtaccccacccaaagggtgttgactgcaaactgactgtcaaatttcataagtagtcaataaacgaacctgttttgagcaagcatgatgtacaaagttcggtgcctattttcattatggaggaattcatgccctcgggagcttctaaactagttagaaaagcagttcatgtgaacagtgtaaggcagtacggaaataaggccacaggaatgatctaattaacctggggtccacaggtgggtttcagaggcatccatagatgccccaaaattgcccgcataattttatgtatgcaagcacacattttttgagtaagtgcttagctttcatcaacttcacctggaaagatagagcaccttttatgccgttagagtttgagcaagagtagtctttataccttcggtagttgagcaggtaagacttgaactcattcttagaaaatagtattcagggcaggaggcagccctgaaaggcaagaatccccaggagatagcctgcgaagactgttgcacttacaaccagatgcctcatgtctctgaaactcagtaagatggaaacctatacaatggtgatcattgttgcttcccatagtttggtgaagtcacataagctcctctttttttttttttttttaactcactctgaaccttgtacagtgctcgactcatatcatagtggacactaactaatatttgatatatgtgtgagttaactgaaatagcaaatgtgagagggctttgtaaatagcagagcactgcttcaacaaaagatgtctgttgccaagagtgtgtattttgtcctttgcaaacagcctgcgctaagtgagcgtcttctccctgcttgaaactgaccctttcccctgtaatgggactcaaagggccagctcatctgatggagtgtccctgggctggtcagatgaatgatagctgtgctgtcaacatggacaagatgtgcagttttccaagagcccagagatgacctcaccctccaagggcttggcctcttcaccccagtgcctgctgaaacacacctgcagccttgctctcactctgggacagggagattccaggagcacctttgctgtcctcagcaaagaggctacgaggtgtggaagggaaagagacagcgggtatggcagagcctctgatgggactcctagcaggataagcaggaccactgattgtatcctctctatgacgtctcaggacggtagaaatgatcaggtgcttctttgctgaacacttctgatatctcccatcttcgctcctcaacttcctagctgtgcgcatgcgaagagagaacagacccactatcaaattgtgtttctcctgtgtgccatcccgtaaacatggtgactcatcgtcaccaccaccaaactccaagcaactcgggctggttgggagtgggaagggtttttaaatgtcattggttgaaggtgacaggagttctcaaaatggtaggaaagatagaagtggtttacacatattgtggttcttggccaggcgcagtggctcatgcctgtaattccagcactttgggaggcgaaggtgggtggatcacttgagcacaggagtttgagaccagcctgggcaacatggtgaaaccccatcttgacaaaaaattagctgggcatggtggtgcacacctgtagtcccagctactcaggaggctgaggtggaaggatctcttcagcccaggaggctgtggctgcagtgagccgtgattgcaccactgcactttggtctgggcaaaagagtgagaccccgtctcaaaacaaaacaaaacaaaacagttctccactgcaggtgttgctgagggaaacagtgtgtgagctgacagaatgagctccaagctaagaattagaaacccttgttccagatctgttgctcagagactttgaacatgtcacgtaacttctcagagcttccagtttcaccaccataaatgggggatagtacctctacgacctctcaggatcattatgatagtcagaatttatgatgatgccccaagtggtataaaggcatacatatttgtcattaagaacatatacatgaacacacctattacatacagaacactcactgtgtgtcaggtcttttacatttatctactgcagtcctcacaacaatcctatgtggttgtattgtttttccatttttatggatgaggaatcagagacgcatgcctggaatcatacagctcacgtgttagtctttcttgaagtccaggcctatttccatccaccactatgacactagctcatgattcttttctcgtgcgtactgttactttatcccttaaaatattacatattcctctggcctttaccatctcttatggactgggcccaacatcttaccctaacctttcttgctataacattgattgattgattgactgattgagtgattgactgagagtctcactctgtcacccaggctggagtgcagtggctcaatctcggctcactgcaacctctgcctcccaggttcaaatgattctcctgcctcagcctctcgagtagctgggattgcaggtgcccgccaccatgcccagctaacttttgtatttttagtcgagatggcgtttcaccatgttgtccaggctggtctcaaactcttggcctcaagtgatctgctcaccttggcctcccaaagtgctgggattacaggcgtgagccaccgtgcctggcccaatttcttttgtttgttttcttcctgctttggcttttgatattcctcttggtcccgctgtcaccccacctgccttgacctctgaacacagtaatgcaaacattaactgagctcctttctagagacagacctcctgctcttgtgaagtgagaaaacaaatggtcattctcttcccaattttccaggctctgaaacatctctgtccataagaaagctgagtgtatagcagccaggtgcggtggctcacacctggaatcccagcactttgggaggccaagacaggtggatcgtttgagatcagaagttcaagaccagcctggcctacatggtgaaaccccgtctctactaaaaacacaaaaattagccaggcatgatggcacatgcttgtagtcccagctactcgggaggctgagacacgagaatcgcctggacccaggaggcagaggttgccgtgagccaagatcataccactgcactccatcctgggcgacagagtgagactgtctcaaaaaaaaaaaaaaaagttgagccaacagggaggaggagggcccacgttttcttgttatcattaagtccttgcgtcgcatgcagacccttcagagaaacgatgatgctttagcactgtagcactagatcttgtcaaataaggtctagtgggggaagtgctggaagtggggactttgcttaatctcttcactcctgtgagacagggcaaagggttattcattctagtttagagatggaaaaggagctagaaggactggctgtgcatcatgcagtgagtcggcagcagaatcagaagcttagtggatgtcagcagtcctgtgtgtccctggggagctaggcacctgggagttgttgccaagggtggttgagtgttggctctgagcttggcactgccagtgcacagctctagcacagttcaggccttgggagaattatctgacacccagccgtgcacccccattttccagagcctagcttaccagatctacagcctgaccctacttgatggagaggtggcagagggagctccccattctcaagtcctacctgacaagctgatcccaagcaacccactcctaaggtgggcctcttcttggggagatgcccttatagatgctgcccattctcccagtgccaggaatcttccctacaattaggtacgagataaatcaaagccaaacttggctgacgaaattcaggagccagtagtgacccttgccacacatataaatcgcagcaggctggccaagggcctttgtctggccaggagagttcaggattatctggccctctttgctgatgtatggagtcaccggctgtcggagtgtttactaacggttatcacctcaatgctgtggccattatcagaggcaggaccgcctgccgaggctggggctcgcaccctctctattaccacctgtcattggcagggagtgtgtgctgacactgcccagccctcactgcctggcgaagatagtttctgacggctgatcaaagaggagaagcaaggcctgataaagagtgcgtgtttcgtgtacttttaactttgggaaacgttggcatttgcattttttccccatcttcccgatgctggcaggaaccaagcccaataaatgcagtggattcagttacctaatcgctggggaaatggtatgtgcttaaagcaacagagcgtgactataatctccttccgagagagagtggatgaaataagctttcacagaagacttgctgtataataaagtagaataattcaagttcggactttgaagtgatctcacatgtaagatctaatcttagcgttcagcagaacaccacagacgttttggaattggggagcagctttggcttaaggacagacccttgccgaagatgctatcacccacctccttgctggtatcccccaaagtaattccctggttgttcatatgcccttgggtagctgggagaccaggtagtgaagtagaacgtgttctcaactgaggcatcaggagagcgagttcttggacctcgtctgccacagacttgctcttccatcttgggccataacttctctgagctccaactataaaatgaggaagttggttataggttatagaatataatggttaagaaagctttaaaaacattaggctatataaccccttctttaaatgaaaatttatttatttatttatttatttatttgtagagacagggtctcgcgctgttgcccaggctggtctcaaagtcctggcctcaagcaatcttcccgcgttggcctctcaaagtgttgggattgcaggtgtaaggcaccactccccgccctaaatgaaattgtagatggaatcccattgtatcaaaaagaggaaagtagggatccgtttgggttgaacctgggaagggggttgccttccccgtcccacttcttaaggtggtccctgaagaccaggggaaccctgtagctcctcagaaacagttgtaaaaccaccagcctcagtgtcacggaagtcactccagaggtctgcactctctcagcggcatgagctatttctcctgcgctacccagtctgttggcggcgtgcttccatcctacaggaaggctacaatggaccctgggtatggagaggagcgggtgggaggtagacaagaatggcctgctccctgaaggtgtggactcaacgtcagatgtcccgtgtgtgccacaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacaggtaaaggtgtcatcagacttctagcctgatttggtcaggaccagcacctgttggtgcagagcttctctggaatcgtttgtgggcatatgtttgtttttgctgttggtttctttagttagcactccagtggctatccgtctgaggagctctggtgttgggaaaccctgtgtaaaggggagctcccagtggaactgcccctcccacgtggaataccacatgcaggattgccatgatcaacaccactgtgcaagtggctcccagaaggacactttcctcctttgggggtgtccccacgtcttccagcagcgctcaggcactgagtcctcaggttgtacctcttcagacacgctggagacttagagattggcaagtctcagtagggcctgccaacctgagcggagtaagcatgaagcaggctgggctggtttcagcccctaccagcttttcctcatgctgcctttggccttgcattcttgcctctgagcgagtccagcaactagggtctgggtggcttcctgcatcccagagcaatcagaagacatccttaaatgatgagggagccctggcccaggcaagtgcatgttcatgtgcgcacacacgcaaacacacacacacaacatgcactcaggaaagccaccaatcatccatctccagtacagctgtaatacagcctgcctcttctttccaaaacccttctttgttctagatagctgtgctgttagtgactgccctagccctgcttttgtgctgacagaggctgccccagcaggcctcttccctcctttcagagggaactttctgttgggtgcagctgactctggctagaggccttttctctcctgcttgcctgagtcctctcaagactctgtcactctgctgtgcactgctccgttcccgttccacatgcctccctgcaaagaaccccagtaaggagaaacttacaacaatggggcaggcgctgatcaggaccagcaagattcagagtcagagcactgaggcagggcttgaaatgtctgacatcatcacacagtcccacttccccgtggctcctccagatctttagatgtttaggtttatggtcaggcgtttccctcatccatccccatgccggtccctccgttccttcactaagacgtgtcatctccacagcactagctgtgtggcctgcccgtggtgctcctgtaataactggcaaatgaacaggatggaaacgataggtgcaagggaggaagagggggagcttggctacatgggtagcatgtcatcatgccactgttctcccagctggacccagagatgagaagcatttaccagggcttgacttcgcttcccctggaagggggcctaagtgaggaatgtggcttacggcacaggcttttgcctgcatctctggggtccctagccagcctcggctcacataaaccggagcccggtgccactggacccatccccggcagcctccctcttccgaggcctggaggagctcccgggtggctcttctctcccaccgccttctcaggagccccttggagcatctcactgtcatccggcaagaggatttgaaggtgcattgagtcacagctgtggaacttcagcctggcatagtaacctgcacagccctggcagcaatgcatctgccagacagctgagggattcaggagaggctttgtggccttaagcagtttcatgaaattaaaaagaataaaaaaagagaaagaaaaaaaggtagaggaaattaaaactgcatgacccacaggtcagaaaataggagactccctttttttttttttagcagagggatttcattgtcctccccaaactgtcaccaaaaggaatttagttggttttctctgaccatattcgatgtatgttttatttttaagaaaaaacttgttctttttttgtttttttttaaggcggagtcttgctctgtcaccagactggagtgctatggcacaatcttggctcactacaacctccacctcccaggttcaagcaattctcctgcctcagcctcctgagtagctatgattacaggcgcccgctaccacgcccagctaatttttgcgtttatgatagagacggggtttcaccatgttggccaggctggtcttgaactcctgacctcgtgatccgcctgcctcggcctcccagagagctgggattacaggcgtgagccaccatgcccagcctaaaactactcccattttaaaggccagtaagcaaagcagatgttatggaagttacccagtttccatggctgagaatcacttttcacattttccaactagaggtaaagcatcagcctggtagtgcagcccaggactttgaaagggcaccctggtacacccgtgcccaggtcagcctactgcccggaggtagttggggaaatacagtgcaacgtgggtaagaatttccagcaagccactctttgcctatagcaacatctcagtccccctctttcttcccacaactctacttctctaggtggcttataggacaaatgaggtatccccaagtgtttgcctctgataggtcctctgatgcaccagagctaagtcagttcccttaatgctttgcagcaggcaccacatgtgacacagcaattgggacccatggcctctttatcaaagtatgaatgaagcacagagagcaactgaaaacttgctctcatgatccctgacacagaagcctattctatagcacgcctcactgttacataggtgtagccagccttgatttgtggatttctgtaatgtaaaaactcctattatggccaatttcaacctgtcacacagtgtcagctagctaacagaggttctggagatgtaacagtctgtgcactccagcacctggttggtaagctgtaccctagggcaggtcagctccccacaaagtaaagtgaaaccttttcaaacctcactattcagagtggtctgggggttgaaggatagctttggtcaaaggatacacagtttcagtcagatgagaagaataagttcaagagatgtattgtccagcatggtgactctagttaataacaatgtattcttgaaaatcactcagagagcagatttgaagtgttctcgacacaaaaaatgttaagtatgtgaggtaatgcatgttaattagctcgatttagccattccaaatgtatacatatttcaaaacaccatgttgtacatgataaatatatataatttttatttgtcaattaaaaaatatatatttttttaaaagtgtggtcttcagacccacagcagcatccgtagccaggcgccggtgagaaatgcaaagcctcaggccatgcccagccctgctcagccgaggtctgcatttcagcaggatccctgcgcatgctgaagtttgagaaggtcagttttaaattatggttaacttataagacagatggcagttctttggtccgtgatggatgccgaccaaatagttgaattcaatcacctatgtgatttgcaagtccagttctaagacaactggctgaactgcctttttgctaatatccttctgccccttgccccgtcacccttccatctttccattcggcaaactccaattcgagctcaatccaactctgctctcacacctgggttcctgaagaaagagcacttattattccaattggtgcctctacagatccatggtctccactctccactggagcctgctctgtgttttcctcatagccccgcccccattctcagtttgcacccatcttttgcagcaaaagacagtgcctagcgcagtgtctgcaatagagacgcagagacgatgaattcttactcagcctctggctacttctcagtccttttcttctgtcgtccttaggcgtatttctcaaggccttgtcttggccctggtctcttctctctcagtacctggcaatctctgcttccgtgtctccaattactatccataaactgatgatttccaaataatttccaagttggctttgtctcctgatctccagaaccatctattcagctacctattgacatatccacatgtctacgaactgaattcctctcttcgggccctttccttctctcgagtttccccatcccggtgtccaaagccctttgagaccagccactgccctcgctccagactcatctcttgctgccctgggccagctccagccaagctaaactcccagagggtccccgagcatacgcagtctcttgcccgcgaggcttctgtgcatacttttccttttgcctggaatgctgtctctcaaagccccctcctctctctgttacccccctcaaaataacttgactaattcctgcttagcagacattcctttcaatattgccttttctagaaaaatagaatttttaaagtaaacaaaacattgacttattccaactgttttgtgtctaggtaaagatataacttaataccagtaaaaaagctttttaaataaacacctgtgtacatattaagtacattttctctttcgactttaactctttcaataactgtagctgcaccttgtctttctttttagtgctctcacacatctgatatcaaaagcccaggccttatgcatgggtccagatccgtgtgtaaagtattccttttttttttttttctgagacggagtttcgctctgttgtccaggctggagtgcagtggcatgatctcggctcactgcaacctccgtctctgggttcaagcaattctcctgcctcagcttcccgagtaactgggactcagatacccaccaccatgcctggctaatttttgtattttttagtagagacagggtttcaccgtgttagccaggctggtctcgaactcctggcctgaagtgatctgtccgcatcagcctcccaaagtgctgggattacaggcatgaaccatggtgcctggcccctatttaaagtattcttgatgcatctctgttgcaggaagtatctgtttgctactgttaacattttttttttctctgtcacccagactggagtgctgtggcacgatctcggctcactgcaacctccacctcatgggttcaagcgattctcatgcctcagcctcctctcctcaggccctttcctgagtggccaggactataggcgtgtgccaacatgcccagctaatttttgtatttttagtagagacgaggtttcaccatgttggccaggctggtctcgaactcctggcctcaagtgatcccaaagtgctgggattacaggcatgaaccacgatgcccagcccctgtttaaagtattcttgatgcatctctgttgcaggaagtatctgtttgctgctgttaacttcttcttcttctttgttttttttttttttttttttgctctgtcacccagactggagtacagtggtgcgatctcggctcactgcaacctccacctcatgggttcaagcgaatcgcatgcctcagcctcctctcctggggccctttcctgagcgactaggactacaggcgtgcgccaccatgcccagctaatttttgtatttttagtagagacggagtttcaccatgttagccaggctggtctcaaactcctggcctcaagtgatctgcccacctcagcctcccaaagtgctgggattacaggcatgaaccgcagttcctggcccccatttaaagtattcttgatgcatctctgttgcaggagtatctgagtatctgtttgctgctgttaacttcctttttttttttttttctctgtcacccaggctggagtgcagtggcacgatctcggctcactgcaacctctgcctccagggttcaagcaattctcatgcctcagcctcccaagtggctaggactacaggcatatgccaccacactcggctaatttttgtatttttagtagagacagggtttcaccatgttggccaggctggtctcaaactcctgacctcaagtgatctgcctgcctcagcttcccaaagtgttgggattacaggcatgagccactgcacccggcctgctgttgactcttaagtgctcacagagtcagctctcagggtccgggagactgtctgttccccgtgactgttccttcctgcggccccgggctcactgattcttctttacagtgacagcattaaagataggaaaaggcttcatcttttcctgcctgccgtctctttaacagtctctgccctagccagaagtagttattcttggggataacatagtgggctcagtctttgcctcttaccttctgtcatatacatattttacttcctgacctagttcacccacatctataacccttcacaaaacaatattacggccagtgcattctagtacttccttttcttctattattctaagaattatcttgtactttctattttatttcattttttaaaaaatgcactcgtgacccactaaagtgatttcacaatacattggtgaatggcaatctgcgctttgaaaatcaatgctctagcttgttcacctaaatcctctgagttttcccatttatgtattaattactctgcagaaaaggctttaagattatgttcaactaaagctcttccaaagatttctgtcagaagctacttttatgtactgaaagggctgcgcctttctttttctcttgttaacataaaaagaacactttgaacattaggcagtttttaagtgatcacgggatggtttcagcaagttaataacaaatatttgttgattgctatgttttgcaaaagatgacctaaaagcactatttgtgtgtgtgtgtgtgtgtgtgtgtgtgtgtgtgtgtactaataaagtctttcattttaagactgtaaaaagtaagctcccaacaaatatgagctgtttttactggagtcaatcagatatgtaccaaataactaatccaaatatctcagtgtattggacccctctcctgcctctagaatcagctcttccaaagggccttggaactcctgcctgggtcagtatggagggctgggaactttttcaatctaaggctacatttccaatagggatcatattagccccatcccataccaggttgccacatgatcagatgacaataattgtaggcaccagtaccatgtgttaattatcttttttttttttttttttgagatggagtctcactctgtcacccagactagagtgcaatggcacaatctcagctcactgcagcctccacctcccatcatgttccagcgattctcctgcctcagcctcctgggtagcgtggattacaggcatgcgccaccatgcccagctaatttttgaatttttagtagagacagggtttcaccatgttggccaggctgatctcagactcctgacctcaggtgatccacccacctcggcctcccaaagtgctgggattacatgcatgagccaccacaccgggccaattatcttttagccatccctactctctggtcagtctcattttaaaagcagataattgatttatcagtattcgctacagaaagtagttgaccacatttgactttgcagacatttcagaagatgtggtggtggttagaattttctgcatcccacatatttttaaaatctgcaatttagagagaactttatccagtccagccctaggggtagatagatgcatcctactggcccaactcattgcaaggccatggaaataggaactgacagtgttgccccagaaagctggagaagtgacatttacatgtgttatgtgggcctctcaggtccctttcccaaacctgagattctctgattctaagtgaaaggtgagcctcctttatgggtcctgggttagccacactgttcctgtcctaagcaaacccggaggttgtgtgagctgaagatgctgccttcacagggccatcgtggctcatagccccataggtcacattccctgcttccctaccacacacaaccaccaagctgctttgatctttccagagaatcttctctcctcttcctacagccactctatcaggcaaactggtatttaccccagatacccaggaagggttagtctttcggcctcctgaaagtaggaatcgctctcctctccaggatccccagtgtggccgcccatgagacccagtcttgtcttttaattttttcctccaagccttacctctccaacttcctgggtccccttctcaagatgcacaagggtgattcatctgtgcaagccatagcttctggcttggtctggctctcttgccaaagtctctaggcttctctgggtaatatctctgattgcccagtgctcctaaaattgcacctgtctcagcaaatgctatcacccaagcaacttagccagaacctagggcttttcctctgccttatctaattgggccctggagttttcctccttctacagcatctacaaaagttctctcagtgtcttctcttaatgacctcatcagtggcccaacgtgttctttctgtggttggggcaggcagggtctccatcggtatctgccagtttcttccccaataggctggagaaaaataagagagacaagtttcctaccctcaaagagattaaagccccagaggaggccacaatactgaacggtgggtctgtttctctctgacttctacccccagcttcccgctgggcctccctagctgagctggaccaagtggaagtcaggagtgctcccctgcccacagggcatggtctttctaggatgcggaggcaaagctggaactccccagtgcctaatgccctgattgctgagggtgagagaagaaagtgtccccagaggcacagggccaccagatagagagcccagtcccaccagcaggtcacaagcatccctactcgggacaagagggagcagctgcgccagcgagactgtgggacagccggtggcctcggcaggggtggtgttgttggtgttgctatttgtgtctcggttcagtgtcggattgcctattcctagctattttccactggcaggagaggccaaatctgagagtcctttcagttcccagcaccaagctcccgctattgggaagaatgtggtgtttttttccccttttcgatgggatttgaagccctcatcaagcaatggggtaaacctgtgaccctgggcaagtgcctttccctctctgggccagtttcttcctctgtgacacagtgtggggaggaggagctagtaaatgtagtaatcgttggcctcctgtaactctgatgtcctggctgctgcagggagcactcggtctctctcttttactcctctccacgatagcagtggccacacctcccgtgggacttgtacgcctaagactctgcctgccacataaatgtcctctaattgtcagagcactgccaggtagaccttcccctctccagtttacaaaggaggaaacgaaagatttgaagtgagagtataactaaaagatgtgggattaaaataagaaatttgggaagaggttccagttattaagatcctgccggtctcccatggtctgaagggttggagttttatcagttattctcaccttttattcagaataagtagggatccagcagaggaaggggactgtcactagcagggcctgccttgactgccgttgcacttccctgctcagaaagtgtccaggcctgcacattgcacccaggctccttgccatcatgtttctgtctcttacaggccttccccaccttcccttccagcctgacctcccaccccttctgcagtaacctctgcatatttcacctcctccaccttcttgccaatataggatcccagcatccccagcatgcaccctgttacctggccctggtgcatgttggtcacccctcaggaccgctgccctcccatcctgcccagtcgtcgtcttaggccaagctcaaatctcacctcctctgtgttgctttccctgaccatgaagccaaatgtgtgcaactctctctgtctctgaatttctgcaccaccgacttgctggatacttggccctgggcaaagagtgtatgctgccttttccattaacttgctcaccaattcccttcgttttgccattggaaaagggccggccctggtggtcccttcagcccctccctcacccatactcccacgagtgtcttgacccactactggttctttgaactgagtctgaaccatctttgttatccccaaccaccagccttctccctgcccagcaaccagcactggaaggagagccaggctgagcctcagttaatgtttgttgagtgactggatgggtttctgtggcccctgagaggtaaatgaaagccagtcaaagcaatgggaatagttattgattaaaagtcacacttgttaatttctggccaggtctcaaatctgattctgggtagatcatttcccccaccccaccttcgtcactaaggctactggaagccccgccaggggcagagctgtaatgggagtttgggctgagactctcctctgcatatttcttagttgtctaaagtgacttttcaactctttcaccaaggcacagtgattcctatcaacaaggaggaagtgccagtgcgacctctgtgacccttcagagtcccctctccaggtgctgccccaacatgaaagcaggaattactgtggataggcacaggcttggactgaggggctgggggagggctgttggacccccagagccaggctctcctctggaagcatcaacataggtaaatggttaacaaaagggaggatttctccctgttcctcctcctctgccacagtattgactgttaaccactgacctttctgtgaggcgtgagattctgaacaaagttgaacgcggtcatggatggttaaattcccacctttcccttctgcccttgcctctgcccctctgccttctcgaaacatggcccgagatgtggaggccaccccctggatgtggtggctgctgagagagggagacacacttgctcacagaaaatgaaagttggcaatgaccctctgaccctttaggaatccagaatcttggctcctagaagccatagagcactgtaccaagaaggccaagccaagcccatccgattgaacttaacggagaagtgaagttccctagtagaagaaggcattttggagcccatcccggaaacagctttccagccttggccttttacttatttcttcctgcccactcctcctcccacgtcacccctgcccccggggacctgccggcccactgcataagacattttttaatttgctggcaaaatcccccagcaccaggcttcgcagccctcccctgttacccacatatgttttatggggtgtagcccgctagcttgcagttccacccctctgcacccttcattgagttttgggagaagcgccatccagtcgtgtcatttgttcaggatgacttttccattccacgcccgctgtgttcgttttcctggaatgttcccatcatctcccagctccagttggccagggccagcgtgccatctccatgctggtgtgtgtgactgtttggtgctgacccgaggggtgggttggtggagtacgagcctgggctggggccttataaggcctggagtttctcggtttcatgcgttatccatccccgaccactgagagctgagtaggatcctgtggttagtgcccttgagctggtctttgtgacctttctctaagcagcccaaccacacactgccatgcagctttgaacttcagacctggtttctaaatccacggaagctgagaggaggaagaaaatctgaggggttacccaggatgccggctttctctctacatcattccctaccccagccctgtgcagcaggcaggagtgtaggaactcaggcagctggactggggaggagggagagagggaaggatgataccagtttaggctagtgagaaatctgtaaaaccctagatgtgctgtgcctgggaacagaccatgaacacccccgcaaagctctcagtggtcaaaccagatttgggtatcgactcactttgatctcagctcttcctgctctcttaaaggtccagtttgtgatccgctttaaaggaatattttattttcaatacagacacagcccttgacgtagcagtaaaaaccttcccccctgagagacacgtggcagtgaagtgttttggtatgtaacgtcctatctttgcctatgtggaaggggttgtcccgttgcttcttttgtccctcaagagggtgccctcctaccccctcgtgcccaggcccaggagcactctagggagggcaggggtcagctcagatgggaggtctcttctggaaggggactggtttgggatggggagtggttgtcatccttcacccaacaagagtttctttgagaacgccactccctgccccccactttgaagatggaagtgaaattttcggactctgctgtgcagagcagggaggtcactaggctctaatgcatttaccattgactgcccctcttgtagtgcgtctattagtgagtaatttgatttgtacctattcatttgcagtccctgcaggagcctggagctggcccctagtataattggtgctgtctctatttttacatcattagattagccccgactcctggccacttgttgtctgcgcttgtctgtccatttatacaacctaatgtaacacaaaattcattactgatcacattactttcaactctgaagccagccttgtgataaacatttggttaaccccttcctacccacgggaggactgacagaacaaatgcacttccacccgacaggcaaatcgatatcttaatacaccaaagtggaattgcatttctagatttgttattcctcctggaggagcaaatggaaaggctcgcctgagccagctgaattgaataatgaatagagccccggcaccagcagccagtctgtgagcaccgcacaaaggcagaccggcatcagccaggccgtttccatctggacgggcggcggcaccaccacaattagctgagactgtgatcctttcccagccgcggcgtgtgggcttgagacacaggctgggaccccaaagagggcaacagaggccgtgccccaacaccattcctttggctaggcttggcctagaacactagaccaagaactgggttatttaacttcaaaccttgttcactgatgtcaaggctaccagacgctaaatgccaccgagaagttaaatctattactaaactcaggtttaccatctggaaaccgaaaaagctcttcctgtttagagccaggtcagtgacattgggattggttggttcacaccaacttgcgtgtgtgtgcctgtccccagggccagcattcttcagcacgcagatgccatgtgtgcctgtatgtggttctggttctctggtagggttgctgtgagcagcatgtgggactctaacacaggagctggccaggagtcttaaagggacctcaacctcagcacagcattattaatctagaaaattctctcctatccccaactggtcatcctctccccaaccttcattggtctctgggtagcagccacagccgcaataagtcattaactttcaggacagcttgtttcaaaatgaaaaatacccccacttattaagaaactctcataaagcctggggccgggcgcggtggctcacgcttataatcccaggactttgagaggctaaggagggtggatcacctgaggtcaggagtttgagaccagcctgaccaacatggtgaaaccccatctctactaaaaatacaaaaattagccagacatggtggcgcgtgcctgtaatcccagctacttgggaggctgaggaaggagaatcagtttttgttttttggcttttttttttctttttttgagacagagtttcactcttgttgcccaggctggagtgcaatggcacgacctcagctcactgcaatgtccgcctcccaggttcaagggattctcctgcctcagcctccccagtagctgggattacagtcacccgccaccacacccagctaattttttgcatttttagtagagatggggtttcaccatgttggtcaggctggtctcgaactcctgacctcaggtgatccacccaccttggcctcccaaagtgttgagattacaggcgtgagccaccgcgcctggccaggagaattgtttgaacccagaaggcggaggttgcagtgagctgagattgcaccactgcactccagcctgggtgaaagagcaagaccctgcctccaaaaaaaaaaaggaagaaggaaagaaagaaagaaactctcataaagcctgtaccacaatgattagaaaaattggcataggggaaggtgaatggaaccattaccatgaaagtcataaatgccatgaactgaaagaaaccatgaacagaagatcctccagtgggaagggaagccgggaaaagcagccctccagggaccattctgcctggatttggatatggggaagtcctgggcaggaggccgaggggcagaggcactgaagcctgaaacagggcaccccctctcacagaggactgcaccttggaccctgctgtcccttcagctgtccagagcccttccaggccagaagtggcaaacagtcctgagagacatggaggtcctggagattcttggagagggccaggcaccactctgggccttgtctgttagacggattcctccaccatctctcatacctctcctccttcgtgtacagggagggggcggggagaggggcgcctccttgccgcagtcccagggccccaaggtgagaagtaagaggtggggaagggcctcaccgtgtcctgggctgtagggccgggccaggccaggtacagggaggtccttgtcccaaagactccagaatcgtaaccctcaagcacttcctactgtgaggagctacaaagcaagccggggtctcctcagcagggtattatgacaccctcacatcccagcagtggaaggacactggtgtgtcactgaggtgagcctgggcacagtgctgtctcctcagggtcagggagacactttcagaaggagtaggggcactaactcaccacccccacccctgttgaacccccagcacactgtcttgctcggctgcaagcccgcagctttggcctcagctgttaatcctctcaggtgggtaaatggaacacgggggtgggggagatccgtgtatcccatgctggccccagccccataagctctagaaaacagataagagcacaggcctttgcctttgcagaataggacggaccagtggcagggaggaacgcgcgtctgcctgtggaatgagagactgtgatttcttaaccttgatggaaaaggggaaagccacatcttaccaaactcttccgctgcgtcgtagggaatttaattacatttggacatttgaatgagaagcagatgtggctctggcccgccggccagcagctctcaaaggacagccactctcctgtggtctgcagggctcagtgctatctcgtcacgctggagggtagctcggggagaccccttcctgggaactagggtgggtcttccaggctttcagggctggacttcaggacacaggcaggtcaaggccagctgccagcacctagtgccaaggacgagtctccaagccctgtcccctcttcatagccgggcagagcgggcctgtgtgccggtgcctgagactcctccaggccccccattggcatccacacagagtggtggcgtggcagcacctggccgggcattctccatcccccaagcccacctgccatgcccctcggcactgagtccaccctaaatggcatcagccaaggctctgcccccaggttggcatggagtagctggagctaggagagacatttcagccccgctcctggagggccctccgctgctaaagacagcagaggcagcaaagcgtatttttttacccagtttcacgtgtgtgtccagtgcgggttctgcttcttaaagccccccacttgcttttctcattagagccgtacacgcccagtgaggtcactagagcagaccctcccctcctgtgccacagatgctgacgcagatgagaagtgaagtgacttgcccaggtcatttggcacatctgtgacagaactgaggccagagtgaagtctcggcctcctcgcacagtcctcctcctccctgggccatccacagggagtggtagggcagggcttctcccacatctggccgatcctgagcatggctccagccagtcctcagatacatccaaaccagcgacagaggagctgggtcagcacagcattttctctcccctggtatagcatgtggtgaccgcatgtactctgccaggggagaaaggggactcctttctcagtccctgctagccccagcacccccgtcctcccaagcgctcactgctggtaggcaaagaggacccctggtctgtgggcctggcagccagctctgaagcctgagggaggaacctggtggggaggggagccccacactgcagggtgaagcctggggaagagggaaagcgcaggggagccaggcagcctgggaggtgggtgtatgctcagtgtggtgggaagcagggctgcctttaactgctgcacttttcacctcctaaaaagtgccctgggggctgaggctggctccatcccagagtgtggtctctgacaaggctgtcaggggcttagagccaatctcagccaactccatctctgtctcacggaacaggcccccgcctcctcagccacgctctggaagagacagcagttgttttcaggcacaggactggtgtaagacaagcagcctggagccatgtctgcctgggccaccacctctccaggtgccagcgccagcaccaggaggctgccagccctgctcaaccccacacaatttgctcaagtcttccttccacttagtctctctctctctccaagccccattttgcatagctggtcctgtttgcaggacataagggccctgggtgcaggccccttgctgaccaagttgatcgcttggggcagaccccatatggttcatttgctgaacttagagcagtcacgtgacccgctggtctcctcttcacatgtcccatcaagggaaaatgcagaaaatgcccgacctcctaatgagaggacctcccctactacgtacctcactgcccattcaggaacccccaggcagaaggtactgaagctgttggttgcaaaccttctcaaagccaggcactgggcaagcgcgggcagctcggctggctgctgtgtgccgcgaagccatccgctcccctgggccaccccggaacccagccccagcaagggtcttaaccacagtccctgctgatgtgggagagctgagaggtggatgcaggagggaaaaatcgatgcatgtcaacagggttggaaatttattttccattttggaagagggtatttgcaaagaggcgaggagggaaatgaaaagctgtaaacacacatctgccatcttcctccctgggccatttcttgattaaaaagaaagaatccttcccaagctccggtggaagccaagctggtgagggcctggatggcagagacacctgctggggagggaggctggagagggaccctgtagtcctgtggatcatcacaatgactaatccgattgcagcaataatagtaactcacatttgctgactggaagcgttaagcactttgtgatgcactctacatgcattatttaatttcattcttagaaccaggccatgacacagacatcgttaacctcatgttcgggaacctgaggcacaaagattcgagtaactttcccaaagtctcccaggtagcaggtggccagggggtgtgctcttaaccacttccctaaacgcctccaccaacatgggcagacactgcccctctgccttctcgggttctcttgaggctgggggctggactggccaggggaaacatcctcatcctcctgctcactgctggaagcaggcagagctgtgggtgcagggtcagactggaccctaaggtctcatcctactcccaccagtcagcgtgggtggagaaatgcagccagggcccagtcacagtgctctgccaatcccttcagtgggcagcatcaatgctcatgtacagagccgtggacgctgctccttttgtggtgacggaagtgccagagctgcccaaagggtgaaccaggggccccaggcagcctcttcctaaacacaaacagagcactgtcctccctggcccctctcaggtccctgagactagggctcaatgcccccacttccgaagccagaggagcttttcgcagggcctttgattggccagacgtccaggttggaagagacccagagaacaccaagcccaaagcaggatttccttactgtttttttttgtttttgttttttgtttttttttttttttttgagatgccaggctggagtgtagtggcacaatcatagcccactgcagcctggaacacctgggctcaagggatcttcctgcctcagcctcctgagtagctgggattacaggcacgtgctaccacacctggctaatcttttaatttttggacacggttttgctgtattgcccaagatggtcttgaactcttggcttcaagtgatccccttgccttggcttcccaaagtgtgggattacaggtgtgagccactgcacctggcccgacttcacctccgacctactgctggggcccctggtttggcctctccagctttccctgcgtctcacacaggccctgtgccctccgcatttcacccctcccggggagtctgctgcccgtcaactcacagcctggcaaaggggccacaacactgcactgtgggtggaggtgcatgggcccatgctgcacggcccagctcaggagtaggacaaggtgtgggcagccatgcccttgcctcctcacagacaaagagtgaccccaccccaccccatctccctgggcacacgctcccaagtgaccagggttgcttctctctaaaaaggccagtcccctctttctgccccctctgacacctctgagtttggatgggctccatatggagtggggcagcatgaggatccagcttgcttttttttcaccctgagaacagtagtgccaaggatccggctgtctcatccttcacttgtttcatgagagcggaggcacctttccttcagttgctactcattcatcatccccctacccctgggggctgtccatcctggcccaaggcatagaggggcagctgcgggtaacaggcccatttccaatatgagccaacagggaatggctctccagcatgggcatgggggccggtcttagtgatgccggagctgccagcaccctgtggcccgcaccagcacccgttctttcttgggggatgggggtgggaggtgaagaaccagagctagtggttgcttcgtcttccttggttttgctctctgcaatgtgggtatatagctcccaccacccaggggaccacatccctggagagtgcaaggtcacaatgaggtgactgggtctagccacttgcctggaagccactcctcctctcctgccctactttggggcctggagaacaagctcttttaaagcttctcccactgaccagaatctccacacctctaaggggggaggtggctggggacacttccctcatttcctgccacagagcccccagcactctctttcgggccctggcaggttcctgatggacttccccaacaggtccacctcaaccgcaggacagctgctcagacctggaggtcttgggagtgggggaggagggcagcagccaggagttgggccactgagtcagaaggtccaagggcatccctgaaaactgcagtctgtttccctgtcctcctccagcaacccacctgcatggggtcccatctggcactgcatgggccgtaggtccccagccctcccacttcctaaaactgttcttcatgttgaacctgtgactcctctccccctcccccactctgaacggggtcttggccccctctgtcacagcagatccatctctgggacccccaagacagattggtccccagcccctacacatgcatgtcactgtcctccttgactgcaaactccccctcctcacggtgtgcccctgcgcctcctgacacctctccacctgcttgcagagatcagtgtacttctcaatcgttgtccatatcttttccaaaaagattcctcaatgcttttcttttcaaaagggaaaaaaaaaggaaaaaaaaaacaatgccaacagcccagcgtccgtgagcaacccaacagtaacaaagcatgcgttcgggatggaggaaggtaaggccacacgtttccatttgccgcttgctcgtagggctgggcggccgggatgacttggaggggggaatctgagcagccctcctcccctccacttcccacacacacccctgcctgcagggggaggagcagaaggggtctgagaggaggcgtggagaaaagcgcccacaaagctgccccggggccagcaggcccccgattctttcagttagtctgtgttgaagaatgggcccccacctccccttaccacatcattcattcattcattcattcattcattcattcattcattcatgctagaaatgtttagggcacccatgattttccaggccactagggatacagagttaaggcacagaacccccccgagggggtctcccctagatgagacacatgggacgatgagggggcctgggctaggagtcagcacagcgcagggtagggtctggcaggctctgctcgggggacaggacgggctcacagaggagtggacactcgtgctaagctttggaagatgagtaggtgttctggggctttgtagagcaagttacatgaacacaggcccagaggcctagaaccacctggatgggtccaaacaccacacagcttcatcacttttgtgtctcagacataataacgggtatcactagtgaggggttggcggcaggtcatggagggccatttcacagtgctggggagttcagaccttgccctgggaactgttaggagtggctgaaggcttttacgcagaggaaaagcaagatgagggctgtgctgtacatagcccactctggctttggcacagggtgggtgacctggagtcaggagactgaggcgcacagggcaggcttagccagggcagaggcagaggagggagaagttcagcagagccttggttaccttaccctgggatgcgggggcgagggagaacgctgcccccatccttcttacccgggtctaactggcaaagggaaaatgcgagcaaggcgctcaggttgtccctggcccccaagaacaggacattcatcttgtaagcccctgggtggctttccctgcactgtggtgtgatgggctggggtgcatccacgaagactcattggtgggaccaccgaggctgctggggtatttgctgggggcctatgccaagggacggtgggggtgccatgcctgggcccgggctcccgtttcctggcttccttggcagtgtggatgtggaggcattttgcatcaaggccgttaaagctgcccctgagctgtaaaaaggggccagccttccccatcctggtggccctgcctgctccttcctcgggggctttcttccttaggcctggcggcccgatcctaaggaagcccctgcttttcttgcgcctgccggtgctcttctcccgcccgcctggccctgctgtcagcgccccctagtgccgggccggccgcgcatgagggcggtgggacagatcgcccacaactcctcggcttgcttttggggaaataaggcaacagaggggtctcttggagtctggagcttccatgtaaaatccccagggtctactcttggctttaccaccctctccatctcatggcacgatggcctgtccccccagattagggtgatactgaaggaggagcaggagaaaaagatcctatctgccttgttttctatccatatccagatagctcttgactttcccaggcagccaatgtcccctggaggtcagggaccatagtcaggccctcggtccctgtccacagtcccatccccctactttccccaatttgccaagaagccctggtgtcccagtgaactgtcccaccgagaccccggcgacagactcggctgatggatcccaagggcccctcccctccccaggcccaggtgcccgcctcctccccactccactctgtggctgctgcaggcctgcagggagtcggggtcagtggttcgttgctggctggctggtgttggccagcccaggagtgaaggccatgaccccttcattccctaaccagagccggctgtactgcgcgtgtggtggcagggggcctgggagcggttgcaggatgaagaccaaggtctcaagccagaccagacgagtgcaacgtttttgcacatcttgctgtttcaagtgactgctttgaggtcctgcactcctgggtggacaggccagactccttcagtcacaggcaggcatcccttggagaaggaaaggttgcaggtctacatatcttggcttggggcaggctccagagactgcccggtgtgtgtgtgcccatatgtcagagcccccgggggagactgaaagggaatcggaactgaccaccttcaaaaagccaagaagtaattggttcttccttgcactcagcaagcagggaattccattcccaacccacctaccccaggacctgacttgggtcaagagatggtaggacaattgagcggcccacagctgaattagatggatcaagctgccatatctgaggtggcaacatggatgtgcagggccagggaggcagaggaggaggagggcgggactccctgcctgcccttcaggttgatgctgaggggcctccaggagacttggggcctaagaggaaaggagaaaggaggcacttcaggcagacagggaccctctcttcattggagcaggcccctctcaaaccaggcatcccctcccagggaaacaggacacttggcaggaggtgccaaagatgagccaagacctggccagcagatggactgtgtgggtgagcatgagtgaatgagtgagtggcaaagccaggcagaagctctaggcacaggcagggcaggagagaggtggggacagatcaggcagggatgctgcaagccctcccgtgtcctagcttctccccgcctgcctcccctgtagagccgggacagaaggcactgtggagttgggggcatgctggctgagcatgagtgtgtgcaggcgtgggtacgggctcatgaagagctgtgtagtccacacacatcgtcagggtggccgtgcttcgggcctaaagggcttcccgcagcagggagacggtgctctcacaccagagtctgccagccagggggctttccctcccctggctgagccttcctgtgacctgagctgccccctgcccatccagggagcaggcggggatccccctgcggaaggacacaagtgaacccagaatggtgcctcaaggcaggcagcctggcccagatggtgcccccactccccagacccaactctaaccaggcctggccctctcctgtgtcttgcagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcatgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccatccctga

SEQ ID NO: 2696 - DNA, 715029 bp, Homo sapiens; identical to SEQ ID NO: 2695

SEQ ID NO: 2697 - DNA, 7265 bp, Homo sapiens
ggatggtccattcgctttattgggtgcgtgtagtgttgtcatgacatctcctaaggaactggggggcacgtttgacactcatgaggtcagaacaggtctggtgggcggggggggggggggtcccagggtggtgaatacccacagcacacccccccaccaaaagagaaaacggggagaggagcctggcaggccagactctgatccccatggtccacacagggaaacccccaacagcggcctcggcccaccgcggcagagccgaggggctggcaggcctggccacctcccattgcccgatcagcctgctttagggtgtcatctggcccctcttcacaactgacaactgtggatgggggtgaattttaaaaaaaggcggggggggggggttcaggagggtgagcggtgagttcacggggccacgagacaccacagctgagtggggaaagggctatatgtacaggaggggcagggcttggggcgggcaggggagcctgggcccctgggggacatcttcaataaataaataaatagctacaataataaataagggtgacgggctaagtcaggagcaggggtcttgtgcccgtggctggtaggggccgggtcaggcccgggtagttgggggaaggtggggaagacagggaagaggggaaagggagtgggatggctctcagcaggcgcagtcctggtgcggtggcacctgctggtcactgagctgtgggccctgcttggcgcctgtgaccgcagggtccgccgtgtccaacgactcggacatcttctcgcagatgacatccaccaggcgctcaaaggtctgcttgacgttaatgttgtccttggcgcttgcctcaaagaactcgaaccctgtggtcagagaaggcagggatgaggaccctggccacgccctatgccaactcccagagatgcttctctgaggaaagggaacacctggagattcccagtgccaagcaacttattgaaggtactgacaaatcccacagagaagaaacttattgaaggtactgacaaatcccacagagaagcaacatggaactgggtcagctttgcatttcctgctttttttttttttttttttttttgagacagggccttgctctgctgcccaggatggagtatggtggcgtgatcatagctcactgcagtctcgacctcctgggctcaagtgatcctccacccccacctctcaaattgctgggattataggtgtgagccagcgcacctggcctcctgcccttccttcctaaaattgtgtctcgttgtccttagggacctggcaagacatgccctgcagcgtccagcccagccccgtgcactggccctggaaggctctgacactcaaatccagctgtgacctccccctgctcacacaccctctgtgactccctattgccctccaaagagtcccagcctctcagcacatggttgaggccctctgtgatcggccacatttcctccagctgaccctcatgttccagtcttgtgaaattattaccaaaacacacaggacctttctcactgcaagcctttgcccaagctatttcctctgcctgaaagacccttcttcactacccaccactccaggaagcctggctcctctcatgtgctcctcccatccaggtccctccctctacctcaggggtccctcgaggcacccctagatgcctcttgagcccagcaacacccaacaaagcgttggacggtgagtgtcagaataaatccttaaactttctgcatggcaaactcctacacatccctcaggatccaactcaaatggctcctggatgaaggctagtttgcagaaagtgtgaattacctggctttagctgtaagaccttgggtgtgtgccctcccctctcttagtgtcctttttctagacttgtgggtctccagcccagctgggcactcaccaaggtggtcagctagctgccggccacgttctgatgacaccacccgctcatcctccatgtcacacttgtttcctaccagcagcacctgggcattgtcccatgagtaggtcttgatctgggtggacctataggaggcaccaatgggggcaggtcagggcttggaggatcccagctccaccctgacgggctgatgtggagcctgtgtccttgtccgaggaagaaagacccagaagcttgcccctccatcctccccaccatcctttcccccaatgtgccccgctttcaccccactccagcccccgactgacccattattgtttctgtgttttggggttttttttgagatagagtctgggtctgttgcccaggctggagtatctgcctgccttcgcttctcaaagtactggaattacaggcatgagccacccagcccagaaattttctttttttgagatagagtcttgctctgtcgcccaggctggagtgcagtggcgcgatctaggctcactgcaatctccgcctcccaggttgaagtgattctcctgcctcagcctcctaagtagctgggactataggcatgagccaccatgcctggtaattttttgtgcttttagtagagacagggtttcactatgttggccacgatggactcgaactcctgagctcaagatctacccacctcggcctcccaaggtgctgggattataggcatgagccactgtgcccaacccagaaatttttttttaaagttattacttctgagcagaaaattgaaatgtttacaatctctaacctatgccaactctccttttttttttgagacagagttttgctcttgttgcccaggctggagtgcaatggcaatcttggctcactgcaacctccacctcccgggttcgagcgattctcctgcctcaggctcccaagtagctgggattacaggtgtgcgccaccacgtctggctaatttttgcattcttagtagagatggggtttctccatcttggtcaggctggtctcgaactcccgacctcaggtgatccacctgcctcagcctcccaaagtgctgggattataggtgtgagccaccgtgcccggccatgccaactctccttatagtctctatattctccaccctacacttgcagatatttgtttctatatggttatagttttacttttccatctgaaatccttctctgacccctacgttttatttattattttttgaagaaagtttggctcagagacaatggccccagaatgagtgtggaaggccagaagcgatggctcacgcctgtaatcccagcactttgggaggccaaggtgggcagatcacttgagccaaggagttcaagaccagcctgggcaacatgaggaaaccccatctcaactaaaaatacaaaaaaattagccaggtgtggtggtatatgcctgtagtcccagctacttgggaggctgaggcaggaggatcacttgagcccaggaggtcgaggctgcagtgagccctgatcgtgccactgcactccagcctgggtgacagaataaaaccctctctcaaagaaaagaaaagaaaaaaaaagagcaagtggggtacactcaccagtcctgcactgcattgaaggattcctcgttggtgatgtcatacatgaggatgaagcccatagcgccccggtagtatgcggtggtgatggtccggtaccgctcttgccctgctgtgtcctagggaggaagagatgaaggtcagagaggacctgcacataaggccctcgaagaggaaatgagctctgatatcatccagttcagccccctgggagaagcaggagcttgcccaggggcacaaagtgtcaggaagagcaggttgggtcaccagtgctcagaatatatgagtgctccattattccacagagtcattcaccaaacgtactgtgccaggtgctgtggctcacacctgtaatcccagcactatgggaggctgaggtgggcaggtggcttgaacccaggagttccagaccagcctgagcaacatagcaagaccccatctctacaaaaagtacaaaaattaacagggtgtggtggctcacacctgtagtcccaactactcaggaggctcaggtgagagggttgcttgagcccaggaggcagaggttgcagtgaggtgagatcgcgccactgcagttcagcctgggtgacagagtgaaaccctgtctcaaaaaacaaacagggggtcgggtgtggtggtggctcacgcctgtaatcccagcactttgggaggccaaggcaggtggatcacctgaggtcaggagttcgagaccagcctggccaacatggtgaaactctgtctctactaaaaatacaaaaattagctcggcgtggtggcatgcacctgtaatcccagctactcaggaggctgaggcaggagaatcgcttgaactcaggagacagaggttgcagtgagccgagatcgcgccattgcactccaccctgggtgacaagagcgagactccgtctcaaaacaataacaacaaaaaaaaaaaaaaaaagaaagaaagaaagaaagaaagaaagaaaacagaggccaggcgtggtggctcatgcttgtaatcccagcaccttgggaggccaagacaggtggatcacttgtggtcaggagttcaagactagcctggccaacatggcgaaaccctatctctactaaaaatacaaaaaaaaattagctgggcttggtggtgagcccctgtaatcccagctactcaggaggctgaggcaggagaatcgcttgaacccgggaggcagaggtttcagtgagccaagattgcactactgcactccagcctgggtgacagagcaaaaactctgtctcaaaaaacaaacaaacaaataaacaaacatggactgggcactgatcttttccacaccctgaactggacactggggacacagttgttaacaagatgggcacttcccttgctaagtgacactcagtgtgggaaatagaaaataacggtataaatgtatcctatattggagagtgacaaggaccaaggagaaaaatcaagccagatgaagatggagagaatttaactgtaggtttaaaaattaaaggaagctgacacttgcctgtactcccagctacttgggaagctgaggcgggaggattgcttgagcccacgagttcaaatccagcctgggcaacagagtgagactctgtctcttaaaactaacaaggccaggtggggtggctcatgcctgtaatcttagcactttgagaggctgaggtgggaggatcgcttgagcccaggagttcaagaccagcctgggcagacatagcccgaccctgtctctacaaaaaagaaaaaaatcagcaggcgtggtggtagaagcccgtggtcctagctactcaggaggctcaggtggaagaatggtttgagcctgggaagtcgaggctgcagagagccgtgatcacgtaactgcattccagcctaggggacagagcaagaccaccctgtctcaaaaaacaaacaaaaaaagagaatggggaccaagatccagctgaaacctcatacatggaagaacttgaagatggggaaactgagggaccaggattaggtgcttatgggagaacacaggtgctgtttctgccccggtacacagtgggcaccttactgataaatgcccagtgtgtaagtgaatgactccagtcaggaaagagatagacgaggttggggctgcttttccaagtacgggaatccaaccgagccgggcgggagccctccagctgggacccacccagatctgcagcttgatcctcttgtcgttgcgatagatggtcttgaccttgaagtcgatgcccacggtgctgacgaaggcaggcgtgaacgagtcgtcagcatagcggaagaggaaggacgtcttgcccacgctgctgttgccgatgatgagaatcttgaacatgtagtcgaagttctgatccgaggactccttctgcccatagcgcgagtctgtggcggatgccatctggggataccgggtgtagcagagccgtgaggggggctctctccatcctcatgtgcccaagcccaggcagaagatggcaagggctccagaaaacggccggtgtatggaggacacccttatcccatcaggagccccagtattaattggtggtgcccccagcagagggcagcctgtgaccttgaaatcctgggcgtttcagaggaggggctcagagggttgccgatggggacaccccagcagcccccttcaaggggcaggtgccccaggtggggctgtaaccctaaacccagggctgagcccggagggggtgactgcggctggctccgccccccatcaatctttcatggtcctcagaacccggccgcgcggccccacgtgcaccgcgtgcatggtccctcgaggacgcgcatctgcagcccccgctccccgcaaacctccaggccggagagctccggccaaggccgctgcatcacatgatacaggaggggcatgcacacgctcacgtgcacacagcctcaaacacgctcatccgtacatacaggagtgtgtgaacgcactgaggtgcacaggacaaagacacagacacctgtttgcacaccgactcgcctatagaaatgtgcaaaccacccgtgcgcacaggcccctccacccatgcaggcgtgtgcacatcacccacacggacacggatccccgtgcttgtatgcacgggccatacctgcacaggcggtccacacgtctttctccacgcgcgtgcaacgctcacacacttaggcccagacccccacggcgtcacacgagcatatccaggtacacaagcaagggtgcacacagacccgctgacacaggcaggcgcgcacacgcgtgtgcacaccacgcgcacgcgcacgcaaaagcctcccgcgcgcacagcttcccgcaaggagctcggctcccctccccctccgccgcagagcaggggggttgggggggttagtggtgaggatcaggcaggagtggggcgcccgggccctacccattcccagcctcgcgaccgccgcatccttccccccattcaaccctagtcaacctcgtcccccacctccatcagcccatcagtcaaatgaaggttatgcaggtgctcggagcctgagcacacccggccgcccaggagctcaccttgccctgcaccgatgcaacggcgaccctagcggcggtgacttttttggcggtggcggtgacaggaccccggtgcgttgatgtggggctgcgcggcggcggcggcagcagcggctcaggcccctgcagtcctccgtgacgtcctgcaaagggaggggcggagcctcac

SEQ ID NO: 2698 - DNA, 3512 bp, Homo sapiens
ggtcggcgcggcgaaagcagagcggcgcgccggttccttggttcctgagggcgatggcgcggggtggctggcgccggctacgccgcctgttatccgcggggcagcttctattccagggccgcgcgctgctcgtcactaacacgctgggctgcggcgcgctcatggcggccggtgatggcgtgcgccagtcctgggagatccgcgcccggcccggccaggttttcgacccacggcgctccggtgaggacgccacgctgcttagtccttcaccccgggcgacctttgatcccgacacccgactgcgggccgtgacccctgacccgtggcctcagtcccccgcaggacccttgccctgaccgcgcctctccccgggtgtctgtctccccgcagctctgggtctccatcacctcccaacccccggaggtctctgcccactacccaggagcctctggagccgcgcctcctggtggggcttgtagtggaagaatgcacgggtgggctcttccggttttcccggtgaggctgaggctccgggatggcattgggcttacccaggccttagccagggagggagagagggaatggactgaggaacttgccggcccgacccagccccctgacttacactcttatagcgagcatgtttgcggtgggctgcagcatgggtcccttcctgcactactggtacttgtcgctggaccgcctattccctgcgtctggcctccgaggcttcccaaatgtcctcaagaaggtcctcgtggatcagctggtagcctctccattgctgggcgtctggtacttcttgggtaaggagcctcctaagcctaggctttgcctctcataggtcgggaggggtggagccagctttgtgttaagaaggatgcagaggtgcatttccaatttgccccctgtttgggtcgccctggactaggagccaggtcacagcggggacaggacggactcggccgatgtgaacgctggcgagtgtaggagggacgaggactgtatctgttggggctgccctgggcgggaggttgagagcatttcccaaagaaggggaccacactcagttgagacatgaagagggaaccagcgggcagagggaacagctaatgcaaaggctctgaggcctgaaggaagagaaattgaggctagacttaatggggtgcaaccgtgccagccctaggctcggtaaagacagcggtattaatagaggagtctctcattctccacctcccagcccggcttcctggtctgtgatggaaaagtaacacaactccctcaacttcagggtgtctccattggggcacgtgtttatatgtttataacctctctttctctcactgggactgacttgctctgttttgtctctacaccagctaccctaattctctgtccatcccatctgaaagtccctgtccctctgcccggggtgggcggcgtgggctctcaggggcccaaccccgccccctccatcgtcagcccatcttgtcgtctcaacagtacttcctggcctctaacactctcatttcttggtttgcttcccaggccttggctgcctggagggtcagacagtgggtgagagctgccaggagctgcgggagaagttctgggaattctacaaggtgggagcacccgccccttgcacatgtccggccccgccccctgatggccgctccgcccccgcccagctctggccccgcccctcatcccccgcctctccccgcaggcagactggtgcgtgtggcctgctgcgcagttcgtgaacttcctcttcgtgcccccccaatttcgagtcacctacatcaacggcctgacgctgggctgggacacgtacctgtcctacttgaagtaccgggtgagtgtggagggcataccaggcacccaggggactccccagggggctacacgtgtgagctccaagtggcagtgtagccagccaccctggagggtgggagtctcctgtgctcctgacaacccacacccaacagtgggctggcggagagctcctcactagcagttaagacccagccgtggctgagcgccgtggctcatgcctgtaatcccagcactttgggaggccgaagcgggtggatcgcctgaaattggagttagagagcagactgggcaatatggtgaaaccccttctctactaaaaatacaaaaaattactggtacgcacctgtaattccagttacttgagaggctgaggcaggagaattgcttgaacccaggaggcagaggctgcagtgagccaagatcatgccactgcactccagcctaggtgacagagcgagactccgtttcaaaaaaaaaagacccatgccgggcgcggtggctcacgcctgtaatcccagcactttgggaggccgaggcaggcggatcacgaggtcaggagatcgagaccgtcctggctaacatggtgaaaccctgtctctactaaaaatacaaaaaaaaaattagccgggcgtggtggcgggcgcctgtagtctcagctactccggaagctgagaccggagaatggcctgaacccgggcagcgaagcttgcagtgagccgagatcgcgccactgcactccagcctgggcgacagttcgagactccgtctcaaacaaacaaaaagacccaacccttctctgctgtctgatgtgacctcagcccggtccctgccaagtctgttgagcagggctgacctctggcccaagggcaggtagagggacagggagggatgagccaggcttctgaccagatgccttgtcttgtgtggacagagcccagttcctctgacacccccaggctgtgtggccctggacacccgagcagactgaactgtctgcttcctggaccagatgcaagactgtctcctggcggaccaccccctctgacagaaggggaatgggctcctgcagcaagctcgggtcttgagccacgtcccagcaccacttcagctccggagcattgggctgagccgccctttccaagctcacttctgggactgagtttcctcaaccggaacacacccatgaagatggatgatcatcccctagcccttctcagcaggaacctcatgcgacctgtgaccaagatgtcccatcctcagcacagggcccactctgccaaccagtctcaagcaccagcccctcaacactgccatccacctggctctgggccaagccaccaatccagagctccctcaggtcctgggactaaggcggggacatgactgatcccctcagagcaggctcaggcctggagtcggcccccaaaagtttcacatagggccaggcagcctctgtgtttctttccctggtcctgaactgtggaaatgccattaaactctctctataatgtaactgaaactgctggctgggcgcagtggctcccacctgtaatctcagcccttcccgaggctgaggtggaaggattgctcgaggccaggtgttcgagaccagcctgggcaacatagcaagaccctgtctctatttatattgaaaaataaaaataacaaaagaa

SEQ ID NO: 2699 - DNA, 30265 bp, Homo sapiens
cggagcctcagccttcgccgccgctgccgctgccgtcgcagttgaggggcgagcacccgcccgcccgctgcagggacgccccgccaacgccactgccgcttcaggtctcgggggcgcccaggggagggggttggcgcgcaccccgcggacgcagacaggggagggggctcgggcgcgtgcccgcccgtcgtggccgcgggagggaggggcggggcggcgcgggggcgggccgggcaggcgcccggacccccaccctgggggaggggcaaggacgccgggagctgtccgcggtgctggcgcgggcgggactgaggggccggcccccaagggaggggagcgaagcggggggacttctaagaccacttctagggtaatctggatttgccctaagggttcagggcgtctcagcctttcgagggggggctcttctccgggtaatggggcatctaagatttgccctggggttgggggtttctcaaccttttggggggtttctttcttgttttgggaggatctgtatcagccttggatgatggaggtgaatcacttttggggggctctgccttggaagatgaggggccttggattttctctgggtctagggggctctgactttgtggggcttttcctgggttgttggatagtctggttttgccctccatcatgaaggaatcacttttgagggggctttactttgaggatggggtaccatctctttaagggctctgctttcactgcgggctgtggttgccgttggactcttccctgcacgtcgggaacctgtgaattgagttggggggttcagcactggacttggttctagtgtgtgtatgaaggagtgtgatgctgtcctggacccctggggagcacatgctcaggggacatgggctggggtttggccggctggggatctgggatttgtccttggctatgactgcatttgcctcccgggaccgcggagctggagtccagtgtttgtttttttttttttttttttttttttttttttttttgcaggagggaggagggaggatcttgtgactggagtggggaggagaaaggggaggagcaaactgtttcaggtgccaggtttggtcatgagtggggaagttctggcttggaggataagtctggttttttactggagggggttgggggaggctcaaaaagcagcctgtgattgatcctctctagtgccgtgagaggggcccactcttggtgcttgcgttttggatgactggttttgttggtgggtaggaggactagaactggctttagttgtaggggtgggggtgctggccgggcttgggaggtccgatctgatccacgatggagagtctgtggctagattttggggtagactggtttggagagccagaacacagctttgtttttcacatttggctggggttggctttggttgagggctagaactggtcatggtttggggatctatggtcttagagtcccagggctagaactggggagccctgtgggctcattaggggtgctagatctcgattatggaggatgggtctactccagattagagggttagtttagagagagctagagttggctttaattgggaggttgtttggggggtttatctggccatactggaggaactggggctagatatgggggcttcatttgatacccttgggaatgggttgaggctcttgaattggtccttattggggggtggctaagattgaatgaagtgtctaagtgttgctatgggaggggtggtcctggggatgaattgggagttagctaaattgggttggagagcttgttttggggggggtgatctgtccccaagtctaagaggctgactggccctgccttgggggcttgtggggagttgaggagggcttccctcaggacaggggacaggggagcaaaggattgggcattctggggacccttccatccatcctctatccaggaaagagcttgagctgcacccacccccaatataaaggcctcacttgcaaaggttttttcatcctttcctattccttccacccatacaccctagcagcccaggccctgaacctgggacttcctgaagggatggggggctgtggcaggttgaggggaccagctgagccctcctgccctgttctgcacagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggtgaggaagctgatggcccctctgcctgtgccaggtgcaggaggcctccagggagcccacgtctcacctgctgcacccgctgctgccatcctgctggtcttacacctctggactgactcaaatcagctccagatctgctcctagctatgtggctttgagtgattcatgtaacatctttgagcctcaatttgctcatctgtaaagtggccagcatctcttctgaatggtgcctgtatcctactgtttgttaaatatttcacttcttaatataacctcctctaccaggttccttccataccatttggggcatttaagatggaaggttggggagatgggctgggacagaccctgggaagcccagggttaaagtaaactttggattcttagagccctgggttctaactgtgtctatgcctgttaccagctgtggggccttaggtaattgtgttaacctcttggagcctcagtttgctgttctataaaattaaggaaataataaatatagctacttcctgggctctgtgcacataaagtacttaacacaaggccacgcacctaagagctgtaattactgtggtcttgttacttttaatacttaatgttacctaagtagctctgggccactaagaaccttgacttcagtcttggagggactgaggtagatatttgctctaagcctcaaccctcagaacttccccctcctctggctgaacccctagacctgtagccctggatatacacacttttctgactcacacagagacacccatgttggccttaaacccttaaatggtcattgatgtttcataaatggtggcatatggcgaaggcagtcttcttgactttgagtttaatggaagttcattctctccctgcctctctggctccctctatctttctttcctgtctgtctatccctctatccttgtctttcttacggtcctctccccatgtttctgattttctgtgcctgtctctctgttgatcactctgtgactgtttgtctctccctgactccttcccatgtctctgtgtccatctgtctctccctgtatctttctgtctccctcccctcacttctgtctgtctgtctctctcttcttgtctctcttccttggttccttccatttctgggcctatctctgcatccacccctcatgtctctctctccctatgtgtctcccactccctgcctctgattctcttttcacatccttccctgtgtcctgtcactctcccacacttctctgattctccccaccatctatctatcttctccatctcctgccatccacccacttggggcaggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcaggtatggtcttcctggcccagatgagggctccctatgccacatgggggccaggtcagggtccaaccccactcaaggtatgtcaagtggaggggatttaatacagggatttatttcaaacttgtagaagatgagaaagggaatattgaagcaatccagctagtaataactgttggaagcagccaccactccctaaggtatggagtacaaagggaaaaggaaggatctagagccacaaagcagtaggtaaatgactagcatgctaaaggtttcacaggaccctgacactcatttcctggatggagaaaccaaggctcaggggtatgggaatggctttgcatggaataacaatgacattcattgagcatttctctaccagtctctgggccaagcactcactgaactcatcccagccacttctggagattggtactgttattatcctgttttaccaatggggaaactgaggcacagaaagtaaggcacctggcccaaggacacacagctaaccagtgtctcctttatgaaacagggcactcttagagaacagacgcagcgtctgcttgtatctgctcccagcttggcagctccatgcttggtacacagcagttcacgtggaatgaccagaggtgaacgtagccattgcttctcacctcccagggagtaatggctcctgcctttgattttctttttttgttgctgttgttgatgttgttgtttgtttttttcttcaagatagttactcactctgtcgcccaagctggagtacagtggcttgatctcagtccattgcagcctcaaactcttgggctcaagtgattctcccacttcagccttccaagtagctgagaccacaagcgcataccaccacgtctggataatctttttaaattttttatagagacagggtctcaccatattgcctagggtagtctcaaactcttgggctcaagcaaccctcccgcctcagccttccaaagtgcttggattacaggtgtgagccatggtatctggcccacgtgactcctgcttttacctgtcaggaacaatgcctgactgactgatgggaaactgaggttccaggaggtgagaggtgaacttacttgtccagagtagcaaatagcaaagcctggatttcagtccagtgcccttgactcttcactcctcctttttgatatatttcctatgtagttatatagtgcttggcatagtgtatggcaaaaaaaaaaaaaaaggctagtaagaaatacataatgacactgattagtatgtattcattcatctctgtggcaaataattattaggtaccagctgggtgtggtggctcacgcctgtaaccccagcacttcgggaggccgaggcgggcggatcacgaggtcaacagttcgagaccagcctgaccaatgtggtcaaacctcatctctactaaaaacacacacaaaaaaattagctgggcatggtggtgcacgcctgtaatcctagctactcaggaggctgtaatcccagctactcaggaggctgaggcaggagaatcacttgaacggggaggcagaggttgcagtgagctgagattgcatcattgcactccagcctgggagacagagcgagactccatctcaaaaaataaaaaaataaaaaaaataattaggtacctactatgtgcccggcacttttctgggtgttgggatatagcagtgggcaaaatggatgaaaagttactgccttcacggtgatcccattctggttgggggaacaagcaaaagaacaaaaagacaaacagatctgaatgtgatggccaatggggtcagttcgttctttttccctccgctcccctccccttcccctctcttttcttttcccctcccttccttccttccttccttgcttccttcgttggagtcttgctctgtcacccaggctggagtgtggtggtgcaatgtctgctcactgcaacctctacctcccaggttcaagcagttctcctgcctcagcctcctgagtagctgggattacaggcatgtgccaccacacccagctaatttttttatttttagtagagatggggtttcaccatgttggccaggctggtctcgaactcctgaccacaggtgattcacccgccttggcctcccaaagtactaggattacaggtgtgagccactgtgcccggccaatgaggtcactacttaatatagaatagcagttctcaaatgtctgggtctccaggaccccccttacactcttaaaccgcattgagatccttagaaagctttgtctgtgtgggttagacctattgacattcactgtattaaaaatgaaaatcgaggccaggcataatggctcatgcctgtatcccagcactttgggaggccgaggcaggaggattgcttgagcctaggagtttgagactagcctgggtaacggagcaacagcctgtctctattttattttatttagttatttgagccaggatctcgctctgttagcaggctggactgcagtggtgcaatcacggctcactgcagcctcaacctctggggctcaagtgatgctcctccctcagtcccgcaagtagctgggactacggacccacaccaccatgcctgattgattttttttttaagaaacagaatctcactatgttggccagtctttatctctatttattgaactaaaaaaaaaaactaaaacggagtctggctctgccacctaggctggagtgcagtggcttgatctcagctcactgcagcctctgcctcctgggttcaagcagttctcctgcctcagtctctggagtagctgggattacaggcctgtgccaccaagcctggctaatttttgtatttttagtagagatggggtttcagcatgttgcccaggctggtctcgaactcgtggcctcaggtgatcggcctgccttggcctcccaaagtgctgggattacaggcatgagccatggcatccagactgtagttctctttcatgtctagaatagaagagagctagcttctcccatccgtgtctgtattcaatccatttcactagcacaggtcatcaggtctctgaaaaacactgctgcatgctggagagagaatgagaatggtgaaggcaaataacatcttagtatttttataaaaatagttgtaaccttgcagatgccttgaaaagatctcagggatcccccaggggttccttggccacagtttgagaactgctgatgtacacaatgtgctgggcactgttaactcctctctcctccccaacagccccatgagggaggtcctgttattatccccacccagcagaaaaccacagcacagaaaggatctgtggctcacagaggtcacatggctaccaagtggctattcaataccacctttagtccctccctgagcctctgtcctccctcttaaataggactctatcatcagtgcaggtctcccagggccaggtggggatgtgcacagaaaggagccacttagcacagtgcccaggatgtggtaagcctgcaagaaaggggcatctgactgtcagggtcccagccagaaacagaagcaggctcacctgcagaaaacttgagtttcttgacaaaggtgtgagtggagaacggggaagctgcaggaagcatatagggctgtgggactcatggaggggagcttttgctcctccctagccagagaaggtagagaaggaaaagttattggaacttggaaggggagagttgccagacaggagctggcactcttagtcaagaacggcagccatggccagacgcagtggctcacgcctgtaatcccagcactttgggaggccaaggcgggtggttcacttgagatcaggaattcaagaccaacctgggcaacatggcaaaaccccgtctctactaaaaatacaaaaattagccgaacgtggtggcacatgcctgtaatcccagctactcgggaggctggggcatgagaatcgcttgaacttgagaggcggaggttgcagtgaggcaagattgcacctcactgcactccagcctgggtgacagagtgagactctgtctcaaaaaaaaaaaaaaagagaaagaaagaaagaacggcagccagaccatggcaccatagcagggaagagctggggagataataccccagactcactttcctctgggcttccctttgtcagccagggctggcttcatgggtgtttgcccgtgcagtgacacagggctccatgcttggtttaatgccctactattgatgtcttgaatttttttgtttttgaggcagtttctacctctgtcacccaggctgaagtgcaatggcgtgatcatggctcactgcagccttgaactcctggactcaagtgaacctgtcacctcagcctcctgagtagctgggactacaagcgtgtgccaccacgcccagataatttttgtagtattttatagagacgggggcctcactgtgttgcccaggctggtctcaaactcctggcctcaagtgatcctcctacgttagtctcccaaagtgctgggattacaggggtgaagcactgcccctggataaaattcttaataaatatttgaacaagggaccttgtgttttcattttgcactgaaaagtataagccatgtttgaggccaacccacatggaagccagaggacaggagggctggtccatgcaggtcagtcctgcacagggcagggtgaagaagcttggactatgggtctcaagatcccgggctgaagcatccatccacctcggcctcccaaagtgctgggatcacaggcgtgagccactgccccagcctattgctaggattcataattatcttgcagtgattactaattcttccccagcagtgttttgcagtggctgaaggcacagacttgggactccagcaggtctggttctgagtcacagctctcccacttgctgccttcgtctctccctctgagccttggatgccttctccttgcaatgggaaggacctcaatgctcaccccctggtggatagcaggagtgtgggaagcagcagagcatctcagtgaagggcatggatgctggcgctgggctgcctgggtcaagccctggctctgtgccttatcacctggatagcccaaggaggttacttttctctccatgcttcagtttctttttctttttttaagagggagtctcactctgttgcccaggctggagtgcagtggcaggacctcggctcactgcaacctccgcctcctggcttcaagtgattctcctgcctcagcgtcctcctgagtagctgggattacaggcacctgccaccacgcctggctaatttttgtatttttagtagagacggggtttcaccatgttggccaggctggtctcaaactcctgacctcaagtgatccacccacctccgcctcccaaagtgctgggattacaggcatgagccaccgcgcctggctgtgcctcattttcttcttcagtaaaatgggcataatgatatttctgacctcataaggacattgtgaaggtgaaaagacataatgcattaagtggtttcagaactgctgacccaacaaatctaagattcagtatttattcacaggtctttaatttttttttttttagaccaagttttgttcttgtcacccaggctggagcgcagtggcacaatctcggctcactgcaaccctctgcctcctgggttcaagtgattctcctgcctcagcctcccgagtagctgggactataggcacccgccaccatacccggctaatttttgtatttttagtagagatggggtttcgccatgttgtccaggctggtcccaaactcctgacctcaagtgatccgcccgcctcggcctcccaaagtgctgggataataggcatgaaccaccgtgcctggccagtctttaattttaactgtcataaaactgagagcatatcaccatcactctactgttttcaaaagctagttgtttcaccttccctttggttgttacttatgtgatacacggttacttcatttgtttttgttcatattccatttggggcatttacccctctccatgctgctttttaattttaatttatttttattttttgatagatggggtctcactatgttacccaggctggtcacaaactcctgggctcaaacagtcctcctgccttagcccctcaaagtgctgggattattcgcgtgagccactgcacctggccccaaaacacattttaaaaaagcaacatggatgattgggcacagtggctcatgcctgtaatcccagcactttgtgaggccaaggcaggaggatcgcttgagcccaggtgttccagaccagcctgggcaacatagcgagattcacatgcctgtgttcccagctactcagaaggctgaagtgggaggatcacttgagcccaggaggttgaagctgcagtgagctgtgatcgtgtcactgcactccaatctggtcgacagagtgagacccccatctcaaaaaaaaaaaaaaaaaaaaaaaaaagaaaagtaatttggaggtggtaaatgaaatatttatatagtgttaaaagttagaaccatctttagctcacttgcttttgccaaattgcctgcccaggtccttctgtggctgctcactctctccccagcagtacacatgagctcctgtttcctctcgtccttgccaacacttggttttgtcagacattttagatctttctcagtccgatggctgggaagtggtatctcactgcagtgtgtgtatttgtatttttttccaatgctactggcgagcttgaccatctttgaccttcttttgtactatttaggttttagaggaaggagttggggcctcctgctttagccagagtacagagttagctcttccctccctgtagggggttcagtctcaaccaagcccagcaaaccatgagatgggggtccccattgttcaagggaggggctgaagcccagaggagacaagggagtggccctggggtcacacagtgatgggtgccagaggcaggctccagcacgagactcctgggcccttttcccagcagagggagcccgaggcaggaagtgactgtgtgggccagggcacccagacggagcccagctgcccctcaggagctgctactggggaagggacctgccaaggccctgctgtcccctggggcatacacaggagaggggttggctgccatccagcctggcacgtttcctggctgtcccatccacccttagggcactggggccaggctgggctgagggaggtactggctcggggtctgaggggtgtagtggtgtgcagtgtgtgagcgatctgtccccctcagcctctctcctgtcctcccgtcgccatctctgtgtctctctcttccctttgtgtccctctctgtcctactctctcactcccttctctctgtctctttatttattttgagacagaatcttactctgtcacccaggctggagtgcagtggcgcgatcttggctcactgcaatctccgcctcccaggttcaagcgattccccagcctccccagtagctgggattacaggcacccgccaccatgcctggctaatttttgtatttttttatttttattttttctttttgagacggaatctcactctgtcacccaggctggagtgcaatggcacagtctcagctcgctgcaacctccgcctcccggattccagcgattctcctgcctcagcctcccaagtagttgtgattacaggcgtgagccaccacgcccggctaatttttgtatttttagtagagatggggtttcaccatgttggccaggttggtcttgaactcctgacctcaggtgatctgcctaccttggcctcccaaagttctgggattacaggcatgagccaccaccccagtctctctgtctctttttatttgacttctctgtctctgcctccttcccgtgttcctcatgtcctccttgtgtcctctccctcatcccgtaccacacccgctgctgcagcaggctctctgggaccccacctcccaggtcctggccacgtgacccagaatcctctctcggggcctgttgccaagctgtgcttcctggccaagaagccagatggtggagtctcaagtcctggctccccagccctcagggacctggccagctggtcggcctcagccacaggctcctgcttggagagatgggggactggtctcctgccagatgagaaaatgcactagaggctttgcagctgccaggctctgtccctggggaccccacactttttccaggcccacccccaccctaagcaaagctctttctctggccaaggaaacaccctcctcccccctgttctgcttctctgtcccatgtttttgtatccagctcagcatggcctaggagaggagtgcacattcagggactatacagtcccagtccttgccttattgggactcaaggcaagggaccccatcctttctttctttccttttttttttgtttttgtttttttgttttttgagacagagtctcactctgttgcccaggctggagtgcagtggcgcgatctcagctaattatgtcttcataattcacaaattatgtcttcaatttatgaaggtgctggctcggggtctgaggggtggagtgatcagtaactcaaattacgtcttcacaaatctccttgtcttcatttctgagcaccgctttcttctgtgttggcctcatggtcagggagtccctgatgttggcaggatgaccccaggatgcccggcctacctcctcccaacttaggaagcccatgggaaagagagcatctcttctgtgcacacacattttcctggcgaaaatggggagagtggccgggcacagtggctcacacctgtaatcccacactttaggaggccaagatgggaggattgcttgaggccaggagttggagacccgcctggccaacacagcgagaccccacctctaccaaaaaagaaaaagtgggaagagttttcattggcccatctaaggttacgtgctcatatctgacccaatctttatgaccagggtgttttcagtgttctgcttggccccacttgggtcatgtgattacccatgactctctaggtttcatttgcccttcaggaagctcaggacctgagagtgagttttgatgtatttggaaggagaggatggattttgggcaggcaaaaccaacaactctgcactacagaactttgaatcaagaagtcttggcttggttcttgagtttggggttttgttttgcagtcatttgtggtaatctgctaccacttaattttttaattgttattttgttttcttctctagctttcctccatctgtttagaattacaagggtaatatatgaatatattcttttgggaaaaaattttactaaccgagcagtcttcagtaaaacataaagtctcactcctatctgcctcccaatcccacatcccaaagagagcctcagttatttggtgtgcatccatctagacctctttctgtgcatttacaagtgtacctatatggatgtttaatgtttttatattatttgcttttcatgtttaatttcaatttttgaataaataaattttcatggtgaagacatcaaaacctctagggaaatcccatgggaaaattatcgccttcatccctgttccccattcattaagttctcatcccctcccccagtaagtaccatctgttatgaacttcttgtttactccagggaatttttatgcatgtgcaatccactataaatttatattcataggtaggttctaaattgcttcttcttcttcctcttttttttttttttttttgtttgtttgttgttgagactgagtttcgctctttttgccaaagccggagcgcaatggcgcgatctcagctcactgcaacctccgcctcccgggttcaagcaattctcctgcctcagcctcccaagtagctgggataacaggcgcctgccacaatgcccggctaattttttgtatttttagtagagactgggtttcaccatgttggccagcatggtgtctatctcttgacctcgtgatccgcccgcctcagccttccaaagtgctgggattacaggcatgagccattgtgcccggcttttttttttttttttttttttttgagatggagttttgcttttgttgcccgggctggagtgcagtggcatgatctcggctcactgcaacctctgcctcccgggttcaagtgattctcctgcctcaggctcccgagtagctgggattacaggtgtctgccatcacgcctggctaattttttgtgtttttagtagagatggggtttcaccatgttggccaggcaggtctcaaactcctgacttcaggtgatccacgcgccttggcctcccagagtgctaggattacaggcgtgagccaccgcacccagcatgctttttcttcttaacagtaacacttggctatttttccatactggtctggatttgtttaaccattttactcttttttattttttatttttttttaagagagggggtctagctgtgttgcccaggctggtctcaaactcctgggctcaagcatttctcccacctcaacctcctaagtagctgggattacaggcatgagctgctgcacctgacttaaccatttctctcttgatgggcattgaggttgcttccagttttttcccattataaactctgctgtgatactacaactttgtgcatctgtgccagtatttcttttttttcttaaaaaaatttttattattattatttaaaaatttttttttcaggatggagtcttgctgtgtcacccaggctgaattgcagcgacgtgatctcggctcactgcaacctccacctcccaagttcaagcaattctcctgcctcagcctcccaagtagctgggattacaggcgtgcatcaccacgcctagctaatttttgtatttttagtagagacagggtttcaccatgttggccaggctggtctcaaactcctgaccttgtgatctgcctgccttggcctcccaaagtgctgggattacaggcgtgagccactgcacttggcctatgacagtatttctttagttatattactagaaatgcaagtgctgggtcaagcagatgcatattttgcattttgatgcaaagacctgccaaattgccttctaaaaaggctctaccaatttatgccaccactgacagtggctgagtgtgcccatctcccaacatctttgccagcattagatactataagtcttttacatttttgccaacctaatgtgtagaaaagaatgccttggccaggcgcagtggctcactcctgtaatcccagcactttgggaggccgaggtgggtggatcacctgtagtcaagagttcaagactagcctggccaacatggtgaaaccccatctctattaaaaattcagaattggccaggcgtggtggctcacgcctgtaatcccagcactttggaaggccaaggcaggcagatcacaaggtcaggagatcgagaccatcctggctaacatggtgaaaccccatctctactaaaaatacaaaaaaaattagtcaggcgtggtggtgggcacctgtagtcccagctacttgggaggctgaggcaggagaatgccgtgaacccaggaggcagagcttggagcttgcagtgagccaagatagcaccattgcactccagcctgggcgaaagagcgagactctgcctcaaaaaaaaaaaaaaaaaaaatcaaaattaaccgggcgtggtgatgtgtgcctgtgatcccagctactcgggaggcggaggcaggagaatcacttgaactgaggaggcagaggttgcagtgagccgagatcatgccattgcactccagcctgggcaaaaagagcgaaactccatctcaaaaaaaaaaaaaaaagaaagaaagaaagaaaagaaaaaagaaaaggaagtcttgttttaatttctattttccagcttattaataagactgagcatcttttcatatgcttgttttgtctgttgcctgttcacatctgatgcccatttctctttttgggcagtcctttttttttgctgatgtcattcatgtatgcattgaacaaatcataactggaggcctattgtgtaccaaaaattgttctaggctttcaagaatatagcagtgagtgtgacacagcccctcccatcatgtgggtcacattctggaagcaagggaccaataaaaatacaaaagtacctgagtgcagtggctcacacctgtaatcccagcactttggaaggccaacgtgagaatagtttgagtccaggagttcaagaccagcctgggcaacatagcaagaccccatctttatgacaaatttcaaaaatgagctgggcatggtggtgtgtgcttgtagtcctagctacttgggaggctgaggcaagaggatcccttgagcccaggagttcaaggctgcagagagttattatcttactactgcatgccaacctggatgacagagcaagaccctatcaaaaaacaaaacacacacacacaaatcaagagagttgtctgatggtggtaagcactgtgaagacgaagcaggatggagggaaattctttgattgttaaactagttccttgcactgatacatatcaatttttacagtttgtcatttgccttctaactctatgaaattttggttgatgcagaagtattttttaattatttttttaattatactttaaattctagggtacatgtgcacaatgtgcaggtttgttacataggaattcatgtgccatgttggtgtgctgcacccattaactcgtcatttacattaggtatttctcttaatgatatccctcccccctccccccaccccatgacaggccccggtgtgtgatgttccctgccctgtgtccaagtgttctcattgttcagctcccacctatgagtgagaacgtgtggtgtttggttttctgtccttgcgatagtttgctcagaatgatggtttccagcttcacccatgtccctacaaaggacatgaactcatccttctttatggctgcatagtattccatggtgtatatgtgccacattttcttaatccagtctatcattgatggacatttgggttggttgcaagtctttgctaatgtgaatagtgccacaataaacatacgtgtgcatgtgtctttatagtagcatgatttataatcctttgggtatatacccagtaatgggatcactgggtcaaatggtatttctagttctagatccttgaggaatcgccacactgtcttccccaatggttgaaccagtttacattcccaccaacagtgtaaaagtgttcctgtttctccacatcctctccagcatctgttgtttcctgactttttaatgatcgctattctaactggtgtgagatgatatctcattgtggttttgatttgcatttatctgatgaccagtgatggtgagcattttttcatatgtctgttggctgatgcagaagtatttttatgtgatcaaattataaatctttccctttatgttttttatgcttggaaagatttttctccatcccaacattataaaagcatttgcccaggttttcttttagtgccttatggatttacttactctgtttaggtctttaatccatctggaattgttttcagtacaaacagcaaggaaaggatccagctaaattggttagccattggcccatgaccattcattaaataatccatctttcccttggggatttgaattggcacctatgaaacacatgaattttcctgtgtatttgggtctgcttttgcactttctgtctattcctaagacacagcagccatccaaattactatagctttgtatttatttttgataatttcttactatcaaatttttttatccggtaatcccagcactttgggaggccaagatgggcagatcacttgaggttatgagtttgagaccagcctgaccaacatggtgaaaccccatctctactaaaaatacaaaaaaaattagcaaggcatggtgtcaggtgcctgtagtcccagctacttgggaggtcaaggcacaagaatcacttgaacctgggaggtggaggttgcagtgagctgaggttgcccactgcactccagcctggatgacacagcacccaggctgatttgttcatcctgaggtcaggagttcaagaccagcctggccaatatggtgaaaccccatctctacaaaaatacaaaaattagccgggcatgatggcaggtgcctgtaatcccagctactcaggaggctgaggcgggagaatcacttgaagccaggaggtgaaggttgcagtgagccaagattacgccattgcactccagcctgggcaacagagcgagactccatctcaaaaaaaaaaaaagcgttaacaaaaaattattactatatttgatggtaataattttggaaagttgactctttggacaaattctttaacttctcttggccttggtttcctcctctgtaaaacagggagactaccaatcttgaaggttgttctgggaattagtgaattaatggaccactttagttccggggtcaggtaagcctctttgagaaggtaatactccagctgaaatctgattgacaaggaagagcatgcctggcagaggaaacagcaaaggcaaaggctccgaggcagggactagcttagtgtgatgcaggttcatgcggagcgcatcgctcctggaggggactgaacaaggagagggtggaagggtgggccgcggtgaggggtctggctgtcaccataagggtactggagagccacagcaggatcaggagggcgggtggggcccattgaccctgcctctgtccccacagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggtgaggccagcgcaggggcctggggcggggcggggcggggcggtggggcggagaaggtgggcatggggcggggctgaagatggagacggctgagaccctcccactcatacgctgaaagacgcattcagccgttcactcattcattcattcacactcatttactcactttgaatcattcgttgatttattcatgaagtcactcatttatttattcactcatccatagtttgttctttcctccactcatttatttacttaactattcattcattcactcctctgttcctcattccatcactcaatttcctgatttgctcattcatttgttcactcagttgatcattctagccccagccctgtgtttggatgatagtggggccacaggggtggccaaggcagaccccattgtgccccagagggttcagagtccaacggggaaaacagacttgtccccagacagtgacaattcagggtggttaggaatatgataggaaacaagacctgtatgtgcaaaggccaacggtgtgagcctggcttaagtgcagacagcaagaaagagtatgtcaacagaggagactgagacaggtgtggtggtgcctgttgtcccagctacatgggaggctgaggtaggaggattatttgagcctggggattcgatcccatctcaaagaaaaaaaaaaaacaaaaaatggaggaggctgaatattcaactgggctcttaggcaaggaagggcctgggatgccgtgcaggtttaaagtttagttgcgatgcaggggttcttggatgcattctccccttgacctgcttcctgtgtcctctccaggcatgggttcaggagcggctgccactggccatgcagacagagcgaggcaacggtttgcaggcggtccagcagcacatcaaaaagaaccaggtgagcagagccaggtgagggagcgagttaggacatttggatacatgtgatagaaacagctgaaggtggttaaagccaaaacaatgaatgtattggcttttggaattaacaagactgtggacagcagatacagatgtatccaggtgcttccatatattttcatgactcttggctctattttttttttttttttgagatggagccttgctttgttgcccaggctggagtttagtggcacaatctttgctcactgcaacctccacttcctgagttcaagcgattctcctgcctcagccatccaagtagctgggattacatgtgtgcaccaccacacctggctaatttttgtatttttagtagagatggacggcggggggtggggtgtttcaccaggttggccaggctgggctcgaactcctggcctcaagtgatccactcgcctcagcctcccaaagtgctgagattacaggtgtgagccaccgcgcccggcctgtttgtttttctgcatgagctttcttcttaggccagtcctcctctcctggtgataaaaggcctccagtggattcaggtttacctcccaccagcaaaactgaagagaatttcccacctcaataatgtcagcagtagtctcaggaataactctcattggctcaccatgcccatggcatcccacgcccatccctgaactaatcatgatggatggggtttcggactgctccttgggctggcctggttaagcgccctcccctggaacctgctgctggaatcagccttagcttaattaccaaggctgagatggaggcaaagggggtttcccaaaggaaaatcaggggcttgagactagaaggaaggggaatagctattggacaaggaaaaagtaaaacaacaacaaacaaaatcacaaaacatcgagttagcctggtgtgatggtgtacccctgtagtcccagctactctggaggctggggagggagggtcccttgagtccagaggtcaaagctgcagtgagccttgaacaccccactgcactccaccctgtgcaacagaatgagaccctatctctctctctctctcacacacacacacacacacacgtcccccaaaacaaacaaacaaaaacacccatagggacaaaggacagagataatcagcaagaggatactactgccccctaacctgagcaaggtgggggagggggcctttgagctcctaaaaaatctctgaatctgttcattcctctggggctcagtttccacatctaaagtagagttggtttagagcagtggttctcaaactgcatacgaagggaaccccttggtcaaagcaactatttcaccaaagcctaaagcaagacataaaagaggaataataataataaggcattgtgccaggtgtggtggctcatgcctgtaatcccagcactctgggaggccaaggcaggatgatcacttgagcccaggagtttgagaccagcctgggcaacatggggaaaccccgtctctaccagaaatacaaaaattagctgagcatagtagaaggtgcctgtaatcccagctacctgggaggctgaggcaggagaattgcttgaacccaggaggcagaggttgcagtgagccaagatcacaccactgtactccagcctgggtgacagagtgagaccctgtctcaaaaaaaaaaaaaaaacatcgattaaagatttactaagtgctggctgggtgcagtggctcatgcctgtaatcccagcactttgggaggctgaggtgggtggatcacctgaggtcaggagttcgagaccagcctgaccaacatggtgaaaccctgtctctactaaaaatgcaaaaaattaaggccaggtgcggtggctcacgcctgtaatcccagcactttgggaggccgaggcgagtggatcacgaggtcaggagatcgagaccatcctggctaacacggtgaaaccgcgtctctactaaaaacacaaaaaattagccgggcgaggtgtcgggcgcctgtaatcccagctactcgggaggctggggcaggagaatcgcttgaacctaggaggcggaggttgcagtgagccaagattgcaccattgcaatacagcctgagtgtcaagagcgagactccgtctcaaaaaaaaaaaaaaaaaaagattaaaaaaaaaaaaagatttactgtgtgctaagtactgtcttagggtttatgctgattatttaatttaatcccctctataaccctatgaggtagatattgtcattatcctcatttcaccaaacaatgtatgttggaagaatagggcactgaaggatggtggggaggtgggtctacagattattttggaagcttcctgatcattctgcagtaggtagagttatttaagagactggagttttgctgagattttgttttcctgtcttgatgaaaatactcttggctgtcaacagtgtgggcgacagaactggcttatcgttgtcatggttgaggaaactgatcaagtgcacttagtacttaaaattgggggagctcagctgtgtgtgcagtgagagtgctggatacacaggggctgttaagccaaaaatagctgcaaatatgatgcatttggtgcatgcagactcagttccaagtgctccatagtttatcaccttataacaaccccgcaaggtagattatctcagcctgatactagctgtgtgaccttagcaaattcctcaccctctctgtgcctcagtcttctcatctgtaaaatggagatggtaatgttgtctggctccataggttgggagtgaggaggtgtgaggctatattatgtaaagctcttacttagcaaagcacctggcaggtagcagggtagcagacactcaagaatcgttggctggccgggcacagtggctcatgcttataagcctagcactttgggaggccaaggtaggaggatcgcttgaggccaggacttcaagaccagcctgagtaacatagcaagacctcgtctctccaaaaatattttttaaaatagcagggcatggtggtgcacacctgtagtcccagccgcttgggaggctgaggcaggaggatcacttgagcccaggagtttaaagctgctgcattccatcctgggtgatagagtgacaccctgtctctaaaaaagcaaaataaggagaggacttgctggctgttattatctttatcagttgagtcacacaaaaagttaaataacgttaaggcacacaaaaagttaaaaaagactcacaaaaagttaaataaggtactctgtaagtaaataaggttaaggcacacaaaacgttaaataaggtactctgcaagtacagagctggttgagggaaccttctgggggatggaagtgttccgcacgctgatctgggcacaccggtgtatgtgtctgtacaaatgtgtgcaactgtatacctaagatttgtgcactctaccgtatacaaatgatacctcggctgctaagctgcagggtttctgtattagggcccatcttgggtcggcaagcggcttggctcagagcacagtctctggaaccagcctcctgtgttcaaatcctgtcactccttactggctgcttgttcttgggcgccgtacttcgcccctctgtgcctgttttcccacctgcagcaagcatagggttatgatgagtgagggagtatcagcaaaatgtttacatggtcttggcacgtggttagcgagctgggggtgcttgttaattgccccgtgggccgtgccagtagcagaggagcgtgtggtcttgcagggcctcggaacgccccctctccacccacatccccttacctcctgcccccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggtgcgcccgagctgggggtgcggagggcctgggggcgctggagccgggggccgccgctgccgcctcatcgtgggcgctttgtgcccccaggacgaacagagcaccctgcagctgctcaagaaacacctgcagctggagcaaggcgtggagaactacgaggaaagcatcgcgcagctgtcgcgccagtgccgggcgctgctggagatggggcacccggacaggtgggcgggcgcgtggccagttcacaggaatggtccagcaggacctgaagcttcgctgttgggagttggcgcagcgctggaattggacgttgggtgggagaggtcctccttgctgtgtgctggagccctcgaatttggcaagtgggcgggccggaatggggggacacggctcagggatggttgagagggtggggccaggagcacctggatttgagtgtagtagtggggaccttgtcgggggagaaaagagtaggcgatgtctaggactggggtagagaagaatttactcaggacaggcaaggggctctttctactcagtgtctgggaggacagaaaagcctgtgctgagattggctatggcggtggggctggagacctcctggtgcagtggggtgatgttgcctcgtgtaggcggatgctgagctccaggcctggaccagggatggaatctgtaaggaggtacagagagagacctctgtccaagtgggctcagagattggggctagaggtgggatgcattggctggggacccaacctgggagtccagagtcccaccgaggttcctggataggaggggcgtgagactgagatagaaaccgggtgaggctgccgaggtgggcggatcacttgaggtcaggagttggagaccagcttggccaacatggtgaaaccctgtctctactaaaaataaaaaattagctgggcatggtggcacgtgcctgtagtcctagctactggggaggctgaggcaggagaatggcttgaacctgggtggcagaggttgcagtgagccgagatcgcgccactgcactccagcctggtgacagagcaagactccgtctcaaaaaaaaaaaaaaaaaaagaaaagaaaaaaaaagaaaggaaactgggtgaggctggatagaggtgagcttatccatttagggaagcggagctttccctgcatgctgaaatgcagggctttctgaacccaagacttgcagaaaacagagtcctggccaggtgtagtggctcacacctgtaatctcaacactgggaggctgaggcaggaggatcgtttgagcccaggagtttgagaacagagggaacatagtgagacctcatctctacaaagaaatcaaaaagttagccaggtgtagagtcacgtgcctgtggtcccacttgggaggctgcaatgggaggattgcttgagcatgggaggtggaggctgcagtgagttgtgatcacaccactgcactccagcctgagcaacagagcaagaccctgtctccaaaaaaaaagaaaaaagaaaagaaaacagagctctacctggggacacagccgtgtctgaagattccaaggaaacacagccctgtcctggggagggggtttaggggggtcacgctctgccccagaagtctcaggggtccatccctgcccctccatgtcccccttcagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgagcatcattagtaataagtgataccaggagctaccactaaggttctctgggccttagtttcctcatctgtagtatgaggataataacagcacccgcctcatggctctgctgtgagacaaatgagttaatataacgtaaagcactgaggaccctgcttggcacacatgctgcctcacacagtgttggttattattatcagcttattattttattgttacttattgttatttttattgttactgttttgttactattcttgccaggtgttcagtaagtgttagatattattttttatgatgatgatgatgatgatgattatcattactcttacctgccacaaaatggtagcctctgccaggtgtggtggctcatgcctgtaatcccaacactttgggaggccaaggcaggtggatcacttgaggtcaggagtatgagaccagcctggccaacatagtgaaaccccgtctctactaaaaacacaaaaaaatcagctgggtgtggtggcacatgcctgtagtcctagctgtttgggaggctgaggcaggagaattgcttgaactggggaggtgaaggttgctgtaagtggctattgaaccactgcacgccaacctgggcgacagagcaagactctgtatcaaaaagaaaaaaaaacattgtaggctggagggggctggtgtatgctgcccctttgctcactttgctgtacccccccccccacttcctgatggcaggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtggggcgccggtggccatcagggcaggtgggagggcctggacagctgtgggcagcagagtgggcaaaaatcaggctgtggagcaggtcgaaattaggcagtggcacagacagaaagcggactacagaacaggaagaaattagataatggagcagatagaaaatggactgatggaatgatatatagaaatcaggtattggcagggaaaagtggtaccttagaaggtctcacagatattaaacagcttctggctgggcgtggtggctccctttgggaggccaacgcaggcggatcatctgaggtcaggagtttaagaccagcctggtcaacgtggtgaaaccccatctctactaaaaatacgaaaattagccaggtctggtggcgggcacctgtaatcccagctacttgggaggctgaggcaggagaatcacttgaacccgggaggaggaggttgcagtgagcccagatctcgccattgcactccagcctatgtgacaagagtgatactctgtctcaaaaaaaaaaaaaaaaaaaaaagcttccaatagatattgggcagtggttctcctaaaactgtgagttttgcctaaatccagatcaagggtctaaagggaattttgagaagtctgagaggaatttggctgtggtgtagatagaaattagacgacagacaaggccaggtgcggtggctcacgcctgtaatcccaacactttgggaggtcgaggcgggcagatcatgaggtcaggagttcaagaccagtctgaccaacatgatgaaaccccgtctctactaaaaatacaaaaattagcaggaatggtggcgggcacctgtaatcccagctacacaggagactgaggcaggagaatcgcttgaacccgggaggcggaggttgcagtgagccgagatcgcgccactgcactccagcctgggcgacagagtgagactccatctcaaaaaaaaaaaagaacttagataacaggtctctgatggaaatcatatgacttttctgaaattaatttgatgggggcgaatttaatgaaaaaggcaacagagatattagaaattaggcagaggttctggccagaattcggatgtggatctgagcagtcagatggaaatgaagctgcaggcccaatacaactcaggcagcaggaaattgggttgcagttctaatggaaggtagaagttgggcaatttttgtttgtttgtttgtttatttttgagacagggtctcactctgtcacccaggctggagtgcagtggcgcgatctcagctcactgcaccctctgcctcccaggcttaagcgattctcctgcctcagccttccaaatagctgggattacatgcacgcgccaccacacctggctaatttttatatttttagtagagacgggatttcaccatgttggccaggctggcctcgaaatcctgacctcaggtgatctacccgtctcggcctcccaaagtgctgggattacaggcatgagctactatgcccagctggcaattattattattattattattattattattattattatgaggcagagtctctctttgtcacccaggctggagtgtagtggtctaatctcggctcactgcaacctctgcttcccgggttcaagcaattctcccacttcagcctcgagtagctgggactacaggtgcaagccaccacacccagctaatttttgtatttttagtagagatggggtttcaccatgttggccaggctgatcttgaactcctgacctcaagtgatctgcccgccttggcctcccaaagtgctggggttataggcatgagccaccgcgcccagcccagttattttttataaatcctacaaatgacttagaaatcaggctgagagattcatagtaataagtggtggatctgttagagatggggaggtcacaccaaaataaatcaggagattgaaccaacagagtgagcagcaggctgagcacagtggcttatgcctataatctcagcactttgggaggccaacctgggaggattgcttgagcccaggagttcaagatgagcctgggcaacatagtaagactccatctctattacaacatatatgtatatatcctgatacagtggcatgcacctgtagttcagctattagtaggctgaggcaggaggatcacttgagcccgggatgtcaaggctgcagtgaattgtgtttgtgccactgcactgcagcctgggcaacagagcaagaccctgtctcagaaaaacaaacaaaaaacccaaaacccaaaagatagagtgagcagagctcatacagcagaatgaatggaaattgggcaggggagtaatggcaattgaacagccgtcgtgtaggaaactgggctactatgaaggagtgggtttgaaataaactgagttaaaaaaaaattagcacatctaaaagacatcaaagtggaaaggggtttcctgaaagacccaaggtaggggtgggcctgcctgaaaacacaggtggcagacccaatagaaataaagctctcagaccaaaagaaatcaggcagtgggttgaaagagatgtggtagtagatctaaaagaagtcagaatgcgggtaagtcaaagagaaatcaggcagcagatatgacaggagcctggctgtgggatcacagtgtgaggctccttatatcttgaggttctgcgctggagcagatggtgggagggagggcacagcctgggccccgtggagggctggcgcccgacctggcatgcccttcaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccaggtgcccctcatccctcctcgggcttcctgcctccccctggtggcctaccccagccacccccagcccattgacagcccccttctcaatggaatgacaacagccaatatctgtgtggcgcctctgtgtgctaggcactgttctaggtgcttcgtgtgtattcagaccccttttttaggcctgtcattggggacttcggtcatggggcatccttctgtccgctgtccttcccagttgcctattattaccctctccatgggatgtcacagcatgaaacaggctaaagacaggatgggcaagggaggtgtgggactgtatttgtgagggtgggtgaagaattctaacaattcca

SEQ ID NO: 2700 - DNA, 109241 bp, Homo sapiens
gggccgggccgggcagcggacgccgacagggagggcggtcggtcgcggcgagcagcggagacagcgacgctggcggccgcgggcccaggtgagctgctaggggggccgacagcccctcccccaagtatgtccccacctggcgagcatccctcctccgcgcgcacggggcatggctggagccccgggtctccccggctggagggaggcaaagggtcgagggcaggacgagcccacaacccccccacccggtctagcttccgcgccacgcgtgggtcttacccccaggccttgtccttcccaggccccctccttgggcgcagtgtctggaccgcagggagagaggcgcggcctgggaagggttaaagcctctgatgccaccgcagcccagcgccccaccagcctttgcgggggggggggggtgttggggggaggctcgcaggacaccccttcccggcttccctattacctgctcccttccttcccattcaatcgcgttatggccagagctgatcctcggcctggccagagggctaacaggagtgctaagggcctccccatctctaagtgtcttccactgaagaaaacagctgtaaccaccgtttaacagggagggaaactgaggcacagaaaggccaagttaaagatactcggttaaagatacagcaagaataaagcggaacttgaactcatttctgtctgactccagaagaggcaaatcgatttgctgagatgtgtgaggaaaagatgaagaataatagcaaggaacatgtatcaagggcttgcagtgtaccagataccatgatccctgcattaataacttacctcttcaaacaccgctaagaaacgggtacgattatcattacttttttttttttttgagacggagtttcactcttgtcacccaagttggagtgtaatggcgcgatcttggctcactgcaacctctgcctcccgacttcaagcagttctcctgcctcagcctcccaagtagctgggattacgggcatgagctaccatgcctggctaattttgaatttttagtagacatggggtttcactatgttggtaaggctggtctccaactcttgacctcaggtgacccacccacctccttggcctctcaaagtgctgggattataggcgtgagccaccgcctggcctacccttttgtgtgtgtgtgacagagtttcattctgtcattcaggctggagtgcagtgagtcaatctcagctcactgcaacctccatcccccaggttcaagcgattctcctgcctcagcctcccaagtaactgggactacagacacgtgccaccacgcctggctaatttttgtattttttttagtaaagaccgggttttgccatgttggccaggccggtctcgaattcctggcctcaagtgatccacctaccttgacctcccaaagtgctgagattataagcatgagccaccgtgccgggccatcattactattttgcagatgaacaaactaaggcccaaagagtggaagtatttcagccaaggtcacacaggtggtaggtagctgtgtgctcactttcacttttccatggaaggagggaagaacaaaaatggatttgggactgggcacagtggctcacatgtgtaaccccagcactttgggaagttgaagtgggcaaatagcttgagcccagatgtttgagaccagcctgagcaacatagtgagaccccctctctacaaaaaatacaaaaattacctggtcatggtggagcttgcctctagtcccatctactcaggaggctgaggtgggaggatcgcgtgagcacaagagttggaggctacagggagctatgattgtgtcactgcactctagcctgggtgatagagcaataccttgtctcagaaaaaaaaaaaagatttcaatgtgtccccctaagggacaatttccactctactcactctactgaccaagacttagaccctgccttcctagaattcagtgggttggcaattgtctgggtcttttgaggacattgatctcccaacttcctcctttgttagtcttttttttttcctttttcttttgagaaggagtcttactctgtcgcccaggctagagtttagtggcacaatctcggctcactacaaccttcgcctcccggtttcaagcaattctcctgcctcagcctcctgagtagctgggattacaggcacctgcaaccttgcccacctaatttttgtgtttttagtagagatggggtttcaccatgttggccaggctggtcttgaactcctgacctcgtgatccacccgcctcagactcccaaagtgctaggattacaggtgtgagccaccacgcccagccgttagtcttagaatcaggcctgggggcccagaaggtaaaggagatacatctaatgtcacttaaccctttaaatttcttctctttttttttgttttttttgagatggagtctcactctctcacccaggctagagtgcagtggtgcgatctcggctcactgcgacctccgcctcctgggttcaagcaattctcctgtctcagcctcctgagtagctgggattacaggcatgtaccaccatacccggctagtttttatatttttagtagaggcggggtttcaccatgttggccaggctggtctggaactcctgacctcaggtgattcacccaccttggcctcccaaagtgctgggattacaggtgtgagccactgtgcccggccaatttcttctttttttaaataattttttgttttctatttttttattttcatttaatttaattttattttttctgagatggggtctcactctgtcgcccaggctggagtgcagtggcacgatctcagctcactgcaacctctgtctcccaggttcaagcgattctactgtctcagtctcctgagtagctgggattataggtgcacaatgccatgcctggctaatttcttgtattttagtagagatggagtttcaccaagttgcccagactggtctcgaacccctgagctcaggcaatccacccgccttggcctccctaagtgccaggataacaggcatgagccaccgtgcccggcctatttttatttttttatttttgtttgagatggtgtctcgccctgttgcccaagccggagtgcagtggtgccatcttggctcactgcaacctctgccttcccaggttcaagcgattctcctgcctcagcctcctgagtagctgggattgcaggcatgcactaccatgcccagctcatttttgtatttttagtagagatggggtttcaccatgttggccgggctggtcttgaactcctgacctcaagcgatctgcctgccttggcctcccaaagtgctgggattacaggtatgagccactgtgcctgccccctccactttaaatttttcttcttcttcttcttctttttttcttgagaatgagtcttactctgtcgcccaggatagagtgcagtggcacaatctcagctcattgcaacctgcgcctcctgggttcaaacgattctcctccctcagcctcctgagtagctgagattacagtagcccgaaaccacacccagctaatttttgtattttcagtagagaccgggtttcaccatgttggccaggctggtctcgaactcctcacctcgtgatccgcctgcctcggcctcccaaagtgctgggattacaggcaggacccactgtgcccagccccattaatgcaaatattctatcaccttttttttttttgagacggagtcttgctctgtctcccaggctggagtgcattggcatgatctcggctcactgcagcctccacctcccaggttcaagtgattctcctgcctcagcctcctgaatacctgggattacaagtgtgtgacaccacgcccagctaatttttgtatttttagagacagggtttcaccatgttggccaggccggtcttgaactcctgacctcaggtgatctacccatctcagccccaaaaagtgctgggattacatgcatgagccaccgcgcctggccctatcatctatgtttgaatcctagatactaactggctgtgtaaccttggaaaaatagatcaactcctctgtgcctcagtttcctcctctgtaaaataggtgtaataatagccaactgttagggaattaaatttgtggaaataataagagaaggtacatgaagtactgaccacagtgcaagtgttcaatatgttcattattgttattactgcattacagaactctattgttctaataataacagtgacaatttgctgagcccttaatatgtgccaggggctaagccatgtgttttatcacatcctgtgaagtggtgagggtgaacattattattattattatttagaaatagggtatcgccatattgcccagtttggagtgcagtgtcactattatagatcactgtagccttggcttcttgggctcaagccatcttcctgcctcagcctcctaaatagctgggactacgggtggcaaccaccacatttggctaatttttaaatttttttaaaagacagtttctggctctgctgcccaggctggagtgcagtggcgctatcttggctcactgcaacctccacttcacaggctcaagccatcctcacacctcagcctcctgagtagctgggattacaggcacgttgccaccacatccagctattttttttttttttttttttttgagacagagtttcgcttttgttgcccaggctggagtgcaatggcatgatcttggctcaccacaacctccgcctcccgggttcaagcgcttctcctgcctcagcctcccgagtagctgggattacaggcatactccacctcgcctggagaattttgtatttttattagagacagcgttctccatgttggtcaggctgatctcgaactcccaacctcaggtgatccgcccgcctctgcctcccaaagtgctgggattataggtgtgagccaccgtgcctggccaatttttgtatttttttgtagagacagggtttcaccatgttgcccaggcttgtctcgaactcctgggctcaagcaatccgccctcctcagcctctcaaagtgttgggattataggcctgagccactgcgcctggcttatttttatttttatagagatgaaatcttgctatgttgcccaggctggtctccaacccctgggctcaagcgattctcctgcctctgcctcccaaagtgctgggattacaggcatgagccactgtgcctaggccttatcattgttattatgtccactttaaagacagagaaattgaggacaagagaggggacaggactcaaagccagtcactgttagaaatgagacttgatcctagacctaacctacctctccctatgtccaggcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcaggtacctggaggagggctggggtgggatgaggaggagggggaagggggaagggtgcccgagaaccttggtggctgggagggtgggaaaagagaccagcactgtccaatagaactttccatgatggtggaaatagtctatatccataatgtaccatataataatcactagtctctgtgacttttgaatgctagaaatgtggccagtgctatgtgacagcctttgagttttaaattttatttagttttaattaaatttatttatatatatattttttgagacagagtcttattctgttgccccggctggggtgtagtggtgagatcttgggtcactgcaatctccacctcaccggctcaagccatcctcctacctcagccccctgactagctgggactacaggtgcccgccaccacacccggctaattctttttgtatttttagtagacaccgggtttcactgtgtttgccaggctggttttgaacttctgatcttaagtgatccacttgctttggcttcccaaagtgctgggattacaggcatgagccactgcacctggcctggtgttttttttttttttttttttgagacggagtttcgctcttgttgcccaggctggagtgcagtggcgcgatctcggctcaccgcaacctccacctcccaggttcaagcgattctcctgcctcagcctccctagtagctgggattacaggcatgtgccaccacgcccagctaattttgtatttttactagagacggggtttctccatgttggtcaggctggtctcgaactcccaacctcaggtgatccacatgtctcggcctcccaaagtgctgagattacaggcatgagccacggcacccggcctgttttaattaaatttaaatagccacatgtggcttgtgactgctgtataggtcagcacagccttagagccttagaaatgtacagtcccagaatggtgggactctgtaagcatattcccttagaatcccgaaatgcagagccatcagatccttggaacttgaaatgtctaagagattcttagacctcttgaaatgaagacctctggcctggcgcggtggctcacgcctgtaatcccagcactttgggaggcaaaggtggacagatctcttgagtgcaggagttcgagaccatgttcgccaacatagtgaaaccctgtctctactaaaaataaaaataaaaaaaaaaattagccaggcgtggtggcatgcatctgtagttccagctatttgggaggctgaggtgggaggatggcctgagactgtgaggtggagattgcagtgagtcaagatcgcgccactgcactccagccccagcagtaaagcaagaacctatctcaaaaaaaaaaaaaaaaaaaaaaaaaaaagagctttggaaatgtgaaacgttatcatcacagacctaagaaattttagtcattgttccctaggatcataggcccttagaaactgaaactgtaatacacaggaacctttgggacttgataatactaaacctttggagtttccaattagaaatgtggatcttgagaaatctgacatagagtgaccaaaaccttcctgcttttaccaccgaaactctcagccttgggccaaccagtacagtgggtcaccctaccattttttttttttttttgagtcagggtctcactcttcacccaggctggagtgcagtggtgtgatcatggctcactgcagccttgaactcctggactcaagtgatcctcccacctcagcctcctgaatagctggaactacaggcatgcgccaccatgcctggctaattaaaaataatttttttttttggcgaagcatggtggcggatgcctgtaatcccagcactttgggaggctgaggcggatggatcacttgagatcaggagtttgagaccagcctgaccaatatggtgacactactaaaaatacaaaaattagatgggtgtggtggtgggcacctgtaatctcagctacccaggaggctgaggcaggagaatcacttgaacccgggagatgggggtttcagtgagctgagatcacaccatttcaatccatcctaagtgacaagagcttaactccgtctcaaaacaaaacaaaaaaatttttttgtaagatggggtcttgctatgttgcccaggctggtgtggaactcctgggctaaaataaccctcccacctcggcctccgaaagtgctttgattacaggggtaagccagagtgcctagtagtcaccctactttgatgtatcagaacaatattagcaaagaccagagaactttatagttatagaaagaccttagacctttagaactgtagacccttgaaccttagtacttagtattcatagaggtctggaaccttagaagtgtttaatcatcagcattaaaactggcaaagaccctgaggagcctcagagatatggaacgtcataatcataagcctttaaaacatgacaccctagcacctttgacccttgggaccttaacatcttagaaacacggagcgctagaatcataaaatatagatgatcataatcatgaattcttaaaacccaaaggtcagaatcagttccctccaaatcttagaactttagtaactcagcagtttataatcacaagatggatctctgatactaagatttttggaactttatttatttatttatttatttgaggtggagtctcactctgttgcccaggctggagtgcagtggcgcaatgtcagctcactgcaacctccacctcccaggttcatgagattctcccgcctcgggagtcccgagtagctgggactacaggcccgcaccaccatgcctggctaatttttgtatttttaattgaggcggggtttcaccatgatggccaggctggtcttgaactcctgggctcgggcaatctgcccaccttggcctcccaaaatgctaggattacaggcatgagccatggcgctggctcaagaaacctggctgatctagaaacctgtagtcccagcactttgagaggccgaggcgggcggatcgcttgagcccaggagttcgagaccagcctggccaacatggtgaaaccccgtctctactaaaaatataaacattagccaggtgtggtggcgcatgcctgtagttccagctagtcaacaggctgaggtgggagaatctcctgagcccgggaagcagaggttgcagtgagccgagattgtgccactgcactccagcctgggcaacaggttgagaccctgtctcaaaacaataagaaacctggttaggcgcggtagctcacgcctataatcccagcgctttgggaggccaaggtggggggatcactggaggttgggtgtttgagaccagcctggccagcacggcaaaaccctgtctctattaaaaatacaaaaattagctgggtgtggtggcgcgtgcctctaatcccagctactcaggaggatgaggcaggagaatcgcctgaacctcagaggcggaggttgcagtgagcctagatcgtgccattgtactccagcctgggcgtcaatagcaaaactctgtctcaaaaaaaaaaaaaaaaaagagagagagagagaaatctgtatatgccacaaagtatgaaccagattcaactggtggattgccagctttgtctgatctagaaacctagactgatgaaaacatacactcatggaaacttacagtcatacttttagagccttagaaccttaaaaaggtaggaacatatcaacttagaattctagaatttactaatttagtgtaagtgagtttgtttttagttttgtttgtttgtttttgtttttgagaaggagtcttgctctgtcgcccaggctggagggcagtgacactatctcggctcactgcaagctccgcctcctgggttcatgccattctcctgcctcagcctcccgagtagctaggactacaggcgcctgccaccatgccccgctaattttttgtatttttagcagagatggggtttcactgtgttagccaggatggttttgatctcctgaccgcgtgatctgcccgccttggcctcccaaagtgctggaattacaggcatgagccaccgcgcccgtcctgtttttagtttttgtttgttttttgaggaggagggggtctctccatgttgcctagacaggtctcaaactcccggtgtcaactcatccttctgagtagctgggattacagatgtgtaccaccactcccagctgtagaatttattattattattattattattatcattatcattattattatttggactgctgccaggctggagtgtggtgataaaaatcatagctcactacaacctccaactcctgggcttgagcaatcctcccaccgtagcctcccaagtagctgagactacaggcatgcaccatcatgcccagctaattttcttattattttatttttttatagagacagggtctcgcaatattttccaggctgaacttgaactcctggactcaagtgatcctcccaccttggcctcccaaagtgttgggattacaggtgtgaaccactggaatttattttatctagaaaatattaattcagtgcctgctgtgtgcctggctcatgctggacaacatgaggggcatagtggtgactgaggcagcctgggtcctgcccccacaggactcataggtcagtgagagagagagatccggttagacaatgatgacccagaggggtcagagacagggtaggggaggcacaggcagagaggttggggctgttgacagaaaggcacaagcatcaggctgtgatggggaagcccaaggactgtgggagcccataggatgtacttgatccagcctggagaatcaaggagggcttcttggagaaggagaggcctaacttcaggcctaaaggatgaattggcatgaacactggagtgaagagtggaagagtattctaggtagagggaactgcatatgcaaggcctccagaagctgggagtggcttgactgagaaggatacaggtgaggagtaaatgatgatgggagaggagccagtggaagccagatcctttttttttgagacggagtttcgctcttgttgtccaggctggagtgcaatgccgcagtctcggctcactgcaacctccgcctcctgggttcaagcgattctcctgcctcagcctcctgagtagctgggattacaggcgcctgtcaccttgcctggctaatttttgtatttttagtagagatgggggtttcaccatgttggccaggctggtctcgaactcctgacatcaggtgacccacctgcctcagcttcccaaagtgctgggattacaagcataagccactgagcctggcagaagccagctcttaaagggccttgcggggtaccagggagctatggaaagattttaagcagaggtgggaagattttaagcagaggtgggatatggtaagatgagaattaaggactctccaaatcttagaaccatgcttctgagagcatcttgcccagggaaatgtagaaatcccctttaagataaaaaaaaaaaatcctctccagtttgggcaacaaagcaagatcctgtatgcacaaaactttaaaaattaactggccacagtggcatgtgcctatattactctggaggctgaggcaggaggatcgcttgagcccaggaattgaaggcagtgatctatgatggcaccactgcattccaaccttccagcttgggcaacagagtgagatcccaccttaagaaattttattttattttattttttttgagacagagtctcgctctgtcacccaggctggagtgcaatggcacgatcttggcttactacaacctctgcctcctgggttcaagctgttctccttcctctgcctcccgagtagttggtattacaggcgcccgtcaccacgcccagctaatattttgtatttttagtagagatggggtttcaccatgttggccaggctggtcttcaactcctgacctcaagtggtccacctgcctcagcctctcaaagtgctgggattacaggcgtgagccacgcccggcctgtatgactttcataaatgctcacaaatgcacaactctgcttaaatctcccatgcttagggttcacatatagctctacaagtaaaacacatttatagaggaactccagaccccaaaccagtaacattcagcttaatagtaacttcatgatgctgctctcctgctgaaaccaccttgccactcaaagtgcaaatatgacgtagaccactacgctgcatttcttttgcatccctttgcccagctctctcatggtttttctcccgcttttattttgaggcagagtctcactctgtcacccaggctggagtgcagtggtgctatcacggctcactgcagcctcgacctcccaggttgcctgtaatcctagcactgaggctgagatgggagcatcacttgagcccaggagtttgagaccgacctggacaacatagtgagaccctgtctctatcaatgttttcaacattaaggaaaattgtttggaccccacgttcagtgtgttctcctactcaccctccacagtttgtggctcactactgtcattgatctgtgtgacgcctctctccaattctcttttattcccaaatctcaaatcaatttcttctcccctgtaggcaaccactgacattgttttgttttgttttttaaataaagatggggtcttgctatgttgcctaggctggtcttgaactcctgggcccaagcaattctcccacctcgacctcccaaagtgttgggaagccactgcttctgaccccattcagatagtttttaatgtgaatctttttctttgcatgagaataattttgcaaaatgtgcattgctaatgagtaagcatatatatatatatatatatatatatatttaactttttattattaaagtagttcatgacacagaatggcagataaatcatgccaatatttccacaaatgagtactctcttgtaaccagcacccatattaaaaaacagaatatacaatggggtgtggtgactcatgcctgtaatccgagtgcgttgggaaactgaggcatgatgatcacttgaggccaggagttcaagaccagtctgggcaacatagagagaccccgtctctacaaaaaaaaaaaattaaaaattagctgggtggggccaggcgtggtggctcacgcctgtaatcccagcactttgggaggcagaggcggatggatcacgaggtcaggagattgagaccatcctggctaacacagtgaaaccctgtctttactaaaaatacagaaaattagctgggcgtggtggtgggcacttgtagtcccagctgcacgtgaggctgaggcaggagaatggtgtgaacctgggaggcggagcttgcaatgagcggagatcaagccactgcactccagccggggttaacagagagagactccgtctcaaaaaaaaaaaaaaaaaaattagctgggtgtggtggcatgagcctgtagtcctagctactcaaaagactgaggtgggaagattgcttgagcccgagttccaggctgcagtgacctaagaaggtgccactgccctccaacctgggcaacagaatgagataccatctctaaaaaacaaacaaacagaatgtgacatatgacagctccagaaaagcatcctcatgccacctccctatcactacagtccaagggtgtactctcttaacttctaacagctcagcttcattttgctggtgttttaactttctgtaaatggaataatgcattgtgtgttgttttatgtccggcattattcactcaacattatgcttgtgggagattcatccatgtctccctgtgcttgtggggtggtccttctccttgctgtatagtgttgcgtggtgtgaatgtaccacagtgtgtttgtgcattcacctgttgataagcatttgggttgctgctagtttggggctactataaatggtggtgttgggccaggtgtggtggctcatgcctgtaatcccagcactttgggaggccaaggcaggcggattacttgagtccaggagttcaagaccagcctgggcaatacagtgagaccccatttctactaaaaatacaaaaaagtttgctgggtgtggtggtgcatgcctgtaatcccagctactcaggacgctgaggcaggagaatcacttgaacccaggaggtggaggttgcggtgagccaagatagtgccactggactctagcctgggtaacagagtgagactctgtcttaaataaataaatacataaaataaatggtggtgttctcaagtttctagtacacatatttggtggacatatgcgcttgtttctggtggtttacacccacgcaggagtgaagctgtccaatcatagagtaagggtatatattttattttacatatatatgtatctgttgttgttaattgagacaaggtcccgctatgttgctcaggctggtctccaactcctaggctcaagcagtcctcctgccttggctgcccaaagtgtttggattacatgtgtgagccatgcgcccggccaagtgagtgcatatctaactttagtagagactgcccgtttgtatcgttttatattcccactagcagtgtaccagagattcagttactgtgcaccccacccttgcgatggtcaggttttttgttttgttttgttttgtttgagacagagtcccactctgtcgcccaggctggagtgcagtggcgcgatctctgctcactgcaacccccgcctcctgagttcaagcaattctcctgtgtcagcctctcaagtagctgggattacaggcgcacaccaccacgctcagctaatttttgtatgtttagtagagacggggtttcgccatgttggccaggctggtctcgaactcctgacctcaggtgatctgcctgcctcagcctcccaaagtgctgggattacaggcgtgagccaccatgcccagctgatggtcagtctttttaattttagccattttggtggctgtgcattctgttgtggttttactttgcattttcctgatgactaagaacaacgaagaaggtgaagcacattttcatacatttattggccattcaaatatcctttagtgagatggccattcaagtcttttttttttttcttttgagatggaatcttgctctgttgcccaggctggagtgcaatggcacgatctcagctcactgcaacctccgcctcccaagttcaagcaattctcctgcctcagccttctgagcagctgggaatacaggtgcccgccaccacacctggctaattcttatatttttagtagagatggggtttcaccatgttggccaggctggtctcgaactcctgacctcaggtgatcgacccacctctgcctcccaaagtgctctgattacaggcgtgagccaccatgcctggcctgatttttaattttttatacaatggggtctggctatgttgccaaggctggtgtggaactcctggcctcaagcaatcctcctgcctcggcctcccaaagtgctgggataatgggcatgagccaccatgcctggcctgatttttctattcctgattacagtcttgttagcatggagcaagagttgagaactgaaatgcccaccaagaccagacgggctgcatacactgagagaactgggacctcctgtaagagggcagcggccacatagctcccgcgatggcagcctggcaggaatggaggtccagggttgccgtatcatgtgatatttcatgagaagcccaaaatctaaattttttaaagacaaagtcttcctattttaaaatgttggcaactgatttacatttttataaaacgcagtcggggtgcaaccaaatatatctcagaggctgggcgcagtggctcatgcctgtaatcccagcactttgggaggctgaggcgggcggatcacctgaggttgggagttcgagaccaacctgaccaacatggagaaaccctgtctctacaaaatatacaaaattagccgggcctcgtggcgcatgcctgtaatcccagctactcgggaggctgaggcaggagaattgcttgaacctggggggtggaggttgcaatgagccaagattacaccactgcactccagcctgggagacagagggagactccatttcaaaaaaataataataaataataaaataaataaataaaatatatatgtatacacacacacacatagacacacacacccctacctctctcaagtatgagttcccaaaatcgatgatcccccagaatccactgaagaaagccaaatctagtccaaatccctctttttgcgaatgtgaaaactggggtcccgagaggggagatgacctcgagaagtcacctggccagttattagtacagacagggcagaacccagttgtcctcattctggtaccactctagggatgcactaaaattccactttggctttagtactagccaaaacctgctatttggcatgggcatcatctgttagaaggcagaggaataaatcctcaatttaaaataattaaaagagtataattggattgtctgcaacacaaaagtatctatcccttaaatatatataactgctatgtacccactaaaattaaaaatacaattttttaaaaaaaatattgcttcttactctagcagtagaaaatatacatttacttatctgtattttttaactttaaattgcaccttgaatgtttacctctagtttgaaaacaaatatgcaaatattaacagtaaatgcaaaggaaatatcttgtttgtgtcagtgtgggttttgtgctgtttagataagatgggaccctatgtgaatactgatcatcaatcatacctgagaaagtgatggcagaaaagatgctaaattgaggatttattcctctgccttctaacagatgatgcccatgccaaatagcaggttttggctagtactaaagccaaagtggaattttagtgcatccctagagtggtaccagaatgaggacaactgggttctgccctgtctgtactaataactggccaggtgacttctcgaggtcatctcccctctcgggaccccggttttcacatttgcaaaaagagggatttggactagatttggctttcttcagtggattctgggggatcatcgcaaagctcttcgcaaagctgaggtggaacgatggcttgagcctgggaggcagaggttgcagtgagccatgatcttacatcaccgcactccagcctggattttatacagggcagaccctgtatcaaaaaaaaagagagaaaaacaagtacaattaaattattattgaatataatcaccctgttgtactgatatcaaatactagatcttactcattctttccatattttgtacccattaaccatcaccccttcccttaaccccactattgataatgttacaaaaggtaaattttatgaaaaaggaaattattgagagatttcaaatggttgaaggagaaataaactggaaatatacatctttattcctgaattaatggaaaacttaataggaaacttaatattatttagtaatgggattttaacagtaactgtacaggctaagctgccaacaaatcgacttcacagtacagtggcttaatggagaagctatttctccctcccagataacctcgagatgatcaacacagttggcaggaagacttagctcagagaggtcagtgtacattccaggttaatttcatcttgtattctgtagacattgaccttggttttccagtttatgggagtcaggggaagaaagaggaaggccaggcagcaattttctttttcttttttaaactttatttttggccaggcgaggtggctcacgcctgtaatcctagcactttgggaggccaaggggggtggatcacgaggtcaggagatggagaccatcctggctaacatggtgaaaccccatctctactaaaaaaaaattaaaaaaaattagccgggcgtggtggcaggtacctgtagtcccagctactgaggaggctgaggcagaagaatggcgtgaacccgggaggcaaagcttgcagtgagctgagatcgcgccactgcactccagcctgggcgatagagtgagactccgtctcaaaaaaaaaacaaaacaaaaaccaaaaaacaaaaaacaaaaaaaccactttattggcacccaccaccatgcccgctaatttttgtttttctggtagaggtggggtttcaccatgttggccaggctggtcccaaactcctgtcgtcaggtgatccacctgcctcagcctcccaaagtgctgggattacaggcgtgagccaccgtgcctggcctaaactttattatttatttattttggaggcagagtctcgctttgtagcccaagctggagtgcagtggcacgatctcggctcactgcaacctccacctccctggttcaagcgattgtcatccctcagcctcctgagtagctgagattacagatgtgcgccactaagtcctgctagttttttgtatttttagaagagacagtgttcgagaggctggtctcgaactcctgagctcaggcaatccacctaccttggcctcccaaagtgccagaattacaggtgtgagccaccatgcccagcctttttaaaactttagattatgaaataattacacattcataggaagtcgcaaagatagtagagatgataaaaagacatgtaactggctggttgtggtagctcgagcctgtaatctcagcactttgggaagcgtacgtgggaggattgcttgagcacagaaggttgagaccagcctgggcaacatcgtgagacccttgtctctacaaaaataaaaattaaaaaatcagatgggcatggtggcatgtgcctgtaaccccagatactcaggaggtgggaggactgcataagcctgagaggttgaggctgcagtgagccatgattgtggcactgcactcaagcctaggcggcagagtgagattgtgactcaaaaaaaaaagagtaatcctactaaaaaatgtccaagggattttaatgacgtttctccaaagatatacaactgtctgatggagcatgaaaagatgctcaacatcattagccattagggaagtgcaaaagaaaaccacagtgaggtacaacttcacgcccactaggatggccataaaaaaaaaaaaaaacagtagagggaaatgaccaagcgcagtggctaacacctgtaatcccagcactttgggaggcctatgtgggtggattccttgagcccaggagtttgagaccagcctgggcaacatagtgagacccctgtctccacaccaaatacaaaaattagccaggcctggtggcatgctcctttggtcccagctacttgggaggctgcgatgggaggatcacctgaggctgggaggcagaggttgcaatgagccaagattgcaccattgcattccagcctgggcaacgtagtgagacccccgtctcaagggaaaaaaaaggaggggttgggaaacagcaagtgttggcaaggatttggagtcctcacacattgctggtgcagcaacttttttttttttttttgagacagggtctggctctgtcacccttgctggagtgcagtggcatgagcacaggtcactgcagcctcaacctcccaaggccaagcgatcctcctgcctcagccactcaaggagatgggactacaggggcattccaccctgcctggctaattttttgtatttttttgtagagacagagtcttcaccatgttccccaggcaggtctcaaactcctgtactccagcaatccacccgccttggcttcccaaagtgctgggattacaggcatgagccaccatgcctggcctatggtgcagctactttggaaaacagtttgacagttccttaaggccgggcgcaatggctcatgcctgtaatcccagcactttgggaggctgaggccatggctgtatttatccgtgtcctctctgaactgagctctgtgagggccctgctgtattcacagagccttgaacaggcacagagtgtgcattcgaatatttattgaatgaatgaatgactagagccaactggggtcacaagcagggaaggcttcctgtgcaagtgacatgtcaggaaaacttcaagggacaggaaggttttcaccaggtgggtggcagagggtcggggaaggcgtcacaggtaggaggagacatgactgctgaggctggactctcttttttttttttgagaaggagtcttgccttgttgcccaggctgcagtgcagtggcgtgatctcggctcactgcaacctccgctccctggttcaagcaattctcctgcctcagtctcccgagtagctgggattaacaggcatgcaccaccatgcccggttaagtttctttttgtatttttagtagagacaggatttcaccatattggccaggctggtcttgaactcctgactttgtgatctgcccgtctcagccttccaaagtgctgggattataggcatgagccaccgcgcccagccgactcactctttttttttttttttgagatggagtcttgctctgtcgcccaggccggagtgcagtgatgcgatcttggctcactgcaggctccacctcccaggttcaagcaattctcctgcctcagcctctccagtagctgggattatgggcgcccgccaccatgtccggctgctttttgtatttttagtagagacggggtttcaccatgttggccaggctggtctcgaactcctacctcaggtgatccgcctgtgaggctggactcttgcagagagctgggtctgagcaggcttggctcgcggagggctggggtgaaggtggaagcgcctgggggctcatcagggcctctcctccagatgagcgggaagccgtgcagaagaaaaccttcaccaagtgggtgaactcgcacctcgcccgcgtgggctgccacatcggggacctctatgtggacctccgggacggcttcgtgctcacgcggctcctggaagtgctgtctggggagcagctggtgagggggcctgaagggctggggcaggggtcctccctggggtctcaggctgggggttgggcttctctggaagggctgaactgcaagcaggggcctggctcatgggcgagtggaacgtgctggaagggccctgtgggtaagaggtccctctactcgggtgtgtggggctgtggcgctggggcggagcttggtcgtgagaagcctgggcgcgtggctggaaccgaagctgatggctcgctagctacggttgcgaggcggggcttcggtggaaggggccgggctctgttgcaaggggcagggctattagagaagggaggagctttgttagaagggactggcccgggttatgagctagtaggggcatgctataaaacaggggcagaactgtattgcgggttgggggtgggtagtggatgaaggtgcggggctctaggctagggggcagtgttcgttggtagggtgacacctaggtcgtcggtgtctagggacgcagacggtgtcctgggatgtggcttgttgtataaattggggctgtgtctctgggcttgaatggggtttcatctaaaagcgtgggattctcatggggtagagattcgttaaaggactggagcctggatctcaaggaattgtgaggggcatggctatggaataggaacaaacagctgggcgctgtggctcatgcctgtaatctcagcactttggggagccaaggtgggaggaacacttgagctcaggagtttcagaacagcccgggcaacataatgagacccccgtctctacggtttgtttgtttgtttgtttatttgtttaaattaaccaggcgtggtggcgcaggcctgtagtcccaagtacccaggaggttgaggagagaggatcgcttgagcctgggaggtcgaggctgcagtgagccatgattgcaccactgctctgcagcctgggcgacaaagcgagactctgtttctctctcttttttcttaatttttttattcttttaaatagatacgaggcgtcactatgttgcccaggctgatctagaactcctggactcaagcgatcctccagcctcggcctcccaaagtgctgggattacaggcgtgagccactgcaccgggcagagaccctgtctcaaaaataaataaataacccaagcgctgtggtgagacccgtttctacaaaaaatttttaaaaaatcaaaaagcattagctgggtgtggtggcgggcacctgtagtcccagctgctcaggaggctgaggcaggagaatcgcttgaacccaggaggcagaggctgcagtgagtcaagatcgcgcgactgcactccagcctgggcgacagagtgagactccgtttcaaaaacaacaacaaaagccaaaaaaaaaaaaaaagaaagaaaaaaaagaatagataggaaccaacgctgttggaaggaattgagccataaacaaggggaagagcactggggcagggcggagcttgattgggatgggcgtggttctagctagggacccgaaagggaagcagcgaggggtgtgacgcggagtttttgtttgtttgtttgaaacgaagtctcgctccctcacccaggctggagtgcagtggcgcgatctcggctcaacagcagcctccgcttcccgggttcaaaggattctcctgcctcatcctcccgagtacctaggattgcgggagcgcgctaccaagcccggctaatttttgtatttttagttagaggcagtgtttcgccatgttggtcaggctggtctcgaactcctcgcctcaagtgaaccacccgcctcggcctcccaaagtgctgggattacaggattgagccactacgccggggcggccatgggattagtggcaaaacattggtagagagggatccaatggcagggccagggctgagactatgggctaggagggcggggcttcatgatgggggcgtggttatcaggttcgaagtggggcgcccgtggaaggggcagagccagggacgtgaataaaccttgaagggatgtgattctttaaagggtctggctatgggaagagacagagcttctttagaaggattgagtcctgtgtcttggataaaacgagaggaggacagcctgatcctggacactcagggggcgtggccacgggaggcgggcttctttggaagctgcggggccgagggcgccatactcctgtctgtccagacccccgatcgcccaccgcccctgtcgccctagcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccaggtgaccctcgagtggcccctgccaagccccgcaacatgggacttaggaaagcgttccccaccatttacccattcattctttccttccaataatatcctaatatgctggaatcctattccaggtgttagggatgaaaataatgataaaaataattgtcacgatcaccaccatcacgataatcattttgtatcgaccctgttccaaacactgttctaagcacttgacatttaatacacacagcaaccccataaattaggtactatttagtaccccattttaccagtgaggaaatggaagcccagataggtggtgtcatctgcccaagatcacatatacctgggtgttggagctgaaattcgaatccaggcaatcttgatccagtatagagacaaatagacaaaggtgtgccttttaggagcttacattgtggtgaggaagacagataataaatacataaatatgtaaagaagacatgtatggaaaaaggaccagttctagttagagaagtttaaaaagctatgcagggccaggtgaagtggcctgtaaacccagcactttgcgaggctgagatgggaggaacactaaggccaggagtttgagaccagcctggccaacataatgagaccttaaataaatttaaaaaattagccaggcatggtggtgcatgcctgtggtcccagctactcaggaggctgaggcaggaggatcacttgagcccagcagtgtgaggctgccgtgagctatgatcatgccactgcactccagcctagacaacagtgagaccatgacttaaaagaaaaaaaaagctacccagaaaaatacagattatgataaaacaagtaatagggatataaaatgtcagttggtggtgttgagattttagatatggtggtcagaagagggctgtctgggaagttgatggctgaatgacatacaaagatgaagagagaatgcattccaggcagggggcacagcagatgcaaagtccctgagatagaaatgagcttggcctgttggaaatacaggaggaagagcagagtggctagagaatgggaggcaacgggagacatggaggagctgaggctcaggggatggaaggggctaggtgatctgtgatgagtagtttggattttattctgtctgagatggggagaggttgcaacattttatcaaggggaggtgcatacaagtttagaaagatagatccctttggctgggcatggcggctcatgcccataatcccagcactttgggaggctgaggcaagaggattacctgagtttaggagttcgagcccagcttggccaacatggtgaaaccccgtctctactaaaaatacagaaattaactgggcttcatggtgcacgcctgtaatcccagcgactcaggaggctgaggcaggagaatgtgagccgagaccacaccactgcactccagcctgggtaatagatagagactctgtctcaaaaaaaaaaaaaaaaaaaaaaaaagtgaccgggcttggtggctcatgcctgtaatcccagcactctgagaggctgaggtgggtggatcacctgaggtcaggagttcgagacaagcctgacaaacatggagaaaccctatctctactaaaaataccaaattagctgggcctggtggcacatgcctgtaatcccagctactagggaggccaaggcaggagaatcgcttgaacctgggaggtggaggttgcggtgagctgagatcacaccattgcactccagcctgggcaacaagagtgaaactccatctaaaaaaaacaaaaacaaaacaaaaaaaaaaacaaagaaagatccctctgggttggaggtgttcaccaacattgggagctgagagcccagggaggaggatagagttggaccagggtgggactatggggaagcaacaaggggcaggtggggaagacactcagggagtggagtggacaggccttacgggaggggagagggagagggtgtccaggggaagactcagagctctggcctggggactagaggatgatggggctgccctgagacagggacagggagaaggagcaggtttgaggaacaccctgaggccagtttgagatgggtccagtggttatgggtccaggacattggagttggggatgttccaggtagatggaacagccagtgctaaaggaccaaggagggaggatgcttgtgattcaggaaaaaggccagcaggtatggagtggagtgagctgttgaagatgaggtcatcaacttactgatgggagatcatgggaacttttacttttaccttgaatgaaacagagatacggagggtgttgaaaagaggagcaaggatctgatttgagtgttcgcagggtccctctctctgccatgtggagaacacactgtggatgcaggagtggggagatcagcatgaaggccaccgcactagcctaggcaggagacggcagtgccttagaccaggaaagtggcccagatgctcagtttggaggctttcttggaaacagagaccgaagtcctaactgatcccctaattgtggatgtcctggccctcaggaattatcctcacactcctggacccccacccccagccagaagctgcctcccccatctcctctgtcacctgccaccttctctggtagcagatggtgagtggggggcattcgaagcctcaagctctccaggccctggtagccattttttgtatcttcacagattcaagtcatcaaaattgagactgaggacaacagagagacacgctcagccaaggatgctctgctcttgtggtgtcagatgaagacagctgggtaagcacccccaccaccttccttaggaggttaggcaagtggtcccctaacctctgcaattccttcccagacaagagctcaaggggcagcccatgtcctcagggtcaaaaagttacatctgaaactaaccagctggtaaataaaatatgtccacttctccagccttgactaataatccttcctaacatgctagaaggccaggttcaaatttattttgaacttgctctgtcacccaggctggagtgcagtggcatgcactgaatagctcactgaagccttgatctcctaggttccagtgatcctccctcctcagcctcccaagtagctgggactactgcaccccacccagtttcaaatgtagaactcttggcctcactaggcacagtgtctcatgcctgtcactttgggagaatgaggctaggactttgagatcagcctaggcaacatagcaagaccccatctctacaaaaagttgtggggttttttttgttgttgttgtcgttgttgtttttaatcacaggcatggtggcagacgtctgtagtcgtagcttctcaggttcccaggaggctgagatgggaggatcatttgagtccaggagttcaaggtgcagtgagctacgatcatgccactgcactccagcctgggctacagagcaagaccctgtcttgaaaataaataacaaacacataaataaataaacaaacaaataaataaaaataaaatagaactcttggactcctcagagaccaatgctggaaagaggtgaactgtccccagcctgctctcttctctctctcccccatcccatttcatcctacatttcaagagatctcacattcacctgtgtggaccctcagtgctatgtccaagctctggccaccctctcccgctgtgagcatctcccttctgcctcacagggcatacacaggaaagttcaaagtccttggtcgcttcagtgtggctgagctggtggcggggtggggtgcaggctctactgggaaggttccctttggcccccaactctctgccctgcagggagcagtaagacctgaaactcaattgtcctctgtagagcagctcctgggaggacggagggaggggcaggtgtgggatggaggtgggcttctctgactctcatccttctggctgtctgtcttgcaaaggagatcatggggacttttgccatctgtttctccatgtgtctatctctatatctgcttttccttgtacttatctcttctctcctccctccttccctcctttcctccttcccttttctcttcatgtcttctttctctctcctctcctttccctccccatctctgtctatatcttgctctctccctgtcttgatacctctctccttcctctctctctccttccctctcttctctcttctttcttttgcttctctttttctcttctctcctgctatctatcttctatcaatctatatatctatcatctatcaacctatatctattatgtatgtatgtatctatctatctatcttctatcaatctatatatatatcatctatcaacctatatctattatctgtctatcatctatcaatctatctatcacctatttatcatctatctatgtatctacctatctctctctctactcaccatctatcacctgtctatcatctatctgtgtatctacctatctctctctctacctacccaacacccacccatccatccatctttctatgttctaccccctctctctcatcttccttccctatcattcggtctccctctgtctttttcccctttcttccctcctaactctccccatctctgcctctgtttctcccttcacccttccagttaccctgaggtaaacatccagaatttcaccaccagctggcgggatggcttggccttcaatgccctcattcaccggcacaggtaccacctggcctgggacagcccagtcctgcccttcagccccccatatccctgcagctgcacacctgtacatgtacttgtgtagatggcacacacagacataaagacccatcccttcacctctacacacacatacagttttctttcccttcacacacatgccctgcacatttacacacaggaacacacacccacacaggctcctgtccaggccacataccctgtgcacacatggacacacatgagccctcgcacagatgcatacacacacacagatacccacgcacgtgcacagcctgcccgcagggtaggaagctcgctcccctgtcactgtcatgctgctgtgtacccagcacctcctcctatcagaaaatgctttctcaggccaggcgcagtggctcacacttgtaatccctgcactttgggaggccaaggtgggaggatcacctgatgttaggagttcaagaccagcctggccaacatggcaaaaccccatctctactaaaaataaaaataaaaaattagccaggtgtggtggtgcgcccctgtagtcccagctactggggaggctgaggcaggagaatcgcttgaacccaggaggcggaggttgcaatgagccgagattgtgccactgcactccagcctgggcaacagagtgagactccacccctaacccccccaccaccaccaaaaaaaagaaaagaaaagaaaacacttcctcaaagtgagcccttagagtccccgtccctgtacacccacggattcataccttggggcctgacattgaaatagctgagggtcagacacccacacaaattagacacacatcatgatcattcgcatgacatattggggaaactgagactcaggcgcaggaaggggcttgtggtggtgtagctgaagccagaacccagctttttctgctgtggacacctgtccactcacaatccctgcttctcacacctacacacactcgtacacacatggggagacccagacccacctccatacacagaaactcacaagctgcaccagggtcatcctcacactaggtgacattcgctcagtgttttctatgcacaggcactgttctaagggcttcccactaaaacattcaatagtcaatgtatccattcagtgtgtccgatccacctatgggcaggtgctatttttatttatttatttattttgagggtgagtctcactctgtcccccaggctagagtgcagtggcacgatctcggctcactgcaacctctgcttcccagattcaagtgattctcctgcctcagcgtcctgagtagctaggattacaggcgcccgccaccacacctggataattgttgtatttttagtagagatgaggtttcaccatgttggccaggctggtcttgaactcctgacctcaggtgatccacccacctcggcctcccaagtagctgggattacaggcatgtgccaccacgcccggctaattttgtttgtttagtggagatggggtttcaccatttgggccaggctggtttcaaactcctgacctcaagtgatctgcccaactcagcttcccaaagtgctgggattacagggatgagccaccatgcccggctggcaggtgctattattatccccattttagaggaaaccaaagcacagagaaacgcagtagctcacctagagtgacacaaccaggatatgaccaagctggggctcaagctctgatgaactggctctggtcctcacacttctaaccactgcataacactacataagaatccccaaagtaagcatatgtgtgtcagaggtacatgtgtcctggccagacgcagtggctcacacctgtaatccctgcactttgggaggcctaggcaggcagatcacttgaggtcaggagttcgagaccagcctggccaacatggtgaaaccccgtctctactaaaaatataaaaattagcagggcctggtggtgcacacctgcaatcccagctacttgggaggctgaggcaggagaattgcttgaacctcggaggcggaggttgcagtgagctgggatcgcgcccctgcactccagcctgggtgacagagcgagactccatctcaaaaaaaaaaaaaaaaaaaaaaagaggtacatgtgtcctcacacaacacacataagggctgtacacactcgtattgtcatatgatttcacagagacatacacaggcaggcaccgtgtgggctcatctcttccaagcacactcaggctggcctacccattcgtctgtgtgcacaggccggcccagcaacaaatgcacatgcacacacacattcccgggaacgcacagagacatgcccgcgtccatcacactcacatcacagctaaatgctgcacagcacacacagcttgccccttggctagactgtgcccttctgcccattgccctgggcagtgctcagacaagggtggcttcttccctgcttgcccgccggctctggagcctgcctgctgcctgcctgctctgtgcccctgcccaggcctgatctcgtggacttcagcaaactcaccaagtccaatgccaactacaacctgcagagagccttccgcacagctgagcagcacctggggctggcgcggctgctggatcctgaaggtgagcctctcgcgggcccagcccagacttcgtcttgggggactcccaaccccaatgccatgtcacactcaactccatcccaccccagcaccatcccaaatcctgaggcctctccaaatcccaactctttccaaatcccaactgtctcctcagcctcctccccttgtgcctccccttcctcatgtgcgatccctcccacataccatcctcacacctcttcctctctcatccccaaccgtgtcccaacgtaacccctcctcttccccattctcaatttccacccatccccaacaccctccccaaccctgctttcaaccatctcccactaaaccaactcccactcccctaccccagccccaaacccagtggcatctccaacgccatccccacccctaacgccaaccccatcttcaagtgtctccatccccaccacatcttcggctccaactccattcctatccccaccctaatccatttccaaactcatttcgccctagcccatccccatgtctatctctcccacaactccatcctcatcctcagctgcttttccatttccagtctatccctaatcccatccctgacttcagcctcagccccaaaccaggatcagccctgacacccatctcccatcccaaattaaagctgctcccttcctctgagctctactgtgtgccagacacatgtctgggaaccttatcagagctgttcactttcatcttcacactgacctggttagagagaatttatcaaccctgttttattttattttatttatttatttatttatttatttatttatttatttatttatttttttagatggagtctcactctgtcgcccaggctggagtgcagtggcatgatctcggctcactgcaagctccacctcctgggttcacaccattctcctgcctcagcctcccaagtagcttggactacaggcgcccgccaccacgcccggctaattttttgtatttttagtagagacggggtttcaccgtgttagccaggatggtctcgatctcctgaccttatggtccacctccttggcctcccaaagtgctgggattacaggcatgagccaccatgcccggcctatttatttaatttttgagacggggtctggctctgttgcccaggctggagtgcagtgccatgatctcggctcacagcaacctccacctcacaggctcaagtgattctcccatctcagcctcccaagtagctgggactacaggtgtgcaccatcacacctggctaatttttgtatttttagtagaggtggggtttcatcatgttgcccaggctggtctcaaactcctgacctcaggtgatctgcccactttagcctcctaaagtgctggaattataggtgtgagccaccgtgcctggacgttttatttatttattgttcttatgttcatttatttatttatttgagacagagcctcgctctgtcactcagactggagtgcagtgggggcgatcctagctcactgcaacctccgcctcccgggttcaagtgattctcctgcctcagcttcccaagtaactgggactacaggtgcacgccaccaagcctggctaatttttttttttttttgtatttttagcagagacagggtttcaccattgttggccaggctagtctcaaactcctgacttcaagtgatctgcttgcctcgtcctcccaaagagctgggattacaggcgtgagccatcacacctggcttacttatttatttttttatccaactgaatttaatatttaaaccctgtttaattattattattatgtttgaaatggggtctcactgtgttgcccaggctggagtgcagtggcacaatcttggctcactacagcttcaacctcctgtgctcaagcaatcctctcacctcagcccccagagtagctggggctataggcgtgcacgaccatgctcagctaatttttgatttttttttttttggtagaggtggggtctcgctatgttgcccaggctggtctcaaactactggactcaagcgatcctcccaccttggcctcccagagtgcctgggattacaggcccgagccacatgcctggcttaacctgtcttccaaagtgatgagaatgacagctcagggatgttgtcacttgcccagcatcacactgaaaatcaggaaaccagaccttatggctccagaattcatggtcttaatcagtcctctaccctgcctcttatagctgtatcctgtgctcagtgcctggtacgtagtaggtgctaatggatgtcagttggacaaggcagtgaagaataaaggccaggtatactgttgtgcatccagtgggtaaattaaaatgatatcactcagtcatggtgatggcttgtgcctgtaatcccagcactttgggaggttaaggcaggaggatcgcttgaggccagaagttcaggaccagcctgggcaatgtagtgaaatcccatatctacaaacctgtagtcccagctacacaggaggccaaggcaggaggatcacttgagcccaggagttcgaggctgcagtgagctctgattacaacactgcaccccagatcccaactcaaaaagcaaaaaacaacaaccaattaaagtgatgttagaatttgttgagtttcccctctgtgccaggctagtctttctaatacttacattgttcccaggaggcaggaaccatgataatctttattataacaatggggaaactgaggcttagagaagctaggttattttctaaggacatgcagtgagtaagtgttgaactgggatccaagtgcatgctgcctccaaagcctatgttcttgacatcaagccttgtgcacaatttgcaagctaactaaattttaatttagcacctactgtgtgctgggtaagacagaacagtgataaagaagataggcatacggctgggcccacgcctatagtggcccacgcctatagtcccagcactatgggaagctgaggcaggagtattgtttcagcccaagagttcaagactagcctgggcaacacagagagaccctgtctatgttttataaaaaataaaaagtctatttaaaaaattacaaaaaattagccgggcgtggtggtgtgtgcctgtaatctcagctacttgggaggctgaggcatgagaattgcttgaacctgggaggcagaggttgtggtgggccaagatcacgccattgcactccagcctgggcaatagcttgagactgtctcaaaaaaaaagaaagaaaaagaaaagaaaggaaaggaaaggaaaggaaaagaaaggaaacaggcatagtgtttgtcctcatgaagctcaagctctagataatgacataatcacataagtgaatatgtaattacaaattgtgatacattctgggaaggacatcataagatgctaagaggagaataacatgaggattatcaactatagacagagtgaacatggaggcttgtctaaggaaatttgagttgagccaggcatggtggttcacacctttagttctgactactcaggaggctgaggtgggaggattgcttgaacctaggagctcgaggctgcagtgagctatgattgcaccactgcacaatcagcctggacaagagagccagactccatctcttgaaaaaaaaaaaagtaaaaagttgagctctgaagaataagtgggaattaggaacacagaagaggaacagtgctccagacagtgagaacagcacatgcaaaggccctgaggtggaaggtagaaaggtgtgttcaagaaacaaatataggccaggtgcggtggctcacatctgtaatcccagcactttgggaggccgaggtgggcggatcacctgaggtcagcagttcgagaccagcctgaccaacatggtgaagccctgtctctactgaaaatataaaattagccaggcatggtggtgcatgcccataaccccagctacttgggaggctgagacagaagaatcacttgaacctgggaggtagaggttgcagtgagttgagatcgtgccattgcactccagcctgggcaacaagagcaaaattccatcttaaaaaaaaaaagaaaagaaaaagaaaagtatagcttatttctctgcggtggtttatatgtgtcaggcactatttaattccaggaggtagatttctatttgacggatacaaaacctgaggaacagagaggttaattatcttgcccaaggtcacacagctagtgagagtggcttctccatccctccatccaataccttcaagcactctgtcaaagtgcccactgtcttgtttccccactccctcttgcttccagatgtgaacatggaggctccagatgagaagtccatcatcacctacgtggtctctttctaccactatttctccaagatgaaggctctggctgtggaggggaagcgtatcgggaaggtataaggagccaaggagtgggtgagtgggaagctggaagctggtggcaggcacgggtgggatgaggctgaccccccttcctctgctgtgtcaggtcttggaccaggtattggaggtggggaagatcatagaacgctacgaggagctggcggctgagctgctggcctggatccaccgcaccgtgggcctcatcagcaatcagaaatttgccaactccttaagtggggtgcagcagcaactccaggctttcacggcctattgcacgctggagaagcctgtcaagtgaggcccagctctggagggagggtgggcaggggtggcatgacggcagggctcctgagctcatgccccttcaggttccaggagaaggggaacctagaggtgctgctcttcagcatccagagcaaactgcgtgcctgcaaccgtcgcctctttgtgcctcgggagggctgtggcatctgggatattgacaaggtgaggccggggatgcaggggagaggcggggttgcactgtggagttgtataggttgcacactgctcaagggaatcattcacattgtagacatgatggattagatattcattctgacagtttttcagtagtaaagtgtcataaggaagcaatattttttccaatttgcatgaagttgccataatgctatgagtgacctcagactaagtcaagaccattaaactgtggggagctgtcagagtctgagtgcctcctcccatctcctgcaggcatggggtgagctggagaaggctgagcatgagcgggaggctgccctacgggctgagctgattcggcaggagaagctggaactactggcacagaggtttgaccacaaggtggctatgagggagagctggctgaatgagaaccagcgtctggtctcccaggtacaaggtgtagggcttggctccagggtaaagggacggagggcggggctgatggtcctgggaccagagagggagacttgatcttctaggcaacagggaagagttagattagtctcctggtgataaatgaggatggggatgggagacttggccttccaagtgattgttgggtgaggggaatgggcctgatctccagggtaatgggagagtgaggctggtctccagggtaactagagagggcagaattcatcttttcaggaatgggggagtgttttaagtgacaagggaggttgtatcttgtgtctagggtaactcagaaggatagaattggtttcctaagtaacagagtcaggtaaacctggtccctaatctccaggacaggggaagcatgggcctccttcctgggtaacaagtttaaggttagagatgtaacaggagggtgggacttgtttccagggtaactggagagagtggggctggtctctggggaaacgggaaggtggggttggtctctagggcaacaggggagggtgggtctggtctccagggtaactggggaagattgggctggtctccaggacaacaggggagggtggagctggtctccaggataactgtggaagatgggctggtctccagggcaacaggggatggggggttggtctttagggtaactggggagggtggggctggtctccaaggtaacaatggagggtggggctggtctccaggttacctgggtaacaggggaggatgaggctggtctccaggataactagggagggcagggccagtctccaaggtaatggagtggggagtccccagggtcacacagggtcaaggtaacaggtggactgctgaggcagcatgggtgagtgtctggctcactgccccaggacaactttgggtatgagctgcccgcagtggaggcagccatgaagaaacacgaagcgatcgaggcagacattgcggcctacgaggagcgggtgcagggtgtggcggagctggcccaggcattggcagccgaaggctactacgatatccggcgggtggcagcccagcgtgacagcgtcctgcgccagtgggccctgctaactgggcttgtgggtgcccggcggacacgacttgagcagaaccttgccctgcagaaggtcttccaggagatggtgtacatggtggactggatggaggagatgcaggtgccggcgggggggcggggatgcgggtggagtgccaggagggaggggaggatgcagacgctgaaagagttgtcagacagctggagatggagagggaagggcagagatagaagaagatagagagaaagccagggagacaaaaagagagaacaagagagagagggagagaaagatacagagatggacaagagaggcagacaaagaaacacagaatgagaaagagacagagacaaatagagagaaatagaaacatgctggacacggtggctcacacctgtaataccagcactttgggaggccaaggagggcagatcacttgaggtcagcagtttcagaccagcctggccaacatggtgaaaccccatctctactaaaaatacaaaacaattagccgggcgtagtggcgggcgcctgtagtcccagctacttgggaggctgaggcaggagaatggcgtgaacccgggaggcggagcttgcagggagccgagatcccgccactgcactccagcctgggcgacagagcgagactccgtctcaaaaaaaaaaacaaaaaaaacaaaaaacaattagctgggcgtggtggcgtgtgcctgtagtcctagctatttgggaggctgaggctcaagaattgcttgaatccaggaggcagaggctgcagtaagccaaggtggtgccactgcactccatccagcctgagtgacagagtttgattctgtttcaaaaaaaaagagagaaatgaaaaaagacatagagatatagaaacagagtaaaccagggatgcagacagagagatagtgacagtttgagagagaggaaatcagagagacagagagaggagaaggcagacacaaaggtgacatggaaatctacatgactacagagaaagatacaggaagatggaatcaatttaagagagagagagagagacctaccagatctagagagagatgagacaagaaagatagaagccagctgggcatggtggctctcacctgcggtaccagcactttgggaggccgaggtaggcagattgcttgagccccagagtttgagaccagcctgatcaacatagtgagatcctgtctgtacaaaaaaaaaaaaaaaaaaaattagctaggcgtggtggtgtgcgcttgtagtcccagctactctgaagtgggaggatcgcttgagcccaggaggttgaggctgtgtgagccatgattgcaccactacacttcaacctggatgacagagtgagaccctgtctcaaaaaaaaaaaaaaaaaaaaaagaagaagccgggcacggtggctcacacctgtaatcccagcactttgggaggctgaggcaggcagatcatctgaggtcaggagttcaagaccagcctggccaacatggcgaaaccccatctctactaaaaaatacaaaaattagccgggcgaagtacatctaatcgggaggcaggagaatcacttgaacctgggaggtggagtttgcagtgagctgagatcgcgccactgcactccagcctgggtgacagaggcagactctgtctcaaaaaaagaagaagaaaaaagaatgaaagggaggaaggaaggaaggaaggaaggaaggaaggaaggaaggaaggaaggaaggaagaaagaaaggtgaacaggagacacagacaggaaggtgaacaggagatggagagaaagagaaaagggtagaaatgtagaaagagaggcagagaaagatggagacaaagatgtatagataagaaagacatggaggcagagagtgagccactgtgacagagacagagcccagaaatgtggagtccacgagagatggaaacattcagagagagactggtagagagagagggagacagagacagaacaccatggctagctgtgagagctgacagcagctggggctcagcttttttctttctgatgaggaaaccgaggtccaggccacagagctggtaagagagtcttgaggctggtccatatctctccaagagggtcagagtcgggagtgatggtgcagagtagcaggggctggcataggcaatgggggagaggtgagtggcccagggcagtgccagaggtgtgctcagtgctgtccccgcttgtaggctcagctgctgtcccgggagtgtgggcagcacctggtggaggcagacgacctgttgcagaagcatggactgctggagggagacattgccgcccagagcgagcgggtggaggctctcaatgccgctgccctgcgcttctcccagctgcagggtgagtcttggggctggggctggggctatgggtggagactgtcaggactggtgctaatagaggcaagagtgactcctgagagaaggaaagagtgagctccttgtccttggaggcatttaagcagagcctaagattacattccactggggaagtcatagggagaatcagtgccctgagtggcaggatgggccactcgacctcttcctgctttagattctgcagtaataacccacatttattgagcacttgttatgtgccaagcccttcacagattgatctcaacgaataccatttaaaaagacttgtgtgggctgggcacggtggctcatgcctataattccagcccttttggaggccgaggcaggaggatcacttgagcccaggaattcaagaccagcctggccaacatagaaagacatcatctgtaccaaaataaataaataaataaattagccaggcacggtgatacaagcctgtagtgccagctatttggaggctgaggcaggaggctcacttgaggccaggaattggaggcttcagtgagccatgatcatgccactacactccagcctgggtgacacagtgagatcttgtctcttaaaaaaccaaaaagaaaacttgtgctaagtaatgttaatcagggcctatttaacacaagtgatagaaactcagttcaaatggcttaaggtgaaaaggagtggattggctaatgtaaccaaaatgttcagggaagcctagtcaacatggcgaaaccccgtctctaccaaaaatacaaaaaattaggtaggcatggtggtgcacgcctgtagtcccagccactgcagaggctgaggtgggagaatcacctgagcctgggaagtcgaggctgcagtaagccaagattgtgccactaaactccagcctgggcaactggactgagaccctgtcagcaaaaaaataaaataaaaaaaaaaaaagtctggggaagggtgggttttacctcaggcatggctggatccaggtatggctcaagggtgcttttaggactccatctgagaccaggcatggtgtctcatgcctgtaattccagagctttgggaggcaaagatgtgaggattgcttgaggccaggagttttgggcaacatagtgagaccccatctctatatcaaaaaagaaaaaaaaaagaaaaagactcaggccaggcacggtggctcatgcttgtaatcctaacactttggaaggccgaggcaggcggatcacttgaggtcaggctttggccaacatggtgaaactccgtctcttctaaaaatacaaaaaaattagccggacatagtggtgcacacctgtaatcctagttactcaggaggctgaggtgggaggattgcttgaacccaggaggcagaggttgccatgagccgagatcgcaccactgcacactccagcctaggtgacagagcgagactccttctcaaaacaaaaacaaaagactccatctctctcgtctctctccatcactagtctttgtgttagtgtcactgttgagcagtcctgtcccttgtggtataaatctgggatcattcagccccaggtatacagcctaacaggttagcagagccaatgggacccaggcccctttctcccaagagttctgacaaaaagtcctaggagagcttgcattggctcacagtgggttccatcattgctcagccaatcattgtggccccagggcatgcagtgatctaatcggccacatgcatgtgacctgcctaccccagggccaggagtggggtcagcccattacaaaggcttagactgaaaaagaggagagagggacggccttaccagatatggatgggacatggatgctgataggcaaaaccaagactggctctaataaggttcctgtcttacttatgtcaatgccctccagccagagaccaccaggagtccctctgtggtcaaacgaagttgggtttggtggctctttacacccaccatggggagctgtggggcttctcagcaagaaagtatgatggggggctaggcgcggtggctcacgcctgtaatcccagcactttgagaggccaaggtaggtggatcacatgaggtcaggagttcgagaccagcctggccaacatggtgaaaccccatccctactaaaaatacaaaaaattaatttggtgtggtggcatgagcctgtaatcccagcaacccagaaggctgaggcaggagaatcgcttgaatctgggaggcggaggttgcagtgagcctagatcgtgccactgcacaccagcctgggcaacagagcgagacctcatctcaaagaaatatatatatatatatgactggtggcttattgtaggatttgggcttgtgttaggtgatttggaagatgattcagtgtagtgagttttgctgtggattggatgctgtcagaatatgggggtgactaggtgattgggggtcttaatcattttgatctaggtggtgggaggaagagaaggaggctgttgcattcattggcagctgtcattcatctgagccggcgaggggatgcgtggtcatttttgtggtttgcacagtgaccttgattttgtctgtgctcaggcaagattatggagcgagcttggttttgtcctactccatcgtggtcagagtggccccatctgatatgagcgttctgtgagttttttttattattattgttgttgtttattgctttttttttttttttttttagacacttgatctctctatgttacccaggctggtcttgaactcctgggctcaagcaatcctcccgcttccacctcccagagtgttgggattacagacgtgagccattgtccctggccatttctgtgagattattatttttacttatttatttatttttgagatggagttttgctcttgttgtccaggccagattgcaatggcgcgatctcggctcactgcaacctctgcctcctgggttcaagcgattcttctgcctcagcctcccgagtagctgggattataggcatgcgccaccatgtccggctaattttgtatttttagtagagactgggtttctccatgttggtcaggctggtctcaaactcttgacctcaggtgatctgcccgctttgtcttcccaaagtgctgggattacaggtgtgaggcactgcgcttggcctgtgagattatttatactcctcagaacacgatggctagccctgagtgctgacggcagttggggctgctttatttctttctcactgatgaggaaactgaggcccaggccatggagctgataagagggtcttgaggctggtccgtatctctccattaagatgttctcctcctttatctggagcccacagccctttggaatcttggagcattattcgaaaaggaagaacctgtctggcttgcaggttgatggggaagtttctcaccctagccgacctgggtcacatcctaaatgcaaatgctgaagtttccctccacgccctggtgtggacatcctgaccctggctcagctccctcccatccccatctcacctccaggggaggttgttgggaccctctccttcaccttagctaggtttgtctcaggaagctccctttgccctcgccttgtgaattctcggctcctgtgacaatcagcagctccgagaatacagcagaggggccagtgtggggagtgcgagtgtggggagtgcgttgtcatggggatgggaggcagcgcttcctgatgggtggtccagagtgtgagctcctgatgggccacttcttagctgatcctagggcaatccttcccctctctgaggctcagtctcttaatctggaaaatggggctgataaggacactggcctcataggatggttgtgagaatcaaatgacattgtgtcagagtaagggctgggtacatggaagctgttttttttttgttgttgttgttttgttttctaagacagagtctcactctgttgcccaggctggagtacggtggcactatctcggctcactgcagcatcaacatccctggctcaagtgatcttcccacttcagcctcccgagtagctgagactacaggtgcacgccaccatgcccagctaatttttgtatttttggtagagatggggttttgccgtgttacccaggctggtctcaaactgctgacctcaagtgatctgcctgcttcggcctcccaaagttaggattacaggtgtaagccactgcgcctagcaagaagctgttgttattgtaactattattcagttggataccttgtggtttgagtcaacatcagcgaatgtccagaattacagaaatcccgcattccacatagggcagtgtctcacttttatgatccagtaagaaatacacagccaggcagtggctcacgcctgtaatcccagtactttgggaggccaaggtgggtgaatttcttcagcccagatattggagaccagccagcgagactctatttctacaagaaacttagaaaaaaaattagccaggcatggtgttgtgggcccatagtcccagctactcaggaagctgaggcgggaggattacttgagcccaggagttggaggctgcagtgagccatgatcatgccactgcactccagcctgggtgatagagtgataccctatctctaaaataaataaataaataaataaacacacttacctcatgactcacagttcacatgcatacatgggcacacaggctaacacagaggttttataaaacaatacttccaggctgggcgcggtggctcaggcctgtaatcccagcattttaggaggctgaggggggcggatcatgaggtcaggagttcgagaccagtctggccaacatagcgaaaccccatctctactaaaaatacaaaaaaaaattagctggacatggtggcacgcgcctgtaatcccaactactctggaggctgaggcaggagaatcacatcaacctgggaggtggaggctgcagtgagctgagatcaagccattgcactccagcccaggcgacagtgagagactctgtctcaatcaaacaaacaaacaataccaaacaacaacagcaacaacaacaaaaatactcccccgaccttgttttgcattgtgatattttccgttccttctattctattccaccaaacaaatgctggctgtgacccattaaattaacttcactgttttctagtcgccaactagccatccaggaggaaggtgaactatttaaggaaaaagagggagttcggggttaagcacagtggctcatgcctataatcccaacacttcgggaggccaagtggaaggattgcttgaggccagccgttcaagaccagcctggccaacatagtgagatcctgtctctattttaaaaagaaaaaggagtgcagataaccactgggattgatagataatgcaacagaggatgacagagggaacctagaaacatggtttaagaaaagagaagttggccggtggcagtggctcatgcctgtaatcccagcagtttaggaggccaaggcgggtggatcactggaggtcaggagtttgagaccagcctggccagcatggtgaaaccccgtctctactaaaaatacaaaaatgagccaggcgtggtggcgggcgcctgtaatcctagctactggggaggctgaggcaggagaatcgcttaaacctggaggtggaggttgcagtgaaccgagatcgcgctactgcactccagcctgggcaacagagtaagaatctgtctcaaacacacaaacaaacaaaaaacaaagaagtttcatttgactcagttctgacataagcacaattttcactcaaatatacagaatctgagatgctctgaatccatccatcattcagtcaacaaatcactacattcactaggctacagctctgggctccaccctttgctgggcagtgtttgggatagggtgtgacagacccaggtcctgcccttaaggagctctcagtccagtgggggagacaggacaaggcaatgacaacacagagtagtcagggctaggatggggaagcagagaagcctgagagggtcgaggaggagcctgctccagccttggggtgtcagggaaggctgcctggaggaggagccacgtgacccggcatctgatgaagtcacaccaaggacagggtaggtagcccgcaccatcctctcttgggcgccccttggcttgtgaccaatcctggatgctccccttctcctggctcaggctaccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccggtgagcgcgcacatgtgggactccggggtccccttcctcatgcacccagtctcaccttcattggctcaacagttcccatgtttgctcagctggaactaggagttccaatccctgcttcacccatagccagctttgtgacagttctgcaacctgcctaatcttcctgaacctcagcttgcccacctgtataatgggggtgatattagtccctacccaggcttgtgatgaacggtaaatgagttcatacatgcagaatacgaagcaaatgcctgggggtagaggaagcattcccccagcatttgctcttgttacccaggcttacattcgccaagcatgaaatcaacgacctatgcttctacagggacacctcagcctggcccctctgctgggaggcctcccattgcttctgcataaatgtcacctccctagctactaaaatagctctgactcttgtgattttccattgtttcatcctgttttacatttctttgtagcacttaccatcccatgacatattgtatactgacttgtctgttggctgacttagcaatgagttgttcaattagtgggtgaacaatgcctattccccctctgcaccactctgtctgagcatcttattcatccatacattcattcagcaggtgtttactgagtgcctatgcctttctaggtcttgtgctgggcactgctggaaacacagggctgctccttgcccctactgtgcctgcagttgcccagttctttgaaacattgatttaaagatgggaggaccatgtctagcttaaagtagacctcagtggctgccatgtggagggcaggttggagcgggtaagagttgtggctgggaacccagagaggcaactgggctggggacccagatggagcggaacaagattagaccagggcgggaggtaagtaaacaggccatggagactgatgggctggagcgattttccaaaacaaagcccagggctctggcctggcagatgacagtgctgtccccaacatgggggcccagaggaagaacaaatttgagtcaggtgggtgtgaatagccccaagaaggtatacagtaggctttgaggtcgaagacaggttcaaaaggtaagaggttgaggctggagactgaggtgtgactgtcatgagttcaggggcaaagaccaaggctgtggggctgggtggaatcattgaagaagggtgtgaaggaaaacccagagggctcagggtggagttgctgctgaggaatctcacatttaaacatcaggtagaggctgggcgtggtggctcacgcctgtaatcccagtactttgggaggccaaggcaggtggatcatataagatcaggagttggagaccagcctggctaacatggtgaaatcccgtttctactaaaaatagaaaagttagctgggcgtggtggcgcatgcttgtaatcccagctacatgggaggctgagacatgagaatcgcttgaatccgggaggcagaggttgcagtgagccacaatcgcgccactgcactccagcctgggtgacagagcgagactctgtctcaatacatacatacataaattaattaaattaaattaaataagttaaattaaattaaataaaataagcagcaagtagaagagaaggagcccacaaaggaggctgaaaagaagggtggattgagaattaggagtagaaccagtagaaggtatttcataaaaccaaggtccgcagggttcgggtgtctgagcatctccatcctcctgcagattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtaggagggcctggggctgggagtccctcccatccttcccttccacactcacacagccatggacagcaagatgtgcaatctcaaacccctggaatcataatggccacccgataaatcaacaaaatgttgaccaaaaatcataatccctgatactggtgatgacgtggtaaaattaaaacaacatttcagttggctgttcatttatttgtccagaaagaatgtattggatatctacaatctgccaggagtattcccaagcactttatatacctttctaaagtatcccaacattcttccgggcacagtggctcatactgtaatcccagcacttcaggaggctgagatgggtggatcacttgagctcatgaattcaagaccagcctgggcaacatggtgaaaccccgtctctctctctacgtgcgcgcacacacacacacacacacacacacacaaaatatatatatacacacacatatatatacacacatatatacgtatatatacacatatatacgtatatatacacatatatacgtatatatacacatatatacgtatatatacacacatatacgtatatatacacatatatatgtatatatatatacacactatatatatgtatatatatatacaaaatttagccaagcatggtggtgcacatttgtagtcccagctacatgggaggctgagttgggaggatgccttgagcccaggaggtagagattgcagtgagcagagattgtgccactgcactccagcctgggcaatagagccagaccttgtctcaaaaaaaaaaaaaaaaaaattcccaatatcccaatttccatagtaaagatcctagaattcagaactctctctctctctcttttgagacaggatcttgctctgttgcccaggttggaatacagtggcatgatcatggctcattgcagcctccaacacctaggctcaagcgatcctcccacctctgcctcctgaggaactgggactacaggtgcatatcaccatgcccagctaattaaaaaaaattttttttgtagagacagggtctcactgtgttggccatgctggtcttacaactcctgggctcggctgggcgtggtagctcacacctgtaatcccagcactttgggaggccaaggcaggtggatcacctgaggtcaggagttcgagaccagcctgaccaatatggtgaaaccccatctctactaaaaatacaaaaattatccgggcatggtggcatgtgcctgtagtcctagctactcaggaggctgaggcagaagaattgcttgaacccgggaggcagaggctacagtgagccaagatcacaccactgcactccagcctaggtgacagagcaagaatctataccaaaacagacaaacaaacaaacaaacaaacaaaaacctcctggcctcctcccaccttggccttccaaagagctgggattacagtgtaagctactgctcctagcccagaactctttaagataagtaacaaactaatatcagtacctctggaatactaccagcaattctcccagtgcaggtggggttcatagatgaagatacaagtccaaaaaggtgaactccttatccaagattactcagtctataagtaggagtcaaatacagttctggctgaatcctgagctgtagctgtttatctaatatatccagtcttcctggtaacactatgaggtggaaactaccccacattagagaggagaaaactggatctcagagaggcgaagatggaggcccaaggttacacagcaagttaggggatcaaaccgggctttgaagatggatatgtttgacttcaaagactgtgctctttttttttttttctttcttgagacagggtcttgctctttcgcccagactggagtgcagtggtacgatcatggctcactacagccttcaccgcccccgacccgagctcaagaaatcctcctgcctcagcctcttgagtagtgggactatggatgcacaccactgcacccggctaatttttgtattttttgtacagatggggtctcactctgttgcccagactggtctcgaactcctgggctcaagtgatcttctgccttggcctccgcaagtgctggaattacaggcatgagccactctgccccacccaaagactacgctcttgactctgtgctgcaagattccaatatccagggattttaaaacctctgtagccaagaccatcgcaaagcatccaggcctaaaaaaataactacaatcataacgatttacagcatgtagagagatctatatgccaagtgctttagccacatgatctcgttacacactcaatgaagtggactttattatccccattttccagatgaggaaactgaagatcagagaaggaaatgatttgcccaaggtcacatggcaaatctggccagagcagaacttgaactcgggtctgcctgatttcagagtcctaatctctgtcctcatggtgtgtccattctagagggggcagaaagacagttaaatacactaataaatggacaagatatttagagaatcataatggctttatgcaagaaacaggcagggcatggtggctcacgcctgtaatcctagcattttgggaggccgaggcaagcagatcacttgaggtcaggagtttgagaccagcctggccaatgtgatgaaaccccatctctattaaaaatataaaaactagccgggtgtggtggtgcacgcctgtaatcccagctacttgggaggctgaggcaggagaatcccatgaacctgggaggcggaggttgcagtgagctgagatcgtgccactgcactccagcctgggcaacagagcaagactctgtctaaaaaagaaaacaaaatttaaaaaacccaaactattgaggaccccaagagcttgttttagtgggtcatatctattgctatttactatattagaacttagtactgagaaaatttaaaatgtttttatttttatttatttattttgagacagggtctcattactctgtcacccaggctggagtgcagtggcacaatcatggctcactgcagcctcgacttcgcaggctccagcaatcctcccatctcagcctcccaagtagctgggaccataggtgtgcacccccacgcccagctaatttttgtattttaggagtctcaccatgttgcccaggctgctctccaactcctgagctcaagcgatccacctgcttccgtcttccaaagtgctgggattacaggtgtgaaccactgcacccggctgagaaatttgaaaacattatttaaaaataacaatacactgggagtggtgcgtgcctgttagacctgtgaggctgaggtgggaggaccgcttgagcctgcgaattggaggcttcagtgtgccataaacgagttcatgaatagccactgcgttctagcctgggcaacatagtgagatctcacgtcttaaaaaaatttttttaaatctaaatatctaacgtgttaatataacttttttattaaaaataacttttcataacacaaaatgtactaagagtggcattgtttcgtacctttgcaaatctctttaaagtctggtttaagagatggcagctgggcttctcttaaatcagagtcggcttctgctctcagtctctcctgccgcctctggaaaactccactgaacactcgggaaagaatgagagtgaaaaagcaaatggcgtcttaacacatttttatgaagatagttttgtcctctatcagattacatgttgagaatggctgccctaagcaaaagtgctgcgtagggttccattttacaccggcagaaactggagaaactttctgaggtcacacagtggctgggtggcttgggcctggattctaccctgggtcggcgggccctccgcgcccaagaggagtccctgtcctcctcaagtcactctctttcccctgggcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtgggaggcgcgcagggaggcgctggtccaggcgcacatctaccagctcttcctgcgggatctacgccaggcgctcgtggtgctgcgtaaccaggtgcccactcggggtgtacatttcggagagggagagtccgaggccgcggggggattgcagggacagggacatgcgggggtggggaggagggtgtttcctgggaccactgggttctgaggtgggtgggaggtgagagagtatccggaatggataactgagtttgtggaacatccagtgtgtgtggaagtgtgtatgtaacagaatttgaggagtatcatcagtggggtaggttggtgtcttatcggaggtgacagtttgtgggctatcccgagtaagtaatgcacgaggatatttattggagtggcttcctgggttcgtggattatctgaaaggaaataagactatgaggttgattggcgatggttaaatggggttcaaagaagatcttggtatggataacaaaggattaggattatggaggtaggtaacaggctgaggggttattggagtcagtcagtgattgtggattacatggtgtggatggctaaattagcacaatatcttcatttctgggaatgacaactatggattctctggagagagtaactgtgtctgtggcatgaggaaccaagtgcagtggttatctggggacagccaatccagttgggagatcactctgggatgggaaccaagtttgagaattttggcaagatggaacagccagttttcagattgtccagtgtttggggatcatgttagaaagggtgcctgcctgtactggttatataagggatgctgacccagtttgaggattatctacagcagtggtccccaatcttttttttttttctttagatagagtcttgctctgtagctaggctggagggcagtggcgtgatctcagctcactgaaacctcagcctcccgggttcaaacgattctcctgcctcagcctcccaagtagctgggactacaggcgcgagccaccatgaccagctaatttttgtatttttagtagagatggggtttcaccatgttggccaggatggttttgatctcttgacctcatgatccgcctgcctcggcctcccaaagtgttgggattacagacatgagccactgcaccaggcccagtccctaatctttttggcaccaaggactggttttctggaagacaattttttccacaaaccggtgggaaaaggaggaatgttttcaggatgattcaagcgaattacatttattgtgtgctttatttctattgttattacattataacatataatgaaataattataaaactcactataatgtagaatcagtgggagtcctgagcttgttttcctgcaactagacgttcccatctagtgacatctaggggtgatgggaggcagcgacagatcatcgggcattagattctcataaggagtgtgcaacctggatcccccacatgcgcagttcacaatagggtttgtgttcctatgagaatgtaaagctgctgctgatctgacaggaggcagagctcaggcagtaatgctcactcgccccccctccacctcctgctatgcggcccagtttttaacaggcgatggactagtacccctctgtggcccagggcttgggaaatcctgatctagggagtggaggagaaaggacagagagcccctgaatcataagattactaaatatggagctgaagtggccttgagagaccctttctgacccacccatttaaaaaatagagacaggatcttgctatgctgcccaggctggtctccagctcctgggctcaaacagtccccctgctttggcctcccaaagtgctgggattgcaggtgtgagccaccatgcccggccctgacccactcattttactagttagaaaactaaccccagagggaaaagaacttccttgagttcacacagtacccagtttagttgtcttctttttttgagacaggacctcactctgtcacccgggccagagtacagtggcacgatcatgactcactgcagccttgatctatggggctcaagcaatcctcccacgtcagccctccaagtagctgggactacaggcacgtgccaccatgcctggttaattttttgtatttttagtagagatgggatttcaccatgttgcccaggctggtcttgaactcctggggtcaagtgatcctcccgcctctgcctcccaaagtgctgggattataggcatgagccaccgtgcccagccttcagtcttcatagtaaccaattttttttttttttttttttgagatggggtcttgctctgtcacccaggctggagtgcagtggcgtgatcttggctcactgcacctcctccgccttctgggttcaagcgattctcctgcctcagcctcctgagtagctgggataacaggtgtgtgccactacacccggctaatatttgtatttgtagtagagatgaggttcaccatgttggccaggctggtctcgaactcctgacctcaggtgatccacccacctcggcctcccaaagtgctgggattacaggcatgagccaccatgtccggcctaatattaaccaaatatttactgagtgcctcctctgtgctgggcgctattttggggctgagcacacctcaggcaacaaaatacaaaatcctgccctcatgtggttgacattctagtatgtaggggaggagagagtaaacaagtcaatgcatcgctaatattgccaggtacatgctatgagaaataatacaggagggttggctgggtgtggtggctcacgcctgtaatcccagcacttcgggagtccaaggcaggtggattacctgcggtcaggagtttgagaccagcctggccaacatggtgaaaccccgtctctaccaaaaatacaaaaaaattagccgggcatggtggtatgcacctgtaatcccagatacttgggaggctgaggcgggagaatcacttgaacccaggaggtggaggttgcagtgagccgggattgcaccactgcatccagcctgggcaacagagtgagactccatctgctccctccctgccaaaaagaaataatacaggagggtagtgggatagggctggggtgggagttgataaatttggcaggttggtcagagacctgaagaaagtgaaggagccagccatgggggtatctggagggacagactcccaggcagaagcaccagcatgggcaacagccccgaggtgggaccacaactggaatgttctatgcttgcaaggttgcggggagtggtggcaagccaggctggcagcctctcccaggtcctggaatggaatgaggctgacctttgcaccacgctccctcctccccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaagtaggtcccctagacccatccaccccagggagggggcagaagatggggcccagcataggggagtggtgtgggaggccagggtcccactcctttcatcacgatttctgcttctctggggctctttcctatttctatttaattccatgttgtcttagatttgatttaagtggatttttttttttgagacggggtctcactgtgttgcccaggctggagtgcagtagcacgatctcggctcactgcaaccctcacctcccaggttcaagtgattctcctgcctcagcctcccgagtagctggggctacaggcatgagccaccacgctggctaatttttgtatttttagtagagacacggtttcaccatgttggccagactggtcttgaactcttgaccacccaccttggcctcccaaagtgctgtgattagcggcatgagccactgcacctggccttaagtggatatattgtgaaaaggtaacctgaggctgtcaacccaaaagatacagaaggatatacaatgaaaggtttctttcttaagtctgccctgagcatgggatagctggtcctgttgttaaaatgttaggctgggtgcagtgactcatgcctgtaatcccagcacttcggtaggctgagacgggaggattgcttgtgctgaagagttccagaccagcctgggcaacatagtgagaccccttctctaaaattaaaaaaaaaaaaaaagctgggcgtggtgatgcgtgcctgtagtcccagctactcttgaggctgagatgggaggactgtttgagtccgggagattgaggcagcaatgaactgtgatcatatcactgcagtccagcctggatgacacagcaacattctgtcccccctccaaaaaaaaaatgtgttaacttacttccctagatgcctcattatccatcctgctcttctgcaccctccttgggaacccccagacctccccagatccagcagctagaggccaggcacaggtgtgttccagctttccagatgggacagtgtcccctgccaggctggttgtcaaatattttgcataagcacctcttcctggccccagccactctaggaagcatgcaaagtgagtgtctgcatgtctctgtgtctctctcatctcttgaacctcattgttctctgcttctgtcgccatctgtctcttgccaccactctcttgtctgtccttgcactaatcaagcgaagatatttattgagcatctactgtgtgccaggcactattgtaggtaggcactgaacaaaacaacaccaccacctccagccatcatgggaagtcctttctcatcttccagacccagttctgtctgtcattagagctgtttctgctcctcctggtgaccctaaatttctcctctcaggctctctggctctctccggcatgatccaggccagaaggggacccagtacccctccttctgtcttcccatctcctgacagaaagcatccctggtcacttcactgtgccacccccagccccaggaccgctaccccttttctgtttacggctcagacatcctttccctagatttatctggggcaaggcagcatgcttctaaaggaaacttttatgggaattctgttcttgaggatgcaaactcatcatttagtgcccccttttccatccaggcctggatccttcctttgttccactttttttttttttttttttgagacagggatcttactctgttgcccaggctggagtgcagtggtgcaatcatagctcactgcagcctggaactcctgggctcaaccaactctcctgcctcagcctcctgagtagctggactataggtgtgagccactgagcatggcctgttccacatttcttgagcacctgctgcatgccaggctcagcaaaacgaggaggaggagcccgggggactgttcattccatgattcattcattcattacttttcagtcattcattaattgctcctttcactctattgtttattcactcatcctccagtcaattaaacatgtactgagcccgtgctctgtacggagtgggggtgtgttcacagaaatgaccaggacagaacatgattcctgcctcacagagctcgaacgttatctgacaaggatggcccagaatgctcggggctgggatggaggaagtccaggcagaaaggtcagggcccggatgggagacgtgcagccgctgtgggagaggcagcatttgtcccaggcttgtggtgggtgaggtgtggtcacagagggattgagacggactaatctctgcaccttcccaccatcccagtcatttatttgtctagggacacatttcccaccctgtgggaggagtgggaggagtgggaggagtttccacatccgccaagggggcagagccatacagagctggggactggggccctggggccctgggggtcttagacctggcttcacccctgaatccgtgacattcagggcaagtcacttagagcttcagcttgcctggcccctcacctggaacctgtgtgtgaggtgctgttctttttttttttttttttttttttgagatggagtctcactctgtcacccaggcaggagtgtagtggcgcgatctcgcctcactgcaacctctgcctccagggttcaagctattctcctgcttcagcctcctgagtactgggatcacaggaaagagccaccatgtccaactaatttttgtatttttggtagagacagggttttgccatgttggccaggctggtctcaaactcctgacttcaagtgatccacctgcctcggctccccaaagtgctgggattacaggcgtgagccaccgcgccggccgctaggtgctgttcttatctgcgttttgcatgtgaggctcagaggggaaaactgacttgcccagagtcatggccaggaagtgccacagcctagatttgaaccctgttgctttcttttcttttcttttttttaaagacagggtcttgctttgttgcccaggctggagtgcagtggtgcgatcactgctcactgcagcctcaatctcctgggctcaaacaatcctcctgcctcagccttctgagtagctgggactaaaagcatgtgccaccttgctcggctaatttttcattctttttttgtagagatgaagtctcactatattgcccagggtggtttcaaactcctgggctcaagcaatcctcctactttggcctccccaaagtgctcggattacaggcgtgagccatcgtgcccggcctactctgttgttctttcaccctcatggagactcagggtcttcctcatctctaggactgatgcttgacagtttggctgctgaaggcctggaaagattgatttcagctcaatttcagaggcattttatctttcctggctcctaagctaagttgggcaggaggcagtcagtgcttcgcttgcttgtctcaggcccttcctgttccttctctctggttctgtctctgcaactgtctcctatacactctgtctctttgcttccatctatccatctatttctgtatctctgtttcctgctccctctctgtttttctctccgtttttctctccctccatctgcacctctctaaccctgtcttttctgcctctgtctttcacagatactgtacttttgtttctcccatcttttttctctctgccactgtgtttcttgcattcattcatttaacaaatataagtcgagcgtgtactgtatgccaagccctttttctaagcattggggacacatctatgaacaaaacagacaaaaatccctgccctcatggaaatgatatatcctagcatgggagacagccaagataaataagtaacatatagcacgtgttagattgcgttaagtgctaaggagaaaattaaagaagggaagaaagccagaaagtgttggggagtggtcaggagggacctcacgaagaaggtgatctttgagtagatgttgggggaaggagcattcccagcagagggaacggctagtgccaagggcctgaggcttgctcaaggcacagcgagaagggcagtacagttaccacagagtgagggggaagagtgcaaggagaataagagtttggaaaggtgggggtgtggggcctggtaggtcagaaaggcctctgagattggccgagtgcaggagctcactcccatcccagcactttgggaggccaaggcgggtggatcacttgaggtcaggagttcgagaccagcctggccaacatggcgaaaactcgtctctactaaaaatacaaaaattagccaggcctggtggtgggcgcctgtaatcccagctagttgggaggctgaggccggagaatcgcttgaacctggggggtggaggttgtagtgagccgagatcacgccactgcactccagcctgggcgatggagcgagactccatctcaaaaaaaaaaaaaaaaaaaaaggactctaaggactctcatggagaccctgggaggatctctaaggactctcatggagaccctgggaggatagtctcattctctctctctccctgggggagacagatagcaacaggacagggatgcatgggagcccatgtgggatgccccagccccatccaccaggcctcttgggcactttgccttgcactgtgggcaggaggccagactgcccggggcccatggtcccagccggctccagagtggtacggcctgggtccagcctggtcagttcagtcaggccaagggcctcgctctgcctgcaggagtgcccacttcagcttctctgcgactctgctgtcatctctccccacactctgctctcttccctctctccaactctgcggccccctggtctgtctgtcgtctgtggggctgtcttttcctggtggcatttgccactcctctgcctgtctctctctgggctgtccctgaccggactcctcctgtcactttccctctctctgcctcctctctttcgtcgtctgctgctccctgagtttctttctggctctgccttgctccatctcttttctcgtctttttttattctctctctcgctctctttctggtgtctcctctcactttctcgtttgttttgttttgtttttgtccctaggtatgtctgtctttacttctctgttatctttctctctggacttgcctttttttctctccgtctatatctctttctttctaagtgcctgtctctgcctctccctttctcttcctctgtctgtctctctctctgcccttcttcagccccgtccctgcgtccctggctttgccccactaattcctccctctctcttacatattttccacgcccttcttcccctacccagcccagtgccctcacagtcctactgccagcgccgcaccccccaacccggggcctttccccagcccttatctccccatccccaggaaccaagaaaaccagttacgggcccagcaatggatgcaaaagctacatgaccaacttgagctgcagcacttcctccgagactgccacgaggtaggaactccaggtgtgctggggacggagacatcccctttagtcgggagggaagtgcttctcggccgaggtgggggtggggacgccccgtctaagtgggtcgcggagcgatgctcgctctaagccgccagggggcgcgcggagccgggtctcagtgcgcatgctccgcaagtccctgcccgcccacgccgactccgggaaacgaaggaggggccccgggcgcccctggcaaccgcgcgtgtccgcgcctacgggtcccgcggggacgcgcgctgatctcacctttctctcctgagatttgtgagaatcgctctaccccaggagaggggcggggcgggcggtggggataagggccgagggccgtgggggggccagcggccctgcgccctcctgcagccagcgatggctctgaaccaagccctcgcccctttaaaggtgttcagtaatcaagccccttcccttagggatgatctgcacacattagggacgatctcccctaatccgagatggtccaggcccccttccttattagtgacggttcaggagacctgctgtcttcccctccttcccttgcattccatagaaacgattctagactttggccacattagagatggcctagtaaacattttcctaaaccctaaacagagctaggcctggccctgagcccctccatctgtgtgacccaggatcatcccctcctccatcatcaccccgtacctaagtttcttccaaccaaagctggttcaggaaccaggtctaacccctaaacccctcagcctcaattaaagacgattcgaccctcccccctatgttgaacacccatgggagattgttctctccgcacacggaataaacaagggcctccataccgtgcccccctcccccataactggggtaggccgggacttgagccactggaggaaccccctgttccccctcgcccccactggagattgtgagatgttccaggtcgccctcccatatcccctgtccacatgtggtggccaggagcccgagcttcttcccattagagatggttcaggaggcccccacccagcccctcaccataatccccactcccttagtgaggcagtccaagccccaggcgctccctcccggcattagatttggtccaggagcaccccccatccctcatgagattgttctggatcaggcagcaatcatctgagatggcgcagaagccccccacccgaagccttggggcgagtggtggttcctcctgcacccccacctggggccccgcaaagaggcgggcagggaggcaggcagggggcgcacgcgggcgggcgcgcggccgccgcgcgggggcgagggagggggcgcgcggccgccggagcctcagccttcgccgccgctgccgctgccgtcgcagttgaggggcgagcacccgcccgcccgctgcagggacgccccgccaacgccactgccgcttcaggtctcgggggcgcccaggggagggggttggcgcgcaccccgcggacgcagacaggggagggggctcgggcgcgtgcccgcccgtcgtggccgcgggagggaggggcggggcggcgcgggggcgggccgggcaggcgcccggacccccaccctgggggaggggcaaggacgccgggagctgtccgcggtgctggcgcgggcgggactgaggggccggcccccaagggaggggagcgaagcggggggacttctaagaccacttctagggtaatctggatttgccctaagggttcagggcgtctcagcctttcgagggggggctcttctccgggtaatggggcatctaagatttgccctggggttgggggtttctcaaccttttggggggtttctttcttgttttgggaggatctgtatcagccttggatgatggaggtgaatcacttttggggggctctgccttggaagatgaggggccttggattttctctgggtctagggggctctgactttgtggggcttttcctgggttgttggatagtctggttttgccctccatcatgaaggaatcacttttgagggggctttactttgaggatggggtaccatctctttaagggctctgctttcactgcgggctgtggttgccgttggactcttccctgcacgtcgggaacctgtgaattgagttggggggttcagcactggacttggttctagtgtgtgtatgaaggagtgtgatgctgtcctggacccctggggagcacatgctcaggggacatgggctggggtttggccggctggggatctgggatttgtccttggctatgactgcatttgcctcccgggaccgcggagctggagtccagtgtttgtttttttttttttttttttttttttttttttttttgcaggagggaggagggaggatcttgtgactggagtggggaggagaaaggggaggagcaaactgtttcaggtgccaggtttggtcatgagtggggaagttctggcttggaggataagtctggttttttactggagggggttgggggaggctcaaaaagcagcctgtgattgatcctctctagtgccgtgagaggggcccactcttggtgcttgcgttttggatgactggttttgttggtgggtaggaggactagaactggctttagttgtaggggtgggggtgctggccgggcttgggaggtccgatctgatccacgatggagagtctgtggctagattttggggtagactggtttggagagccagaacacagctttgtttttcacatttggctggggttggctttggttgagggctagaactggtcatggtttggggatctatggtcttagagtcccagggctagaactggggagccctgtgggctcattaggggtgctagatctcgattatggaggatgggtctactccagattagagggttagtttagagagagctagagttggctttaattgggaggttgtttggggggtttatctggccatactggaggaactggggctagatatgggggcttcatttgatacccttgggaatgggttgaggctcttgaattggtccttattggggggtggctaagattgaatgaagtgtctaagtgttgctatgggaggggtggtcctggggatgaattgggagttagctaaattgggttggagagcttgttttggggggggtgatctgtccccaagtctaagaggctgactggccctgccttgggggcttgtggggagttgaggagggcttccctcaggacaggggacaggggagcaaaggattgggcattctggggacccttccatccatcctctatccaggaaagagcttgagctgcacccacccccaatataaaggcctcacttgcaaaggttttttcatcctttcctattccttccacccatacaccctagcagcccaggccctgaacctgggacttcctgaagggatggggggctgtggcaggttgaggggaccagctgagccctcctgccctgttctgcacagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggtgaggaagctgatggcccctctgcctgtgccaggtgcaggaggcctccagggagcccacgtctcacctgctgcacccgctgctgccatcctgctggtcttacacctctggactgactcaaatcagctccagatctgctcctagctatgtggctttgagtgattcatgtaacatctttgagcctcaatttgctcatctgtaaagtggccagcatctcttctgaatggtgcctgtatcctactgtttgttaaatatttcacttcttaatataacctcctctaccaggttccttccataccatttggggcatttaagatggaaggttggggagatgggctgggacagaccctgggaagcccagggttaaagtaaactttggattcttagagccctgggttctaactgtgtctatgcctgttaccagctgtggggccttaggtaattgtgttaacctcttggagcctcagtttgctgttctataaaattaaggaaataataaatatagctacttcctgggctctgtgcacataaagtacttaacacaaggccacgcacctaagagctgtaattactgtggtcttgttacttttaatacttaatgttacctaagtagctctgggccactaagaaccttgacttcagtcttggagggactgaggtagatatttgctctaagcctcaaccctcagaacttccccctcctctggctgaacccctagacctgtagccctggatatacacacttttctgactcacacagagacacccatgttggccttaaacccttaaatggtcattgatgtttcataaatggtggcatatggcgaaggcagtcttcttgactttgagtttaatggaagttcattctctccctgcctctctggctccctctatctttctttcctgtctgtctatccctctatccttgtctttcttacggtcctctccccatgtttctgattttctgtgcctgtctctctgttgatcactctgtgactgtttgtctctccctgactccttcccatgtctctgtgtccatctgtctctccctgtatctttctgtctccctcccctcacttctgtctgtctgtctctctcttcttgtctctcttccttggttccttccatttctgggcctatctctgcatccacccctcatgtctctctctccctatgtgtctcccactccctgcctctgattctcttttcacatccttccctgtgtcctgtcactctcccacacttctctgattctccccaccatctatctatcttctccatctcctgccatccacccacttggggcaggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcaggtatggtcttcctggcccagatgagggctccctatgccacatgggggccaggtcagggtccaaccccactcaaggtatgtcaagtggaggggatttaatacagggatttatttcaaacttgtagaagatgagaaagggaatattgaagcaatccagctagtaataactgttggaagcagccaccactccctaaggtatggagtacaaagggaaaaggaaggatctagagccacaaagcagtaggtaaatgactagcatgctaaaggtttcacaggaccctgacactcatttcctggatggagaaaccaaggctcaggggtatgggaatggctttgcatggaataacaatgacattcattgagcatttctctaccagtctctgggccaagcactcactgaactcatcccagccacttctggagattggtactgttattatcctgttttaccaatggggaaactgaggcacagaaagtaaggcacctggcccaaggacacacagctaaccagtgtctcctttatgaaacagggcactcttagagaacagacgcagcgtctgcttgtatctgctcccagcttggcagctccatgcttggtacacagcagttcacgtggaatgaccagaggtgaacgtagccattgcttctcacctcccagggagtaatggctcctgcctttgattttctttttttgttgctgttgttgatgttgttgtttgtttttttcttcaagatagttactcactctgtcgcccaagctggagtacagtggcttgatctcagtccattgcagcctcaaactcttgggctcaagtgattctcccacttcagccttccaagtagctgagaccacaagcgcataccaccacgtctggataatctttttaaattttttatagagacagggtctcaccatattgcctagggtagtctcaaactcttgggctcaagcaaccctcccgcctcagccttccaaagtgcttggattacaggtgtgagccatggtatctggcccacgtgactcctgcttttacctgtcaggaacaatgcctgactgactgatgggaaactgaggttccaggaggtgagaggtgaacttacttgtccagagtagcaaatagcaaagcctggatttcagtccagtgcccttgactcttcactcctcctttttgatatatttcctatgtagttatatagtgcttggcatagtgtatggcaaaaaaaaaaaaaaaggctagtaagaaatacataatgacactgattagtatgtattcattcatctctgtggcaaataattattaggtaccagctgggtgtggtggctcacgcctgtaaccccagcacttcgggaggccgaggcgggcggatcacgaggtcaacagttcgagaccagcctgaccaatgtggtcaaacctcatctctactaaaaacacacacaaaaaaattagctgggcatggtggtgcacgcctgtaatcctagctactcaggaggctgtaatcccagctactcaggaggctgaggcaggagaatcacttgaacggggaggcagaggttgcagtgagctgagattgcatcattgcactccagcctgggagacagagcgagactccatctcaaaaaataaaaaaataaaaaaaataattaggtacctactatgtgcccggcacttttctgggtgttgggatatagcagtgggcaaaatggatgaaaagttactgccttcacggtgatcccattctggttgggggaacaagcaaaagaacaaaaagacaaacagatctgaatgtgatggccaatggggtcagttcgttctttttccctccgctcccctccccttcccctctcttttcttttcccctcccttccttccttccttccttgcttccttcgttggagtcttgctctgtcacccaggctggagtgtggtggtgcaatgtctgctcactgcaacctctacctcccaggttcaagcagttctcctgcctcagcctcctgagtagctgggattacaggcatgtgccaccacacccagctaatttttttatttttagtagagatggggtttcaccatgttggccaggctggtctcgaactcctgaccacaggtgattcacccgccttggcctcccaaagtactaggattacaggtgtgagccactgtgcccggccaatgaggtcactacttaatatagaatagcagttctcaaatgtctgggtctccaggaccccccttacactcttaaaccgcattgagatccttagaaagctttgtctgtgtgggttagacctattgacattcactgtattaaaaatgaaaatcgaggccaggcataatggctcatgcctgtatcccagcactttgggaggccgaggcaggaggattgcttgagcctaggagtttgagactagcctgggtaacggagcaacagcctgtctctattttattttatttagttatttgagccaggatctcgctctgttagcaggctggactgcagtggtgcaatcacggctcactgcagcctcaacctctggggctcaagtgatgctcctccctcagtcccgcaagtagctgggactacggacccacaccaccatgcctgattgattttttttttaagaaacagaatctcactatgttggccagtctttatctctatttattgaactaaaaaaaaaaactaaaacggagtctggctctgccacctaggctggagtgcagtggcttgatctcagctcactgcagcctctgcctcctgggttcaagcagttctcctgcctcagtctctggagtagctgggattacaggcctgtgccaccaagcctggctaatttttgtatttttagtagagatggggtttcagcatgttgcccaggctggtctcgaactcgtggcctcaggtgatcggcctgccttggcctcccaaagtgctgggattacaggcatgagccatggcatccagactgtagttctctttcatgtctagaatagaagagagctagcttctcccatccgtgtctgtattcaatccatttcactagcacaggtcatcaggtctctgaaaaacactgctgcatgctggagagagaatgagaatggtgaaggcaaataacatcttagtatttttataaaaatagttgtaaccttgcagatgccttgaaaagatctcagggatcccccaggggttccttggccacagtttgagaactgctgatgtacacaatgtgctgggcactgttaactcctctctcctccccaacagccccatgagggaggtcctgttattatccccacccagcagaaaaccacagcacagaaaggatctgtggctcacagaggtcacatggctaccaagtggctattcaataccacctttagtccctccctgagcctctgtcctccctcttaaataggactctatcatcagtgcaggtctcccagggccaggtggggatgtgcacagaaaggagccacttagcacagtgcccaggatgtggtaagcctgcaagaaaggggcatctgactgtcagggtcccagccagaaacagaagcaggctcacctgcagaaaacttgagtttcttgacaaaggtgtgagtggagaacggggaagctgcaggaagcatatagggctgtgggactcatggaggggagcttttgctcctccctagccagagaaggtagagaaggaaaagttattggaacttggaaggggagagttgccagacaggagctggcactcttagtcaagaacggcagccatggccagacgcagtggctcacgcctgtaatcccagcactttgggaggccaaggcgggtggttcacttgagatcaggaattcaagaccaacctgggcaacatggcaaaaccccgtctctactaaaaatacaaaaattagccgaacgtggtggcacatgcctgtaatcccagctactcgggaggctggggcatgagaatcgcttgaacttgagaggcggaggttgcagtgaggcaagattgcacctcactgcactccagcctgggtgacagagtgagactctgtctcaaaaaaaaaaaaaaagagaaagaaagaaagaacggcagccagaccatggcaccatagcagggaagagctggggagataataccccagactcactttcctctgggcttccctttgtcagccagggctggcttcatgggtgtttgcccgtgcagtgacacagggctccatgcttggtttaatgccctactattgatgtcttgaatttttttgtttttgaggcagtttctacctctgtcacccaggctgaagtgcaatggcgtgatcatggctcactgcagccttgaactcctggactcaagtgaacctgtcacctcagcctcctgagtagctgggactacaagcgtgtgccaccacgcccagataatttttgtagtattttatagagacgggggcctcactgtgttgcccaggctggtctcaaactcctggcctcaagtgatcctcctacgttagtctcccaaagtgctgggattacaggggtgaagcactgcccctggataaaattcttaataaatatttgaacaagggaccttgtgttttcattttgcactgaaaagtataagccatgtttgaggccaacccacatggaagccagaggacaggagggctggtccatgcaggtcagtcctgcacagggcagggtgaagaagcttggactatgggtctcaagatcccgggctgaagcatccatccacctcggcctcccaaagtgctgggatcacaggcgtgagccactgccccagcctattgctaggattcataattatcttgcagtgattactaattcttccccagcagtgttttgcagtggctgaaggcacagacttgggactccagcaggtctggttctgagtcacagctctcccacttgctgccttcgtctctccctctgagccttggatgccttctccttgcaatgggaaggacctcaatgctcaccccctggtggatagcaggagtgtgggaagcagcagagcatctcagtgaagggcatggatgctggcgctgggctgcctgggtcaagccctggctctgtgccttatcacctggatagcccaaggaggttacttttctctccatgcttcagtttctttttctttttttaagagggagtctcactctgttgcccaggctggagtgcagtggcaggacctcggctcactgcaacctccgcctcctggcttcaagtgattctcctgcctcagcgtcctcctgagtagctgggattacaggcacctgccaccacgcctggctaatttttgtatttttagtagagacggggtttcaccatgttggccaggctggtctcaaactcctgacctcaagtgatccacccacctccgcctcccaaagtgctgggattacaggcatgagccaccgcgcctggctgtgcctcattttcttcttcagtaaaatgggcataatgatatttctgacctcataaggacattgtgaaggtgaaaagacataatgcattaagtggtttcagaactgctgacccaacaaatctaagattcagtatttattcacaggtctttaatttttttttttttagaccaagttttgttcttgtcacccaggctggagcgcagtggcacaatctcggctcactgcaaccctctgcctcctgggttcaagtgattctcctgcctcagcctcccgagtagctgggactataggcacccgccaccatacccggctaatttttgtatttttagtagagatggggtttcgccatgttgtccaggctggtcccaaactcctgacctcaagtgatccgcccgcctcggcctcccaaagtgctgggataataggcatgaaccaccgtgcctggccagtctttaattttaactgtcataaaactgagagcatatcaccatcactctactgttttcaaaagctagttgtttcaccttccctttggttgttacttatgtgatacacggttacttcatttgtttttgttcatattccatttggggcatttacccctctccatgctgctttttaattttaatttatttttattttttgatagatggggtctcactatgttacccaggctggtcacaaactcctgggctcaaacagtcctcctgccttagcccctcaaagtgctgggattattcgcgtgagccactgcacctggccccaaaacacattttaaaaaagcaacatggatgattgggcacagtggctcatgcctgtaatcccagcactttgtgaggccaaggcaggaggatcgcttgagcccaggtgttccagaccagcctgggcaacatagcgagattcacatgcctgtgttcccagctactcagaaggctgaagtgggaggatcacttgagcccaggaggttgaagctgcagtgagctgtgatcgtgtcactgcactccaatctggtcgacagagtgagacccccatctcaaaaaaaaaaaaaaaaaaaaaaaaaagaaaagtaatttggaggtggtaaatgaaatatttatatagtgttaaaagttagaaccatctttagctcacttgcttttgccaaattgcctgcccaggtccttctgtggctgctcactctctccccagcagtacacatgagctcctgtttcctctcgtccttgccaacacttggttttgtcagacattttagatctttctcagtccgatggctgggaagtggtatctcactgcagtgtgtgtatttgtatttttttccaatgctactggcgagcttgaccatctttgaccttcttttgtactatttaggttttagaggaaggagttggggcctcctgctttagccagagtacagagttagctcttccctccctgtagggggttcagtctcaaccaagcccagcaaaccatgagatgggggtccccattgttcaagggaggggctgaagcccagaggagacaagggagtggccctggggtcacacagtgatgggtgccagaggcaggctccagcacgagactcctgggcccttttcccagcagagggagcccgaggcaggaagtgactgtgtgggccagggcacccagacggagcccagctgcccctcaggagctgctactggggaagggacctgccaaggccctgctgtcccctggggcatacacaggagaggggttggctgccatccagcctggcacgtttcctggctgtcccatccacccttagggcactggggccaggctgggctgagggaggtactggctcggggtctgaggggtgtagtggtgtgcagtgtgtgagcgatctgtccccctcagcctctctcctgtcctcccgtcgccatctctgtgtctctctcttccctttgtgtccctctctgtcctactctctcactcccttctctctgtctctttatttattttgagacagaatcttactctgtcacccaggctggagtgcagtggcgcgatcttggctcactgcaatctccgcctcccaggttcaagcgattccccagcctccccagtagctgggattacaggcacccgccaccatgcctggctaatttttgtatttttttatttttattttttctttttgagacggaatctcactctgtcacccaggctggagtgcaatggcacagtctcagctcgctgcaacctccgcctcccggattccagcgattctcctgcctcagcctcccaagtagttgtgattacaggcgtgagccaccacgcccggctaatttttgtatttttagtagagatggggtttcaccatgttggccaggttggtcttgaactcctgacctcaggtgatctgcctaccttggcctcccaaagttctgggattacaggcatgagccaccaccccagtctctctgtctctttttatttgacttctctgtctctgcctccttcccgtgttcctcatgtcctccttgtgtcctctccctcatcccgtaccacacccgctgctgcagcaggctctctgggaccccacctcccaggtcctggccacgtgacccagaatcctctctcggggcctgttgccaagctgtgcttcctggccaagaagccagatggtggagtctcaagtcctggctccccagccctcagggacctggccagctggtcggcctcagccacaggctcctgcttggagagatgggggactggtctcctgccagatgagaaaatgcactagaggctttgcagctgccaggctctgtccctggggaccccacactttttccaggcccacccccaccctaagcaaagctctttctctggccaaggaaacaccctcctcccccctgttctgcttctctgtcccatgtttttgtatccagctcagcatggcctaggagaggagtgcacattcagggactatacagtcccagtccttgccttattgggactcaaggcaagggaccccatcctttctttctttccttttttttttgtttttgtttttttgttttttgagacagagtctcactctgttgcccaggctggagtgcagtggcgcgatctcagctaattatgtcttcataattcacaaattatgtcttcaatttatgaaggtgctggctcggggtctgaggggtggagtgatcagtaactcaaattacgtcttcacaaatctccttgtcttcatttctgagcaccgctttcttctgtgttggcctcatggtcagggagtccctgatgttggcaggatgaccccaggatgcccggcctacctcctcccaacttaggaagcccatgggaaagagagcatctcttctgtgcacacacattttcctggcgaaaatggggagagtggccgggcacagtggctcacacctgtaatcccacactttaggaggccaagatgggaggattgcttgaggccaggagttggagacccgcctggccaacacagcgagaccccacctctaccaaaaaagaaaaagtgggaagagttttcattggcccatctaaggttacgtgctcatatctgacccaatctttatgaccagggtgttttcagtgttctgcttggccccacttgggtcatgtgattacccatgactctctaggtttcatttgcccttcaggaagctcaggacctgagagtgagttttgatgtatttggaaggagaggatggattttgggcaggcaaaaccaacaactctgcactacagaactttgaatcaagaagtcttggcttggttcttgagtttggggttttgttttgcagtcatttgtggtaatctgctaccacttaattttttaattgttattttgttttcttctctagctttcctccatctgtttagaattacaagggtaatatatgaatatattcttttgggaaaaaattttactaaccgagcagtcttcagtaaaacataaagtctcactcctatctgcctcccaatcccacatcccaaagagagcctcagttatttggtgtgcatccatctagacctctttctgtgcatttacaagtgtacctatatggatgtttaatgtttttatattatttgcttttcatgtttaatttcaatttttgaataaataaattttcatggtgaagacatcaaaacctctagggaaatcccatgggaaaattatcgccttcatccctgttccccattcattaagttctcatcccctcccccagtaagtaccatctgttatgaacttcttgtttactccagggaatttttatgcatgtgcaatccactataaatttatattcataggtaggttctaaattgcttcttcttcttcctcttttttttttttttttttgtttgtttgttgttgagactgagtttcgctctttttgccaaagccggagcgcaatggcgcgatctcagctcactgcaacctccgcctcccgggttcaagcaattctcctgcctcagcctcccaagtagctgggataacaggcgcctgccacaatgcccggctaattttttgtatttttagtagagactgggtttcaccatgttggccagcatggtgtctatctcttgacctcgtgatccgcccgcctcagccttccaaagtgctgggattacaggcatgagccattgtgcccggcttttttttttttttttttttttttgagatggagttttgcttttgttgcccgggctggagtgcagtggcatgatctcggctcactgcaacctctgcctcccgggttcaagtgattctcctgcctcaggctcccgagtagctgggattacaggtgtctgccatcacgcctggctaattttttgtgtttttagtagagatggggtttcaccatgttggccaggcaggtctcaaactcctgacttcaggtgatccacgcgccttggcctcccagagtgctaggattacaggcgtgagccaccgcacccagcatgctttttcttcttaacagtaacacttggctatttttccatactggtctggatttgtttaaccattttactcttttttattttttatttttttttaagagagggggtctagctgtgttgcccaggctggtctcaaactcctgggctcaagcatttctcccacctcaacctcctaagtagctgggattacaggcatgagctgctgcacctgacttaaccatttctctcttgatgggcattgaggttgcttccagttttttcccattataaactctgctgtgatactacaactttgtgcatctgtgccagtatttcttttttttcttaaaaaaatttttattattattatttaaaaatttttttttcaggatggagtcttgctgtgtcacccaggctgaattgcagcgacgtgatctcggctcactgcaacctccacctcccaagttcaagcaattctcctgcctcagcctcccaagtagctgggattacaggcgtgcatcaccacgcctagctaatttttgtatttttagtagagacagggtttcaccatgttggccaggctggtctcaaactcctgaccttgtgatctgcctgccttggcctcccaaagtgctgggattacaggcgtgagccactgcacttggcctatgacagtatttctttagttatattactagaaatgcaagtgctgggtcaagcagatgcatattttgcattttgatgcaaagacctgccaaattgccttctaaaaaggctctaccaatttatgccaccactgacagtggctgagtgtgcccatctcccaacatctttgccagcattagatactataagtcttttacatttttgccaacctaatgtgtagaaaagaatgccttggccaggcgcagtggctcactcctgtaatcccagcactttgggaggccgaggtgggtggatcacctgtagtcaagagttcaagactagcctggccaacatggtgaaaccccatctctattaaaaattcagaattggccaggcgtggtggctcacgcctgtaatcccagcactttggaaggccaaggcaggcagatcacaaggtcaggagatcgagaccatcctggctaacatggtgaaaccccatctctactaaaaatacaaaaaaaattagtcaggcgtggtggtgggcacctgtagtcccagctacttgggaggctgaggcaggagaatgccgtgaacccaggaggcagagcttggagcttgcagtgagccaagatagcaccattgcactccagcctgggcgaaagagcgagactctgcctcaaaaaaaaaaaaaaaaaaaatcaaaattaaccgggcgtggtgatgtgtgcctgtgatcccagctactcgggaggcggaggcaggagaatcacttgaactgaggaggcagaggttgcagtgagccgagatcatgccattgcactccagcctgggcaaaaagagcgaaactccatctcaaaaaaaaaaaaaaaagaaagaaagaaagaaaagaaaaaagaaaaggaagtcttgttttaatttctattttccagcttattaataagactgagcatcttttcatatgcttgttttgtctgttgcctgttcacatctgatgcccatttctctttttgggcagtcctttttttttgctgatgtcattcatgtatgcattgaacaaatcataactggaggcctattgtgtaccaaaaattgttctaggctttcaagaatatagcagtgagtgtgacacagcccctcccatcatgtgggtcacattctggaagcaagggaccaataaaaatacaaaagtacctgagtgcagtggctcacacctgtaatcccagcactttggaaggccaacgtgagaatagtttgagtccaggagttcaagaccagcctgggcaacatagcaagaccccatctttatgacaaatttcaaaaatgagctgggcatggtggtgtgtgcttgtagtcctagctacttgggaggctgaggcaagaggatcccttgagcccaggagttcaaggctgcagagagttattatcttactactgcatgccaacctggatgacagagcaagaccctatcaaaaaacaaaacacacacacacaaatcaagagagttgtctgatggtggtaagcactgtgaagacgaagcaggatggagggaaattctttgattgttaaactagttccttgcactgatacatatcaatttttacagtttgtcatttgccttctaactctatgaaattttggttgatgcagaagtattttttaattatttttttaattatactttaaattctagggtacatgtgcacaatgtgcaggtttgttacataggaattcatgtgccatgttggtgtgctgcacccattaactcgtcatttacattaggtatttctcttaatgatatccctcccccctccccccaccccatgacaggccccggtgtgtgatgttccctgccctgtgtccaagtgttctcattgttcagctcccacctatgagtgagaacgtgtggtgtttggttttctgtccttgcgatagtttgctcagaatgatggtttccagcttcacccatgtccctacaaaggacatgaactcatccttctttatggctgcatagtattccatggtgtatatgtgccacattttcttaatccagtctatcattgatggacatttgggttggttgcaagtctttgctaatgtgaatagtgccacaataaacatacgtgtgcatgtgtctttatagtagcatgatttataatcctttgggtatatacccagtaatgggatcactgggtcaaatggtatttctagttctagatccttgaggaatcgccacactgtcttccccaatggttgaaccagtttacattcccaccaacagtgtaaaagtgttcctgtttctccacatcctctccagcatctgttgtttcctgactttttaatgatcgctattctaactggtgtgagatgatatctcattgtggttttgatttgcatttatctgatgaccagtgatggtgagcattttttcatatgtctgttggctgatgcagaagtatttttatgtgatcaaattataaatctttccctttatgttttttatgcttggaaagatttttctccatcccaacattataaaagcatttgcccaggttttcttttagtgccttatggatttacttactctgtttaggtctttaatccatctggaattgttttcagtacaaacagcaaggaaaggatccagctaaattggttagccattggcccatgaccattcattaaataatccatctttcccttggggatttgaattggcacctatgaaacacatgaattttcctgtgtatttgggtctgcttttgcactttctgtctattcctaagacacagcagccatccaaattactatagctttgtatttatttttgataatttcttactatcaaatttttttatccggtaatcccagcactttgggaggccaagatgggcagatcacttgaggttatgagtttgagaccagcctgaccaacatggtgaaaccccatctctactaaaaatacaaaaaaaattagcaaggcatggtgtcaggtgcctgtagtcccagctacttgggaggtcaaggcacaagaatcacttgaacctgggaggtggaggttgcagtgagctgaggttgcccactgcactccagcctggatgacacagcacccaggctgatttgttcatcctgaggtcaggagttcaagaccagcctggccaatatggtgaaaccccatctctacaaaaatacaaaaattagccgggcatgatggcaggtgcctgtaatcccagctactcaggaggctgaggcgggagaatcacttgaagccaggaggtgaaggttgcagtgagccaagattacgccattgcactccagcctgggcaacagagcgagactccatctcaaaaaaaaaaaaagcgttaacaaaaaattattactatatttgatggtaataattttggaaagttgactctttggacaaattctttaacttctcttggccttggtttcctcctctgtaaaacagggagactaccaatcttgaaggttgttctgggaattagtgaattaatggaccactttagttccggggtcaggtaagcctctttgagaaggtaatactccagctgaaatctgattgacaaggaagagcatgcctggcagaggaaacagcaaaggcaaaggctccgaggcagggactagcttagtgtgatgcaggttcatgcggagcgcatcgctcctggaggggactgaacaaggagagggtggaagggtgggccgcggtgaggggtctggctgtcaccataagggtactggagagccacagcaggatcaggagggcgggtggggcccattgaccctgcctctgtccccacagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggtgaggccagcgcaggggcctggggcggggcggggcggggcggtggggcggagaaggtgggcatggggcggggctgaagatggagacggctgagaccctcccactcatacgctgaaagacgcattcagccgttcactcattcattcattcacactcatttactcactttgaatcattcgttgatttattcatgaagtcactcatttatttattcactcatccatagtttgttctttcctccactcatttatttacttaactattcattcattcactcctctgttcctcattccatcactcaatttcctgatttgctcattcatttgttcactcagttgatcattctagccccagccctgtgtttggatgatagtggggccacaggggtggccaaggcagaccccattgtgccccagagggttcagagtccaacggggaaaacagacttgtccccagacagtgacaattcagggtggttaggaatatgataggaaacaagacctgtatgtgcaaaggccaacggtgtgagcctggcttaagtgcagacagcaagaaagagtatgtcaacagaggagactgagacaggtgtggtggtgcctgttgtcccagctacatgggaggctgaggtaggaggattatttgagcctggggattcgatcccatctcaaagaaaaaaaaaaaacaaaaaatggaggaggctgaatattcaactgggctcttaggcaaggaagggcctgggatgccgtgcaggtttaaagtttagttgcgatgcaggggttcttggatgcattctccccttgacctgcttcctgtgtcctctccaggcatgggttcaggagcggctgccactggccatgcagacagagcgaggcaacggtttgcaggcggtccagcagcacatcaaaaagaaccaggtgagcagagccaggtgagggagcgagttaggacatttggatacatgtgatagaaacagctgaaggtggttaaagccaaaacaatgaatgtattggcttttggaattaacaagactgtggacagcagatacagatgtatccaggtgcttccatatattttcatgactcttggctctattttttttttttttttgagatggagccttgctttgttgcccaggctggagtttagtggcacaatctttgctcactgcaacctccacttcctgagttcaagcgattctcctgcctcagccatccaagtagctgggattacatgtgtgcaccaccacacctggctaatttttgtatttttagtagagatggacggcggggggtggggtgtttcaccaggttggccaggctgggctcgaactcctggcctcaagtgatccactcgcctcagcctcccaaagtgctgagattacaggtgtgagccaccgcgcccggcctgtttgtttttctgcatgagctttcttcttaggccagtcctcctctcctggtgataaaaggcctccagtggattcaggtttacctcccaccagcaaaactgaagagaatttcccacctcaataatgtcagcagtagtctcaggaataactctcattggctcaccatgcccatggcatcccacgcccatccctgaactaatcatgatggatggggtttcggactgctccttgggctggcctggttaagcgccctcccctggaacctgctgctggaatcagccttagcttaattaccaaggctgagatggaggcaaagggggtttcccaaaggaaaatcaggggcttgagactagaaggaaggggaatagctattggacaaggaaaaagtaaaacaacaacaaacaaaatcacaaaacatcgagttagcctggtgtgatggtgtacccctgtagtcccagctactctggaggctggggagggagggtcccttgagtccagaggtcaaagctgcagtgagccttgaacaccccactgcactccaccctgtgcaacagaatgagaccctatctctctctctctctcacacacacacacacacacacgtcccccaaaacaaacaaacaaaaacacccatagggacaaaggacagagataatcagcaagaggatactactgccccctaacctgagcaaggtgggggagggggcctttgagctcctaaaaaatctctgaatctgttcattcctctggggctcagtttccacatctaaagtagagttggtttagagcagtggttctcaaactgcatacgaagggaaccccttggtcaaagcaactatttcaccaaagcctaaagcaagacataaaagaggaataataataataaggcattgtgccaggtgtggtggctcatgcctgtaatcccagcactctgggaggccaaggcaggatgatcacttgagcccaggagtttgagaccagcctgggcaacatggggaaaccccgtctctaccagaaatacaaaaattagctgagcatagtagaaggtgcctgtaatcccagctacctgggaggctgaggcaggagaattgcttgaacccaggaggcagaggttgcagtgagccaagatcacaccactgtactccagcctgggtgacagagtgagaccctgtctcaaaaaaaaaaaaaaaacatcgattaaagatttactaagtgctggctgggtgcagtggctcatgcctgtaatcccagcactttgggaggctgaggtgggtggatcacctgaggtcaggagttcgagaccagcctgaccaacatggtgaaaccctgtctctactaaaaatgcaaaaaattaaggccaggtgcggtggctcacgcctgtaatcccagcactttgggaggccgaggcgagtggatcacgaggtcaggagatcgagaccatcctggctaacacggtgaaaccgcgtctctactaaaaacacaaaaaattagccgggcgaggtgtcgggcgcctgtaatcccagctactcgggaggctggggcaggagaatcgcttgaacctaggaggcggaggttgcagtgagccaagattgcaccattgcaatacagcctgagtgtcaagagcgagactccgtctcaaaaaaaaaaaaaaaaaaagattaaaaaaaaaaaaagatttactgtgtgctaagtactgtcttagggtttatgctgattatttaatttaatcccctctataaccctatgaggtagatattgtcattatcctcatttcaccaaacaatgtatgttggaagaatagggcactgaaggatggtggggaggtgggtctacagattattttggaagcttcctgatcattctgcagtaggtagagttatttaagagactggagttttgctgagattttgttttcctgtcttgatgaaaatactcttggctgtcaacagtgtgggcgacagaactggcttatcgttgtcatggttgaggaaactgatcaagtgcacttagtacttaaaattgggggagctcagctgtgtgtgcagtgagagtgctggatacacaggggctgttaagccaaaaatagctgcaaatatgatgcatttggtgcatgcagactcagttccaagtgctccatagtttatcaccttataacaaccccgcaaggtagattatctcagcctgatactagctgtgtgaccttagcaaattcctcaccctctctgtgcctcagtcttctcatctgtaaaatggagatggtaatgttgtctggctccataggttgggagtgaggaggtgtgaggctatattatgtaaagctcttacttagcaaagcacctggcaggtagcagggtagcagacactcaagaatcgttggctggccgggcacagtggctcatgcttataagcctagcactttgggaggccaaggtaggaggatcgcttgaggccaggacttcaagaccagcctgagtaacatagcaagacctcgtctctccaaaaatattttttaaaatagcagggcatggtggtgcacacctgtagtcccagccgcttgggaggctgaggcaggaggatcacttgagcccaggagtttaaagctgctgcattccatcctgggtgatagagtgacaccctgtctctaaaaaagcaaaataaggagaggacttgctggctgttattatctttatcagttgagtcacacaaaaagttaaataacgttaaggcacacaaaaagttaaaaaagactcacaaaaagttaaataaggtactctgtaagtaaataaggttaaggcacacaaaacgttaaataaggtactctgcaagtacagagctggttgagggaaccttctgggggatggaagtgttccgcacgctgatctgggcacaccggtgtatgtgtctgtacaaatgtgtgcaactgtatacctaagatttgtgcactctaccgtatacaaatgatacctcggctgctaagctgcagggtttctgtattagggcccatcttgggtcggcaagcggcttggctcagagcacagtctctggaaccagcctcctgtgttcaaatcctgtcactccttactggctgcttgttcttgggcgccgtacttcgcccctctgtgcctgttttcccacctgcagcaagcatagggttatgatgagtgagggagtatcagcaaaatgtttacatggtcttggcacgtggttagcgagctgggggtgcttgttaattgccccgtgggccgtgccagtagcagaggagcgtgtggtcttgcagggcctcggaacgccccctctccacccacatccccttacctcctgcccccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggtgcgcccgagctgggggtgcggagggcctgggggcgctggagccgggggccgccgctgccgcctcatcgtgggcgctttgtgcccccaggacgaacagagcaccctgcagctgctcaagaaacacctgcagctggagcaaggcgtggagaactacgaggaaagcatcgcgcagctgtcgcgccagtgccgggcgctgctggagatggggcacccggacaggtgggcgggcgcgtggccagttcacaggaatggtccagcaggacctgaagcttcgctgttgggagttggcgcagcgctggaattggacgttgggtgggagaggtcctccttgctgtgtgctggagccctcgaatttggcaagtgggcgggccggaatggggggacacggctcagggatggttgagagggtggggccaggagcacctggatttgagtgtagtagtggggaccttgtcgggggagaaaagagtaggcgatgtctaggactggggtagagaagaatttactcaggacaggcaaggggctctttctactcagtgtctgggaggacagaaaagcctgtgctgagattggctatggcggtggggctggagacctcctggtgcagtggggtgatgttgcctcgtgtaggcggatgctgagctccaggcctggaccagggatggaatctgtaaggaggtacagagagagacctctgtccaagtgggctcagagattggggctagaggtgggatgcattggctggggacccaacctgggagtccagagtcccaccgaggttcctggataggaggggcgtgagactgagatagaaaccgggtgaggctgccgaggtgggcggatcacttgaggtcaggagttggagaccagcttggccaacatggtgaaaccctgtctctactaaaaataaaaaattagctgggcatggtggcacgtgcctgtagtcctagctactggggaggctgaggcaggagaatggcttgaacctgggtggcagaggttgcagtgagccgagatcgcgccactgcactccagcctggtgacagagcaagactccgtctcaaaaaaaaaaaaaaaaaaagaaaagaaaaaaaaagaaaggaaactgggtgaggctggatagaggtgagcttatccatttagggaagcggagctttccctgcatgctgaaatgcagggctttctgaacccaagacttgcagaaaacagagtcctggccaggtgtagtggctcacacctgtaatctcaacactgggaggctgaggcaggaggatcgtttgagcccaggagtttgagaacagagggaacatagtgagacctcatctctacaaagaaatcaaaaagttagccaggtgtagagtcacgtgcctgtggtcccacttgggaggctgcaatgggaggattgcttgagcatgggaggtggaggctgcagtgagttgtgatcacaccactgcactccagcctgagcaacagagcaagaccctgtctccaaaaaaaaagaaaaaagaaaagaaaacagagctctacctggggacacagccgtgtctgaagattccaaggaaacacagccctgtcctggggagggggtttaggggggtcacgctctgccccagaagtctcaggggtccatccctgcccctccatgtcccccttcagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgagcatcattagtaataagtgataccaggagctaccactaaggttctctgggccttagtttcctcatctgtagtatgaggataataacagcacccgcctcatggctctgctgtgagacaaatgagttaatataacgtaaagcactgaggaccctgcttggcacacatgctgcctcacacagtgttggttattattatcagcttattattttattgttacttattgttatttttattgttactgttttgttactattcttgccaggtgttcagtaagtgttagatattattttttatgatgatgatgatgatgatgattatcattactcttacctgccacaaaatggtagcctctgccaggtgtggtggctcatgcctgtaatcccaacactttgggaggccaaggcaggtggatcacttgaggtcaggagtatgagaccagcctggccaacatagtgaaaccccgtctctactaaaaacacaaaaaaatcagctgggtgtggtggcacatgcctgtagtcctagctgtttgggaggctgaggcaggagaattgcttgaactggggaggtgaaggttgctgtaagtggctattgaaccactgcacgccaacctgggcgacagagcaagactctgtatcaaaaagaaaaaaaaacattgtaggctggagggggctggtgtatgctgcccctttgctcactttgctgtacccccccccccacttcctgatggcaggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtggggcgccggtggccatcagggcaggtgggagggcctggacagctgtgggcagcagagtgggcaaaaatcaggctgtggagcaggtcgaaattaggcagtggcacagacagaaagcggactacagaacaggaagaaattagataatggagcagatagaaaatggactgatggaatgatatatagaaatcaggtattggcagggaaaagtggtaccttagaaggtctcacagatattaaacagcttctggctgggcgtggtggctccctttgggaggccaacgcaggcggatcatctgaggtcaggagtttaagaccagcctggtcaacgtggtgaaaccccatctctactaaaaatacgaaaattagccaggtctggtggcgggcacctgtaatcccagctacttgggaggctgaggcaggagaatcacttgaacccgggaggaggaggttgcagtgagcccagatctcgccattgcactccagcctatgtgacaagagtgatactctgtctcaaaaaaaaaaaaaaaaaaaaaagcttccaatagatattgggcagtggttctcctaaaactgtgagttttgcctaaatccagatcaagggtctaaagggaattttgagaagtctgagaggaatttggctgtggtgtagatagaaattagacgacagacaaggccaggtgcggtggctcacgcctgtaatcccaacactttgggaggtcgaggcgggcagatcatgaggtcaggagttcaagaccagtctgaccaacatgatgaaaccccgtctctactaaaaatacaaaaattagcaggaatggtggcgggcacctgtaatcccagctacacaggagactgaggcaggagaatcgcttgaacccgggaggcggaggttgcagtgagccgagatcgcgccactgcactccagcctgggcgacagagtgagactccatctcaaaaaaaaaaaagaacttagataacaggtctctgatggaaatcatatgacttttctgaaattaatttgatgggggcgaatttaatgaaaaaggcaacagagatattagaaattaggcagaggttctggccagaattcggatgtggatctgagcagtcagatggaaatgaagctgcaggcccaatacaactcaggcagcaggaaattgggttgcagttctaatggaaggtagaagttgggcaatttttgtttgtttgtttgtttatttttgagacagggtctcactctgtcacccaggctggagtgcagtggcgcgatctcagctcactgcaccctctgcctcccaggcttaagcgattctcctgcctcagccttccaaatagctgggattacatgcacgcgccaccacacctggctaatttttatatttttagtagagacgggatttcaccatgttggccaggctggcctcgaaatcctgacctcaggtgatctacccgtctcggcctcccaaagtgctgggattacaggcatgagctactatgcccagctggcaattattattattattattattattattattattattatgaggcagagtctctctttgtcacccaggctggagtgtagtggtctaatctcggctcactgcaacctctgcttcccgggttcaagcaattctcccacttcagcctcgagtagctgggactacaggtgcaagccaccacacccagctaatttttgtatttttagtagagatggggtttcaccatgttggccaggctgatcttgaactcctgacctcaagtgatctgcccgccttggcctcccaaagtgctggggttataggcatgagccaccgcgcccagcccagttattttttataaatcctacaaatgacttagaaatcaggctgagagattcatagtaataagtggtggatctgttagagatggggaggtcacaccaaaataaatcaggagattgaaccaacagagtgagcagcaggctgagcacagtggcttatgcctataatctcagcactttgggaggccaacctgggaggattgcttgagcccaggagttcaagatgagcctgggcaacatagtaagactccatctctattacaacatatatgtatatatcctgatacagtggcatgcacctgtagttcagctattagtaggctgaggcaggaggatcacttgagcccgggatgtcaaggctgcagtgaattgtgtttgtgccactgcactgcagcctgggcaacagagcaagaccctgtctcagaaaaacaaacaaaaaacccaaaacccaaaagatagagtgagcagagctcatacagcagaatgaatggaaattgggcaggggagtaatggcaattgaacagccgtcgtgtaggaaactgggctactatgaaggagtgggtttgaaataaactgagttaaaaaaaaattagcacatctaaaagacatcaaagtggaaaggggtttcctgaaagacccaaggtaggggtgggcctgcctgaaaacacaggtggcagacccaatagaaataaagctctcagaccaaaagaaatcaggcagtgggttgaaagagatgtggtagtagatctaaaagaagtcagaatgcgggtaagtcaaagagaaatcaggcagcagatatgacaggagcctggctgtgggatcacagtgtgaggctccttatatcttgaggttctgcgctggagcagatggtgggagggagggcacagcctgggccccgtggagggctggcgcccgacctggcatgcccttcaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccaggtgcccctcatccctcctcgggcttcctgcctccccctggtggcctaccccagccacccccagcccattgacagcccccttctcaatggaatgacaacagccaatatctgtgtggcgcctctgtgtgctaggcactgttctaggtgcttcgtgtgtattcagaccccttttttaggcctgtcattggggacttcggtcatggggcatccttctgtccgctgtccttcccagttgcctattattaccctctccatgggatgtcacagcatgaaacaggctaaagacaggatgggcaagggaggtgtgggactgtatttgtgagggtgggtgaagaattctaacaattccagcatctcagtggcttcattagtgggcatgggcttattgctcacatagtggttggatgtgagtgtccagcagaatcctgtcccctggtgattgggagccagggtccttccatcatgccaccctgggagtcacatgctggaccctctgcatcccgctgcagatgggaaaagatagcaggaggatcacacagaaggttttagggataaagccggcacccacacactgccagcccggtggcctaacctgtctgccagggaggctgcaaatttttttttctcttgagatggagtcttgctctgttgcccaggctggagtgcagtggcacaatatcacctcactgcaacctccgtctcccaggttcaagcgattctcctgcctcagcctcccaagtagctgggactacaggcgcccaccaccacgtctggctaattttgtatttttagtagagaaagggtttcaccgtgttggccactctggtctcaaactcctggcctcaagtggtccacctgcctcagccttccaaagtgctgggattacaggcataagccaccgtgcctgacctaggctggaaatttagtttcatggtgtggctaggaagaaaaggacctagggaatcagggacacctggcattgcttctgggaatgcagatcctgcagcctgcattcatttactcagcaaatatgtattaaatgcatatggtgtgccatgtggtgagcaaggccaagcacttgccctgagacagattgcattctcatagcacttattactttctgaaatatagcatggggatggggcacagtggctcacgcctgtaatcccagcactttgggaggctgaggcaggcagatcacctgagctcaggagtttgagaccagcctagccaacatggcaaaactccgtctctactaaaaatacaaaaattagccaggcatagtggtggacacctgtaatcccagctacttgggaggctgaggcaggagaatcgcttgaacccgggaggtggaggtcacagtgagccaagatcgtgccactgcactccagcctgggtgacaagagcaaaactccgtctcaaaaaaaaaaaaaagaaaagaaaaaaaaatgaaatatagcgtgggtatatatacatacataggaagggaatgatagctggcaaagtctctctgaggatgtgcgtttgactggagacctgaatgaagtgatgggtgagtcaggtaaagttttgagggaagagttttctaggtggagggacccacaagtgcaagggcccagaagtgggctgtagttaggcatgtgtgaggaaaagctagagatcactgtggccagatggagggagggagtgagggagtgtagggtgagaggaagtgagtacagaggggcactggggccctggaaaccacacatggtgaggagcatgccttctctatgaggaacgtgggagccatgcgagagtttagagcagagtggagtgatgtgatgtgtacatttgagaaaaataggccgggcatggtggcttatacctgtcatcccagcactttgggaggccaaggcgggtggatcacttgaggacaggactttgagaccagcttggccaatgtggcgaaaccccgcctctactaaaaatacaaaaattagctgggtgttgtggcatgtgcctgtagtcccagctactggggaggctgaggcaggagaattgcttgaacctggaaggtggaggttgcagtgtgctgagatcgtaccactgcactccagcctgggcaacagagcgagactctgtgtcaaaaaaaaaaaaaaaaaaaaaaaggctgggcacagtggctcacacctgtaatcccagcattttgggaggctgaggtgggtggatcacttgaggtcgggagttcgagagcagcctgaccaacatagagaaacctcatctctactaaaaatacaaacttagccgggtgtggtggcacatgcctgtaatcccagctacttgggaggctgaggcaggagaattgcttgaacccaggaggcggaggttgcggtgagccaagattgtgccattgcactccagcctgggcaacaagagcgaaattccatctcaaaaaaaaaaaaattaaatatacagggaagtaaaggtaacccacatgtgtatcgtgaacacttggcttgaacaaccatcaacatttggccaatctagccaaaagaggtggctcacgcctgtaatcccaacactgggaggccaaggcaagaggatcacttgaggccaggagtttgagactaccctacgcaacatagtgagaccccatctctacaaaaaagaaaaaaattagtcaagcatggtggtgtgcatgcctgttgtcccagctacttgggagtctgagggaggaggatcacttgagtccaggagggtcaggctgcagtgagccatgattatgccatttcactccagcctgggtgacagagcgagattctgtcttaaaaaaaaattttttttttttaattagctgggcattgtggtgcatgcctgtagtcccagctaccctggaggctaagccaggatgatcacttaagcccaggtggtagattcaaaccatagcatgaagctatgattgccaactgatggaaccttcagaaacttggaatttgttttggacataagatggcttagaatggtgctgtccaatagttatataacacgagccacaaatgcgagccacatatatactttaaaatcttcttgtggccatactaacaaagcaaagcaaatgaaacttaattttagtaatacatttttatttaacctgacatacccaaagtattatcacttcaacaggtagtcaatattaaaactattaatgaggccaggcagtttcgaacttctggcctcaggtgatccgcccgcctcagcctcccaatctcagccaagcggagatcgcaccactgcagtccagcctaggtgacagaaggagactccatctcaaaaacaacaacaaccaaaacaaagaaacaaaactattaatgaggccaggcgcagtggctcatgcctgtaatctcggctgagattgggaggctaaggcaggcggatcacctgaggccagaagttcgagaccagcctggccaacatgccaaaaatccatctctactgaaaatacagaacaaaaaattagccaggcttggtggcgggcacctgtaatcccagctactcgggaggctgaggcaggagaattgcttgaacccagaaggtggaggctgcagtgagccaagatcacgccattgcactccagcctgggcaagaagagcaaatctctgtctcaaaaacaaacaaacaaacaaacaaaggctgggtgcggtggctcacgcctgtaatccctgcactttgggaggcctaggcaggcggatcaactgaggtcaggagtttgagaccagcctgacaaacatgttgaaaccctgtttctactaaaaatacaaaaaaattagccaggcatggtggcaggtgcctgtaatcccagctactcaggaagctgaggcaggggaatcgcttgaacctacctagaagggggaggttgcagtgagcggagatcgcaccactgcacaacaacaacaaaaaactattaatgagacattttacattcttttttacattaactccacaaaatctggtgtgcattttacactttacaccaaaattcagactggccacatttcaagtgctcacatgtctagtggctactgccttggagagcacagacttggaacgttaaaatcattggctagtggaaccttcagaagcatagctagaaaaagtttgaaaatttggatcttggctgggtgtggtggcttatgcccatagccttgaactttgggaggctgaggcaggtggattgcttgagcccaggggtttgagaccagcctgggcaacatagcaagaccctgtctctacagaaaatgaaaaattagttgggtgtgatggtgtgcacctgtggtccccgctactcaggaggctgaggcaggaggattgcatgagcccaggaggttgagactgaagtgagctgcaatcttgccactgcactccagtctgggcaacagagcaagaccctattaaaaaaaaaaaaaaggaaaatttggatcttgaaatcctagaaggttagaatcaccaaagtgtgaaattttagaaacttggaaaatttgaatcattgaattagtgaaccatggaccctcagaatttggtcatcgaaagtaggtgtctcagtctggtttggtgactcaacgcctgtaatcccagcactttgggagactgagatgggaggatcacctgaggtcaggagttcaagaccagcctggccaacatggagaaaccccatctctactaaaaatataaaaattatctgggcgtggtggcaggtgcctgtaatcccagctactcaggaggctgaggcaggagaatcgcctgaactcgggaggtggagtttgcagtgagccgagatcgccccactgcactccagcctgggccatagggtgagactttatctcaaaaaaaaaaagaaaagaaaagaaaagaaaagaaagtaagtgtcttgaggtggtatgggatgtcagcctcaaggatttggggtcaccaggagccacatgtatggggcaggctgaggaggctccctgtggctcagatccctgcctgccacccactgcagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgaggtggggagcagggagggggtccccctctgccacccgggcacattggggtggaagccattccacaccctgacttccctcccacccacctgccactcccagatccaggcacagctggacaagctgggaaccaggaaggaggaggtgtcggaaaagtgggaccgccattgggagtggctgcagcagagtgagtgggggcccaggcacacgtggttcaagggcacagggacatgctccagcctgtccagccaaggcccagagggtgacaggagcatgctttgcaccctacccatgggtctccagaagcaaacataagggcctggaagggtggacaagggggctgccttgccattgaatacccacccttgaaaaaaaagtcttaaagtcctgggtggggggacattaaggaaggaggaatgggagtcagaaaggaggaatgatgcccactgaaatagccccagcctctgccattcctgcagagcccaggatggtcagggctcgggtatggaaagccggaggggtgtggaaggccaggggaacagccattgcccccaggaagggccccagatgccccagaatccttaccctgcatgcccctcctcagtgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacggtcagctccccagatactgccccattacccccacccccaccaagacccccacacccatggctctatatgagacagacacaccgagacatggtgcttggtcctgtgttgtgtgagtgccaagacagactcttgctaggctcccagtggagcagagggacagacctgtcaccagtgacagcccagaatgtcagggatgtgataggggaagaacaagcagagggatagtgcctgggatgggggagtgggagggggaactggcctgggggattctattctgagacttgaataattaggtgaagagaatgtagtaataaaaaggattaggccaggtgtgacggctcatgcctgtagtcccagcattttgggagaccaagatgggtggatcacttgaggccaggagtttgagaccagcctggccaacgtggtgaaaccccatctctactaaaaatgcaaaaattagctgggcgtggtggtgcacgcctgtaatcccagctactcgggaggctgaggcaggataatcacttgaacttgggaggcagaggttgcagtgagccaagatcgtgccactgcctgggtaacagaacaagactccatctcaaaacaacaacaacaataaaaaaaaaacaacaaaaaaaaaccgcttaaaggctgggtggggtggctcacacctgtactctctttggaagcctaggcgggaggatcacttgaacccaggagttcaagaccagccttggcaacatactgagaagccgtctctaccaaaaccaaaagcaaacaaagaaaaaacagccaggcgtgatggcacgtgcctgtagtcccagctactcagaggggtgactgagactcgaggatcacttgagcactggaggtcaaggctgcaatgagctatgatcttgctgcttgcactccagcctgggcgacagagcaagactgtctcaaaaataaataaataaataaataaataaataaataaataaataaataaagtcttaaagtcctgggtggggggacattaaggaaggagaaatgggagtcagaaaggcacgcagagcaattgatttacccaatttttaaaaaagtgatttagccaattcttaaaagagcaataggtgtttgccggagagaataggctttaagttcttggcagagagcaaagcatcgcacaggcctggacaccttgctttttcaaggaactggtcaattgagtgatgaggcagaaaaacccaggccgcctccccggacctcccccttaccccgccccggccccacgcctccaacctaaccctggtccctccatcctcagatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggtgaggtgcccgccttatgaccagaaagtgaggggaggggaaagcggagagctcctagaacccctcaggcccagtgaaagggcttcagggctcagaacttcccaaagaaggagatatcgccgcggtacccattttgcagaggtgtaaactgaagctgcaagataatcgatgtgcccattgttacacagaaaggggagcccttcctgttgaaagaaaaggcagactgcctttctccagacgtaggttctcggcccctgggttgtgactcctgcatcaagtctcccgggtgccccgaggcagggattttgtcctctctgtgcctcagtttgcccactgggctaatggtggaaccctcacctccttgattggagaggagaccctttatcacaattctctcagcagccttatgaagtgggggctgttgtcttctccattgtatgactagggcaactgaggcacaaaaagggcaagtcactcagcttaaacgaaccaggactttcagaatccagagttggccagtgtgtgttgtgcagatctgtccagtcagctgagtgtgtctccagaaagaggcctttggtcaggagacaatgacttcttgattctttttaaattgcacatttcatgaacatttgctgagtgcccactctgcctggcatgtgctgagtcgagcggtgactgaaccagtcccatccctgactttagagactcacagtccattgggaaaaacaggcttgtcatcaatgatgaccgagaattatctgggctggaatgggggcgattgggggactggagagtcaggggtgggtggagaaaggcaacgtttgcaagttgttctttgtgctgcttaaaattcaaaggggcatctgggcgcggtggctcacgcctgtaatctcagcactttgggaggttgaggcgggcagatcacttgaggtcagaagttcgagaccaacctggccaatatagcaaaaccctgtctctactaaaaatgcaaaaattagccggcatggtggcgcacgcctgtagtaccagctacttgggaggctgaggcaggggaatcgcttcaacacaggaggcagaggttgcagtgagccgagatcatgcaccactacactccagcctgggcaacagagaaagactccgtctcaaaaaaaaaaaaaaaaaaattcaaaggggcgagaggtttggtcttccattcagcagacacgtcccaaacacctgtggtacctaaggcgagcatctgagagaaacagctgcagaagtgggcaggggcctggcacttccagctaagaagtggaggctcctctgcccagccagacaggtccatgggagaaggaaccctggtttcactgggtctttctgtcccccatcccccaggaaggccaccctggctgacattgtggaacagctgcaggagaaagaggcaggcccagggctgcctgctggggtaagttgagcctcggatgggtggggataggaggacccctttttcagagcaggaggcaggatctcagaaacagccagtgcctagccctggcaggacccattccctacctggaccctgcagagacagcatggactctcagggtccccagaatctgaaaatgtcccccttagaaagacggggcacctacctaagagacccctactgcccctccacacacacacacacacacacacacacacacacacacagacacacacacacagacacacacacacagacacacagacacagatacacacacagacacacacacacagactcttcccacatctgtcctggactccgtatttcttcagctcagtggggtcccaaatttcttcatagcctcatacacacacacacagaaggaagccccaggtttctcctgcagacagtggggacacgccctgcttgcacccccacctccagagatctggctgcctctttccaccaccgagagagattccaaaccaatgagtcctaacagactcactcccaagacccatggggccctaagaattgggcctccaaccctgaggtcctcccatactcgcctccgagacaaatggccctgtagacagatgggaccccagacccatgactcccccaaacagatgacccccacaccctctccatggacagcacccctcttccccctcccttcacacagccgtcgctgcctcagccacgcgagcttcccccaggtcgcctgcccaacgggcttgagctgcccgagcggacacctcggccggaccggccccgggcgcgggaccggcccaagccgcgacggcggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtgagcgtgtgggcggggctttggaaggcgggtctcaggctcagggtgaccattgcgtggagcggtgggactgaggagggggtgtggctcaacttcaggccctccagcaggtggcggtagtaggtggggccagagctggggggtggtggtggcttaaatcaagaaagccaaccaatgagcaggagggggtgtggtttaacgtcaggccctccaacccgtgggggtagtaggtggggccagatgaggggtggggctcaactttgatgattccaaccaatgaacaggaaggggcaggacctaaggttagtgcatctaatggatgatgggtagagcttaggtgggaacagaaggaaaatgttctgaaagtgagtaaattggaacctaacctcttagcaaccaacccaggagttgatcagctaaatagcaaagagggaggcatctagttgagaaggtttcaatggcttgtcgtggagcttggagaggtcactcaaccaatgagtggggtgggtctacccttgaagtttcaaattgggggagggtccgaaaacgggcagagcccaaactaatgagggtaggggttgggaagggggagtcatctcttacaggtttccaaatgagggtctagccatgatgtgcctgctcttggggagtccagctcctgcttgtccaccctctttttgtccaactgagaggcagaatctggggacaagtggagccaaaaaggggtatcaccggccagtaatggagtgagtcccaagatatgaagtgggcaggacagattcagattttgctagtggaatctgtaggtggtctttcttcctcgtacctaatgccaaggtaggaataaacaagggcacctagtatgttttgctttgggagggattcctccaggatcgaggctttggatgactggagagacaggaattctttattccagacagtagaccaatagactttccttgagaaagctccatgagtggggaggattgagtggagcaaaggcttatggaggagacagcttaagacttaccttcaggaaattcagtatgggaggggataaggaagggaaatctcagcctgggcaaaggcttgatactgagagacttaaatgctcccctcagggcagcaacagccttaaggaagagcattttaggtccaactagggcgcaactagggcgcaaaggtccagaggtaggaaggctcagacatattcagaccttgaggatgttaatgaagagttattaggcagagtgctgcggctctgccttgagccccatcttgtcgctccaggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagtgagccccccaatgggcaggagggagggatccaaggctcagcttcaactcccagtgggaccctggcttccctgggggacacttggtgggcaggtgggctgggccccttccccagatctctgaagtcctgtgtcccttcctgcaggacccaggatggcagtgagtttttgctccaggcaaaagatgaggtgagatctggtcctttcctccctctgtgtggacctcagtaatgacctggctgtctggctcctgacccagagtgatggggctgtgagaagggacactcacaggccagagttatcagggctgtaatgggaaagcccacaggcactgagagcccaaaggaggttcctaacccagtggggagtgggaagggcttcagggagggctgcctgcagatcctgatgacaaagtccaacatctttgccgtggtcactcaggtgagactggaatggagggagttcgctttaaaaaggggtgatttggccaggcgcggtggctcacgcttgtaatcccagtactttgggaggccaagacgggcagatcacctgaggtcaggagtttgagaccagcctggccaacatggtgaaaccccgtctctactaaaaaatacaaaaattaactgggcatggtggcaggtgccttaatcccagctacttgggaggcagaggcaggagaatcgtttgaacctggaaggcggaggttgcagtgagctgagatggagccattgcactcaagcctgggggacaacagcgagacttccttcgaaaataaaataaaaataaaaagggtgattcagagggacagtgggggtctaaaaaaaggagtgattcaggttgggcaccatggctcaggcctgtaatcccagcactttgggaggccaaggcaggagactgcttgagcccaggacttcaagatcagcctgggcaacacggaaagatcccatctctatgggtaataataataataaattagccgggagtggtggcacatgcctgtggtcccagctactcaggaggccgagtggaaggatcacctgaaccagggaggtcaaggctacaatgagctgtgattgtactatggcactccaggctgggtgacagagtgagattctgtctcaaaaacaagagggggtgggtgatctaggtagagggaactgcaagtgcagaggaccagaggtgcagtattgcaaagggttaactgctggagggcagagttcatggaagaaggtcccagaaaggttcccaggagataggtgtctcaggacaggatgggccatttggaggagattggattttttacctaagggcactggagagctaggggggattacagtgatgtgtaaaaaagattcctggctgggcgcagtggcttacgcctgtaatcccagcacttcgggaggccgaggcgggtggatcacctgaggtcaggagtttgaggccagcctgaccaacatggagaaaccccatctcttatggtgcatgcctgtaatcccagctactcgggaggctgaggcaggaggattgcttgaacccggaaggcagaggttgcagtgagctgagacagcgccattgcactccagcctgggtaacaagagcaaaactccatctcaaaaacaaaataaacaggccgggcatggtggctcacgcctgtaatcccagcattttgggaggccgaggcgggcagatcacaaggtcaggagatcgagaccatcctggctgacacggtgaaaccccgtctctactaaaaatacaaaaaaattagctgggcatggtggcgggcgcctgtagtcccagctacttgggaggctgaggcagaagaatggcttgaacccgggaggtggagcttgcagtgagctgagattgcgccactgcactccagcctgagcgacagagcgagactccatctcaaaacaaaacaaacaaacaaaacaaaacaaaacaaaacaaaacaaaaaaagattcctttggctacctgggtgggtagcccaggccgcggccagggcagggacccaagtgggagagcgcatggctgggccacacaggcctgtggggagaggaggaagaggagtctgagagaggcaagcataaaggtggtttgaagagatgttgagagtaataactaacacttgttatctcattcaatcttcacaagatgcaatgaagaagtgggctttttttttttttgagacagagtttctctcttgtcacccaggctggagtgccatggcgcaatctcagctcactgcaacctccacttcccgggttcaagcgactctcctgcctcagctacctgggtgactgggattacaggcttgcgccaccatgcccggctaatttatgtatttttagtagagacggggtttctccatgttggtcaggctggtctcaaactcctgacctcaggtgatccacccgcctcagcctcccaaagtgctgggattacaggcatgagccaccacacccggccagaagtaggcctttacccactacatgccttcttttacttatctgcacaatgaagattaaaaatagtttcttggcctggcatggtgcctcacacctgtaattccagcactttgggaggctgaggtgggcagatcatttgaggtcagaagttcaagaccagtgtggccaacgtggcgaaaccccatctctactaaaaatacaaaaagtagccaggcatggtggcacgtgcctgtagtcccagacactcaggagactgaggcacaagaatctcttgaacctgggagatggaggttgcagtgagctgacatcgagccattgcactccagcctgggggacagagcaagactctgtctcaaaaaaaaaaaaaaaaaagtctcttatcatagggttactgtgagaattaaattgctccatgtttaattgatacatgataaactgatacttagcacagggcctagtaaatatcagtgctctagtagtgcctgcccatattattatcattgtttgtgtcatttatctctgtagtaggaagtatatacaatcctattgcataggtttaagggaattaatccactaaagtgtttggaacagagcctggcacatattgctatgtaactgcatcatcatcatcatccctttttaatagatgagaaaactgaatttcagagagggtagtctgatctgaaattcacctattattccagcttctctcttccaaatacggcctctgtgccctgtttcttcccccaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacaccccctccccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttga

SEQ ID NO: 2701 - DNA, 32586 bp, Homo sapiens
gatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccaggtaagccccctgcttccttgtgccccttccacccaataagtctggtggtccaggaggaccacggctttcggattcaggggaaactcgaacccactgcttcgatgtggagatgcaaagagggcccttggatttattaggcgccctcaatttgtaggggttagattcggggagtactgagatttttaggggaaagagtcccctttattgtggtggagaaggctaagtctccagagaatcctggggttagttcggggaaaggtctctagtttattggggcagggggtggggggctgagctctcctagaatgatagagacgtgtggggtcttcgagctaggatggagcgccccaagtttcttgggcgcgtaaggaggaaaggtgttgggggattctggagggactttatgaggccgctgagttgtcctggttttctaggatttgggggctctgtgttcatgaaaagcgacctttgggtttttcgaattggtcaggaagacatagactcttgcgttgatggtggaggggcttgtggggagtggggtcgggtgggggagtcctcaggcttcagaacggttggggatgctcaagtttcctagaattagaggactctgggattgaatgaggctccagtgatttcaccgcgagagatccaggattccctatagatctgggggctataggcgcccttcctgtctgcgggtgacgggactgaaggaagccgtctgcccagcacccccacccaccctccccgcctggcggcccagcgctccgttacaaaggccccgggctcctctcccgcctgggtctctgcgaatgcgtttagtaacccgagccgcggcgggggcggggccgggaaggggttaacctggagaaaaggcgggagggatgacggcaagatcggggatccccgaggctccccaccagatggcctcatcctccactcggccccacccacctgagaggggcccacgcgctggacacccccctctctgcacccccccactgctctcctctcggggtctgggcgcgcgccctcgtctctagacccccttagcctggggataatggacttgtctggggggccccttcattgcgacgcacttgaaccggagctggaagctccgccactgagaccctctgggctgggagatgtctgcaagaacggcacctttctcctggtcaggcgggaaactgaggcccaaagaccaagaaacgctggcttctggacacacatcgtggaagggcaagaacgggctagaactcaggctctgggattctcagtcctggactgtgactcccgttatccccctccacctcagcaccctgctggacccacagtcagagggaagagccttccctccccagctgccgaggcctgtgaaaatggcgccacctgtcggccaggctcaggatggcgtctgagtcccggaccgggatgtgcgggagggcggggttctagattcccagacagtgcgggcttagaaatgctcttagaaatcgagtcttttgtttttgtttttgttttttaatcacttttaaaaggctttaaaataacgtattttttcaataaaatcgtacgccaaaatctcttcataagacaaaagtacggtttctgtgcccttcagcccgaagtctaagccaatttgcctcccattgtacagatggagaaactgaggcgtggggagaagaacctcgttagtcatatacctgtttcaagccccctcaggatgcgtcttggtttcccctccccgattgccctcctttgcagagttctggggtgctaggggcctgagtgacttccactccactatttatagcgttgctgtttgtcgctgctgcccgggccagacgtctaggaggagccgctgcatccgaggtgggttctggaagatggagtatgagtagggggcaaaagggaataggaggagaggggcagggagctccccatccctcccctcatcccagtgggagagctggatgcatttggtagagaagtacttggtcccctccttccccacttagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgtgagtgggcagtccctcccctaccaaatcctccctcaggaactcctagctttgcccccgtttccgctcctcctcccttcccctctccctctctctcccccctccctccccggctctttcttttgctatcagcctgtctgtccgtttctatttcatcccttgcctgcctatctcaggctcttcccatctctgcattatttctgtctctttctgtttctttctagttacctgtctcttttcctctctctctttctccctgtgtctcactgcctgcctctatgtctaagtctctctgccccttctctctttctctcccccaacccccatcatctctctttctctcagggtctttgtttctctcccactagaggcctggtccccataaataggtgttgtggggggagggttgggcagagccgctactgaaagacattttcctggcatggaggccctttggtggggaggtcagtttaacccggtgacagcagcttttccgtcctctcccacccaggctccaggaggccagagctctactgaagcggcggcggccccgggggccagggggccggggactactgagaaggaggcccccacagcgtgcccccgctggcaaggccccgggtaagcacatccgcctttcctccgcctggggcgaggggggttccgggccagataaagccgtctggttcccacggtccagccgccgcctacccgccccccgttgtagctcagcacccacccccaggacgaggccccctctagggaccccagcgtccggccgtgcgaggtgagcccgggacaggaccagacacaggccagaggcactgacccgcgggggtggggccgggaagccaggcgtccgggctccccgcggccgaagagggagggcgctggcccgttagaaagctccgccgaaccagcccagacaacaaaagcgattgtgcgggttggcgcctgcctgggcaccaaatgctcaagattgtggggcggctgggggccaaaggcctcctcctgtttcccgaatcttccccctgccctcctcccgctccagctcttgacccctagtctagaacacccctcatctcaaacaccctcaaaaccctcctcttgctgtagccttcagcccagatgtgacccctccccctaaagtcttccagatgtgagcctcgggccagatgttagtacccccgcccacagcctccctttatccattgtgacttctcccgccaggtgtggcgttctggccagatgtggctacatcttcacatgtatcccccccacctccagcctcctgcccaggatctagacgcccaattcctttatgtgcccaggtgtagcgacccttctcccatccctcagatgtcccacctggctgtccagatgtaccatgatagccccctatcaagatgaagcccctttctctgtgccccgggcagaagaggatcaactcttagctgtctccccaaatgtggcccccactactcttaatggatttcctctttatggattcagctctgtctggggggaaacccgcccgcccccacctgttcccttccccgccgctcccctacaggcccggtccacttgttggtgcgcggatggggacagagggggcgccccgctcacccctgcgagtctagcgcccagcctgcgagcctctggctaagcgcccagccccacgcgcccccgcgcggccgccggggagggagtggtgaggagggggggcctgagcgggggcgcgggcgacctcccccgcgggcgggcgggcgggtgcggccgggcccctcgggcgggctggggcggcggcgcggcggagcgcggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgcctgtgagtgcggggtggtggtcccgagagagcggctccgggggggaggaggatccctggggatggaggagacagtcctccagggagagggagcccagattccatatgcaatagtgcaagggaatatcaggggctatttgaggaagggggccccaaattcctggcttttggggttgggtcctgagggttccgattttgcaagcaatgagggttcttagaggcctgtgatgtcccacgtgagggaattggcgccagctttcatgctttgcgtcaaaatggggatctcagaattgaggggcctgagaacttttgggaggggggctcgaattctgagacgctgagtaaggagtccccggggaccaagcaagagtctcaggaccgcatgggggacgtctcagtttctgtgtgtttgggtgggaaggttctgtatgggaatgcctgtgaggtggggtactagagagaagaaagttaatccgaagaactaagagggagaggggacagagacgggggttgtgtgtgtgtgtgtgtgtgtgtgtgtgtgtgtgtgtggcggcgggggtggggtgggggtgtctccgcaggacctgagttgcaggggtcccacgtgcgacagaaatccagataagagggcttacggaaggggcgccccctgggggcggaggggacaggaggtgtatgcaccaggcactcctagagatggggagccttgggggttcaggtgaggtgggggagggcgcaccacctgttgttccaggatgcaaaagtgggcagactctctgggatcgggccttcctgccccctaccccgcagaccctatggagtggggagtgggggcccctggagcggagaactcgcccagcctggcccccagccagcccagcccggccggcgtgagctcatctcccgcctgagcccccgcccgctgccactccctctctcctccccttcctccctctttctttcactctttcccggcccagccccaacgtgcctgtgccaggcgccatgcccaggcgggtgccaagcccttgggggtgcaaggagtggcatgtgaagtgggggctgacctcaaagggacccctatgtcctcaactccccgcttggccagggctgtggggcatgacgttggctgtggccatctagtggcccaccctgggtgtaggcacccccagggagctggcctgcgggcctgcattcaggccaagagaaggcagagaaatgcctctggagcctgggaaataccctcagacctggctggtttcccaccccctccatcagagacccttaccattctgcaattttgattcctagttaagcctctcctaggccccactactcaattaaaagcccccattagaccaccctggagtcatggccccacactcctacctaagggagctgagtttttgctccaggccctagacccgctctccaaccatggcaacagactttagagaccactcctccagtgaaattccctctcattcttccctcccacctcccaaactgtgcctttccccagataactctgtagtattgtccagaagtcctgttcttctagctcacccccttccccaggaacttctgatcccatttatcttcagagaaccccagggttggtcttgataagtgggttctcgcaagaggactccagacattgtgctccttacaggcagccattaataaaaagcctttggcacttaatccttagctgggaggggaggggattccacagagggactcggccaattgagcctcttaagtgctgatgacttccaggaattccacttcactatctaaaccctgttttcagcaccgtcaaactggttgtctcctaggcggcactagagtcctgttttctaggtaactgtccacaaaaggactcctgctgaaaggacgcctcagtttcctctgagctaggttcctccatcccagaaacctccagccgtctttgaactcgagaggactgccctttagtcgatctcctcccaggactccagtccctttatccttctaaacggaggtggctctctgcgtcctttcctctctacagttgtggctcagaatcccacacgcgcctcccccggccgcctgcctcctccctcccctccgcacagctgtctccagctgttctctgcagccccgggagagagagggagggggtgccctcgcaggacagcccggcctcctttggctcaaaggtcccggggctccccaagggtccggaatgtggagcctccgccctgcccccgccgcacctctctctttgtttaccccgccgcacagctggcagtgccccgcccagaggtggcctggggcccagcgagggcgcgcagaggggagtggaggcgcgttcccgctcgtggctccgccccggtgctactggaggctgtaaggccgagctagaactctaaagccccagccagaaagaagttgggcggagacacagcgcggtgggcggaactagggcacccggacagcctggaggtggggtgggaggggcgtgaacaagtgagccgggcgaatcagagtgcggaaaggaaggtgggaggggctagaggcagcaggttaagctcctggataggcggggtttagaatcccgcgggtagaaggtaatgtgagaggggctacaaagggggcacagccagggggcggaggtaggacttcgtggaccaagcagagggagtgtgggcgggcatagaatgcgaaggagacagagttgggcggggagttatgccagggagtggttaaaatgtggtttgagtcaatggaagggatcagcattgggtcggaggggctggaacagcaaagggttccgtcggactacggaatgggcggggtcagcgccgtctgggctggtctggaactccgtggactcagccagaaattgggatccgagaggttgacatgaaagtgaataaacagcctgagggctggctgggctcacgcctgtaatcccagcactttgggagactgaggcagaaggattgcctgagcccaggagttcaagaccagcctggccaacatagtgagaccccgcctctaccaaatttttaaaaaacgtagcccgatgtggtgcacgcctgtcgtctcagctacttaggaggctcagatgggaggatcacttcagcttaggaggtcgaggctgcagagccataatcacgctactgcattccagcctgggcaatagagcgagatcctgccgacttagtgggtgggaccgtacctctgatggctgaacaactggactgggccaatgctgatgccagaattggggcggggccacatgacagctaagggcggagcgacttagaaatgaatgataccttgagggagtagggaccccaggagaacctgccaggaatggtggcgcccctgagtgtcctcgttctcctcccagtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggtgaggaaagggtggccagagtcccctccgacccctgtcaagcatttcactttgcccctgaccctcatatttcccgccttcccgagcacctttgcccagctcgccctccccgccttgtctagccccaccccgtaagaacccgtgtagacatccgtttgcccggccgtgcctcccctaggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaagtgagaggaggcccgtggggaggggcccggagcttgcctccgcgcgggggcgcgctcacccaacacttccccgcagtgcgcgtccccgctgcccgggctccggacgcaggaggtctgctgccgaggggccggcttggcctggggcgttcacgactgtcagctgtgctccgagcgcctgggtaagccccaggacgtccccgaagtgctcggagctggggagtggtgacaacctcaccgttcctcctactctgccctagataaacccagttcacaaattgtagccacgcctaccccattgtggaggcgacttccagtcctgagcttttcataccgctctgggaccacccaccccattttctgactttggccactctgttctcaccctgcctttgtgccttggccccccaccatatactttgggagtctccaatgttgccatttcaactgccaacctaaggctgtccctgcacttaaactacagccaacatcttttagtccctcccaccccgtcttcgtctctgcccactccattctcgctctgcccacctgtccctggcccacccctctcctctcgccacagggaactccgaaagagtgagcgccccagatggaccttgtccaaccggctttgaaagagttaatgggtcctgcgaaggtgcaacggggcaggggtgggaggggcttggttctgggggcgggatttgcagggatcaagttcctgactccacggtgacctccccaaccctggcagatgtggatgagtgcgcgactggcgggcgctgccagcacggcgagtgtgcaaacacgcgcggcgggtacacgtgtgtgtgccccgacggctttctgctcgactcgtcccgcagcagctgcatctgtgagcaaccagcagggagctgaggctgggtcccgccctccctgccctcagaagtcccagagcatcctggggcctttaattccctcggacccccccagactcccgggttcctctgtcagccttagagccccctcagaacttctcagattcttatacagcttcagcatccctggaccacctttagacctttcaagccttttggatccagatccctccagactcccagacttttttttttggagatggagtctcgctctgtcgcccaggctggagtgcagtggcgcgatctcggctcactgcaatctctgcctcctggtttcaagtgattctcctgcctcggcctcccgagtagctagaactacaggcgggcaccaccatgcccggctaaatttttttgtatttttggtagagacagggtttcgccacgttggccaggctggcctcaaacccctggcttcaagtgatctgcccacctcagcctcccaaagtgctgggattacaggcgtaagccactgcgcccagctctcccagactttctggaatccttctcagacccccaaatcctctcgtccccctcaacgactcgactatcttcagatcttgagatccttctcagagtctctcattcaccactgacaccccattgaggctccaagcccttctcagacctccagagcccactgctctccttcagaccctctcagacctctcccaaatgcccctcgcacccaccaaccccccacccccaaccccagaaccattcccctctctcccaaatccctcagtgctacagcattcccagccccgccctgaaggatttcctccctgctcctcgcagcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcaggtgagcccctgcggcagtgcctagccctacgcgcaacacatgtggcgctcattctacgccccaccctccaaccctgagttcactgccccaacctgactggctgggctccagccttggccacgcagcagcctctgagacccgcaggcctcagactggacagcatccatggctccacctccatctgtagccacagccacccctccattcgtagccacagctaccccggagctcccaagttagtttttgtctcctgagcgtcaacgcccagtcccaccctgtccctgaactttgaccaagtccttggcttctgagacactgccttcagcttagccccaccccaggcatgcccctccctgagacacctccctggcattctatcttctgcttaaaactaaatctcacaagggagctatttcctagcctccaactctgtccctgtagacccaaccggaccctgccctcaaccctgttcctaccaccatcccaaatgtgggaaaacgctcttggccccacctgtagcctctaagacattctactctttggccaggacaccaccccatcccagcctccagctcaaacccctgacactctccagccaagccctgcccctagccaaggccagagtctgggctggccatcgttttcttcccgctctcttgtcctctctctgtctctcttacctattcccagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggtgagctggctctggcagaagtgggtgccatcttcaaggggctgccccagccccatagtgaaaggaggcaagagaggatttgggctccactcgttgataccccttctttatcaggctttctgcccacccatcgcctggagccccggcctgaaccccggcccgatccccggcccggccctgagcttcccttgcccagcatccctgcctggactggtcctgagattcctgaatcaggtttgctagaaagaactgagggcattgggcctgcagcagtggctcacgcctgtaatcccagcattttgggaggctgaggagggtggatcaccaggtcaggagttcgagaccagcctggccaacatggcgaaaccctgtctctactaaaactacaaaaattaactgggcgtggtggcagatgcctgtaatcccagctacttgggaggctgaggcaggagaatcacttgaacccaggaggcagaggttgcagtgagctgagatcgtgccattgcactccagcttgagcgacactccatctcaaaaaaaaaaaaaaaaaaagaattcagggcattgatgggggtattacaggtgggattctggggtaaaagactccaaggtgaagattccaggttacagcaaataggaatggtatgggcagagataagcgtttgaagggttgggtggtagttagatcaggagctggagtcacagttgggctcttctgtgtcaatcgagcaagccatttaacctctgagactcagttttctcattggtaaaatggggatggttgttgagatgcctctgaagtgtctgacacctagtaagtgctcagataaatacttatggtagataattatttttcattatctaatattagataattatttctcaggtagggcactaagaatgtatctcaggcggagggttggagagcaaactattcaaagccagagaccttggggtggcatgatgaggggattcggccaaggatctgatgagaacgttccaggataaaaaagatggagatcagaagaagactgggcttgcttggggaggagacatccatgaaggtgttttatggatgtctccgggggtgggggttttactgggatgaaaggaacggaggattcagagatgggggaaccctggctgactggaccccccaggtccctcctccggcatgtgtcagcgcaacccccaggtctgcggcccaggacgctgcatttcccggcccagcggctacacctgcgcttgcgactctggcttccggctcagcccccagggcacccgatgcattggtgagcaagacggagggcgcggaaggaggcggggcggggggctttgcctggtcaccttgtcaccagccccctccgtgtcctcagatgtggacgaatgtcgccgcgtgcccccgccctgtgctcccgggcgctgcgagaactcaccaggcagcttccgctgcgtgtgcggcccgggcttccgagccggcccacgggctgcggaatgcctgggtgagaaatttgccccacccggctccaggcccaccccagggtctcgctcctgctctcactccagagcctctccagccctcccacgcttcccctctcgggtcccgccccaggactgctctgccctggcccttggccctgcccttccctgacccgcctccacccagctccagcctccctttgaccccacccctacccagctcccaaactgccagtttctatcggggcctggtcgcaactcgtattgctccgcccccacgcccaggccccgcccttattggccacgcccctccctgactaactccctcccccaggccccgccactgtcctgcaactgcggcaaccaatctcctgaccgcgaccccgattccaaccctgccacaccagagccctatccccaaactgctcctttcttctctagcccctaccccaccttcccttagcttggtccccaaagctctcctttctgcccttgcgctaccaaaccctgccctccacaattgcctctctcactgtgcccctctccggctgtcctggccgggtccccatcctggctctggcccaagcttggtcccgctcccgcttccctctacccctgcctccttgcgtcgcttctcccggggctgtctgccccagtcccagccgcctggtctgtgcctacagatgtggacgagtgccaccgcgtgccgccgccgtgtgacctcgggcgctgcgagaacacgccaggcagcttcctgtgcgtgtgccccgccgggtaccaggctgcaccgcacggagccagctgccagggtgagggcctgggaggggcagctgggaaggggtgtgagcggttgggtagagcgcagtgatgagggccagagagactgaacaatagggcaaagcgagttgatttggagacagaggccaggctctcgagcagacgtgtggcctgatggcagtagagagagacctgggatgcagaggccaagtgatgggaaacagaaaggctgagtcatgaaagatggagaagcagaatgaggagggatggagatgtcagtaatcgggtaaggggagcagagttatggaggaaaggggagaaggaggccttctcatggggactacagagacagaaccagccaggcagcttagtagggattggtggaggatgcagagtcagatgatggtgacaaggaggaatagagatggggtcacggggacagaatgttggagggtggaaagccaaagtgacagaggtcagggaggcagaggggaacaagtgaccccgggccccctgccctgtgcagatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaaggtgagggtgctgagcccagccctactccatcactgtttgctgtggagactggagagagattattgaggggcagagaggcagagtgatggggctcagggatggagaacaggggctgagggatggggacctcactccagagtcttctctcctttcaacaaaataaggcagtcctccccacccctcctccctttttgaaagatactcttgtgcttatgggaaccctgaggagggggtcacctgaggcagggcaggcaacatggagttggtgccttagcccccaccttagtagctggagagaccattgaatggggacacgaggaaggtgtctgtcttcctgggaagagggagcagcctgaggcaagtccagaaggcaggctcaagactggaatgctggggtgggtggtgatggccatgggaatggattcaggccccttcctcagcctcattggtcccctctgccccagatgtggatgagtgtgcccgaagccccccaccctgcacctacggccggtgtgagaacacagaaggcagcttccagtgtgtctgccccatgggcttccaacccaacactgctggctccgagtgcgagggtgaggccggggagggagggaggagtgtggatgggtgaggggggagttggaccacttcttcaaggccaccctctcccctgccccccagatgtggatgagtgtgagaaccacctcgcatgccctgggcaggagtgtgtgaactcgcccggctccttccagtgcaggacctgtccttctggccaccacctgcaccgtggcagatgcactggtgagaccaggccctggctgtgaccttgggcctgcatcatgacccccgacccttgacccagatcacaactatgacctggccgtaacctcctgacctggacctcagtccctcagtccccagagcctgtgactcctgaccctgacctggaccacaactcttgaccctgaatgtgactcctgagacccaacttgacagtaacatttgaccctaaccatcacccttgatgatagtccctgcccataccctgatagcaattgtgaccctcatgactctggccctgaatgtgacctataactcctgaatttgactgtgacatttgaccctaatcataaccactaaccatagcactgaccataaccttgactgtgtgactcttggtcctatctctttcacagcccctgcctcttctcagaatcccttctctggaacctggttgggttcataatccctgaccctggcccctgacttgaggcagaattctggaccctgactataacttctgatcctaactggattcagattccagtcactaactctgacccatggctcagccgaatcccatccaatgatcctagtttataatacttgactggtcccttgccctagttgatttctgatccctgtctgatccctctcctgactccaaaatcctggcacaggtagttcctagaaacctagacccacaggacttgcaaccatggtccccggaacccgagaaccttggtcagccctacccacctctgccatagagccctcccccagcctccaactcatgagacttcccaccacctcccccagacaccctactccaaggggattggtcgggtgtgtcccgagactggaccctttctgaacacccccaccccccacagatgtggacgaatgcagttcgggtgcccctccctgtggtccccacggccactgcactaacaccgaaggctccttccgctgcagctgcgcgccaggctaccgggcgccgtcgggtcggcccgggccctgcgcaggtgagcagcatagggacccgccagagagtctgggagtagggcctgggttccagggcaaagccggctggaaaggtggaggcgggaccaaggcgctgtgggaggagcttagaaacctggcattggtgggggcggggttactgcgatgtgggcggagcttgtctgggaggccgggtcccgtgactccgcccaatctcccgcgtaccctagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgacgagtgcagcgaggaggacctttgccagagcggcatctgtaccaacaccgacggctccttcgagtgcatctgtcctccgggacaccgcgctggcccggacctcgcctcctgcctcggtgagaggccccgccccggcctgatccctcctcccttcgactccccgactcgccgattggcctcccacctctgtctttcctcctccgcttctcccctccccttacctctttcccccgcctcctctcctagcctccccaactctcctctaccccaatcttctcctgccctctcctctgcttccccggcctcccccttctgactctcctctcccctctttgtatcccccatcttgcctccctgcttcccacatccgaccacccgacctctctcctcagacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacggtgagcctgcccccacccgccttcgctagcgcttgcaacgcggtgctggaggctgctcccttggggactgaggaggggcgccctgcttcccagacttaggcggagggaaagaacaccctctcaccgtatctctgtagtggaaataagccgccaccgtgtccatgtattttcttgtgtcaggatcacggccaagcctcccttccagccgcagtccattccccctctgcagctgaagcccggtccacattttaggctatgcccccagtaagacaccgccccaaaactgttaggccccgccccttccaatcggcctctggattaaaaccccctcttcaggccccttctcttcctaacagaagtttggacgtgccctttccgcgccctccaccagtcctacttccagccttccctccaaagaggcccaatcccggtggccctaggccccattctttcccaatgagaaattcccaaggtgaaattctcctagcattggcccccgcccgtttaagctctgcccttccttggtctctctagacagggctttccattcgctcggatggctccagtctctcgaacacttaggccctcccttcctatctttgctccgcccacagacccgccccttgccttttcttactttccaggccttccctcccgccccgctctttcacccctcccgggtcaggctccagcgaggcaggagggtggggctaatcttccatacagtatatatttttttgtgtcggcgggggggggggggcggtgatggtgtgtgagtccgcatcttgtggaacacatgaaacaaaacatctgtgggctgccgttgactctgctagacctctgactcatggaaatctagcttcataagatctcattcattaattccacaagaattcactaagcacctactctatgccagcgtctggaaaaggtaataagagcaacaggaaataagtcatataaaaacccctgccttcctggagttattgtggggtaataaatatgtaaataaattcaagatttatacagcaggccaggagctgtggctcatgcctgtaatcccagcactttgggaggccaaggcggatggatcacgaggtcaggagatcgagactagcctggccaacatggtgaaaccccgtctctactaaaaatacaaaaattagctgggcatggtggcatgcgcctgtagtcccagctactcaggagactgaggcaggatactcgcttgaacccgggaggcggaggtggcagttgagccgagatcgcgccactgcactgcagcctcggcgacagagtgagattgtctcaaaaaaaaaatttatacaacaaaaaactggggggcaccttactatatgttgggcactggagatgtagcaaggaacaaaatagacacaaatccctgctattgtagagtttgtattctagagaggcgacagttggcataccaataaatacatacgtataacatcaggtttaggaaggaaaacaaagcaagacaaatgggacagagatgacagagcagtggatggaggagtgctaggagggcttgacctagacaccagacagaagcgagggaggcagccatgcagagagctgaggggagactgttcctggcagagggaagagccagtgcaaaggctctgaggcaggaccatgcttttgagaaatggcagtgaggacttgagagttatcaactatgctaggtgtggtggcacaagcttgtaatcccagctactcaggaggctaaggtgggagaactgcctgaacccgggaggttgaagctccagtgagccatgatcctgtcactacactccagcctgagcaacagagcaagaccccatttaaaaaaaagaaaaaaaagctggatggggtggctcatgcctataatcccagcactttggaaggctgaggcagctagattgcctgaggtcagaagttcatcaccagcctggccaatatgatgaaaccccatctctactaaagaaaaaaaaaaaagatagtggctgggcgtggtggctcacacctgtaatcctaggacttgaggaggccgaggtggacagatcgcttgaggtcaggagttcgagaccattctggtcaacatggtgaaatctcatctctactaaaaatacaaaaattagctaggcatgatggtgcatgcctgtagtcccagctgctctagaagctgaggtagaattgcttgaacctaggaggcaaaagttgcagtgagctgagattgagccactgcactccagcctgagtgaaagagcgagactccgtctcaaagaaaaaacaaagttttcaacattgttgatcttcagaagctcaggctcctagaataccagattgctaaagacttcttagtcttgggcaccggaagtggtgttagaacttctgaattcaggcctttgactcccctttcatctcctccacactctgcagatgtggatgagtgccaagaatatggtcccgagatttgtggagcccagcgttgtgagaacacccctggctcctaccgctgcacaccagcctgtgaccctggctatcagcccacgccagggggcggatgccagggtgggtgtccatcaggcatcgggtgagatgtggagatggtagaaggtccagaaatggcctgactgtctggtggttgcagatgtggacgaatgccggaaccggtccttctgcggtgcccacgccgtgtgccagaacctgcccggctccttccagtgcctctgtgaccaggttacgagggggcacgggatgggcgtcactgcgtgggtacgggacttcaggaggtggatgggaccaaagggggtgggggaggttggtcaggccctgtccctccccatatatctgaacaaatgggaattttcgggttgtggaatttagactttggaatataagatcatcttcatgccaggcacggtggctcacgcctgtaatcccagtactttgggaggccgaggcgggcagatcacttgaagtcaggagtttgaaaccagcctggtcaacatggtgaaaccccgtctctactaaaaatacaaaaattagccggatctggtggcaaatgcctgtaatcccagctactcaggaagctgaggcacaagaattgcctgaacccaagaggtggaggttgcagtgagccaagattgtgcaattgcactccagcctgggtgacagagtgagaccctgtctcaaaaaaaaaaaaaaaaaaaaaaaaatcagaactgttgtagtggctggtgacagaaacctgacttaatcaggttttatttttgtgtgtgttcttttaaaaatgtataaagtataaatgtataaagtactaatcttaagtgttcataaacattaatctttcctaacattttatgaggaaaatttctaaacacaaagcaaattgagagaatcatagaatgaacacctacctactcatgatctagattatattatcattttattacacttgcttcctcacatatctatccattaatccatctaattttttggacagagttaaaagtaaattgcaggcaccagtctgcttccccataaattcttcaatatgcatatcactaaccagaattcaatatgtgtttaccaatgtattcttctcttctctcttttttttttttactttgaggtggggtcttgctctgttgcccaggctggagtgtggttgtttgatcatagcttactgcagcctctaactcctgggctcaagccatcctccctccagaactgagcttccgagtagctgctaccacaggcacacgcaaccacgcccagctaatgtttttaatttttgtagagatgagttttttttttttttttggagacagagttttgctctagttgtccaggctggagtgcaatggcatgatcttggctcactgcaacctccacctcccgggttcaagcaattctcctgcctcagcctcccaagtagctgagattacaggtgcccaccactatgcccagctaattttttgtactttgagtagagatggagttttgccatgttggccaggctggtcttgaactcctgaccttaggtgatccgcccaccgtggcctcctaaagtgctgggattataagcatgagccaccacgcctggcctgtagagatgagttattgctctgttgcccagactggtctcaaactcctggctttaagcaaccctccctccttggcctcccaaagcactgggattacaggcatgagccattgtaccctacagatattttcattcaacgttcaatttatatacagtgaaatgcagcaatcttaattatacattctgtaaattttcacaaatgcaaacacaacaggttttatttctttaaagggaattaaaactataaagtcttgggatatatttgaactccaggcataactggatccaggaattttaacaaggctatttctatcttctctgagttctgctttcttctattgcatgattttcaggcagattatttttcacaatgatgaaggtggccctagaacctctgggctaacatctccagtgggccacccgagagctaaaaagggaggtttttttttcaatatttctagcaaaagcgccaggcctggctttgattgacccagcatgatcactgcctatgtctgaaccagagaaatgccgtcatctgtttggtcattcctggaacttgtgcccacctctcagagtagatatagccctactcaaagaacaggattgaaaatagaggagcacagggttcccaagggaaattcaaggtttctcactagaagaaaaacagatgatgggatctgggccattaaatatacacattatatttgaaagctgagactttcggacctttggaatcatagaagcttataaccactgagtccctctcccctgttgtctcctgcttacagatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggtgagactgatgtgtctatttaactgatggcggctggccccatgggaaaatcacgtggtctaatcattcctgatgtggacagctaccatcagctaaatactgttgttttaaacatcaacaaaagacacataagttaacatgggtagtgagactgtgtcaggagaattagaccctggtcctgactctaccagattctttcattcaacaaatgttcacagggtgtgcactgtgttcaggccatcttctgggcactgagaacatagtagtgaccagaagggatcactgtctgtcctcaaggggctcacaagccaatggggcagacagagatatcaccagatagtgacaacccagagaaatcaacaagactgtgacggggaaagcccaggggggttttggaggaggcgcctggcccagcatgagaagaggattagggagttcttcctgtaggagacgacatctgaactgagagctgtgggatgaatagaaatgagccaggcccgatgagtgaggagggcattctgggcagaggacacagcaagggcaaaggcctggcaaagccagagagcatctggcatgtgagaagaactgaaacaggttcaacatggcatgatttagagagcaaaggaaggggtagggagagatggggccagggaaagagtcaggtgcccgatcacactgacttatcacagtaagagagcactgcggtaccgtggaaggggtttcggcgttttttttttgaaaattttttttaaatgttttttttttaagacagggtcgtactttcacccaggccggagtgcagtggcgtgatctcagctcactgcaacctccacctcctgtgctcaaggaatcctccaacctcagcctgctgagtaactgggactacaggcacatatcaccacaacagctaatttttgtattttttgtagagatgtggttttgtcatgttgcccaggctgcagtatttttttttttttaatttttaaatgttacatatttaggctaggattggtggctgaaggccataatcccagctctctgggaggccaaggcgggaggatcacctgaggtcaggagttcgagaccagcatggccaacatggcaaaaccctgtctctactaaaaatacaaaaattagctgggtgtagtggtgcacgcctgtaatcccagctattcgaaaggctgaggcaggaaaatcgcttgaatccaggaggcggaggttgtgggattgcaccactgcactccagcctgggtgagagaggaagactccgtcccaaaaaaaaaaaaaaaaaaaaagctatgtatttatttatttttaataatttccatctttactttagattcaggggatacatgtgcaggctttttacctgggtatatttcgtgatgctgagctttgggatacaaatgatcccgtcacccagatagtaagcacagtacccaacagccagtttttttttttctttgagacggagttttgctcttgttgcccaggctagagtgcagtggcgtgatctcagctcactgtaacctccacctccctggttcaagtgattctcctgcctcagcctcctgagtagctgggattacaggtgtccgccaccacgcccagctaattttttgtatttttagtacagacggggtttcatcatattggtcaggctggtctcgaactcctgacctcaggtcatccacctgcctcggcttcccaaagtgcagggattacaggcgtgagccaccatgctcggcccaacagccagtttttcaacccttgtacctctgtccctcccccatctagtggtccccagcaactattgtgggcatctttacatccatgagtacccactgtttagctctcacttgtaagtgagaacatgtggtatttggtcttctgtttctgcattaatttgcttaggataatggcctccagctgcatccatgttgctgctaaggacatgatttcattctttttcatggctgtgtagtattcatggaagggttctaagcaggaaagatagaatcagattttgaaacctccctctggccgccatgtgaaggtgattgaagcgggtgatatggaggctgggagctcagggaacaggctggggcaggggcctggacaggagagaacagggctggaccaaggcaggggctgtggaaggggaggagaaggtggtgggagaaaaacccaagaggccatgtggacaagctgtggatgtctgggtggggaagctgtgtccaagacaaggcataggttttttgtttgtttgttttgtgacagagtctcgctctgtcgcccaggctagaatgcagtggtgtgatctcggctcactgcaacttccgctcccgggttcaagcgattctcctgcctcagcctcccaagtagctgggattacaggcatgcgccaccacacccggctaattttttctatttttagtagagaccgggtttcaccatgttggtcaggctggtctcgaactcctgacctcaagtaatccaaccgcgtcggcctcctgaagtgctgggaggacaggcaggagccactgcacctggcgacaaattgtaggttttgagatgaagactcagccagtttgccacacactggataagagacccagagaggcatccaggaagccagggaagttccctcaccacccacccaagctgttagctgcagtgacgggaaagtgtgaggtggggaggcaagagatgcagaaatgacaggaggtgacagtgggagaaagagaaacagtgacagaggagcgtgagaggtgtggagtctggttctgccactgatggctgccaccctctgtttccctatctatgccagcctcagtttccccatctatgatagtggcggggctggggattcagcccacactgggctaaagctccttgtctccccaggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacaggtgggcatgggctgatggggacacagggctgagggcttgggtggaaatactgggtggggtgtgggcctgggacaggggacacttttggacagggccttgaggtactagtactgtcagggcaagggcgagctgccaggcaggtgggcatgggcagacataaggctgagaggtgggcactaacaggcacagggccagagggacttttgtgacaagtgggcacgagcaggtcagggctggggctggggctctggtgtcctggctcaggcttgtctctgtgtgtagctgagtaccagtcattgtgccctcacggccggggctacctggcgcccagtggagacctgagcctccggagaggtgaggccagcctttgaccctccaccccactcagctctgaggcccagcttcgtctcttcctgttttctttgcctctgtctctcaccctttctgtttctctgtatctgtctccccgaccccacccatactctgtctctttctttcttttctttcttttttttttttttcttaagatagagttttgttcttgtcgcccaggctggagagcaatggcgagatcttggctcactgcaacctttgtctcctgggttcaagcgattctcttgcctcagcctctggcgtagctggctacagacactagccactacgcctggctaatttttttgtatttttagtagagacagggtttcaccatgttggccagattggtctcgaactcctgacctcaagtgatccgcccaccttagcctcctgaagtgctgggatttcaggcatgagccaccgctcctggcctctccatctttctttccctgtctctacttcttggtctatcaccagctctgtctctgtcttcccacgtcatgccctcacacactccacccatccagcccgcccccatctctctctctgcttttcgcacagacgtggacgaatgtcagctcttccgagaccaggtgtgcaagagtggcgtgtgtgtgaacacggccccgggctactcatgctattgcagcaacggctactactaccacacacagcggctggagtgcatcggtacaagccccacctcccccaacccccggcaactctctccaacccctagccttgccagctcccctctggaatgtggccaccaccagcgggaagtctttcctggagtctagactccatccatcacactgccaatgtgctgggaagagaaatgggaaagggtggggagagttgaaggggatgcctcttaatcatcctctccctagacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcggtaaccccgcccacgccatccaggccctccttcccttggctcggcctcacacccgcacccgggccacacctttgcgacggccacgccctccgaaggccacgccccatgctcctggctcgaccacgccccactgagccctcactcagtctctgtcccactgtctgtctctctgaggcgagctggctaggtggttaaaggcaaaagttttagggcaacctttgcatgttgcctcttggactccaggtttctttctgcacactgggtgaatagcccctaccttatagggtggctgtgaggaattttatttaattttatttatttattttttgagacggagtttcgctcttgttgcccaggctagagcgcagtggcgccatctcagctcactgcaacctccacctccggggttcaaacgattctcctgcctcaggctcccgagtagctgggattacaggcatgtgctaccacgcccagctaattttgtatttttttctttagtagagacagggtttctccatgttggtcaggctggtctcgaactcccgacctcaggtgatccgcctgccttggcctcccaaagtgctaggattacaggtgtgagccaccacacctggctgatgaattttattttattttattttatttttaatttttaatttttagttttattatttattttttactaagtaccacatgagtgctgcctgttattatttatctgcatctctaggtctctgtctctttccagctgtttgtggatttctgtctttggggttttctctgaatttctgacaccctctggatctttgttttcaggtccctttctcctgcctctgtatctttgttttcctgttttgagtctttgactctttggatgtgtttctctctctctctttgggtcttttttctcccttttcgtttctgactattttcctatctctaggcccctaacaacttctgctgaagctctgtctcttgaacactctacttgtcgttgtttgttttcatttttgagacaagatctcgctctgtcatccaagctgaagtacagtggcacaatcacagctcactgcagcttccacctctcatgcccaaatgatcctcccacctcagacttgcagtagctgggagtccaggagcccgccaccaagcctggctaatttttgtatttatatatatatatatatatatatatatatatatatatatatatatatatatatatatatatatatttttttttttaaagatgggtttttgccatgttgcccaggctggtcttgaactcatgggctcaagcaacccccccacctcagcctcccaaagtgctgggattacaggctccaacacactctctctgtgcttcttgccacctctctttttgcccactgtcccaaccactcttctctcatttcctgtgccttcagcacttacccccatacagtgagatgtcagacaatgctcagagaagcaaagcaactgccccgaggccacacagccctccagaggccagacttgggtagacccctctcaggccctacctcccagtcattggacaccttcttctgccctctcctcctatatgacagtctccttgttcctcaatccagaaccctggagtgacctcagagaacttccagagttagatcacagctgatgagaaggatttgctgataggcagagggtgcctgggctgctcagcaggggaagggtccagcccctgggaggacctgagtgccaggcccactctgacacatgctgtctccacctacagatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcaggtgctggcactggcctaggctgaactcagaggccttgccccatgggctccaaatctaggccctcagatccccagtcgcagaacccccagactctatccaaactctgtcccctagaccaacccctatgtcgcagcccatcccaaaatcttggtccccgattcacactccaaagacttccaagtctcagccacagacatcccaaggcctgacccagcagatcccatagtaccagacccacaggcccctgaggtctggtctctcatatgctcagctcctggtctctagaaccaccagacacagcctatgagatgtcctcccctaaatcctgggcccttagacctgaaatgccagttgctcagacctcaccatcctggccccagaccccctggtcacagccccacagacctccaagtcccattgccttagacaccctccaagtcccattgccttacacaccacatccgggtgcctaagaccccaacacacagccccagagattcccaagtcttggtttctacaacctctgagtccctcagtcctcagcccttaggaacccagttccaaagccccagtcctgggtcctcagacctccaggtcccagtgcctcagactgtctcccatgcatcctgccccctcaggtccccagcagcaatccctgggattccccagtcctggtccacagaacacccccatctaatttcttcaggtccctagtcctagctcccatgggtcgctccaattccagcctctcagaccctgattcttagcaggcttcattacccttgatctcagcacgtccgaatcccagtctcagccttcagattctcagcgctggctccagaaaccccggggccacccaggaccctccccatccagtcctctgcctcctctcccaaggggggtatgtgagtggtgggtgtgggggccagcaggggctgattgtttgccttggctcctgttcccagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggtgagcactgccagcgcatgatgagactgagatgaggggtgaggtgtgcacggagagaggagggagggaaacagaaggcgggaggagagacggaacacaggtgcaactggagagagccacagaaagggacagagaagtgtctatagcccggcaaagaaagagaaggtggcagagggaaagctggcgagagaatgaggtaagcttactggccccgcagcacccgccacagccctggagcgggatggacagtttacagcgagaaagatggagccaaggacgcgcacccaccgttgtgggtaaggggtgaaggcagggacctcaagtcatagggtccccgcatttcccacaggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttggtgagggcgggcccggggccagcatgcgcagggagaggcgaggcttgtccagggagggtggaagccctgactagggggtgctggtcagggacgggaaaggacctcactacaggggacgggccagcgcaaaagggaggagtaattcttccacctgggtggggcttgactgaagaaggcggagtcagggtgccagcagggcagggcttaaccacggggctggagccgggccttgaagcaggatagaggaatagaatagtgctggtgtgacttgcagtgctaccttgggcagtctgcaggacctctttggagagcctcagtcttcccacctgtaaaatgggaatattaatcaagtctgcctaatttggatggcagtaaagccaagtgattaaaatcaagaacatagccgggcgcagtggctcacgcctgtaatcccagcactttgggaggccgaggcgggcggatcattaggtcaggagtttgagaccagcctggccaatatggtgaaaccccgtctctaaaaatacaaaattagccgggtgtggtggtgcatgcgtgtaatcccagctactcgggaggaacccaggaggcagaggttgtggtgagccaagatcgcgccattgcactccagcctgggcaataagagcaaaactccgtctcaaaaaacaaacaaaactcgaggaggtcacatagacctcagactcagtccagcaacttgctgtgtgacgctggacaggtcactgtcccttacctaatttttctgatatgaaaaatggctacagtcaaagatcccatttcatagaattgcgaatattattaacactgatttacaataacattgagagtcatgtgcaaatggaggcacatgcgtaaaacgaattacagtacctacctaataggggtattagaaggacaaagttaatacttgtaatgtgcttaaaacaatgcatgaacatttattgttgttgacaccatcatcagtatttttttcttcttttttttttcttttcttggcgacagagactcactctgtcgcccaggctggagtgcagtggcctgatctcggctcacagcaacctcctcctcccaggttcaagcgattctcctgcctcagcctctcgagtagctgggattacaggcgcccgccaccatgcctggctaatttttgtattcttagtagagacggggtctcaccatgttggccaggttcgtctcgaactccggcctcaagtgatccacccgcctcagcctcccaaagtgctgagattacaggcatgagccaccgcgcccggccattattattttcttaacaaaatcctagtgcggtatgggccaccatatccatcttacagaacacgaaactgaagcacagtgaggttaagccacctggccgggctcacacagttagcagatggcagaggccagattggactccaaactgctcagcatctgtgctcctctgttccaagaacttaaggggccaaggaggcgagcttctggggccccagccttcagcagcgatcgttgtctcccctccgcagacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatc
